(12) United States Patent
Bentwich

(10) Patent No.: US 7,250,496 B2
(45) Date of Patent: Jul. 31, 2007

(54) BIOINFORMATICALLY DETECTABLE GROUP OF NOVEL REGULATORY GENES AND USES THEREOF

(75) Inventor: Isaac Bentwich, Kvuzat Shiler (IL)

(73) Assignee: Rosetta Genomics Ltd., Rehovot (IL)

( * ) Notice: Subject to any disclaimer, the term of this patent is extended or adjusted under 35 U.S.C. 154(b) by 714 days.

(21) Appl. No.: 10/310,914

(22) Filed: Dec. 6, 2002

(65) Prior Publication Data

US 2006/0003322 A1    Jan. 5, 2006

Related U.S. Application Data

(63) Continuation-in-part of application No. 10/293,338, filed on Nov. 14, 2002, now abandoned.

(51) Int. Cl.
  C07H 21/02  (2006.01)
  C07H 21/04  (2006.01)
  C12N 15/00  (2006.01)
  C12N 15/09  (2006.01)
  C12N 15/63  (2006.01)
  C12N 15/70  (2006.01)
  C12N 15/74  (2006.01)

(52) U.S. Cl. .................. 536/23.1; 435/320.1
(58) Field of Classification Search ............... 536/23.1; 435/320.1
See application file for complete search history.

(56) References Cited

U.S. PATENT DOCUMENTS

| | | | |
|---|---|---|---|
| 6,203,992 B1 * | 3/2001 | Granados et al. | 435/6 |
| 6,207,380 B1 * | 3/2001 | Billing-Medel et al. | 435/6 |
| 6,361,940 B1 * | 3/2002 | Van Ness et al. | 435/6 |
| 6,566,072 B1 * | 5/2003 | Watson et al. | 435/7.1 |
| 7,049,425 B2 * | 5/2006 | Wheeler et al. | 536/23.5 |
| 2002/0086356 A1 | 7/2002 | Tuschl et al. | |

FOREIGN PATENT DOCUMENTS

| | | |
|---|---|---|
| WO | WO 2001/068836 | 9/2001 |
| WO | WO 2002/044321 | 6/2002 |
| WO | WO 2002/094185 | 11/2002 |

OTHER PUBLICATIONS

Gallinaro, H., L. Domenjoud and M. Jacob. Structural study of the 5' end of a synthetic premessenger RNA from adenovirus. Evidence for a long-range exon-intron interaction J Mol Biol Jul. 15, 1994 205-225 240.
Lu, C. and R. Bablanian. Characterization of small nontranslated polyadenylylated RNAs in vaccinia virus-infected cells Proc Natl Acad Sci U S A Mar. 5, 1996 2037-2042 93.
Crawford, E. D., E. P. Deantoni, R. Etzioni, V. C. Schaefer, R. M. Olson and C. A. Ross. Serum prostate-specific antigen and digital rectal examination for early detection of prostate cancer in a national community-based program. The Prostate Cancer Education Council Urology Jun. 1996 863-869 47.
Engdahl HM, Hjalt TA, Wagner EG. A two unit antisense RNA cassette test system for silencing of target genes. Nucleic Acids Res. Aug. 15, 1997 3218-27 25.
Dsouza, M., N. Larsen and R. Overbeek. Searching for patterns in genomic data Trends Genet Dec. 1997, 497-498 13.
Moss, E. G., R. C. Lee and V. Ambros. The cold shock domain protein LIN-28 controls developmental timing in *C. elegans* and is regulated by the lin-4 RNA Cell 1997 637 88.
Fire, A., S. Xu, M. K. Montgomery, S. A. Kostas, S. E. Driver and C. C. Mello. Potent and specific genetic interference by double-stranded RNA in *Caenorhabditis elegans* Nature Feb. 19, 1998 806-811 391.
Waterhouse, P. M., M. W. Graham and M. B. Wang. Virus resistance and gene silencing in plants can be induced by simultaneous expression of sense and antisense RNA Proc Natl Acad Sci U S A Nov. 10 1998 13959-13964 95.
Ngo, H., C. Tschudi, K. Gull and E. Ullu. Double-stranded RNA induces mRNA degradation in *Trypanosoma brucei* Proc Natl Acad Sci U S A Dec. 8, 1998 14687-14692 95.
Verma, S. and F. Eckstein. Modified oligonucleotides: synthesis and strategy for users Annu Rev Biochem *No date in Pubmed* 1998 99-134 67.
Wuchty, S., W. Fontana, I. L. Hofacker and P. Schuster. Complete suboptimal folding of RNA and the stability of secondary structures Biopolymers Feb. 1999 145-165 49.
Mathews, D. H., J. Sabina, M. Zuker and D. H. Turner. Expanded sequence dependence of thermodynamic parameters improves prediction of RNA secondary structure J Mol Biol May 21, 1999 911-940 288.
Chang, P. L. Encapsulation for somatic gene therapy Ann N Y Acad Sci Jun. 18, 1999 146-158 875.
Zhang, M. Q. Large-scale gene expression data analysis: a new challenge to computational biologists Genome Res Aug. 1999 681-688 9.
Grisaru, D., M. Sternfeld, A. Eldor, D. Glick and H. Soreq. Structural roles of acetylcholinesterase variants in biology and pathology Eur J Biochem Sep. 1999 672-686 264.
Fire, A. RNA-triggered gene silencing Trends Genet Sep. 1999 358-363 15.
Tabara, H., M. Sarkissian, W. G. Kelly, J. Fleenor, A. Grishok, L. Timmons, A. Fire and C. C. Mello. The rde-1 gene, RNA interference, and transposon silencing in *C. elegans* Cell Oct. 15, 1999 123-132 99.

(Continued)

Primary Examiner—Brian Whiteman
(74) Attorney, Agent, or Firm—Polsinelli Shalton Welte Suelthaus PC; Teddy C. Scott, Jr.

(57) ABSTRACT

The present invention relates to a first group of novel genes, here identified as "genomic address messenger" or "GAM" genes, and a second group of novel operon-like genes, here identified as "genomic record" or "GR" genes. GAM genes selectively inhibit translation of known 'target' genes, many of which are known to be involved in various diseases. Nucleic acid molecules are provided respectively encoding 20600 GAM genes, and 6635 GR genes, as are vectors and probes both comprising the nucleic acid molecules, and methods and systems for detecting GAM and GR genes and specific functions and utilities thereof, for detecting expression of GAM and GR genes, and for selectively enhancing and selectively inhibiting translation of the respective target genes thereof.

4 Claims, 148 Drawing Sheets

OTHER PUBLICATIONS

Ryo, A., Y. Suzuki, K. Ichiyama, T. Wakatsuki, N. Kondoh, A. Hada, M. Yamamoto and N. Yamamoto. Serial analysis of gene expression in HIV-1-infected T cell lines FEBS Lett Nov. 26, 1999 182-186 462.

Olsen, P. H. and V. Ambros. The lin-4 regulatory RNA controls developmental timing in Caenorhabditis elegans by blocking LIN-14 protein synthesis after the initiation of translation Dev Biol Dec. 15, 1999 671-680 216.

Tuschl, T., P. D. Zamore, R. Lehmann, D. P. Bartel and P. A. Sharp. Targeted mRNA degradation by double-stranded RNA in vitro Genes Dev Dec. 15, 1999 3191-3197 13.

Reinhart, B. J., F. J. Slack, M. Basson, A. E. Pasquinelli, J. C. Bettinger, A. E. Rougvie, H. R. Horvitz and G. Ruvkun. The 21-nucleotide let-7 RNA regulates developmental timing in Caenorhabditis elegans Nature Feb. 24, 2000 901-906 403.

Pitt, J. N., J. A. Schisa and J. R. Priess. P granules in the germ cells of Caenorhabditis elegans adults are associated with clusters of nuclear pores and contain RNA Dev Biol Mar. 15, 2000 315-333 219.

Hammond, S. M., E. Bernstein, D. Beach and G. J. Hannon. An RNA-directed nuclease mediates post-transcriptional gene silencing in Drosophila cells Nature Mar. 16, 2000 293-296 404.

Slack, F. J., M. Basson, Z. Liu, V. Ambros, H. R. Horvitz and G. Ruvkun. The lin-41 RBCC gene acts in the C. elegans heterochronic pathway between the let-7 regulatory RNA and the LIN-29 transcription factor Mol Cell Apr. 2000 659-669 5.

Fortier, E. and J. M. Belote. Temperature-dependent gene silencing by an expressed inverted repeat in Drosophila Genesis Apr. 2000 240-244 26.

Mourrain, P., C. Beclin, T. Elmayan, F. Feuerbach, C. Godon, J. B. Morel, D. Jouette, A. M. Lacombe, S. Nikic, N. Picault, K. Remoue, M. Sanial, T. A. Vo and H. Vaucheret. Arabidopsis SGS2 and SGS3 genes are required for posttranscriptional gene silencing and natural virus resistance Cell May 26, 2000 533-542 101.

Sijen, T. and J. M. Kooter. Post-transcriptional gene-silencing: RNAs on the attack or on the defense? Bioessays Jun. 2000 520-531 22.

Brenner, S., M. Johnson, J. Bridgham, G. Golda, D. H. Lloyd, D. Johnson, S. Luo, S. McCurdy, M. Foy, M. Ewan, R. Roth, D. George, S. Eletr, G. Albrecht, E. Vermaas, S. R. Williams, K. Moon, T. Burcham, M. Pallas, R. B. Durbridge, J. Kirchner, K. Fearon, J. Mao and K. Corcoran. Gene expression analysis by massively parallel signature sequencing (MPSS) on microbead arrays Nat Biotechnol Jun. 2000 630-634 18.

Ryo, A., Y. Suzuki, M. Arai, N. Kondoh, T. Wakatsuki, A. Hada, M. Shuda, K. Tanaka, C. Sato, M. Yamamoto and N. Yamamoto. Identification and characterization of differentially expressed mRNAs in HIV type 1-infected human T cells AIDS Res Hum Retroviruses Jul. 1, 2000 995-1005 16.

Nilsson, M., G. Barbany, D. O. Antson, K. Gertow and U. Landegren. Enhanced detection and distinction of RNA by enzymatic probe ligation Nat Biotechnol Jul. 2000 791-793 18.

Kent, W. J. and A. M. Zahler. Conservation, regulation, synteny, and intons in a large-scale C. briggsae-C. elegans genomic alignment Genome Res Aug. 2000 1115-1125 10.

Kennerdell, J. R. and R. W. Carthew. Heritable gene silencing in Drosophila using double-stranded RNA Nat Biotechnol Aug. 2000 896-898 18.

Voinnet, O., C. Lederer and D. C. Baulcombe. A viral moment protein prevents spread of the gene silencing signal in Nicotiana benthamiana Cell Sep. 29, 2000 157-167 103.

Mette MF, Aufsatz W, van der Winden J, Matzke MA, Matzke AJ. Transcriptional silencing and promoter methylation triggered by double-stranded RNA. EMBO J. Oct. 2, 2000 5194-201 19.

Yang, D., H. Lu and J. W. Erickson. Evidence that processed small dsRNAs may mediate sequence-specific mRNA degradation during RNAi in Drosophila embryos Curr Biol Oct. 5, 2000 1191-1200 10.

Anandalakshmi, R., R. Marathe, X. Ge, J. M. Herr, Jr., C. Mau, A. Mallory, G. Pruss, L. Bowman and V. B. Vance. A calmodulin-related protein that suppresses posttranscriptional gene silencing in plants Science Oct. 6, 2000 142-144 290.

Fagard, M., S. Boutet, J. B. Morel, C. Bellini and H. Vaucheret. AGO1, QDE-2, and RDE-1 are related proteins required for post-transcriptional gene silencing in plants, quelling in fungi, and RNA interference in animals Proc Natl Acad Sci U S A Oct. 10, 2000 11650-11654 97.

Llave, C., K. D. Kasschau and J. C. Carrington. Virus-encoded suppressor of posttranscriptional gene silencing targets a maintenance step in the silencing pathway Proc Natl Acad Sci U S A Nov. 21, 2000 13401-13406 9.

Cogoni, C. and G. Macino. Post-transcriptional gene silencing across kingdoms Curr Opin Genet Dev Dec. 2000 638-643 10.

Elbashir, S. M., W. Lendeckel and T. Tuschl. RNA interference is mediated by 21- and 22- nucleotide RNAs Genes Dev Jan. 15, 2001 188-200 15.

Bernstein, E., A. A. Caudy, S. M. Hammond and G. J. Hannon. Role for a bidentate ribonuclease in the initiation step of RNA interference Nature Jan. 18, 2001 363-366 409.

Vaucheret, H. and M. Fagard. Transcriptional gene silencing in plants: targets, inducers and regulators Trends Genet Jan. 2001 29-35 17.

Thomas, C. L., L. Jones, D. C. Baulcombe and A. J. Maule. Size constraints for targeting post-transcriptional gene silencing and for RNA-directed methylation in Nicotiana benthamiana using a potato virus X vector Plant J Feb. 2001 417-425 25.

Galyam, N., D. Grisaru, M. Grifman, N. Melamed-Book, F. Eckstein, S. Seidman, A. Eldor and H. Soreq. Complex host cell responses to antisense suppression of ACHE gene expression Antisense Nucleic Acid Drug Dev Feb. 2001 51-57 11.

Sharp, P. A. RNA interference—2001 Genes Dev Mar. 1, 2001 485-490 15.

Mallory, A. C., L. Ely, T. H. Smith, R. Marathe, R. Anandalakshmi, M. Fagard, H. Vaucheret, G. Pruss, L. Bowman and V. B. Vance. HC-Pro suppression of transgene silencing eliminates the small RNAs but not transgene methylation or the mobile signal Plant Cell Mar. 2001 571-583 13.

Matzke, M. A., A. J. Matzke, G. J. Pruss and V. B. Vance. RNA-based silencing strategies in plants Curr Opin Genet Dev Apr. 2001 221-227 11.

Schisa, J. A., J. N. Pitt and J. R. Priess. Analysis of RNA associated with P granules in germ cells of C. elegans adults Development Apr. 2001 1287-1298 128.

Di Serio, F., H. Schob, A. Iglesias, C. Tarina, E. Bouldoires and F. Meins, Jr. Sense- and antisense-mediated gene silencing in tobacco is inhibited by the same viral suppressors and is associated with accumulation of small RNAs Proc Natl Acad Sci U S A May 22, 2001 6506-6510 98.

Piccin, A., A. Salameh, C. Benna, F. Sandrelli, G. Mazzotta, M. Zordan, E. Rosato, C. P. Kyriacou and R. Costa. Efficient and heritable functional knock-out of an adult phenotype in Drosophila using a GAL4-driven hairpin RNA incorporating a heterologous spacer Nucleic Acids Res Jun. 15, 2001 E55-55 29.

Vance, V. and H. Vaucheret. RNA silencing in plants—defense and couterdefense Science Jun. 22, 2001 2277-2280 292.

Argaman, L., R. Hershberg, J. Vogel, G. Bejerano, E. G. Wagner, H. Margalit and S. Altuvia. Novel small RNA-encoding genes in the intergenic regions of Escherichia coli Curr Biol Jun. 26, 2001 941-950 11.

Grishok, A., A. E. Pasquinelli, D. Conte, N. Li, S. Parrish, I. Ha, D. L. Baillie, A. Fire, G. Ruvkun and C. C. Mello. Genes and mechanisms related to RNA interference regulate expression of the small temporal RNAs that control C. elegans developmental timing Cell Jul. 13, 2001 23-34 106.

Hutvagner, G., J. McLachlan, A. E. Pasquinelli, E. Balint, T. Tuschl and P. D. Zamore. A cellular function for the RNA-interference enzyme Dicer in the maturation of the let-7 small temporal RNA Science Aug. 3, 2001 834-838 293.

Hammond, S. M., S. Boettcher, A. A. Caudy, R. Kobayashi and G. J. Hannon. Argonaute2, a link between genetic and biochemical analyses of RNAi Science Aug. 10, 2001 1146-1150 293.

Vaucheret, H., C. Beclin and M. Fagard. Post-transcriptional gene silencing in plants J Cell Sci Sep. 2001 3083-3091 114.

Wesley, S. V., C. A. Helliwell, N. A. Smith, M. B. Wang, D. T. Rouse, Q. Liu, P. S. Gooding, S. P. Singh, D. Abbott, P. A.

Stoutjesdijk, S. P. Robinson, A. P. Gleave, A. G. Green and P. M. Waterhouse. Construct design for efficient, effective and high-throughput gene silencing in plants Plant J Sep. 2001 581-590 27.

Mattick, J. S. and M. J. Gagen. The evolution of controlled multitasked gene networks: the role of introns and other noncoding RNAs in the development of complex organisms Mol Biol Evol Sep. 2001 1611-1630 18.

Carter, R. J., I. Dubchak and S. R. Holbrook. A computational approach to identify genes for functional RNAs in genomic sequences Nucleic Acids Res Oct. 1, 2001 3928-3938 29.

Ketting, R. F., S. E. Fischer, E. Bernstein, T. Sijen, G. J. Hannon and R. H. Plasterk. Dicer functions in RNA interference and in synthesis of small RNA involved in developmental timing in *C. elegans* Genes Dev Oct. 15, 2001 2654-2659 15.

Ruvkun, G. Molecular biology. Glimpses of a tiny RNA world Science Oct. 26, 2001 797-799 294.

Lee, R. C. and V. Ambros. An extensive class of small RNAs in *Caenorhabditis elegans* Science Oct. 26, 2001 862-864 294.

Lau, N. C., L. P. Lim, E. G. Weinstein and D. P. Bartel. An abundant class of tiny RNAs with probable regulatory roles in *Caenorhabditis elegans* Science Oct. 26, 2001 858-862 294.

Itaya, A., A. Folimonov, Y. Matsuda, R. S. Nelson and B. Ding. Potato spindle tuber viroid as inducer of RNA silencing in infected tomato Mol Plant Microbe Interact Nov. 2001 1332-1334 14.

Mattick, J. S. Non-coding RNAs: the architects of eukaryotic complexity EMBO Rep Nov. 2001 986-991 2.

Elbashir, S. M., J. Martinez, A. Patkaniowska, W. Lendeckel and T. Tuschl. Functional anatomy of siRNAs for mediating efficient RNAi in *Drosophila melanogaster* embryo lysate Embo J Dec. 3, 2001 6877-6888 20.

Ambros, V. microRNAs: tiny regulators with great potential Cell Dec. 28, 2001 823-826 107.

Blaszczyk, J., J. E. Tropea, M. Bubunenko, K. M. Routzahn, D. S. Waugh, D. L. Court and X. JI. Crystallographic and modeling studies of RNase III suggest a mechanism for double-stranded RNA cleavage Structure Dec. 2001 1225-1236 9.

Crete, P., S. Leuenberger, V. A. Iglesias, V. Suarez, H. Schob, H. Holtorf, S. Van Eeden and F. Meins. Graft transmission of induced and spontaneous post-transcriptional silencing of chitinase genes Plant J Dec. 2001 493-501 28.

Smallridge, R. A small fortune Nat Rev Mol Cell Biol Dec. 2001 867 2.

Eddy, S. R. Non-coding RNA genes and the modern RNA world Nat Rev Genet Dec. 2001 919-929 2.

Lu, C. M. miRNA bead detection Genaco Biomedical Products PHS 398 2001 1.

Matzke, M., A. J. Matzke and J. M. Kooter. RNA: guiding gene silencing 2001 1080 293.

Grosshans, H. and F. J. Slack. Micro-RNAs: small is plentiful J Cell Biol Jan. 7, 2002 17-21 156.

Meshorer, E., C. Erb, R. Gazit, L. Pavlovsky, D. Kaufer, A. Friedman, D. Glick, N. Ben-arie and H. Soreq. Alternative splicing and neuritic mRNA translocation under long-term neuronal hyper-sensitivity Science Jan. 18, 2002 508-512 295.

Paddison, P. J., A. A. Caudy and G. J. Hannon. Stable suppression of gene expression by RNAi in mammalian cells Proc Natl Acad Sci U S A Feb. 5, 2002 1443-1448 99.

Moss, E. G. MicroRNAs: hidden in the genome Curr Biol Feb. 19, 2002 R138-140 12.

Banerjee, D. and F. Slack. Control of developmental timing by small temporal RNAs: a paradigm for RNA-mediated regulation of gene expression Bioessays Feb. 2002 119-129 24.

Elbashir, S. M., J. Harborth, K. Weber and T. Tuschl. Analysis of gene function in somatic mammalian cells using small interfering RNAs Methods Feb. 2002 199-213 26

Han, Y. and D. Grierson. Relationship between small antisense RNAs and aberrant RNAs associated with sense transgene mediated gene silencing in tomato Plant J Feb. 2002 509-519 29.

Nicholson, R. H. and A. W. Nicholson. Molecular characterization of a mouse cDNA encoding Dicer, a ribonuclease III ortholog involved in RNA interference Mamm Genome Feb. 2002 67-73 13.

Puerta-Fernandez, E., A. Barroso-Deljesus and A. Berzal-Herranz. Anchoring hairpin ribozymes to long target RNAs by loop-loop RNA interactions Antisense Nucleic Acid Drug Dev Feb. 2002 1-9 12.

Giordano, E., R. Rendina, I. Peluso and M. Furia. RNAi triggered by symmetrically transcribed transgenes in *Drosophila melanogaster* Genetics Feb. 2002 637-648 160.

Martens, H., J. Novotny, J. Oberstrass, T. L. Steck, P. Postlethwait and W. Nellen. RNAi in Dictyostelium: the role of RNA-directed RNA polymerases and double-stranded RNase Mol Biol Cell Feb. 2002 445-453 13.

Mourelatos, Z., J. Dostie, S. Paushkin, A. Sharma, B. Charroux, L. Abel, J. Rappsilber, M. Mann and G. Dreyfuss. miRNPs: a novel class of ribnucleoproteins containing numerous microRNAs Genes Dev Mar. 15, 2002 720-728 16.

Seggerson, K., L. Tang and E. G. Moss. Two genetic circuits repress the *Caenorhabditis elegans* heterochronic gene lin-28 alter translation initiation Dev Biol Mar. 15, 2002 215-225 243.

Morel, J. B., C. Godon, P. Mourrain, C. Beclin, S. Boutet, F. Feuerbach, F. Proux and H. Vaucheret. Fertile hypomorphic Argonaute (ago1) mutants impaired in post-transcriptional gene silencing and virus resistance Plant Cell Mar. 2002 629-639 14.

Catalanotto, C., G. Azzalin, G. Macino and C. Cogoni. Involvement of small RNAs and role of the qde genes in the gene silencing pathway in Neurospora Genes Dev Apr. 1, 2002 790-795 16.

Boutla, A., K. Kalantidis, N. Tavernarakis, M. Tsagris and M. Tabler. Induction of RNA interference in *Caenorhabditis elegans* by RNAs derived from plants exhibiting post-transcriptional gene silencing Nucleic Acids Res Apr. 1, 2002 1688-1694 30.

Pasquinelli, A. E. and G. Ruvkun. Control of developmental timing by micrornas and their targets Annu Rev Cell Biol Epub Apr. 2, 2002 495-513 18.

Paddison, P. J., A. A. Caudy, E. Bernstein, G. J. Hannon and D. S. Conklin. Short hairpin RNAs (shRNAs) induce sequence-specific silencing in mammalian cells Genes Dev Apr. 15, 2002 948-958 16.

Beclin, C., S. Boutet, P. Waterhouse and H. Vaucheret. A branched pathway for transgene-induced RNA silencing in plants Curr Biol Apr. 16, 2002 684-688 12.

Eddy, S. R. Computational genomics of noncoding RNA genes Cell Apr. 19, 2002 137-140 109.

Lagos-Quintana, M., R. Rauhut, A. Yalcin, J. Meyer, W. Lendeckel and T. Tuschl. Identification of tissue-specific microRNAs from mouse Curr Biol Apr. 30, 2002 735-739 12.

Kent, W. J. Blat—the Blast-like alignment tool Genome Res Apr. 2002 656-664 12.

Hutvagner, G. and P. D. Zamore. RNAi: nature abhors a double-strand Curr Opin Genet Dev Apr. 2002 225-232 12.

Nilsson, M., J. Baner, M. Mendel-Hartvig, F. Dahl, D. O. Antson, M. Gullberg and U. Landegren. Making ends meet in genetic analysis using padlock probes Hum Mutat Apr. 2002 410-415 19.

Pasquinelli, A. E. MicroRNAs: deviants no longer Trends Genet Apr. 2002 171-173 18.

Lai, E. C. Micro RNAs are complementary to 3' UTR sequence motifs that mediate negative post-transcriptional regulation Nat Genet Apr. 2002 363-364 30.

Schwartz, D. S. and P. D. Zamore. Why do miRNAs live in the miRNP? Genes Dev May 1, 2002 1025-1031 16.

Brantl, S. Antisense-RNA regulation and RNA interference Biochim Biophys Acta May, 3, 2002 15-25 1575.

Li, H., W. X. Li and S. W. Ding. Induction and suppression of RNA silencing by an animal virus Science May 17, 2002 1319-1321 296.

Zamore, P. D. Ancient pathways programmed by small RNAs Science May 17, 2002 1265-1269 296.

Chen, S., E. A. Lesnik, T. A. Hall, R. Sampath, R. H. Griffey, D. J. Ecker and L. B. Blyn. A bioinformatics based approach to discover small RNA genes in the *Escherichia coli* genome Biosystems Mar.-May 2002 157-177 65.

Lee, N. S., T. Dohjima, G. Bauer, H. Li, M. J. Li, A. Ehsani, P. Salvaterra and J. Rossi. Expression of small interfering RNAs targeted against HIV-1 rev transcripts in human cells Nat Biotechnol May 2002 500-505 20.

Draghici, S. Statistical intelligence: effective analysis of high-density microarray data Drug Discov Today Jun. 1, 2002 S55-63 7.

Silhavy, D., A. Molnar, A. Lucioli, G. Szittya, C. Hornyik, M. Tavazza and J. Burgyan. A viral protein suppresses RNA silencing and binds silencing-generated, 21- to 25-nucleotide double-stranded RNAs Embo J Jun. 17, 2002 3070-3080 21.

Ayash-Rashkovsky, M., Z. Weisman, J. Diveley, R. B. Moss, Z. Bentwich and G. Borkow. Generation of Th1 immune responses to inactivated, gp120-depleted HIV-1 in mice with a dominant Th2 biased immune profile via immunostimulatory [correction of imunostimulatory] oligonucleotides—relevance to AIDS vaccines in developing countries Vaccine Jun. 21, 2002 2684-2692 20.

Tabara, H., E. Yigit, H. Siomi and C. C. Mello. The dsRNA binding protein RDE-4 interacts with RDE-1, DCR-1, and a DExH-box helicase to direct RNAi in C. elegans Cell Jun. 28, 2002 861-871 109.

Bettencourt, R., O. Terenius and I. Faye. Hemolin gene silencing by ds-RNA injected into Cecropia pupae is lethal to next generation embryos Insect Mol Biol Jun. 2002 267-271 11.

Hooper, N. M. and A. J. Turner. The search for alpha-secretase and its potential as a therapeutic approach to Alzheimer s disease Curr Med Chem Jun 2002 1107-1119 9.

Liu, Q., S. Singh and A. Green. High-oleic and high-stearic cottonseed oils: nutritionally improved cooking oils developed using gene silencing J Am Coll Nutr Jun. 2002 205S-211S 21.

Zeng, Y., E. J. Wagner and B. R. Cullen. Both natural and designed micro RNAs can inhibit the expression of cognate mRNAs when expressed in human cells Mol Cell Jun. 2002 1327-1333 9.

McManus, M. T., C. P. Petersen, B. B. Haines, J. Chen and P. A. Sharp. Gene silencing using micro-RNA designed hairpins Rna Jun. 2002 842-850 8.

Reinhart, B. J., E. G. Weinstein, M. W. Rhoades, B. Bartel and D. P. Bartel. MicroRNAs in plants Genes Dev Jul. 1, 2002 1616-1626 16.

McCaffrey, A. P., L. Meuse, T. T. Pham, D. S. Conklin, G. J. Hannon and M. A. Kay. RNA interference in adult mice Nature Jul. 4, 2002 38-39 418.

Hannon, G. J. RNA interference Nature Jul. 11, 2002 244-251 418.

Dennis, C. The brave new world of RNA Nature Jul. 11, 2002 122-124 418.

Jacque, J. M., K. Triques and M. Stevenson. Modulation of HIV-1 replication by RNA interference Nature Jul. 25, 2002 435-438 418.

Cullen, B. R. RNA interference: antiviral defense and genetic tool Nat Immunol Jul. 2002 597-599 3.

MA, C. and A. Mitra. Intrinsic direct repeats generate consistant post-transcriptional gene silencing in tobacco Plant J Jul. 2002 37-49 31.

Novina, C. D., M. F. Murray, D. M. Dykxhoorn, P. J. Beresford, J. Reiss, S. K. Lee, R. G. Collman, J. Lieberman, P. Shankar and P. A. Sharp. siRNA-directed inhibition of HIV-1 infection Nat Med Jul. 2002 681-686 8.

Pomerantz, R. J. RNA interference meets HIV-1: will silence be golden? Nat Med Jul. 2002 659-660 8.

Zeng, Y. and B. R. Cullen. RNA interference in human cells is restricted to cytoplasm Rna Jul. 2002 855-860 8.

Xiang, C. C., O. A. Kozhich, M. Chen, J. M. Inman, Q. N. Phan, Y. Chen and M. J. Brownstein. Amine-modified random primers to label probes for DNA microarrays Nat Biotechnol Jul. 2002 738-742 20.

Llave, C., K. D. Kasschau, M. A. Rector and J. C. Carrington. Endogenous and silencing-associated small RNAs in plants Plant Cell Jul. 2002 1605-1619 14.

Hipfner, D. R., K. Weigmann and S. M. Cohen. The bantam gene regulates Drosophila growth Genetics Aug. 2002 1527-1537 161.

Liu, Q., S. P. Singh and A. G. Green. High-stearic and High-oleic cottonseed oils produced by hairpin RNA-mediated post-transcriptional gene silencing Plant Physiol Aug. 2002 1732-1743 129.

Stoutjesdijk, P. A., S. P. Singh, Q. Liu, C. J. Hurlstone, P. A. Waterhouse and A. G. Green. hpRNA-mediated targeting of the Arabidopsis FAD2 gene gives highly efficient and stable silencing Plant Physiol Aug. 2002 1723-1731 129.

Suzuma, S., S. Asari, K. Bunai, K. Yoshino, Y. Ando, H. Kakeshita, M. Fujita, K. Nakamura and K. Yamane. Identification and characterization of novel small RNAs in the aspS-yrvM intergenic region of the Bacillus subtilis genome Microbiology Aug. 2002 2591-2598 148.

Milligan, L., T. Forne, E. Antoine, M. Weber, B. Hemonnot, L. Dandolo, C. Brunel and G. Cathala. Turnover of primary transcripts is a major step in the regulation of mouse H19 gene expression EMBO Rep Aug. 2002 774-779 3.

Hamilton, A., O. Voinnet, L. Chappell and D. Baulcombe. Two classes of short interfering RNA in RNA silencing Embo J Sep. 2, 2002 4671-4679 21.

Lee, Y., K. Jeon, J. T. Lee, S. Kim and V. N. Kim. MicroRNA maturation: stepwise processing and subcellular localization Embo J Sep. 2, 2002 4663-4670 21.

Klahre, U., P. Crete, S. A. Leuenberger, V. A. Iglesias and F. Meins, Jr. High Molecular weight RNAs and small interfering RNAs induce systemic posttreanscriptional gene silencing in plants Proc Natl Acad Sci U S A Sep. 3, 2002 11981-11986 99.

Park, W., J. Li, R. Song, J. Messing and X. Chen. Carpel Factory, a Dicer homolog, and Hen1, a novel protein, act in microRNA metabolism in Arabidopsis thaliana Curr Biol Sep. 3, 2002 1484-1495 12.

Jiang, M. and J. Milner. Selective silencing of viral gene expression in HPV-positive human cervical carcinoma cells treated with siRNA, a primer of RNA interference Oncogene Sep. 5, 2002 6041-6048 21.

Martinez, J., A. Patkaniowska, H. Urlaub, R. Luhrmann and T. Tuschl. Single-stranded antisense siRNAs guide target RNA cleavage in RNAi Cell Sep. 6, 2002 563-574 110.

Allshire, R. Molecular biology. RNAi and heterochromatin—a hushed-up affair Science Sep. 13, 2002 1818-1819 297.

Reinhart, B. J. and D. P. Bartel. Small RNAs correspond to centromere heterochromatic repeats Science Sep. 13, 2002 1831 297.

Volpe, T. A., C. Kidner, I. M. Hall, G. Teng, S. I. Grewal and R. A. Martienssen. Regulation of heterochromatic silencing and histone H3 lysine-9 methylation by RNAi Science Sep. 13, 2002 1833-1837 297.

Llave, C., Z. Xie, K. D. Kasschau and J. C. Carrington. Cleavage of Scarecrow-like mRNA targets directed by a class of Arabidopsis miRNA Science Sep. 20, 2002 2053-2056 297.

Mochizuki, K., N. A. Fine, T. Fujisawa and M. A. Gorovsky. Analysis of a piwi-related gene implicates small RNAs in genome rearrangement in tetrahymena Cell Sep. 20, 2002 689-699 110.

Hutvagner, G. and P. D. Zamore. A microRNA in a multiple-turnover RNAi enzyme complex Science Sep. 20, 2002 2056-2060 297.

Coburn, G. A. and B. R. Cullen. Potent and specific inhibition of human immunodeficiency virus type 1 replication by RNA interference J Virol Sep. 2002 9225-9231 76.

Caudy, A. A., M. Myers, G. J. Hannon and S. M. Hammond. Fragile X-related protein and VIG associate with the RNA interference machinery Genes Dev Oct. 1, 2002 2491-2496 16.

Ishizuka, A., M. C. Siomi and H. Siomi. A Drosophila fragile X protein interacts with components of RNAi and ribosomal proteins Genes Dev Oct. 1, 2002 2497-2508 16.

Voinnet, O. RNA silencing: small RNAs as ubiquitous regulators of gene expression Curr Opin Plant Biol Oct. 2002 444-451 5.

Golden, T. A., S. E. Schauer, J. D. Lang, S. Pien, A. R. Mushegian, U. Grossniklaus, D. W. Meinke and A. Ray. Short Integuments1/Suspensor1/Carpel Factory, a Dicer homolog, is a maternal effect gene required for embryo development in Arabidopsis Plant Physiol Oct. 2002 808-822 130.

Merkle, I., M. J. Van Ooij, F. J. Van Kuppeveld, D. H. Glaudemans, J. M. Galama, A. Henke, R. Zell and W. J. Melchers. Biological significance of a human enterovirus B-specific RNA element in the 3' nontranslated region J Virol Oct. 2002 9900-9909 76.

Froeyen, M. and P. Herdewijn. RNA as a target for drug design, the example of Tat-TAR interaction Curr Top Med Chem Oct. 2002 1123-1145 2.

Carmell, M. A., Z. Xuan, M. Q. Zhang and G. J. Hannon. The Argonaute family: tentacles that reach into RNAi, developmental control, stem cell maintenance, and tumorigenesis Genes Dev Nov. 1, 2002 2733-2742 16.

Provost, P., D. Dishart, J. Doucet, D. Frendewey, B. Samuelsson and O. Radmark. Ribonuclease activity and RNA binding of recombinant human Dicer Embo J Nov. 1, 2002 5864-5874 21.

Zhang, H., F. A. Kolb, V. Brondani, E. Billy and W. Filipowicz. Human Dicer preferentially cleaves dsRNAs at their termini without a requirement for ATP Embo J Nov. 1, 2002 5875-5885 21.

Mallory, A. C., B. J. Reinhart, D. Bartel, V. B. Vance and L. H. Bowman. A viral suppressor of RNA silencing differentially regulates the accumulation of short interfering RNAs and micro-RNAs in tobacco Proc Natl Acad Sci U S A Nov. 12, 2002 15228-15233 99.

Gottesman, S. Stealth regulation: biological circuits with small RNA switches Genes Dev Nov. 15, 2002 2829-2842 16.

Calin, G. A., C. D. Dumitru, M. Shimizu, R. Bichi, S. Zupo, E. Noch, H. Aldler, S. Rattan, M. Keating, K. Rai, L. Rassenti, T. Kipps, M. Negrini, F. Bullrich and C. M. Croce. Frequent deletions and down-regulation of micro- RNA genes miR15 and miR16 at 13q14 in chronic lymphocytic leukemia Proc Natl Acad Sci U S A Nov. 26, 2002 15524-15529 99.

Gaudilliere, B., Y. Shi and A. Bonni. RNA interference reveals a requirement for myocyte enhancer factor 2A in activity-dependent neuronal survival J Biol Chem Nov. 29, 2002 46442-46446 277.

Jones, L. Revealing micro-RNAs in plants Trnds Plant Sci Nov. 2002 473-475 7.

Schauer, S. E., S. E. Jacobsen, D. W. Meinke and A. Ray. Dicer-Like1: blind men and elephants in Arabidopsis development Trends Plant Sci Nov. 2002 487-491 7.

Okazaki, Y., M. Furuno, T. Kasukawa, J. Adachi, H. Bono, S. Kondo, et al. Analysis of the mouse transcriptome based on functional annotation of 60,770 full-length cDNAs Nature Dec. 5, 2002 563-573 420.

Huttenhofer, A., J. Brosius and J. P. Bachellerie. RNomics: identification and function of small, non-messenger RNAs Curr Opin Chem Biol Dec. 2002 835-843 6.

Wood, N. T. Unravelling the molecular basis of viral suppression of PTGS Trends Plant Sci 2002 384 7.

Cohen, O., C. Erb, D. Ginzberg, Y. Pollak, S. Seidman, S. Shoham, R. Yirmiya and H. Soreq. Neuronal overexpression of "readthrough" acetylcholinesterase is associated with antisense-suppressible behavioral impairments Mol Psychiatry *No date in pubmed* 2002 874-885 7.

Mlotshwa, S., O. Voinnet, M. F. Mette, M. Matzke, H. Vaucheret, S. W. Ding, G. Pruss and V. B. Vance. RNA silencing and the mobile silencing signal Plant Cell * No date in pubmed* 2002 S289-301 14 Suppl.

Lee, et al.; The *C. Elegans* Heterochronic Gene lin-r Encodes Small RNAs with Antisense Complementary to lin-14; *Cell*, 75:843-854 (Dec. 3, 1993).

Wightman, et al.; Posttranscriptional of the Heterochronic Gene lin-14 by lin-4 Mediates Temporal Pattern Formation of *C. elegans*; *Cell*, 75:855-862 (Dec. 3, 1993).

Smith, et al.; Total Silencing by Intron-Spliced Hairpin RNAs; *Nature*, 407:319-320 (Sep. 21, 2000).

Pasquinelli, et al.; Conservation of the Sequence and Temporal Expression of let-7 Heterochronic Regulatory RNA; *Nature*, 408:86-89 (Nov. 2, 2000).

Elbashir, et al.; Duplexes of 21-Nucleotide RNAs Mediate RNA Interference in Cultures Mammalian Cells; *Nature*, 411:498-498 (May 24, 2001).

Moss; RNA interference: It's a Small RNA World; *Curr. Biol.*, 11:R772-775 (Oct. 2, 2001).

Lagos-Quintana, et al.; Identification of Novel Genes Coding for Small Expressed RNAs; *Science*, 294:853-858 (Oct. 26, 2001).

Rhoades, et al.; Prediction of Plant MicroRNA Targets; *Cell*, 110:513-520 (Aug. 23, 2002).

* cited by examiner

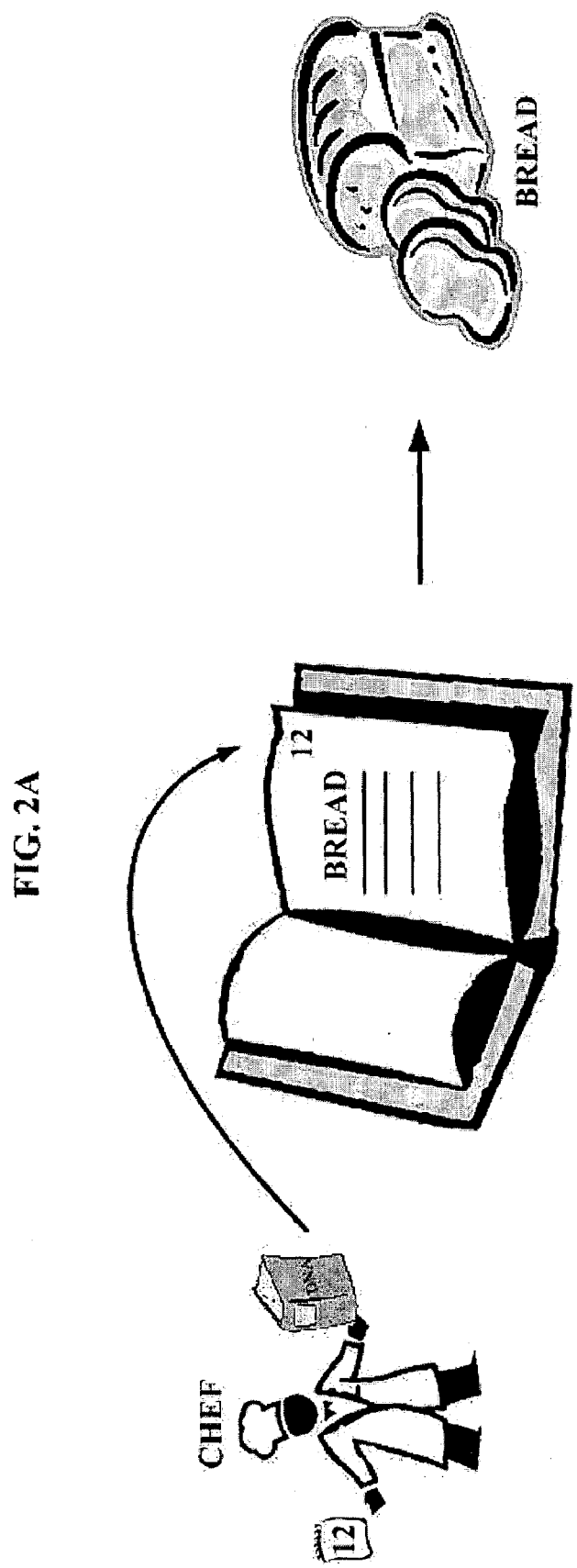

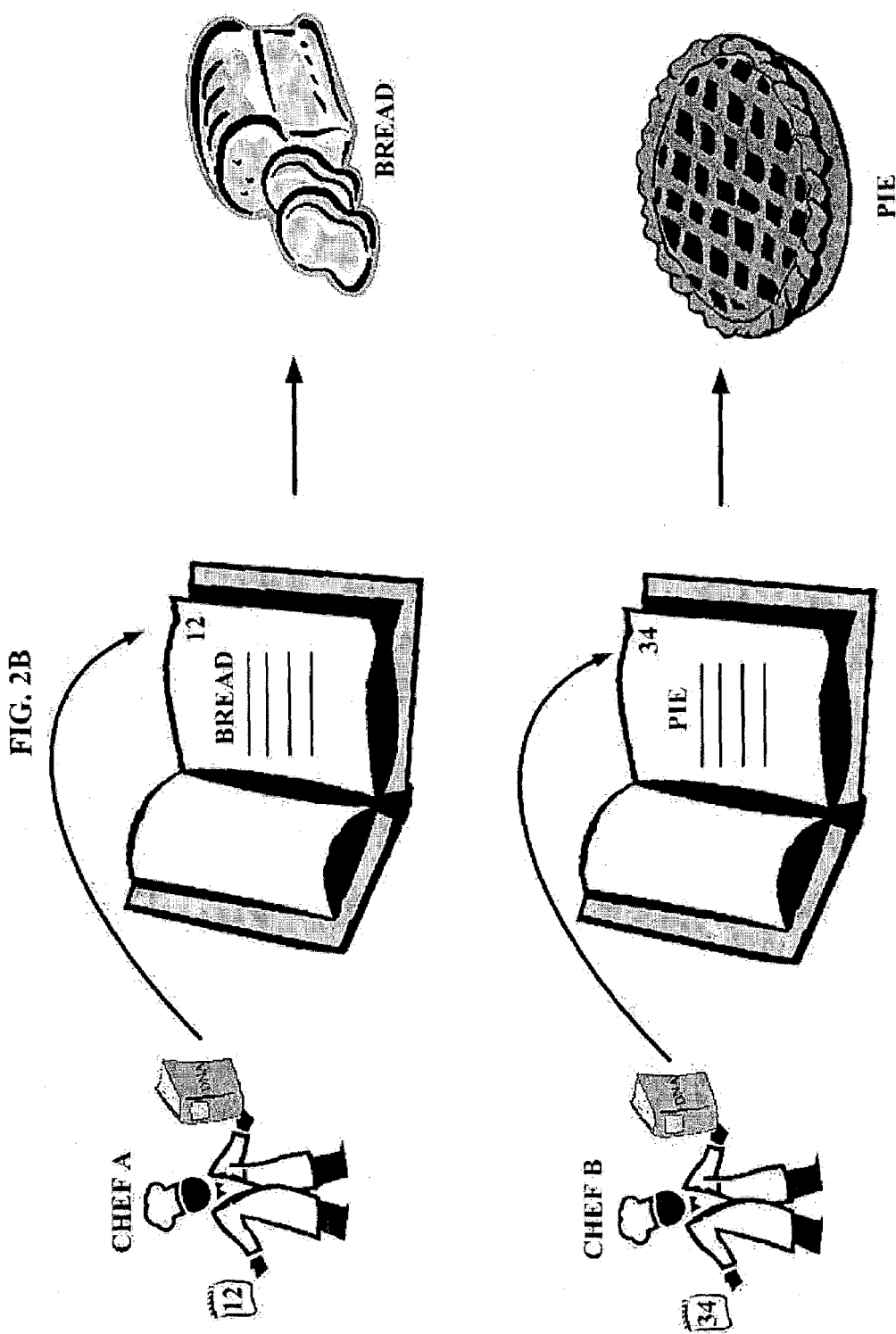

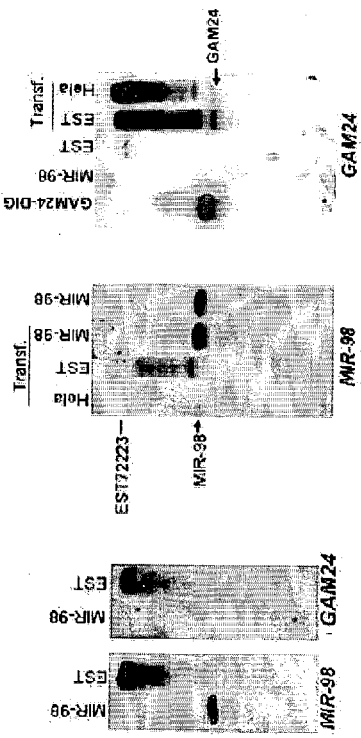
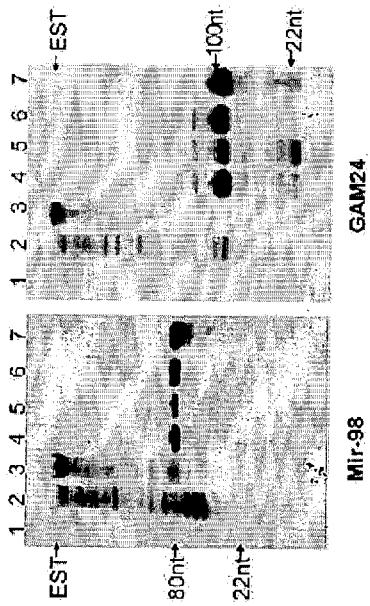
FIG. 21A
FIG. 21B
FIG. 21C
FIG. 21D

FIG. 22A dbEST Id.7929020(Image4514344) sequence:
GCAAAAACTGGAAGCATTCCCTTTGAAAACTGGCACAAGACAGGGATGCCCTCTCTCAC
CGCTCCTATTGAACATAGTGTTGGAAGTTCTGGCCAGGGCAATTAGGCAGGAGAAGGAA
ATAAAGGGTATTCAATTAGGAAAAGAGCAAGTCAAATTGTTCCTGTTTGCAGATGACAT
GATTGTATATCTAGAAAACCCCATTGTCTCAGCCCCAAATCTCCTTAAGCTGATAAGCA
ACTTCAGCAAAGTCTCAGGATACAAAATAAATGTACAAAAATCACAAGCATTCTTACAC
ACCAACAACAGAAAAACAGAGCCAAATCATGAGTGAACTCCCATTCACAATTGCTTCAA
AGAGAATAAAATACCTAGGAATCCAACTTACAAGGGATGTGAAGGACCTCTTCAAGGAG
AACTACAAACCACTGCTCAAGGAAATAAAAGAGGATACAAACAAATGGAAGAACATTCC
ATGCTCATGGGTAGGAAGAATCAATATTGTCAAAATGGCCATACTGCCCAAGGTAATTT
ACAGATTCAATGCCATCCCCATCAAGCTACCAATGACTTTCTTCACAGAATTGGAAAAA
ACTACTTTAAAGTTCATATGGAACCAAAAAGAGCCCGCATCGCCAAGTCAATCCTA**AG
CCAAAAGAACAAAGCTGGAGGCATCACACTACCTGACTTCAAACTTTACTACAAGGCTA** GAM23
CAGTAACCAAAACAGCATGGTACTGGTACCAAAACAGAGATATAGATCAATGGAACAGA
ACAGAGCCCTCAGAAATAACGCCGAATACCTACAACTATCTGATCTTTGACAAACCTGA
GAAAAACAAGCAATGGGGAAAGGATTCCCTATTTAATAAATGGTGCTGGGAAAACTGAC
TAGCCATATGTAGAAAGCTGAAACTGGATCCCTTCCTTACACCTTATACAAAAATCAAT
TCAAGATGGATTAAAGATTTAAACGTTAGACCTAAAACCATAAAAACCCTAGAAGAAAA
CCTAGGCATTACCATTCAGGACATAGGCATGGGCAAGGACTTCATGTCCAAAACACCAA
AAGCAATGGCAACAAAAGACAAAATTGACAAATGGGATCTAATTAAACTAAAGAGCTTC
TGCACAGCAAAAGAAACTACCA**TCAGAGTGAACAGGCAACCTACAAAATGGGAGAAAAT
TTTCGCAACCTACTCATCTGA**CAAAGGGCTAATATCCAGAATCTACAATGAACTCAAAC GAM25
AAATTTACAAAAAAAAAAAAAAA

FIG. 22B

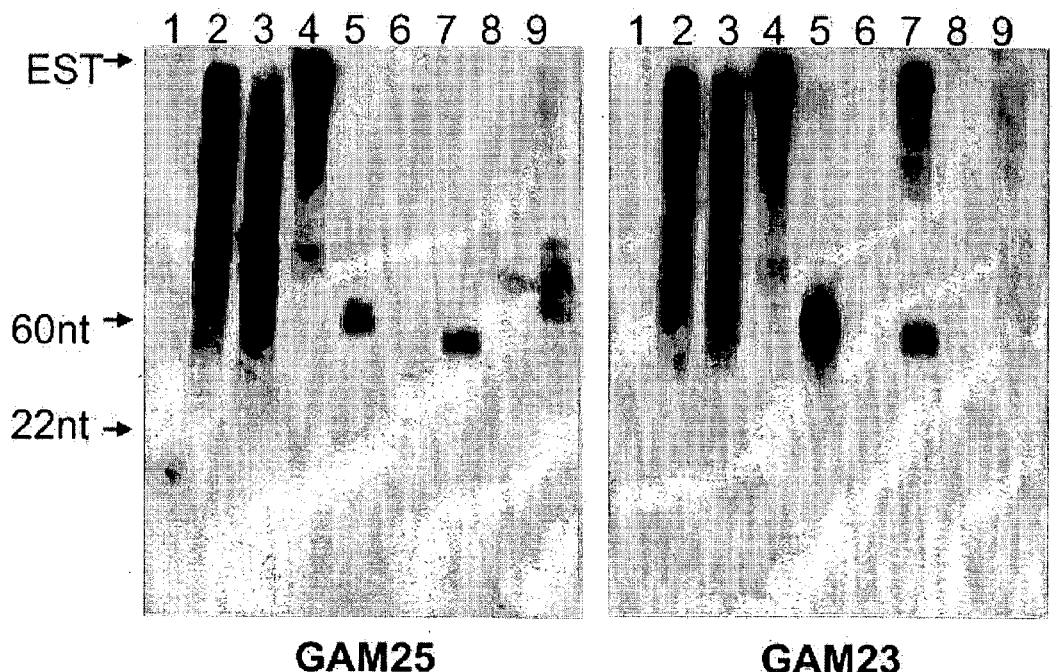

GAM25    GAM23

FIG. 23A dbEST Id.1388749 (Image1020185) Sequence:
ACTCCTATCAACAGTGTAAAAGCATTCCTGTTTCTCCATAATCTTGCCAGCATCTTTT
CATTTTTTTGAATTATAGCCATTCTGACTGTTGTGAGATGGTGTCTCATTGTGGTTTT
GATTTGCATTTCTCAGATGATCAGTGATGTTGAAGTTTTTTTGTTTGTTGGCTGCATG
TATGCCTTCTTTTGAAAAGTGTCTGTTTGTGTCCTTTGACCACTTTCTAATGGGGTTG
AGTTTTTTTTCTTGTAAATTTGTTTAAGTTCCTTGTAGATGCTGGATATTAGACCTT
TGTCAGATGGATAGAGTGCAAAAATTTTCTCCCATTCTGTAGGTTGTCGGTTTACTCT
GTTGATAGGTTCTTAATGCTGTGCAGAAGCTCTTTAGTTTAATTAGATCCCATTTGTC
AATTTTGGCTTTTGTTGCAATTGCTTTTGGCATCTTCGTCATGAAATCTTTGCCCTTG
CCTGTGTCCTGAATGGCATTGCCTAGGTTTTCTTCCAGGATTTTTATAGTTTTGGGTT
GTAGATTTAAGTCTTTAATCCATCTTGAGTTAACTTTTGTATATGGGTTAAGGAAGGG
GCCCGTTTCAATTTGCTGCAAATGGCTAGCCAGTTCTCCCAGCACCATTTATTAAATA
GGGAATCTTTTCCCCATTGCTTCCTTTTGTCAGGTTTGTCAAAGATCACATGGTTGTA
GGTGTGTGGTCTTATTTCTGGGTTCTCTATTCTGTTCCATTGGGCTATGGGCCGGTTC
TGTACCACCACTATGCTGTTTTGGGTACCATAGTCTTGTAGAATGTTTGAAGCTGGGT
AGCATGATGCCTCTAGCTTTGCTCTTCTTGCTAAGAAATGTCTTGGCTATTTGGGCTC
TTTTTTGGTTCCATATGAATTTTAAAATAGCTTTTTCTAGGTCTGTAAAGAATGTGAA
TAGTAGTTTAATGGGCCTAGCATTTAATTTACAGATTGCCTTGGGCAGTGTGGTCATT
TTCACGATATTGATCCTTCCTGTCTGTGAGCATATGTTT**TTCCATTTGTTTGTGTCAT
CTCTGATTTCTTTGAATAATGGTTTATAGTTATCCTTGAAAAGGTCCTTCACTTTTCT** GAM26
TGTTAGCTGTATTCCTAGATATTATACTCTTCTTGTGGCAATTGTGAATGGGAGTTAA
TTCATGAGTTTTCTCTCGGCTTGCCTGTTGTTGGTGTATAGGAATGCTAGTGACTTTT
GCACATTGATTTTGTATCCTGAGACTTTGTTGAAGTTGCTTATCAGCTAAGAAGTTTT
TGAGCTGAGATGATGGAGTTTTCTAGATATAGGATCATATCATCTGCAAACAAAGATA
GTTTGACTTCCTGTCTTCCTATTTGAATAGCTTTTCTTTCTTTCTCTTGCCTGATTGC
CTTGGTGAGAATTTCTAATACTGTGTTGAATAGGAGTGGTGAGCTCGTGCCAA

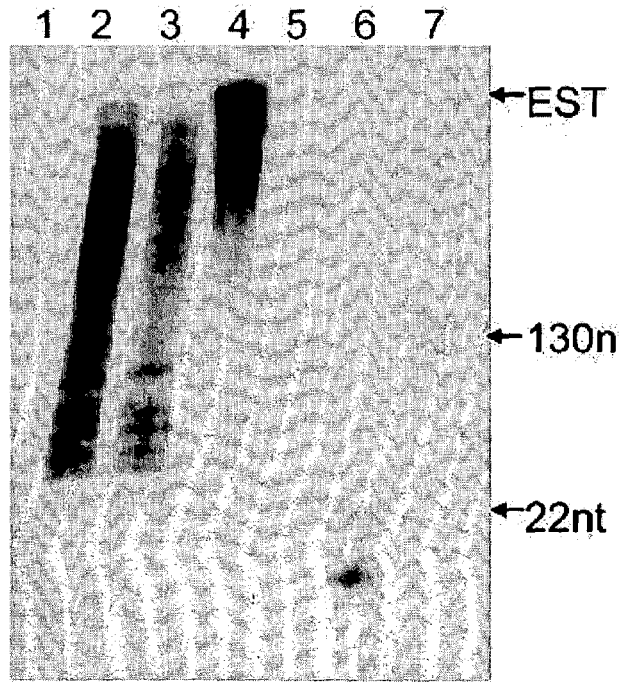

FIG. 23B

GAM26

ACTGTGGAATGCCTGCGGGGTGATGTTGATATTCTAATG  SEQ ID: 24
GAGTTCCTGCTCAATGTCACCA<u>CAGCACCAGAATTTCGT</u>
<u>CGT</u>

CAGCACCAGAATTTCGTCGT  SEQ ID: 1

```
        TG     GCC--    GG-            T-----     TA
     AC   TGGAAT    TGC   GGTGATGTTGA      ATTC   A         SEQ ID: 24
     ||   ||||||    |||   ||||||||||||     ||||
     TG   GCTTTA    ACG   CCACTGTAACT      TGAG   /
        CT     AGACC    ACA            CGTCCT     GT
```

Fig. 24D/1

```
                        TTC   C
              5' CAGCACCA GAAT    GT GT 3'      SEQ ID:20602
DCLRE1A          |||||||| ||||    || ||
BINDING SITE  3' GTCGTGGT CTTG    CA CA 5'      SEQ ID:507529
                        G    TA-  A

CA         TTC  -
              5'    GCACCAGAAT   G TCGT 3'      SEQ ID:20602
DKFZP586I2223       ||||||||||   | ||||
BINDING SITE  3'    CGTGGTCTTG   C AGCA 5'      SEQ ID:534456
                 GG         TCT G

CA    CCA        -
              5' GCA      GAATTTC GTCGT 3'      SEQ ID:20602
FLJ13725         |||      ||||||| |||||
BINDING SITE  3' CGT      CTTGAGG CAGCA 5'      SEQ ID:604594
                 AC    AC-       T

A          TC--  C
              5' AGC  CCAGAATT    GT GT 3'      SEQ ID:20602
PASK             |||  ||||||||    || ||
BINDING SITE  3' TCG  GGTCTTAA    CG CA 5'      SEQ ID:907327
                 G          TTGT  A

A         TC
              5' CAGC CCAGAATT    GTCGT 3'      SEQ ID:20602
TIGD5            |||| ||||||||    |||||
BINDING SITE  3' GTCG GGTCTTGG    CGGCA 5'      SEQ ID:993571
                  C         T-

-     C  C
              5' CAGCACCAGAA TTT  GT GT 3'      SEQ ID:20602
LOC151556        |||||||||||  |||  || ||
BINDING SITE  3' GTCGTGGTCTT AAA  CG CA 5'      SEQ ID:1151343
                             C    T  A

C         TT-   TC
              5' CAG ACCAGAAT     CG GT 3'      SEQ ID:20602
LOC196812        ||| ||||||||     || ||
BINDING SITE  3' GTC TGGTCTTA     GT CA 5'      SEQ ID:1214315
                  -         TCT   GA

AATT
              5' AGCACCAG    TCGTCGT 3'         SEQ ID:20602
LOC256158        ||||||||    |||||||
BINDING SITE  3' TCGTGGTC    GGCGGCA 5'         SEQ ID:1317257
                            CCTC

CA           G
              5'    GCACCAGAATTTC TCGT 3'       SEQ ID:20602
LOC90342            ||||||||||||| ||||
BINDING SITE  3'    TGTGGTCTTGGAG AGCA 5'       SEQ ID:1356067
                 A-              A
```

CCACCAGTCCTTGCACTGTTCTGACACTTTCCCCAGGAGG SEQ ID: 25
AAAACAAGTACAAAGGTTACGGTGG

GGAAAACAAGTACAAAGGTTACGG    SEQ ID: 2

```
     AGT-     GCAC   T  GACAC     CC
CCACC     CCTT    TGT CT     TTTCC  A
|||||     ||||    ||| ||     |||||         SEQ ID: 25
GGTGG     GGAA    ACA GA     AAAGG  G
     CATT     ----   T  ACA--     AG
```

Fig. 25D/1

```
                       A    A         TTACG
              5' GGAA ACA GTACAAAGG           3'      SEQ ID:29474
EED              ||||  ||| |||||||||
BINDING SITE  3' CCTT TGT CATGTTTCT           5'      SEQ ID:144323
                       C    -          TAC

A  A  AA      ACG
              5' GGAAAACA GT CA    GGTT       3'      SEQ ID:29474
MLPH             ||||||||  || ||   ||||
BINDING SITE  3' CCTTTTGT CA GT    CCGA       5'      SEQ ID:256513
                          -  C  C-      C

A  A      A
              5' GGAAAACA GT CA AGGTT CGG       3    SEQ ID:29474
NPY2R            ||||||||  || || ||||| |||
BINDING SITE  3' TCTTTTGT CA GT TCCGA GCC       5    SEQ ID:277186
                          C  C     C

A           A G   AC
              5' GG AAACAAGTACAA G TT   GG       3    SEQ ID:29474
NR1I2            || |||||||||||| | ||   ||
BINDING SITE  3' CC TTTGTTCATGTT C GA   CC       5    SEQ ID:277734
                    G           -  G   GA

AG A  A      TACGG
              5' GGAAAACA   T CA AGGT             3'   SEQ ID:29474
dJ383J4.3        ||||||||   | || ||||
BINDING SITE  3' CCTTTTGT   A GT TCTA             5'   SEQ ID:512554
                           CT  C   C      TC

GA         ACAA    TT    -
              5' G  AAACAAGT        AGG  AC GG          SEQ ID:29474
FLJ14280         |  ||||||||        |||  || ||
BINDING SITE  3' C  TTTGTTCA        TCC  TG CC          SEQ ID:610221
                    TC         CG--    TT   A

GGAAAAC        C      ---
              5'         AAGTA AA    AGGTTACGG          SEQ ID:29474
KIAA1678                 ||||| ||    |||||||||
BINDING SITE  3'         TTCAT TT    TCCAATGCC          SEQ ID:803886
                 CTT----        T      ATA

A      A  -       T
              5' GGAAA CAAGT CA AAGGT ACGG       3    SEQ ID:29474
KIAA1724         ||||| ||||| || ||||| ||||
BINDING SITE  3' CCTTT GTTCA GT TTTCA TGTC       5    SEQ ID:806213
                        -      A        -

A      -    AG-   ACGG
              5' GGAAA CAAGT ACAA    GTT              SEQ ID:29474
KIAA1949         ||||| ||||| ||||    |||
BINDING SITE  3' CCTTT GTTCA TGTT    CAA              SEQ ID:820868
                        C      A    CTA   CC
```

Fig. 25D/2

```
                        AAACA     CAAA-
                5' GGA      AGTA      GGTTACGG   3       SEQ ID:29474
RoXaN              ||       ||||      ||||||||
BINDING SITE    3' CCT      TCGT      CCAATGCC   5       SEQ ID:950975
                        C----     CCTAC

A          A  GT
                5' GGAAA CAAGTACA  AG   T        3'      SEQ ID:29474
SERP1              ||||| ||||||||  ||   |
BINDING SITE    3' CCTTT GTTCATGT  TC   A        5'      SEQ ID:963990
                        -        C   TG

-  C       TTACG
                5' GGAAAACAAG TA AAAGG            3'     SEQ ID:29474
SYNE-1             |||||||||| || |||||
BINDING SITE    3' CCTTTTGTTC AT TTTCC            5'     SEQ ID:986316
                             C  T       G

AAA          G
                5' GGA      CAAGTACAAA GTT        3'     SEQ ID:29474
TNRC4              |||      |||||||||| |||
BINDING SITE    3' CCT      GTTCATGTTT CGA        5'     SEQ ID:996086
                         CC-          G

G          ACAAA     T
                5' GAAAACAAGT          GGT ACGG     3    SEQ ID:29474
LOC196047          ||||||||||          ||| ||||
BINDING SITE    3' CTTTTGTTCA          TCG TGTC     5    SEQ ID:1210373
                         A          CG---     -

A   A  A-    TTACG
                5' GGAAAACA GT CAA  GG            3'     SEQ ID:29474
LOC221540          |||||||| || |||  ||
BINDING SITE    3' CCTTTTGT CA GTT  CC            5'     SEQ ID:1274947
                          A   C  GA    G

A   A  A-    TTACG
                5' GGAAAACA GT CAA  GG            3'     SEQ ID:29474
LOC257545          |||||||| || |||  ||
BINDING SITE    3' CCTTTTGT CA GTT  CC            5'     SEQ ID:1274947
                          A   C  GA    G

A   A  A-    TTACG
                5' GGAAAACA GT CAA  GG            3'     SEQ ID:29474
LOC257598          |||||||| || |||  ||
BINDING SITE    3' CCTTTTGT CA GTT  CC            5'     SEQ ID:1274947
                          A   C  GA    G

-  A  AA   TACGG
                5' GGAAAACAA GT CA   GGT          3      SEQ ID:29474
LOC63928           ||||||||| || ||   |||
BINDING SITE    3' CCTTTTGTT CA GT   CCA          5      SEQ ID:1347928
                           A  C  C-   CC
```

CGGCCGCCGAGTTCCGCGGCTCCGGGAGCGAAGCGCGCA  SEQ ID: 26
CCTGTGAGGCAGACGGCACCTCCTGCGACCGTCGCCGCC
ACCGCCGCCGCCGCCGCCGGGCGCCGAGGGGCTGGCGG
GCG

TCGCCGCCACCGCCGCCGCCGCCG                 SEQ ID: 3

```
     G     G     G    -    GA   AA   C   ACCT   A-    A     CACCT
  CG CCGCC AGTTCC CGGC TCCGG  GCG  GCG GC    GTG  GGC  GACGG     C
  || ||||| |||||| |||| |||||  |||  ||| ||    |||  |||  |||||     C    SEQ ID: 26
  GC GGCGG TCGGGG GCCG GGGCC  CGC  CGC CG    CAC  CCG  CTGCC     C
     G    -      A    C      GC   --   -    CCGC CG    -      AGCGT
```

Fig. 26D/1

```
                           5' GCCACCGCCGCCGCCGCCG      3'                SEQ ID:20604
ACVR1B                        ||||||||||||||||||
BINDING SITE               3' TGGTGGCGGCGGCGGCGGC      5'                SEQ ID:46182

A
                           5' CGCCGCC CCGCCGCCGCCG     3'                SEQ ID:20604
ACVR1B                        ||||||| |||||||||||||
BINDING SITE               3' GTGGCGG GGCGGCGGCGGC     5'                SEQ ID:46198
                                         C

A
                           5' CGCCGCC CCGCCGCCGCCG     3'                SEQ ID:20604
DLG3                          ||||||| |||||||||||||
BINDING SITE               3' GTGGCGG GGCGGCGGCGGC     5'                SEQ ID:46198
                                         C

C--    A    C
                           5' TCGC   GCC CCGC GCCGCCGCCG                  SEQ ID:20604
ADARB1                        ||||   ||| |||| |||||||||
BINDING SITE               3' GGCG   CGG GGCG CGGCGGCGGC                  SEQ ID:48568
                                   AAC    C    A

C--    A    C
                           5' TCGC   GCC CCGC GCCGCCGCCG                  SEQ ID:20604
ADARB1                        ||||   ||| |||| |||||||||
BINDING SITE               3' GGCG   CGG GGCG CGGCGGCGGC                  SEQ ID:48568
                                   AAC    C    A

A            CG
                           5' CGCCGCC CCGCCGCCGC   CC   3'                SEQ ID:20604
ADRBK1                        ||||||| |||||||||| ||
BINDING SITE               3' GCGGCGG GGCGGCGGCG  GG    5'                SEQ ID:51719
                                      C            A-

G   A-
                           5' GCC CC  CCGCCGCCGCCGCCG   3'                SEQ ID:20604
ADRBK1                        ||| ||  |||||||||||||||
BINDING SITE               3' CGG GG  GGCGGCGGCGGCGGC   5'                SEQ ID:51737
                                 A  AG

G   A-
                           5' GCC CC  CCGCCGCCGCCGCCG   3'                SEQ ID:20604
ADRBK1                        ||| ||  |||||||||||||||
BINDING SITE               3' CGG GG  GGCGGCGGCGGCGGC   5'                SEQ ID:51737
                                 A  AG

-   AC  C-
                           5! GC CGCC  CG  CGCCGCCG     3'                SEQ ID:20604
AKAP13                        || ||||  ||  ||||||||
BINDING SITE               3' CG GCGG  GC  GCGGCGGC     5'                SEQ ID:54490
                                  A    A-  CA
```

Fig. 26D/2

```
                         CA        C
                 5' CGC    CCGCCGCCGC GC  3'         SEQ ID:20604
AMD1                ||| |||||||||| ||
BINDING SITE     3' GCG    GGCGGCGGCG CG  5'         SEQ ID:57140
                         AC        A

CCG
                 5' CGCCGCCACCGCCGCCG    CC  3'      SEQ ID:20604
APP                 |||||||||||||||||    ||
BINDING SITE     3' GCGGCGGTGGCGGCGGC    GG  5'      SEQ ID:62063
                                         AGA

C  C
                 5' CGCCGC AC GCCGCCGCCG  3'         SEQ ID:20604
ARAF1               |||||| || |||||||||
BINDING SITE     3' GCGGCG TG CGGCGGCGGC  5'         SEQ ID:63732
                         A  T

C   A    -    G    CG
                 5' TCGC GCC CCGC CGCC CCGC          SEQ ID:20604
ASC                 |||| ||| |||| |||| ||||
BINDING SITE     3' GGCG CGG GGCG GTGG GGCG          SEQ ID:66821
                       A   C    A    -   AC

A   GCC
                 5' CGCCGCC CC    GCCGCCG  3'        SEQ ID:20604
ATF4                ||||||| ||    |||||||
BINDING SITE     3' GCGGCGG GG    CGGCGGC  5'        SEQ ID:67884
                            C     GA-

A    C---     C
                 5' CCGCC CCGC    GC GCCGCCG  3'     SEQ ID:20604
ATP1A1              ||||| ||||    || |||||||
BINDING SITE     3' GGCGG GGCG    CG CGGCGGC  5'     SEQ ID:68935
                         C    ACAA     A

CCA              C------
                 5' GCCG    CCGCCGCCGC        GCCG   SEQ ID:20604
ATP1A1              ||||    ||||||||||        ||||
BINDING SITE     3' CGGC    GGCGGCGGCG        CGGC   SEQ ID:68949
                        TAC          ACAACGA

CC   ACC
                 5' TCG    GCC    GCCGCCGCCGC  3'    SEQ ID:20604
ATP1A1              |||    |||    |||||||||||
BINDING SITE     3' AGC    CGG    CGGCGGCGGCG  5'    SEQ ID:68961
                        C-   CTA

ACC     C
                 5' TCGCCGCC    GCCGC GCCGC  3'      SEQ ID:20604
ATP2B2              ||||||||    ||||| |||||
BINDING SITE     3' GGCGGCGG    CGGCG CGGCG  5'      SEQ ID:69717
                           CGA       A
```

Fig. 26D/3

```
                            ACC        C
                      5' TCGCCGCC  GCCGC GCCGC 3'           SEQ ID:20604
DR1                      ||||||||  ||||| |||||
BINDING SITE          3' GGCGGCGG  CGGCG CGGCG 5'           SEQ ID:69717
                            CGA      A

CA   C     C
                      5' TCGCCGC CCGC GCCGC GCCG 3'         SEQ ID:20604
ATP2B2                   ||||||| |||| ||||| ||||
BINDING SITE          3' GGCGGCG GGCG CGGCG CGGC 5'         SEQ ID:69718
                            AC   A     A

A    C     C
                      5' GCCGCC CCGC GCCGC GCCG 3'          SEQ ID:20604
ATP2B2                   |||||| |||| ||||| ||||
BINDING SITE          3' CGGCGG GGCG CGGCG CGGC 5'          SEQ ID:69745
                            C    A     A

A    C     C
                      5' GCCGCC CCGC GCCGC GCCG 3'          SEQ ID:20604
DR1                      |||||| |||| ||||| ||||
BINDING SITE          3' CGGCGG GGCG CGGCG CGGC 5'          SEQ ID:69745
                            C    A     A

C  A      C
                      5' GC GCC CCGCCGC GCCGC 3'            SEQ ID:20604
ATP2B2                   || ||| ||||||| |||||
BINDING SITE          3' CG CGG GGCGGCG CGGCG 5'            SEQ ID:69749
                           A  C      A

CCAC
                      5' CCG      CGCCGCCGCCGCCG 3'         SEQ ID:20604
AUP1                     |||      |||||||||||||
BINDING SITE          3' GGC      GCGGCGGCGGCGGT 5'         SEQ ID:72273
                              A---

--  AC
                      5' CGCC  GCC  CGCCGCCGCCG 3'          SEQ ID:20604
AUP1                     ||||  |||  |||||||||||
BINDING SITE          3' GCGG  CGG  GCGGCGGCGG 5'           SEQ ID:72277
                              GC  CA

AC       C
                      5' TCGCCGCC  CGCCGC GCCGCCG 3'        SEQ ID:20604
BCL11B                   ||||||||  |||||| |||||||
BINDING SITE          3' GGCGGCGG  GCGGCG CGGCGGC 5'        SEQ ID:78295
                            C-       A

C  A    C
                      5' TCGC GCC CCGC GCCGCCGCCG 3'        SEQ ID:20604
BCL11B                   |||| ||| |||| ||||||||||
BINDING SITE          3' GGCG CGG GGCG CGGCGGCGGC 5'        SEQ ID:78304
                             A    C    A
```

Fig. 26D/4

```
                           C    A        C
                   5' TCGC GCC  CCGC GCCGCCGCCG    3        SEQ ID:20604
BCL11B                ||||  ||| ||||  ||||||||||
BINDING SITE       3' GGCG CGG  GGCG CGGCGGCGGC    5        SEQ ID:78304
                           A    C        A

CA          C
                   5' CGCCGC    CCGCCGC GCCGCCG    C        SEQ ID:20604
BCL11B                ||||||    ||||||| |||||||    |
BINDING SITE       3' GCGGCG    GGCGGCG CGGCGGC    G        SEQ ID:78310
                         AC          A

ACC
                   5' GCCGCC        GCCGCCGCCGCCG  3'       SEQ ID:20604
BCL11B                ||||||        |||||||||||||
BINDING SITE       3' CGGCGG        CGGCGGCGGCGGC  5'       SEQ ID:78336
                         CGA

A-
                   5' CGCCGCC    CCGCC GCCGCCGCCG  3        SEQ ID:20604
BCL7B                 |||||||    ||||| ||||||||||
BINDING SITE       3' GCGGCGG    GGCGG CGGCGGCGGC  5        SEQ ID:79353
                                  CG      G

A              G
                   5' CCGCC CCGCCGCCGCC CC           3'     SEQ ID:20604
BCR                   ||||| ||||||||||| ||
BINDING SITE       3' GGCGG GGCGGCGGCGG GG           5'     SEQ ID:79756
                          C              A

A              G
                   5' CCGCC CCGCCGCCGCC CC           3'     SEQ ID:20604
BCR                   ||||| ||||||||||| ||
BINDING SITE       3' GGCGG GGCGGCGGCGG GG           5'     SEQ ID:79756
                          C              A

A        C
                   5' CCGCC CCGCCGC GCCGCCG          3'     SEQ ID:20604
BCR                   ||||| ||||||| |||||||
BINDING SITE       3' GGCGG GGCGGCG CGGCGGC          5'     SEQ ID:79759
                          C        A

A      C
                   5' TCGCCGCC CCGC GCCGCCGCCG       3'     SEQ ID:20604
BCR                   |||||||| |||| ||||||||||
BINDING SITE       3' GGCGGCGG GGCG CGGCGGCGGC       5'     SEQ ID:79761
                            C      A

A      C
                   5' TCGCCGCC CCGC GCCGCCGCCG       3'     SEQ ID:20604
BCR                   |||||||| |||| ||||||||||
BINDING SITE       3' GGCGGCGG GGCG CGGCGGCGGC       5'     SEQ ID:79761
                            C      A
```

Fig. 26D/5

```
                              A         C
                     5' CCGCC CCGCCGC GCCGCCG  C  3'     SEQ ID:20604
BCR                     ||||| ||||||| |||||||  |
BINDING SITE         3' GGCGG GGCGGCG CGGCGGC  G  5'     SEQ ID:79762
                              C         A

ACC
                     5' TCGCCGCC    GCCGCCGCCGCCG  3'    SEQ ID:20604
BCR                     ||||||||    |||||||||||||
BINDING SITE         3' GGCGGCGG    CGGCGGCGGCGGC  5'    SEQ ID:79766
                                    CGA

ACC
                     5' TCGCCGCC    GCCGCCGCCGCCG  3'    SEQ ID:20604
BCR                     ||||||||    |||||||||||||
BINDING SITE         3' GGCGGCGG    CGGCGGCGGCGGC  5'    SEQ ID:79766
                                    CGA

ACC
                     5' TCGCCGCC    GCCGCCGCCGCCG  3'    SEQ ID:20604
ZNF6                    ||||||||    |||||||||||||
BINDING SITE         3' GGCGGCGG    CGGCGGCGGCGGC  5'    SEQ ID:79766
                                    CGA

A           ---
                     5' TCGCCGCC CCGCCGC CGCCGCCG       SEQ ID:20604
BCRP2                   |||||||| ||||||| ||||||||
BINDING SITE         3' GGCGGCGG GGCGGCG GCGGCGGC       SEQ ID:79919
                                C        AGC

CGCC
                     5' GC     ACCGCCGCCGCCGCCG  3'     SEQ ID:20604
BCRP2                   ||     |||||||||||||||
BINDING SITE         3' CG     TGGCGGCGGCGGCGGC  5'     SEQ ID:79941
                           ACCT

-      C
                     5' CCA CCGC GCCGCCGCCG  3'         SEQ ID:20604
BSG                     ||| |||| ||||||||||
BINDING SITE         3' GGT GGCG CGGCGGCGGC  5'         SEQ ID:83983
                            T    A

C    A      C
                     5' TCG CGCC CCGC GCCGCCG  3'       SEQ ID:20604
BSN                     ||| |||| |||| |||||||
BINDING SITE         3' AGC GCGG GGCG CGGCGGC  5'       SEQ ID:84199
                            C    C    A

CACC
                     5' CGCCGC     GCCGCCGCCGC  3'      SEQ ID:20604
BTG3                    ||||||     |||||||||||
BINDING SITE         3' GCGGCG     CGGCGGCGGCG  5'      SEQ ID:84854
                              A---
```

Fig. 26D/6

```
                              CACC
                    5' CGCCGC       GCCGCCGCCGC  3'        SEQ ID:20604
CHS1                   ||||||       |||||||||||
BINDING SITE        3' GCGGCG       CGGCGGCGGCG  5'        SEQ ID:84854
                          A---

G      ACC   C
                    5' TC CCGCC  GC GCCGCCGCCG   3'        SEQ ID:20604
BTG3                   || |||||  || ||||||||||
BINDING SITE        3' AG GGCGG  CG CGGCGGCGGC   5'        SEQ ID:84863
                       -    ---  A

-  CCACC
                    5' CGC CG       GCCGCCGCCGCC  3'       SEQ ID:20604
HIRA                   ||| ||       ||||||||||||
BINDING SITE        3' GCG GC       CGGCGGCGGCGG  5'       SEQ ID:85041
                        A  -----

-  C  C
                    5' GCCACCGCC GC GC GC   3'             SEQ ID:20604
CACNA1A                ||||||||| || || ||
BINDING SITE        3' CGGTGGCGG CG CG CG   5'             SEQ ID:87774
                                 A  A  A

----   CACC
                    5' CGC     CGC     GCCGCCGCCGCCG       SEQ ID:20604
CALM1                  |||     |||     ||||||||||||
BINDING SITE        3' GCG     GCG     CGGCGGCGGCGGC       SEQ ID:89443
                       ACAC    ATA-

A          ---
                    5' GCCGCC CCGCCGCC     GCCGCCG  3      SEQ ID:20604
CALM1                  |||||| ||||||||     |||||||
BINDING SITE        3' CGGCGG GGCGGCGG     CGGCGGC  5      SEQ ID:89450
                            C          ACG

A
                    5' TCGCCGCC CCGCCGCCGCCGCCG  3'        SEQ ID:20604
CACNA1A                |||||||| |||||||||||||||
BINDING SITE        3' GGCGGCGG GGCGGCGGCGGCGGC  5'        SEQ ID:94853
                                C

A
                    5' TCGCCGCC CCGCCGCCGCCGCCG  3'        SEQ ID:20604
CBL                    |||||||| |||||||||||||||
BINDING SITE        3' GGCGGCGG GGCGGCGGCGGCGGC  5'        SEQ ID:94853
                                C

A
                    5' TCGCCGCC CCGCCGCCGCCGCCG  3'        SEQ ID:20604
CBL                    |||||||| |||||||||||||||
BINDING SITE        3' GGCGGCGG GGCGGCGGCGGCGGC  5'        SEQ ID:94853
                                C
```

Fig. 26D/7

```
                    A
              5' TCGCCGCC CCGCCGCCGCCGCCG 3'      SEQ ID:20604
CBL              |||||||| |||||||||||||||
BINDING SITE  3' GGCGGCGG GGCGGCGGCGGCGGC 5'      SEQ ID:94853
                    C

A
              5' TCGCCGCC CCGCCGCCGCCGCCG 3'      SEQ ID:20604
CBL              |||||||| |||||||||||||||
BINDING SITE  3' GGCGGCGG GGCGGCGGCGGCGGC 5'      SEQ ID:94853
                    C

A
              5' TCGCCGCC CCGCCGCCGCCGCCG 3'      SEQ ID:20604
FGF18            |||||||| |||||||||||||||
BINDING SITE  3' GGCGGCGG GGCGGCGGCGGCGGC 5'      SEQ ID:94853
                    C

A
              5' TCGCCGCC CCGCCGCCGCCGCCG 3'      SEQ ID:20604
FGF18            |||||||| |||||||||||||||
BINDING SITE  3' GGCGGCGG GGCGGCGGCGGCGGC 5'      SEQ ID:94853
                    C

A
              5' TCGCCGCC CCGCCGCCGCCGCCG 3'      SEQ ID:20604
FMR1             |||||||| |||||||||||||||
BINDING SITE  3' GGCGGCGG GGCGGCGGCGGCGGC 5'      SEQ ID:94853
                    C

A
              5' TCGCCGCC CCGCCGCCGCCGCCG 3'      SEQ ID:20604
FMR1             |||||||| |||||||||||||||
BINDING SITE  3' GGCGGCGG GGCGGCGGCGGCGGC 5'      SEQ ID:94853
                    C

A
              5' TCGCCGCC CCGCCGCCGCCGCCG 3'      SEQ ID:20604
FMR1             |||||||| |||||||||||||||
BINDING SITE  3' GGCGGCGG GGCGGCGGCGGCGGC 5'      SEQ ID:94853
                    C

A
              5' TCGCCGCC CCGCCGCCGCCGCCG 3'      SEQ ID:20604
FMR1             |||||||| |||||||||||||||
BINDING SITE  3' GGCGGCGG GGCGGCGGCGGCGGC 5'      SEQ ID:94853
                    C

A
              5' TCGCCGCC CCGCCGCCGCCGCCG 3'      SEQ ID:20604
FMR1             |||||||| |||||||||||||||
BINDING SITE  3' GGCGGCGG GGCGGCGGCGGCGGC 5'      SEQ ID:94853
                    C
```

Fig. 26D/8

```
                          A
            5' TCGCCGCC CCGCCGCCGCCGCCG 3'      SEQ ID:20604
FMR1           |||||||| ||||||||||||||||
BINDING SITE 3' GGCGGCGG GGCGGCGGCGGCGGC 5'      SEQ ID:94853
                          C

A
            5' TCGCCGCC CCGCCGCCGCCGCCG 3'      SEQ ID:20604
FMR1           |||||||| ||||||||||||||||
BINDING SITE 3' GGCGGCGG GGCGGCGGCGGCGGC 5'      SEQ ID:94853
                          C

A
            5' TCGCCGCC CCGCCGCCGCCGCCG 3'      SEQ ID:20604
GSPT1          |||||||| ||||||||||||||||
BINDING SITE 3' GGCGGCGG GGCGGCGGCGGCGGC 5'      SEQ ID:94853
                          C

A
            5' TCGCCGCC CCGCCGCCGCCGCCG 3'      SEQ ID:20604
GSPT1          |||||||| ||||||||||||||||
BINDING SITE 3' GGCGGCGG GGCGGCGGCGGCGGC 5'      SEQ ID:94853
                          C

A
            5' TCGCCGCC CCGCCGCCGCCGCCG 3'      SEQ ID:20604
GSPT1          |||||||| ||||||||||||||||
BINDING SITE 3' GGCGGCGG GGCGGCGGCGGCGGC 5'      SEQ ID:94853
                          C

A
            5' TCGCCGCC CCGCCGCCGCCGCCG 3'      SEQ ID:20604
MLLT1          |||||||| ||||||||||||||||
BINDING SITE 3' GGCGGCGG GGCGGCGGCGGCGGC 5'      SEQ ID:94853
                          C

A
            5' TCGCCGCC CCGCCGCCGCCGCCG 3'      SEQ ID:20604
MLLT1          |||||||| ||||||||||||||||
BINDING SITE 3' GGCGGCGG GGCGGCGGCGGCGGC 5'      SEQ ID:94853
                          C

A
            5' TCGCCGCC CCGCCGCCGCCGCCG 3'      SEQ ID:20604
NTRK3          |||||||| ||||||||||||||||
BINDING SITE 3' GGCGGCGG GGCGGCGGCGGCGGC 5'      SEQ ID:94853
                          C

A
            5' TCGCCGCC CCGCCGCCGCCGCCG 3'      SEQ ID:20604
PPP3CA         |||||||| ||||||||||||||||
BINDING SITE 3' GGCGGCGG GGCGGCGGCGGCGGC 5'      SEQ ID:94853
                          C
```

Fig. 26D/9

```
                     A
             5' TCGCCGCC CCGCCGCCGCCGCCG 3'      SEQ ID:20604
PPP3CA          |||||||| ||||||||||||||
BINDING SITE 3' GGCGGCGG GGCGGCGGCGGCGGC 5'      SEQ ID:94853
                     C

A
             5' TCGCCGCC CCGCCGCCGCCGCCG 3'      SEQ ID:20604
PPP3CA          |||||||| ||||||||||||||
BINDING SITE 3' GGCGGCGG GGCGGCGGCGGCGGC 5'      SEQ ID:94853
                     C

A
             5' TCGCCGCC CCGCCGCCGCCGCCG 3'      SEQ ID:20604
RELN            |||||||| ||||||||||||||
BINDING SITE 3' GGCGGCGG GGCGGCGGCGGCGGC 5'      SEQ ID:94853
                     C

A
             5' TCGCCGCC CCGCCGCCGCCGCCG 3'      SEQ ID:20604
RGS19IP1        |||||||| ||||||||||||||
BINDING SITE 3' GGCGGCGG GGCGGCGGCGGCGGC 5'      SEQ ID:94853
                     C

A
             5' TCGCCGCC CCGCCGCCGCCGCCG 3'      SEQ ID:20604
RGS19IP1        |||||||| ||||||||||||||
BINDING SITE 3' GGCGGCGG GGCGGCGGCGGCGGC 5'      SEQ ID:94853
                     C

A
             5' TCGCCGCC CCGCCGCCGCCGCCG 3'      SEQ ID:20604
RGS19IP1        |||||||| ||||||||||||||
BINDING SITE 3' GGCGGCGG GGCGGCGGCGGCGGC 5'      SEQ ID:94853
                     C

A
             5' TCGCCGCC CCGCCGCCGCCGCCG 3'      SEQ ID:20604
RGS19IP1        |||||||| ||||||||||||||
BINDING SITE 3' GGCGGCGG GGCGGCGGCGGCGGC 5'      SEQ ID:94853
                     C

A
             5' TCGCCGCC CCGCCGCCGCCGCCG 3'      SEQ ID:20604
UBE2B           |||||||| ||||||||||||||
BINDING SITE 3' GGCGGCGG GGCGGCGGCGGCGGC 5'      SEQ ID:94853
                     C

A
             5' TCGCCGCC CCGCCGCCGCCGCCG 3'      SEQ ID:20604
UBE2B           |||||||| ||||||||||||||
BINDING SITE 3' GGCGGCGG GGCGGCGGCGGCGGC 5'      SEQ ID:94853
                     C
```

Fig. 26D/10

```
                        A
                  5' TCGCCGCC CCGCCGCCGCCGCCG 3'         SEQ ID:20604
UBE2B                 |||||||| ||||||||||||||
BINDING SITE      3' GGCGGCGG GGCGGCGGCGGCGGC 5'         SEQ ID:94853
                                C

A
                  5' TCGCCGCC CCGCCGCCGCCGCCG 3'         SEQ ID:20604
UBE2B                 |||||||| ||||||||||||||
BINDING SITE      3' GGCGGCGG GGCGGCGGCGGCGGC 5'         SEQ ID:94853
                                C

A
                  5' GCCGCC CCGCCGCCGCCGCCG  C           SEQ ID:20604
CAMK4                 |||||| ||||||||||||||  |
BINDING SITE      3' CGGCGG GGCGGCGGCGGCGGC  G           SEQ ID:94860
                               C

A
                  5' GCCGCC CCGCCGCCGCCGCCG  C           SEQ ID:20604
CBL                   |||||| |||||||||||||   |
BINDING SITE      3' CGGCGG GGCGGCGGCGGCGGC  G           SEQ ID:94860
                               C

CAC--
                  5' TCGCCGC    CGCCGCCGCCGCCG           SEQ ID:20604
CD47                  |||||||   ||||||||||||||
BINDING SITE      3' GGCGGCG    GCGGCGGCGGCGGC           SEQ ID:97660
                       CCCCA

---   A
                  5' TCGCC   GCC CCGCCGCCGCCGCCG         SEQ ID:20604
CDC2L1                |||||   ||| ||||||||||||||
BINDING SITE      3' GGCGG   CGG GGCGGCGGCGGCGGC         SEQ ID:99045
                       GCA   C

A---
                  5' TCGCCGCC    CCGCCGCCGCCGCCG         SEQ ID:20604
CDC2L1                ||||||||   ||||||||||||||
BINDING SITE      3' GGCGGCGG    GGCGGCGGCGGCGGC         SEQ ID:99046
                         GCAC

GCCAC
                  5' CC     CGCCGCCGCCGCCG 3'            SEQ ID:20604
CDC34                 ||     ||||||||||||||
BINDING SITE      3' GG     GCGGCGGCGGCGGC 5'            SEQ ID:99180
                       AGAC-

G  CCACC
                  5' TC CCG    GCCGCCGCCGCCG 3'          SEQ ID:20604
CDH23                 || |||   ||||||||||||||
BINDING SITE      3' AG GGC    CGGCGGCGGCGGC 5'          SEQ ID:100443
                       -  T----
```

Fig. 26D/11

```
                          A         ---
                5' CCGCC CCGCCGCCGC    CGCCG  3'       SEQ ID:20604
CDH6               ||||| ||||||||||    |||||
BINDING SITE    3' GGCGG GGCGGCGGCG    GCGGC  5'       SEQ ID:100628
                          C            CCA

A
                5' CGCC  CCGCCGCCGCC  3'               SEQ ID:20604
CDH6               ||||  |||||||||||
BINDING SITE    3' GCGG  GGCGGCGGCGG  5'               SEQ ID:100637
                         C

A
                5' CGCC  CCGCCGCCGCC  3'               SEQ ID:20604
PEA15              ||||  |||||||||||
BINDING SITE    3' GCGG  GGCGGCGGCGG  5'               SEQ ID:100637
                         C

G A
                5' GCC CC CCGCCGCCGCCG  3'             SEQ ID:20604
CDH6               ||| || ||||||||||||
BINDING SITE    3' CGG GG GGCGGCGGCGGC  5'             SEQ ID:100646
                        A C

A ----     C   C
                5' TCGCCGCC CC    GC GC GCCGCCG        SEQ ID:20604
CDK9               |||||||| ||    || || |||||||
BINDING SITE    3' GGCGGCGG GG    CG CG CGGCGGC        SEQ ID:101419
                            G TCAG A   A

A G ----    C  C
                5' TCGCCGCC CC CC    GC GC GCCG        SEQ ID:20604
CDK9               |||||||| || ||    || || ||||
BINDING SITE    3' GGCGGCGG GG GG    CG CG CGGC        SEQ ID:101421
                            C G TCAG  A  A

A       G    C-
                5' CGCCGCC CCGCC  CCG  CGC  3'         SEQ ID:20604
CDK9               ||||||| |||||  |||  |||
BINDING SITE    3' GCGGCGG GGCGG  GGT  GCG  5'         SEQ ID:101424
                          C       G    CA

C  CACC           CG
                5' TCGC GC      GCCGCCGC CC  3'        SEQ ID:20604
CDK9               |||| ||      |||||||| ||
BINDING SITE    3' AGCG CG      CGGCGGCG GG  5'        SEQ ID:101437
                     A  A---            A-

A       C---    C
                5' CCGCC CCGCCGC    GC GCCG  3'        SEQ ID:20604
CDKN2D             ||||| |||||||    || ||||
BINDING SITE    3' GGCGG GGCGGCG    CG CGGC  5'        SEQ ID:102195
                        C    ACTC    T
```

Fig. 26D/12

```
                        GCC    AC
                    5'  TC  GCC    CGCCGCCGCCGCCG              SEQ ID:20604
    CDKN2D              ||  |||    ||||||||||||||
    BINDING SITE    3'  AG  CGG    GCGGCGGCGGCGGC              SEQ ID:102235
                        ACT    AC                GA

A  C       GC
                    5'  CGCCGCC CCGC GCC    CG  3'             SEQ ID:20604
    CHN2                ||||||| |||| |||    ||
    BINDING SITE    3'  GCGGCGG GGCG CGG    GC  5'             SEQ ID:105797
                             C  A        GA

G   CAC
                    5'  TC CCGC    CGCCGCCGC   3'              SEQ ID:20604
    CHRNA3              || ||||    |||||||||
    BINDING SITE    3'  AG GGCG    GCGGCGGCG   5'              SEQ ID:106136
                          A   AA-

CCA    C
                    5'  GCCG    CCGC GCCGCCGCCG  3'            SEQ ID:20604
    CHS1                ||||    |||| ||||||||||
    BINDING SITE    3'  CGGC    GGCG CGGCGGCGGC  5'            SEQ ID:106651
                          TGC    A

CA
                    5'  CCGC    CCGCCGCCGCCGC  3'              SEQ ID:20604
    CKAP1               ||||    |||||||||||||
    BINDING SITE    3'  GGCG    GGCGGCGGCGGCG  5'              SEQ ID:107655
                             TC

CA
                    5'  CCGC    CCGCCGCCGCCGC  3'              SEQ ID:20604
    CKAP1               ||||    |||||||||||||
    BINDING SITE    3'  GGCG    GGCGGCGGCGGCG  5'              SEQ ID:107655
                             TC

A   C  C   C
                    5'  TCGCCGCC CCGC GC GC GC  3'             SEQ ID:20604
    CKAP1               |||||||| |||| || || ||
    BINDING SITE    3'  GGCGGCGG GGCG CG CG CG  5'             SEQ ID:107659
                              C   A  A   A

A    G    C
                    5'  TCGCCGCC CCGCC CCGC GCC  3'             SEQ ID:20604
    COL5A1              |||||||| ||||| |||| |||
    BINDING SITE    3'  AGCGGCGG GGCGG GGCG TGG  5'             SEQ ID:114312
                                 C     -    C

G   A     GC
                    5'  TCGCC CC CC    CGCCGCCGCCG  3'          SEQ ID:20604
    COL5A1              ||||| || ||    |||||||||||
    BINDING SITE    3'  AGCGG GG GG    GCGGCGGCGGC  5'          SEQ ID:114314
                            A   A  A-
```

Fig. 26D/13

```
                         -- CA
                  5' CGC  CGC  CCGCCGCCGCCG 3'        SEQ ID:20604
CPE               |||  |||  ||||||||||||
BINDING SITE      3' GCG  GCG  GGCGGCGGCGGC 5'        SEQ ID:116431
                         AC  A-

A   C  CG
                  5' CGCCGCC CCGC GC  CCG 3'          SEQ ID:20604
CSNK1D            ||||||| |||| ||  |||
BINDING SITE      3' GCGGCGG GGCG CG  GGC 5'          SEQ ID:120331
                        C   A  A-

A   GC   C
                  5' TCGCCGCC CCGCC CGC GC 3'         SEQ ID:20604
CUGBP1            |||||||| ||||| ||| ||
BINDING SITE      3' GGCGGCGG GGCGG GCG CG 5'         SEQ ID:122870
                         C   A-   A

CA-            C
                  5' CCGC    CCGCCGCCGC GCCG 3'       SEQ ID:20604
CUGBP1            ||||    |||||||||| ||||
BINDING SITE      3' GGCG    GGCGGCGGCG CGGC 5'       SEQ ID:122874
                       CAG            A

CG  G
                  5' CGCCGCCACCGCCGC CC CCG 3'        SEQ ID:20604
DAG1              ||||||||||||||| || |||
BINDING SITE      3' GCGGCGGTGGCGGCG GG GGC 5'        SEQ ID:127812
                                   A-  -

C   CACC  C
                  5' TCG CGC   GC GCCGCCGCCG  3       SEQ ID:20604
DAG1              ||| |||   || ||||||||||
BINDING SITE      3' AGC GCG   CG CGGCGGCGGC  5       SEQ ID:127882
                        C   CTT-  A

A    C
                  5' CGCC CCGC GCCGCCGCCG 3'          SEQ ID:20604
DDEF2             |||| |||| ||||||||||
BINDING SITE      3' GTGG GGCG CGGCGGCGGC 5'          SEQ ID:129959
                        C    A

-----          C
                  5' TCGCCGC    CACCGCCGC GCCGCC      SEQ ID:20604
DDEF2             |||||||    |||||||| ||||||
BINDING SITE      3' GGCGGCG    GTGGCGGCG CGGCGG      SEQ ID:129968
                               AGCCT         A

CA        CG
                  5' CGCCGC CCGCCGCCGC CCG 3'         SEQ ID:20604
DDEF2             |||||| |||||||||| |||
BINDING SITE      3' GCGGCG GGCGGCGGCG GGC 5'         SEQ ID:129973
                        AC        A-
```

Fig. 26D/14

```
                                G   A  -  C
                    5' TC CCGCC CC GC GCCGCCG 3'          SEQ ID:20604
DHFR                   || |||||| || || |||||||
BINDING SITE        3' AG GGCGG GG CG CGGCGGC 5'          SEQ ID:133111
                        -      -  T  A

5' TCGCCGCCACCGCCGCCGCCG 3'           SEQ ID:20604
DLG3                   |||||||||||||||||||||
BINDING SITE        3' GGCGGCGGTGGTGGCGGCGGC 5'           SEQ ID:134695

5' TCGCCGCCACCGCCGCCGCCG 3'           SEQ ID:20604
DLG3                   |||||||||||||||||||||
BINDING SITE        3' GGCGGCGGTGGCGGCGGTGGC 5'           SEQ ID:134697

G    CA     C
                    5' C CCGC CCGC GCCGCCGCCG 3'          SEQ ID:20604
DR1                    | |||| |||| ||||||||||
BINDING SITE        3' G GGCG GGCG CGGCGGCGGC 5'          SEQ ID:138522
                         G    AC     A

CA    C    C
                    5' TCGCCGC CCGC GCCGC GC 3'           SEQ ID:20604
DR1                    ||||||| |||| ||||| ||
BINDING SITE        3' GGCGGCG GGCG CGGCG CG 5'           SEQ ID:138525
                            AC    A    A

C   A      C
                    5' TCGC GCC CCGCCGC GCCGC 3'          SEQ ID:20604
DR1                    |||| ||| ||||||| |||||
BINDING SITE        3' GGCG CGG GGCGGCG CGGCG 5'          SEQ ID:138526
                           A   C      A

CA         C
                    5' GCCGC CCGCCGCCG GCCG 3'            SEQ ID:20604
DR1                    ||||| ||||||||| ||||
BINDING SITE        3' CGGCG GGCGGCGGC CGGC 5'            SEQ ID:138546
                            AC         A

A-
                    5' TCGCCGCC  CCGCCGCCGCCGCCG 3        SEQ ID:20604
DSCAM                  ||||||||  ||||||||||||||
BINDING SITE        3' GGCGGCGG  GGCGGCGGCGGCGGC 5        SEQ ID:139794
                               GC

A-
                    5' TCGCCGCC  CCGCCGCCGCCGCCG          SEQ ID:20604
DSCAM                  ||||||||  ||||||||||||||
BINDING SITE        3' GGCGGCGG  GGCGGCGGCGGCGGC          SEQ ID:139795
                               GC
```

Fig. 26D/15

```
                          A       C       --
               5' CGCCGCC CCGCCGC GCC   GCCG  3'        SEQ ID:20604
DSCAM             ||||||| ||||||| |||   ||||
BINDING SITE   3' GCGGCGG GGCGGCG CGG   CGGC  5'        SEQ ID:139808
                          C       A     AT

A  GC   -
               5' TCGCCGCC CC  CG CCG  3'               SEQ ID:20604
DSCR1             |||||||| ||  || |||
BINDING SITE   3' AGCGGCGG GG  GC GGC  5'               SEQ ID:139913
                           C  GA  A

A        C  C
               5' TCGCCGCC CCGCCGC GC GC  3'            SEQ ID:20604
DUSP5             |||||||| ||||||| || ||
BINDING SITE   3' GGCGGCGG GGCGGCG CG CG  5'            SEQ ID:141448
                           C       -  T

AC
               5' CGCCGCC  CGCCGCCGCCG  3'              SEQ ID:20604
DVL3              |||||||  |||||||||||
BINDING SITE   3' GCGGCGG  GCGGCGGCGGC  5'              SEQ ID:141937

CG  ACC
               5' GC  CC    GCCGCCGCCG  3'              SEQ ID:20604
DXYS155E          ||  ||    ||||||||||
BINDING SITE   3' CG  GG    CGGCGGCGGC  5'              SEQ ID:142341
                     CA  GTC

C    AC
               5' GC GCC  CGCCGCCGCCG  3'               SEQ ID:20604
DYRK2             || |||  |||||||||||
BINDING SITE   3' CG CGG  GCGGCGGCGGC  5'               SEQ ID:142933
                     A    CA

GCC  CACC
               5' TC GC      GCCGCCGCCGCCG  3'          SEQ ID:20604
DYRK2             || ||      |||||||||||||
BINDING SITE   3' AG CG      CGGCGGCGGCGGC  5'          SEQ ID:142953
                     AC-  C---

A           G
               5' CCGCC CCGCCGCCGCC CC  3'              SEQ ID:20604
EFNA3             ||||| ||||||||||| ||
BINDING SITE   3' GGCGG GGCGGCGGCGG GG  5'              SEQ ID:144685
                        C           G

CCA
               5' CCG    CCGCCGCCGCCG  3'               SEQ ID:20604
EFNA3             |||    |||||||||||||
BINDING SITE   3' GGC    GGCGGCGGCGGCGGC  5'            SEQ ID:144687
                        CTC
```

Fig. 26D/16

```
                          A        GCC
              5' GCCGCC CCGCCGCC    GC      3'          SEQ ID:20604
EGLN1            ||||||  ||||||||   ||
BINDING SITE  3' CGGCGG GGCGGCGG    CG      5'          SEQ ID:145984
                          C        AGT

5' TCGCCGCCACCGCCGCCGCCG      3'          SEQ ID:20604
EGR3             ||||||||||||||||||||||
BINDING SITE  3' GGCGGCGGTGGCGGCGGTGGCGGC   5'          SEQ ID:146843

5' TCGCCGCCACCGCCGCCGC CG     3'          SEQ ID:20604
EGR3             ||||||||||||||||||| ||
BINDING SITE  3' GGCGGCGGTGGCGGCGGCG GC     5'          SEQ ID:146845
                                    A

A
              5' GCCGCC CCGCCGCCGCCGCCG     3'          SEQ ID:20604
EGR3             ||||||  |||||||||||||||
BINDING SITE  3' CGGCGG GGCGGCGGTGGCGGC     5'          SEQ ID:146876
                       C

G  CCACC
              5' TC CCG       GCCGCCGCCGCCG  3'         SEQ ID:20604
EGR3             || |||       ||||||||||||
BINDING SITE  3' AG GGC       CGGCGGCGGCGGC  5'         SEQ ID:146919
                   -   TCGA-

CCA            C--
              5' CCG    CCGCCGCCGC    GCC   3'          SEQ ID:20604
EIF2C1           |||    ||||||||||    |||
BINDING SITE  3' GGC    GGCGGCGGCG    CGG   5'          SEQ ID:148159
                    AAC            CCT

C          C  C
              5' TCGC GCCACCGCCGC GC GCCG   3'          SEQ ID:20604
EIF4G1           ||||  ||||||||||  ||  ||||
BINDING SITE  3' GGTG CGGTGGCGGCG CG CGGC   5'          SEQ ID:148798
                    A           A  A

CACC   C         G
              5' TCGCCGC    GC GCCGCC CC     3'         SEQ ID:20604
EIF4G1           |||||||    || ||||||  ||
BINDING SITE  3' GGCGGCG    CG CGGCGG GG     5'         SEQ ID:148812
                         A---  A       G

C  CACC  C              -
              5' TCGC GC    GC GCCGCCGC CG   3           SEQ ID:20604
EIF4G2           |||| ||    || |||||||| ||
BINDING SITE  3' AGCG CG    CG CGGCGGTG GC   5           SEQ ID:148906
                    A  A---  T              A
```

Fig. 26D/17

```
                              A          ---
                     5' TCGCCGCC CCGCCGCC    GCCGCCG       SEQ ID:20604
EIF5A                   |||||||| ||||||||    |||||||
BINDING SITE         3' GGCGGCGG GGCGGCGG    TGGCGGC       SEQ ID:148944
                              C          AGA

A     ---
                     5' TCGCCGCC CCGCC    GCCGCCGCCG       SEQ ID:20604
EIF5A                   |||||||| |||||    ||||||||||
BINDING SITE         3' GGCGGCGG GGCGG    TGGCGGCGGC       SEQ ID:148945
                              C     AGA

CA
                     5' CCGC    CCGCCGCCGCCGCC    C  3     SEQ ID:20604
EIF5A                   ||||    ||||||||||||||       |
BINDING SITE         3' GGCG    GGCGGCGGCGGCGGC    G  5    SEQ ID:148952
                           AC

CA-    C
                     5' TCGCCGC    CCGC GCCGCCGCCG         SEQ ID:20604
EP300                   |||||||    |||| ||||||||||
BINDING SITE         3' GGCGGCG    GGCG CGGCGGCGGC         SEQ ID:151947
                                CGA    -

-    A
                     5' TCGC CGCC CCGCCGCCGCCGCCG  3       SEQ ID:20604
EZH2                    |||| |||| |||||||||||||||
BINDING SITE         3' GGCG GCGG GGCGGCGGCGGCGGC  5       SEQ ID:156540
                            C    C

G    AC-
                     5' TCGCC CC    CGCCGCCGCCGCCG  3      SEQ ID:20604
EZH2                    ||||| ||    ||||||||||||||
BINDING SITE         3' AGCGG GG    GCGGCGGCGGCGGC  5      SEQ ID:156546
                            G    CGC

G    A----
                     5' TCGCC CC       CCGCCGCCGCCGCCG     SEQ ID:20604
EZH2                    ||||| ||       |||||||||||||||
BINDING SITE         3' AGCGG GG       GGCGGCGGCGGCGGC     SEQ ID:156547
                            G    CGCGC

A            C
                     5' TCGCCGCC CCGCCGCCGC GC  3'         SEQ ID:20604
FGF18                   |||||||| |||||||||| ||
BINDING SITE         3' GGCGGCGG GGCGGCGGCG CG  5'         SEQ ID:163374
                              C            A

A            C
                     5' TCGCCGCC CCGCCGCCGC GC  3'         SEQ ID:20604
SERPINB8                |||||||| |||||||||| ||
BINDING SITE         3' GGCGGCGG GGCGGCGGCG CG  5'         SEQ ID:163374
                              C            A
```

Fig. 26D/18

```
                          A       C  C
             5' TCGCCGCC CCGCCGC GC GC    3'         SEQ ID:20604
FGF18           |||||||| ||||||| || ||
BINDING SITE 3' GGCGGCGG GGCGGCG CG CG    5'         SEQ ID:163376
                          C       A  A

G    A
             5' TC CCGCC CCGCCGCCGCCGCCG  3'         SEQ ID:20604
FGF18           || ||||| |||||||||||||||
BINDING SITE 3' GG GGCGG GGCGGCGGCGGCGGC  5'         SEQ ID:163380
                   A    C

C  CA      ---
             5' GC GC  CC     GCCGCCGCCG  3          SEQ ID:20604
FKRP            || ||  ||     ||||||||||
BINDING SITE 3' CG CG  GG     CGGCGGCGGC  5          SEQ ID:166297
                   -  AG      CGA

CG  A--           C
             5' TCGC  CC    CCGCCGCCGC GCCG          SEQ ID:20604
FLT1            ||||  ||    |||||||||| ||||
BINDING SITE 3' GGCG  GG    GGCGGCGGCG CGGC          SEQ ID:167123
                     A-  CTC           A

A   CC   G
             5' TCGCCGCC CCG GCC CCG      3'         SEQ ID:20604
FLT1            |||||||| ||| ||| |||
BINDING SITE 3' AGCGGCGG GGC CGG GGC      5'         SEQ ID:167194
                         C   --  -

A         ---
             5' TCGCCGCC CCGCCGCC    GCCGCCG         SEQ ID:20604
FMR1            |||||||| ||||||||    |||||||
BINDING SITE 3' GGCGGCGG GGCGGCGG    CGGCGGC         SEQ ID:167700
                         C          AGG

A         ---
             5' TCGCCGCC CCGCCGCC    GCCGCCG         SEQ ID:20604
FMR1            |||||||| ||||||||    |||||||
BINDING SITE 3' GGCGGCGG GGCGGCGG    CGGCGGC         SEQ ID:167700
                         C          AGG

A       G
             5' CCGCC CCGCC CCGCCGCCG     3'         SEQ ID:20604
SMURF1          ||||| ||||| |||||||||
BINDING SITE 3' GGCGG GGCGG GGCGGCGGC     5'         SEQ ID:167709
                    C     A

A
             5' TCGCCGCC CCGCCGCCGCCGCCG  3'         SEQ ID:20604
FMR1            |||||||| |||||||||||||||
BINDING SITE 3' GGCGGCGG GGCGGCGGCGGCGGC  5'         SEQ ID:167713
                         A
```

Fig. 26D/19

```
                          A
              5' TCGCCGCC  CCGCCGCCGCCGCCG  3'        SEQ ID:20604
FMR1             ||||||||  |||||||||||||||
BINDING SITE  3' GGCGGCGG  GGCGGCGGCGGCGGC  5'        SEQ ID:167713
                          A

G    A
              5' TCGCC  CC  CCGCCGCCGCCGCCG  3'       SEQ ID:20604
FMR1             |||||  ||  |||||||||||||||
BINDING SITE  3' GGCGG  GG  GGCGGCGGCGGCGGC  5'       SEQ ID:167717
                     A    C

G    A
              5' TCGCC  CC  CCGCCGCCGCCGCCG  3'       SEQ ID:20604
FMR1             |||||  ||  |||||||||||||||
BINDING SITE  3' GGCGG  GG  GGCGGCGGCGGCGGC  5'       SEQ ID:167717
                     A    C

A              G
              5' CGCCGCC  CCGCCGCCGCC  CCG  3'        SEQ ID:20604
FMR1             |||||||  |||||||||||  |||
BINDING SITE  3' GCGGCGG  GGCGGCGGCGG  GGC  5'        SEQ ID:167722
                        C              A

A              G
              5' CGCCGCC  CCGCCGCCGCC  CCG  3'        SEQ ID:20604
FMR1             |||||||  |||||||||||  |||
BINDING SITE  3' GCGGCGG  GGCGGCGGCGG  GGC  5'        SEQ ID:167722
                        C              A

A              G
              5' CGCCGCC  CCGCCGCCGCC  CCG  3'        SEQ ID:20604
GNB1             |||||||  |||||||||||  |||
BINDING SITE  3' GCGGCGG  GGCGGCGGCGG  GGC  5'        SEQ ID:167722
                        C              A

A              G
              5' CGCCGCC  CCGCCGCCGCC  CCG  3'        SEQ ID:20604
ZNF6             |||||||  |||||||||||  |||
BINDING SITE  3' GCGGCGG  GGCGGCGGCGG  GGC  5'        SEQ ID:167722
                        C              A

A            C--
              5' CGCCGCC  CCGCCGCCGC     GCCG  3      SEQ ID:20604
FMR1             |||||||  ||||||||||     ||||
BINDING SITE  3' GCGGCGG  GGCGGCGGCG     CGGC  5      SEQ ID:167723
                        C            CGA

A     GC   -
              5' TCGCCGCC  CCGCC  CGC  CGCCG  3       SEQ ID:20604
FMR1             ||||||||  |||||  |||  |||||
BINDING SITE  3' AGTGGCGG  GGCGG  GCG  GCGGC  5       SEQ ID:167756
                         C     GC    A
```

Fig. 26D/20

```
                             CACC
                    5' GCCGC       GCCGCCGCCGCCG  3'        SEQ ID:20604
FOXD2                  |||||       |||||||||||||
BINDING SITE        3' CGGCG       CGGCGGCGGCGGC  5'        SEQ ID:169035
                             A---

A---
                    5' CGCCGCC      CCGCCGCCGCCGCCG          SEQ ID:20604
FOXF1                  |||||||      |||||||||||||||
BINDING SITE        3' GCGGCGG      GGCGGCGGCGGCGGC          SEQ ID:169360
                                  AGGG

CACC
                    5' CGC        GCCGCCGCCGCCG  3'          SEQ ID:20604
FUS1                   |||        |||||||||||||
BINDING SITE        3' GCG        CGGCGGCGGCGGC  5'          SEQ ID:170829
                          TCCA

A              GCCG
                    5' GCCGCC CCGCCGCC         CCG  3'       SEQ ID:20604
FUS1                   |||||| ||||||||         |||
BINDING SITE        3' CGGCGG GGCGGCGG         GGC  5'       SEQ ID:170846
                           C             AA--

C  CACC  C         G  G
                    5' TCGC GC    GC GCCGCC CC  3'           SEQ ID:20604
FZD2                   |||| ||    || ||||||  ||
BINDING SITE        3' AGCG CG    CG CGGCGG GG  5'           SEQ ID:172450
                          A  C---  A         A

C  A
                    5' GC GCC CCGCCGCCGCCGCCG  3'            SEQ ID:20604
GABRB3                 || ||| |||||||||||||||
BINDING SITE        3' CG CGG GGCGGCGGCGGCGGC  5'            SEQ ID:173934
                          A   C

C  A
                    5' GC GCC CCGCCGCCGCCGCCG  3'            SEQ ID:20604
NPAS2                  || ||| |||||||||||||||
BINDING SITE        3' CG CGG GGCGGCGGCGGCGGC  5'            SEQ ID:173934
                          A   C

C  A
                    5' GC GCC CCGCCGCCGCCGCCG  3'            SEQ ID:20604
REPS2                  || ||| |||||||||||||||
BINDING SITE        3' CG CGG GGCGGCGGCGGCGGC  5'            SEQ ID:173934
                          A   C

C  A
                    5' GC GCC CCGCCGCCGCCGCCG  3'            SEQ ID:20604
SERPINB8               || ||| |||||||||||||||
BINDING SITE        3' CG CGG GGCGGCGGCGGCGGC  5'            SEQ ID:173934
                          A   C
```

Fig. 26D/21

```
                         C
               5' TCGCCGCCACCGCCGCCGC GC  3'        SEQ ID:20604
GAL               ||||||||||||||||||| ||
BINDING SITE   3' GGCGGCGGTGGCGGCGGCG CG  5'        SEQ ID:174735
                                     A

A
               5' GCCGCC CCGCCGCCGCC  3'            SEQ ID:20604
GAL               |||||| ||||||||||||
BINDING SITE   3' CGGCGG GGTGGCGGCGGCG  5'          SEQ ID:174743
                         C

A
               5' TCGCCGCC CCGCCGCCGCCGCCG  3'      SEQ ID:20604
GDI1              |||||||| |||||||||||||||
BINDING SITE   3' AGCGGCGG GGTGGCGGCGGCGGC  5'      SEQ ID:178360
                           C

G   CA
               5' TC CCGC   CCGCCGCCGCCGCC         SEQ ID:20604
GNB1              || ||||   ||||||||||||||
BINDING SITE   3' AG GGCG   GGCGGCGGCGGCGGC        SEQ ID:182802
                   -    AG                 G

ACC  C    CC
               5' GCCGCC   GC GCCG   GCCG  3'       SEQ ID:20604
GPRK5             ||||||   || ||||   ||||
BINDING SITE   3' CGGCGG   CG CGGC   CGGC  5'       SEQ ID:186691
                       CGA  A    CT

A  ------
               5' TCGCCGCC CC         GCCGCCGCGC   SEQ ID:20604
GSPT1             |||||||| ||         ||||||||||
BINDING SITE   3' GGCGGCGG GG         CGGCGGCGGCG  SEQ ID:189737
                           C  TCCCTT

A
               5' CGCCGCC CCGCCGCCGCCG  3'          SEQ ID:20604
GSPT1             ||||||| |||||||||||||
BINDING SITE   3' GCGGCGG GGCGGCGGCGGTG  5'         SEQ ID:189752
                           C

A    ------
               5' GCCGCC CCGCC        GCCGCCGCCG    SEQ ID:20604
GSPT1             |||||| |||||        ||||||||||
BINDING SITE   3' CGGCGG GGCGG        CGGCGGCGGC    SEQ ID:189763
                         C   TCCCTT

CACC  CG
               5' GCCGC    GC  CCGCCGCCG  3'        SEQ ID:20604
GSPT1             |||||    ||  |||||||||
BINDING SITE   3' CGGCG    CG  GGCGGCGGC  5'        SEQ ID:189764
                       ACGA  AG
```

Fig. 26D/22

```
                         C  CA
                     5' GC GC    CCGCCGCCGCCGCCG  3'        SEQ ID:20604
GSPT1                   || ||    |||||||||||||||
BINDING SITE         3' CG CG    GGCGGCGGCGGCGGC  5'        SEQ ID:189765
                         A  AG

G     A
                     5' TC CCGCC CCGCCGCCGCCGCCG  3'        SEQ ID:20604
GSPT1                   || ||||| |||||||||||||||
BINDING SITE         3' AG GGCGG GGCGGCGGCGGCGGC  5'        SEQ ID:189777
                           -     C

GC-          C--
                     5' CC    CACCGCCGC     GCCG  3'        SEQ ID:20604
GTF2I                   ||    |||||||||     ||||
BINDING SITE         3' GG    GTGGCGGCG     CGGC  5'        SEQ ID:190454
                           ACA          TAC

A        G
                     5' CGCCGCC CCGCCGCC CCG  3'            SEQ ID:20604
HCCS                    ||||||| |||||||| |||
BINDING SITE         3' GCGGCGG GGCGGCGG GGC  5'            SEQ ID:192464
                                C        -

C--     A
                     5' GC    GCC CCGCCGCCGCCGCCG  3'       SEQ ID:20604
HCN2                    ||    ||| |||||||||||||||
BINDING SITE         3' CG    CGG GGCGGCGGCGGCGGC  5'       SEQ ID:192735
                          CCT     C

C  CACC            C   -
                     5' GC GC     GCCGCCGC GC CG  3'        SEQ ID:20604
HDAC2                   || ||     |||||||| || ||
BINDING SITE         3' CG CG     CGGCGGCG CG GC  5'        SEQ ID:193593
                         A  A---           C  A

C  CACC    C  C
                     5' GC GC    GC GC GCCGCCG  3'          SEQ ID:20604
HDAC2                   || ||    || || |||||||
BINDING SITE         3' CG CG    CG CG CGGCGGC  5'          SEQ ID:193594
                         A  A--- A  A

C  CACC    C  C
                     5' GC GC    GC GC GCCGCCG  3'          SEQ ID:20604
IRS1                    || ||    || || |||||||
BINDING SITE         3' CG CG    CG CG CGGCGGC  5'          SEQ ID:193594
                         A  A--- A  A

CCACC       C
                     5' CCG         GCCGC GCCGCCG  3'       SEQ ID:20604
HIC1                    |||         ||||| |||||||
BINDING SITE         3' GGC         CGGCG CGGCGGC  5'       SEQ ID:195147
                             CCGA-        A
```

Fig. 26D/23

```
                          A            C
               5' TCGCCGCC  CCGCCGCCGC  GCCG  3'      SEQ ID:20604
HIRA              ||||||||  ||||||||||  ||||
BINDING SITE   3' GGCGGCGG  GGCGGTGGTG  CGGC  5'      SEQ ID:195839
                          C            T

CCA
               5' CG     CCGCCGCCGCCGCCG  3'          SEQ ID:20604
HIRA              ||     |||||||||||||||
BINDING SITE   3' GC     GGCGGCGGCGGCGGC  5'          SEQ ID:195850
                  C--

C           C  C
               5' TCGCCGC  ACCGCCGC  GC  GCCG  3'     SEQ ID:20604
HMGA2             |||||||  ||||||||  ||  ||||
BINDING SITE   3' GGCGGCG  TGGCGGCG  CG  CGGC  5'     SEQ ID:197765
                          A         A  T

G    A    CG         CG
               5' TC CCGCC CCGC    CCGCCGC      3     SEQ ID:20604
HMGA2             || ||||| ||||    |||||||
BINDING SITE   3' AG GGCGG GGCG    GGCGGCG      5     SEQ ID:197853
                   -       C    AT       AC

CA-
               5' CCGC     CCGCCGCCGCCG  3'           SEQ ID:20604
HPCAL1            ||||     ||||||||||||
BINDING SITE   3' GGCG     GGCGGCGGCGGC  5'           SEQ ID:201019
                    ACG

CC  C
               5' TCG  GC  ACCGCCGCCGCCGCCG  3        SEQ ID:20604
HRB               |||  ||  ||||||||||||||||
BINDING SITE   3' GGC  TG  TGGCGGCGGCGGCGGC  5        SEQ ID:201812
                      CC  T

-  CA         C   C
               5' GCC GC  CCGCCGC  GC  GC  3'         SEQ ID:20604
HS3ST3B1          ||| ||  |||||||  ||  ||
BINDING SITE   3' CGG CG  GGCGGCG  CG  CG  5'         SEQ ID:202532
                    G   CC         A   A

CCAC           G
               5' CGCCG     CGCCGCCGCC  CCG  3'       SEQ ID:20604
ING1L             |||||     ||||||||||  |||
BINDING SITE   3' GCGGC     GCGGCGGCGG  GGC  5'       SEQ ID:213784
                       A---            A

--  AC         C
               5' GCCG   CC  CGCCG  CGCCGCCG  3'      SEQ ID:20604
ING1L             ||||   ||  |||||  ||||||||
BINDING SITE   3' CGGC   GG  GCGGC  GCGGCGGC  5'      SEQ ID:213788
                       TA  C-         A
```

Fig. 26D/24

```
                        C   CACC   C
                  5' GC  GC      GC GCCGCCGCC 3'        SEQ ID:20604
IRS1                 ||  ||      || |||||||||
BINDING SITE      3' CG  CG      CG CGGCGGCGG 5'        SEQ ID:215707
                     A   A---    A

CA              C
                  5' CGC   CCGCCGCCGC GC 3'             SEQ ID:20604
KCNA6                |||   |||||||||| ||
BINDING SITE      3' GCG   GGCGGCGGCG CG 5'             SEQ ID:221336
                        AC            T

A         G  -
                  5' TCGCCGCC  CCGCCGCC CC GCC 3'       SEQ ID:20604
KCNA7                ||||||||  |||||||| || |||
BINDING SITE      3' GGCGGCGG  GGCGGCGG GG CGG 5'       SEQ ID:221548
                              C         -  T

--    A
                  5' GCC  GCC  CCGCCGCCGCCGCCG 3'       SEQ ID:20604
KCNA7                |||  |||  |||||||||||||||
BINDING SITE      3' CGG  CGG  GGCGGCGGCGGCGGC 5'       SEQ ID:221616
                             GA    -

A---
                  5' GCCGCC       CCGCCGCCGCCGCCG 3     SEQ ID:20604
KCNA7                ||||||       |||||||||||||||
BINDING SITE      3' CGGCGG       GGCGGCGGCGGCGGC 5     SEQ ID:221618
                                AGCC

A          C
                  5' GCCGCC CCGCCGC GCCGC 3'            SEQ ID:20604
KCNF1                |||||| ||||||| |||||
BINDING SITE      3' CGGCGG GGCGGCG CGGCG 5'            SEQ ID:222269
                            C          A

CACC    C    C    G
                  5' TCGCCGC      GC GC GCC CC 3'       SEQ ID:20604
KCNK3                |||||||      || || ||| ||
BINDING SITE      3' GGCGGCG      CG CG CGG GG 5'       SEQ ID:223599
                          A---   A  A     -

G    ACC         CC
                  5' TC CCGCC    GCCGCCGCCG 3'          SEQ ID:20604
KCNK3                || |||||    ||||||||||
BINDING SITE      3' AG GGCGG    CGGCGGCGGC 5'          SEQ ID:223678
                          -      GCC

CC   A    -         C
                  5' TCG   GCC  CCG  CCGCCGC  GC 3'     SEQ ID:20604
KCNK3                |||   |||  |||  |||||||  ||
BINDING SITE      3' AGC   CGG  GGC  GGCGGCG  CG 5'     SEQ ID:223685
                         --    -        C        A
```

Fig. 26D/25

```
                    5' TCGCCGCCACCGCCGCCGCCGC 3'          SEQ ID:20604
KCNMB4                 ||||||||||||||||||||||
BINDING SITE        3' GGCGGCGGTGGCGGCGGCGGCG 5'          SEQ ID:224477

A
                    5' TCGCCGCC CCGCCGCCGCCGCCG 3'         SEQ ID:20604
KCNMB4                 |||||||| |||||||||||||||
BINDING SITE        3' GGCGGCGG GGTGGCGGCGGCGGC 5'         SEQ ID:224480
                              C

A    - C  C
                    5' CGCCGCC CCGCC GC GC GCCG 3'         SEQ ID:20604
KCNS2                  ||||||| ||||| || || ||||
BINDING SITE        3' GCGGCGG GGCGG CG CG CGGC 5'         SEQ ID:224998
                           C     G T  A

GC
                    5' TCGCCGCCACC CGCCGCCG 3'             SEQ ID:20604
KRAS2                  ||||||||||| ||||||||
BINDING SITE        3' GGCGGCGGTGG GCGGCGGC 5'             SEQ ID:229032
                                AA

ACC  C   G
                    5' TCGCCGCC   GC GCC CCGCCG 3'         SEQ ID:20604
KRAS2                  ||||||||   || ||| ||||||
BINDING SITE        3' GGCGGCGG   CG CGG GGCGGC 5'         SEQ ID:229035
                             CGA  A   A

CACC    G
                    5' TCGCCGC    GCC CCGCCGCCG 3'         SEQ ID:20604
KRAS2                  |||||||    ||| |||||||||
BINDING SITE        3' GGCGGCG    CGG GGCGGCGGC 5'         SEQ ID:229036
                            ACGA   A

A    C  C   G
                    5' GCCGCC CCGC GC GCC CCG 3'           SEQ ID:20604
KRAS2                  |||||| |||| || ||| |||
BINDING SITE        3' CGGCGG GGCG CG CGG GGC 5'           SEQ ID:229050
                          C    A  A   A

A    C
                    5' TCGCCGCC CCGC GCCGCCGCCG 3'         SEQ ID:20604
KRAS2                  |||||||| |||| ||||||||||
BINDING SITE        3' AGCGGCGG GGTG CGCGGCGGC 5'          SEQ ID:229059
                             C    A

CC  CA
                    5' TCG GC  CCGCCGCCGCCGCCG 3'          SEQ ID:20604
LASS1                  ||| ||  ||||||||||||||
BINDING SITE        3' GGC CG  GGCGGCGGCGGCGGC 5'          SEQ ID:231693
                          CC  AC
```

Fig. 26D/26

```
                          AC
              5' CCGCC    CGCCGCCGCCGCCG  3'          SEQ ID:20604
LASS2            |||||    ||||||||||||||
BINDING SITE  3' GGCGG    GCGGCGGCGGCGGC  5'          SEQ ID:231822
                          CC

A              C
              5' TCGCCGCC CCGCCGCCG CGCCG  3'         SEQ ID:20604
LMO2             |||||||| ||||||||| |||||
BINDING SITE  3' GGCGGCGG GGCGGCGGC GCGGC  5'         SEQ ID:236309
                         C              A

A        C
              5' TCGCCGCC CCGCCG CGCCGCCG  3'         SEQ ID:20604
LMO2             |||||||| |||||| ||||||||
BINDING SITE  3' GGCGGCGG GGCGGC GCGGCGGC  5'         SEQ ID:236311
                         C        A

AC          CG
              5' CGCCGCC CGCCGCCGC  CC   3'           SEQ ID:20604
LMO2             ||||||| |||||||||  ||
BINDING SITE  3' GCGGCGG GCGGCGGCG  GG   5'           SEQ ID:236328
                        CA          A-

ACCG  -       G
              5' TCGCCGCC    CC GCC CCG  3'           SEQ ID:20604
LMO2             ||||||||    || ||| |||
BINDING SITE  3' AGCGGCGG    GG CGG GGC  5'           SEQ ID:236380
                       CGA-  A       A

-    CAC      CCG
              5' TCGC CGC    CGCCG    CCG  3'         SEQ ID:20604
LMO2             |||| |||    |||||    |||
BINDING SITE  3' AGCG GCG    GCGGC    GGC  5'         SEQ ID:236383
                      C    ACA       CGA

C-      A
              5' TCG    CGCC CCGCCGCCGCCGCCG  3       SEQ ID:20604
LMO2             |||    |||| ||||||||||||||
BINDING SITE  3' AGC    GCGG GGCGGCGGCGGCGGC  5       SEQ ID:236384
                        CC    C

C-      A
              5' TCG    CGCC CCGCCGCCGCCGCCG         SEQ ID:20604
LMO2             |||    |||| ||||||||||||||
BINDING SITE  3' AGC    GCGG GGCGGCGGCGGCGGC         SEQ ID:236385
                        CC    C

G    A
              5' TC CCGCC CCGCCGCCGCCGCCG  3'        SEQ ID:20604
LRP8             || ||||| ||||||||||||||
BINDING SITE  3' GG GGCGG GGCGGCGGCGGCGGC  5'        SEQ ID:238167
                     G    C
```

Fig. 26D/27

```
                    G    A
               5'  TC CCGCC CCGCCGCCGCCGCCG  3'        SEQ ID:20604
LRP8               || ||||| ||||||||||||||
BINDING SITE   3'  GG GGCGG GGCGGCGGCGGCGGC  5'        SEQ ID:238167
                    G    C

G    A
               5'  TC CCGCC CCGCCGCCGCCGCCG             SEQ ID:20604
LRP8               || ||||| ||||||||||||||
BINDING SITE   3'  GG GGCGG GGCGGCGGCGGCGGC             SEQ ID:238168
                    G    C                 GA

A         C
               5'  CGCC CCGCCGC GCCGCC  3'              SEQ ID:20604
LRP8               |||| ||||||| ||||||
BINDING SITE   3'  GCGG GGCGGCG CGGCGG  5'              SEQ ID:238188
                    C         A

G  A
               5'  GCC CC CCGCCGCCGCCGCCG     C         SEQ ID:20604
LRP8               ||| || ||||||||||||||      |
BINDING SITE   3'  CGG GG GGCGGCGGCGGCGGC     G         SEQ ID:238204
                   G  C

CA    G
               5'  GCCGC CC CCGCCGCCGCCG  3'            SEQ ID:20604
LRP8               ||||| || ||||||||||||
BINDING SITE   3'  CGGCG GG GGCGGCGGCGGC  5'            SEQ ID:238208
                        AC    G

G     CACC
               5'  TC CCGC      GCCGCCGCCGCC  3'        SEQ ID:20604
LRP8               || ||||      |||||||||||
BINDING SITE   3'  AG GGCG      CGGCGGCGGCGG  5'        SEQ ID:238239
                      G        ----

C    A      CC
               5'  TCGC GCC CCGCCG GCCGC  3'            SEQ ID:20604
MAD                |||| ||| |||||| |||||
BINDING SITE   3'  AGCG CGG GGCGGC TGGCG  5'            SEQ ID:241104
                     A    C      C-

C       CC  C-
               5'  TCGC GCCA GC  GCCGCCGCC             SEQ ID:20604
MAD1L1             |||| |||| ||  |||||||||
BINDING SITE   3'  AGCG CGGT CG  CGGCGGCGGC             SEQ ID:241126
                     T       --  AA

A         CG
               5'  CGCCGCC CCGCCGCCGC CCG  3'           SEQ ID:20604
MAF                ||||||| |||||||||| |||
BINDING SITE   3'  GCGGCGG GGCGGCGGCG GGC  5'           SEQ ID:241961
                        C         A-
```

Fig. 26D/28

```
                            A
                  5' GCCGCC CCGCCGCCGCCGCCG 3'      SEQ ID:20604
ADARB1               ||||||  ||||||||||||||||
BINDING SITE      3' CGGCGG GGCGGCGGCGGCGGC 5'      SEQ ID:241978
                            C

A
                  5' GCCGCC CCGCCGCCGCCGCCG 3'      SEQ ID:20604
BCL11B               ||||||  ||||||||||||||||
BINDING SITE      3' CGGCGG GGCGGCGGCGGCGGC 5'      SEQ ID:241978
                            C

A
                  5' GCCGCC CCGCCGCCGCCGCCG 3'      SEQ ID:20604
FMR1                 ||||||  ||||||||||||||||
BINDING SITE      3' CGGCGG GGCGGCGGCGGCGGC 5'      SEQ ID:241978
                            C

A
                  5' GCCGCC CCGCCGCCGCCGCCG 3'      SEQ ID:20604
MAF                  ||||||  ||||||||||||||||
BINDING SITE      3' CGGCGG GGCGGCGGCGGCGGC 5'      SEQ ID:241978
                            C

A
                  5' GCCGCC CCGCCGCCGCCGCCG 3'      SEQ ID:20604
NPAS2                ||||||  ||||||||||||||||
BINDING SITE      3' CGGCGG GGCGGCGGCGGCGGC 5'      SEQ ID:241978
                            C

A
                  5' GCCGCC CCGCCGCCGCCGCCG 3'      SEQ ID:20604
RELN                 ||||||  ||||||||||||||||
BINDING SITE      3' CGGCGG GGCGGCGGCGGCGGC 5'      SEQ ID:241978
                            C

A
                  5' GCCGCC CCGCCGCCGCCGCCG 3'      SEQ ID:20604
ZNF6                 ||||||  ||||||||||||||||
BINDING SITE      3' CGGCGG GGCGGCGGCGGCGGC 5'      SEQ ID:241978
                            C

G   ACC
                  5' CC CC    GCCGCCGCCGCCG  3'     SEQ ID:20604
MAFK                 || ||    ||||||||||||
BINDING SITE      3' GG GG    CGGCGGCGGCGGC  5'     SEQ ID:242287
                       -  AGC

-           G
                  5' CC GCCACCGCCGCC CCG  3'        SEQ ID:20604
MAN2A1               || ||||||||||||  |||
BINDING SITE      3' GG CGGTGGCGGCGG  GGT  5'       SEQ ID:243405
                       A
```

Fig. 26D/29

```
                              -    AC     GC
                        5' TCGC CGCC  CGCC  CGCCGCCG   3      SEQ ID:20604
MAP3K5                     |||| ||||  ||||  ||||||||
BINDING SITE            3' AGCG GCGG  GCGG  GCGGCGGC   5      SEQ ID:244540
                                C     C-    GA

A             C
                        5' TCGCCGCC CCGCCGC GCCGC    3'        SEQ ID:20604
MAP4K5                     |||||||| ||||||| |||||
BINDING SITE            3' GGCGGCGG GGCGGCG TGGTG    5'        SEQ ID:245274
                                C              -

CCA---     C
                        5' CCG      CCG CGCCGCCGCCG   3'       SEQ ID:20604
MAP4K5                     |||      ||| |||||||||||
BINDING SITE            3' GGC      GGC GCGGCGGCGGC   5'       SEQ ID:245277
                              CCAAAC     A

A           - -
                        5' TCGCCGCC CCGCCGC C GCCGC   3'       SEQ ID:20604
MAP4K5                     |||||||| ||||||| | |||||
BINDING SITE            3' AGCGGCGG GGCGGTG G CGGCG   5'       SEQ ID:245293
                                C           A T

A
                        5' TCGCCGCC CCGCCGCCGCCG   3'          SEQ ID:20604
MAP4K5                     |||||||| ||||||||||||
BINDING SITE            3' AGCGGCGG GGCGGCGGCGGC   5'          SEQ ID:245294
                                C

A  CC  C
                        5' CGCCGCC CCG  GC GCCGCCG   3'        SEQ ID:20604
MAPK1                      ||||||| |||  || ||||||||
BINDING SITE            3' GCGGCGG GGC  CG CGGCGGC   5'        SEQ ID:245382
                                  C  CA  T

C   ACC
                        5' GC GCC     GCCGCCGCCG   3'          SEQ ID:20604
MAPK1                      || |||     |||||||||
BINDING SITE            3' CG CGG     CGGCGGCGGC   5'          SEQ ID:245394
                              A   CC-

G    CA-
                        5' TC CCGC    CCGCCGCCGCCGCCG  3       SEQ ID:20604
MATK                       || ||||    |||||||||||||||
BINDING SITE            3' GG GGCG    GGCGGCGGCGGCGGC  5       SEQ ID:247365
                              A .   CGC

G   CCAC
                        5' C CCG     CGCCGCCGCCGCCG   3'       SEQ ID:20604
MID2                       | |||     ||||||||||||||
BINDING SITE            3' G GGC     GCGGCGGCGGCGGC   5'       SEQ ID:254906
                              G   CA--
```

Fig. 26D/30

```
                          AC----            C
              5' TCGCCGCC        CGCCGCCGC GCCG           SEQ ID:20604
MID2             ||||||||        ||||||||| ||||
BINDING SITE  3' GGCGGCGG        GCGGCGGCG CGGC           SEQ ID:254911
                          GCGGAA           A

C    C     C
              5' GCCGC ACCG CGCCG CGCCG    3'             SEQ ID:20604
MID2             ||||| |||| ||||| |||||
BINDING SITE  3' CGGCG TGGC GCGGC GCGGC    5'             SEQ ID:254918
                       A    A     T

A           CG
              5' TCGCCGCC CCGCCGC    CCGC   3'            SEQ ID:20604
MID2             |||||||| |||||||    ||||
BINDING SITE  3' AGCGGCGG GGCGGCG    GGTG   5'            SEQ ID:254922
                          C          AT

A---    CG    C
              5' TCGCCGCC      CCGC  CCG CGCCG            SEQ ID:20604
MID2             ||||||||      ||||  ||| |||||
BINDING SITE  3' AGCGGCGG      GGCG  GGC GCGGC            SEQ ID:254923
                          CGAC     AT    A

A         -    C
              5' TCGCCGCC CCGCCGC CG CGCCG    3           SEQ ID:20604
MLLT1            |||||||| ||||||| || |||||
BINDING SITE  3' GGCGGCGG GGCGGCG GT GCGGC    5           SEQ ID:255942
                          C        A  T

A
              5' CGCCGCC CCGCCGCCGCCGCCG    CG            SEQ ID:20604
MLLT1            ||||||| ||||||||||||||||   ||
BINDING SITE  3' GCGGCGG GGCGGCGGCGGCGGC    GC            SEQ ID:255948
                         C

A
              5' CGCCGCC CCGCCGCCGCCGCCG    CG            SEQ ID:20604
NTRK3            ||||||| ||||||||||||||||   ||
BINDING SITE  3' GCGGCGG GGCGGCGGCGGCGGC    GC            SEQ ID:255948
                         C

C  A
              5' GC GCC CCGCCGCCGCCGCCG      C            SEQ ID:20604
MLLT1            || ||| ||||||||||||||||     |
BINDING SITE  3' CG CGG GGCGGCGGCGGCGGC      G            SEQ ID:255952
                     -  C

-      A
              5' TCGC CGCC CCGCCGCCGCCGCCG               SEQ ID:20604
MLLT1            |||| |||| |||||||||||||||
BINDING SITE  3' AGCG GCGG GGCGGCGGCGGCGGC               SEQ ID:255957
                      A    C
```

Fig. 26D/31

```
                       ACC         CG
                  5' CGCCGCC    GCCGCCGC   CCG  3'      SEQ ID:20604
MPP6                 |||||||    ||||||||   |||
BINDING SITE      3' GCGGCGG    CGGCGGCG   GGC  5'      SEQ ID:259906
                       CGA         AG

A-----              C
                  5' GCCGCC       CCGCCGC GCCGCCG        SEQ ID:20604
MPP6                 ||||||       ||||||| |||||||
BINDING SITE      3' CGGCGG       GGCGGCG CGGCGGC       SEQ ID:259910
                     AGGCGC              A

G  -  AC    CGC
                  5' TC CCG CC   CGC    CGCCGCCG  3     SEQ ID:20604
MTA1L1               || ||| ||   |||    ||||||||
BINDING SITE      3' AG GGC GG   GCG    GCGGCGGC  5     SEQ ID:261852
                     -   C  GC    ACA

----          A
                  5' TCGC    CGCC CCGCCGCCGCCGCCG       SEQ ID:20604
MTMR1                ||||    |||| |||||||||||||||
BINDING SITE      3' AGCG    GCGG GGCGGCGGCGGCGGC       SEQ ID:262287
                     TCGG        C

A         G G
                  5' GCCGCC CCGCCGCC CC CCG  3'         SEQ ID:20604
MVK                  |||||| ||||||||  || |||
BINDING SITE      3' CGGCGG GGCGGCGG GG GGC  5'         SEQ ID:264118
                           C         A -

CGCCA
                  5' GC          CCGCCGCCGCCGCCG  3'    SEQ ID:20604
NCKAP1               ||          |||||||||||||||
BINDING SITE      3' CG          GGCGGCGGCGGCGGC  5'    SEQ ID:268447
                         ACCAC

-         C
                  5' CCA  CCGCCGC GCCGCCG  3'           SEQ ID:20604
NFYA                 |||  |||||||  |||||||
BINDING SITE      3' GGT  GGCGGCG CGGCGGC  5'           SEQ ID:272973
                          C         A

CA           C
                  5' TCGCCGC  CCGCCGCCGC GCCG  3'       SEQ ID:20604
NFYA                 |||||||  ||||||||||  ||||
BINDING SITE      3' GGCGGCG  GGCGGCGGTG CGGC  5'       SEQ ID:272979
                           AC           A

A            C
                  5' CGCCGCC CCGCCGCCG GC  3'           SEQ ID:20604
NPAS2                ||||||| |||||||||  ||
BINDING SITE      3' GCGGCGG GGCGGCGGCG CG  5'          SEQ ID:275935
                          C            C
```

Fig. 26D/32

```
                              C  CA
                         5' GC GC   CCGCCGCCGCCGCCG    C     SEQ ID:20604
NPAS2                       || ||   |||||||||||||||    |
BINDING SITE             3' CG CG   GGCGGCGGCGGCGGC    G     SEQ ID:275947
                              A  AC

-  CC
                         5' TCGCCGC CA  GCCGCCGCC   3'       SEQ ID:20604
NRG2                        ||||||| ||  |||||||||
BINDING SITE             3' GGCGGCG GT  CGGCGGCGC   5'       SEQ ID:279264
                                A  --

CC     C
                         5' CG   ACCG CGCCGCCGCCG   3'       SEQ ID:20604
NUP98                       ||   |||| |||||||||||
BINDING SITE             3' GC   TGGC GCGGCGGCGGC   5'       SEQ ID:281811
                              TT     A

A    CG    G
                         5' TCGCCGCC CCGC  CCGCC CC  3'      SEQ ID:20604
NUP98                       |||||||| ||||  ||||| ||
BINDING SITE             3' AGCGGCGG GGCG  GGTGG GG  5'      SEQ ID:281839
                                  C    AT    -

C   A
                         5' GC GCC  CCGCCGCCGCCGCCG  3'      SEQ ID:20604
OSR1                        || |||  |||||||||||||||
BINDING SITE             3' TG CGG  GGCGGCGGCGGCGGC  5'      SEQ ID:285281
                               T   C

A
                         5' TCGCCGCC CCGCCGCCGCCGCCG  3'     SEQ ID:20604
PACE4                       ||||||||  ||||||||||||||
BINDING SITE             3' GGCGGCGG GGCGGTGGCGGCGGC  5'     SEQ ID:287686
                                       C

A
                         5' CGCCGCC CCGCCGCCGCCGCCG  3'      SEQ ID:20604
PACE4                       |||||||  ||||||||||||||
BINDING SITE             3' GCGGCGG GGCGGCGGTGGCGGC  5'      SEQ ID:287698
                                      C

CA
                         5' CGC   CCGCCGCCGCC    3'          SEQ ID:20604
PACSIN1                     |||   ||||||||||||
BINDING SITE             3' GCG   GGCGGCGGTGGCG 5'           SEQ ID:287889
                                 AC

G    C         C
                         5' TC CCGC ACCGCCGCCGC GCCG 3'      SEQ ID:20604
PAPOLA                      || |||| ||||||||||| ||||
BINDING SITE             3' GG GGCG TGGCGGCGGCG CGGC 5'      SEQ ID:288993
                              G    T         A
```

Fig. 26D/33

```
                         A    ------
                    5' TCGCCGCC CCGCC         GCCGCCGC      SEQ ID:20604
PEA15                  |||||||| |||||         ||||||||
BINDING SITE        3' GGCGGCGG GGCGG         CGGCGGCG      SEQ ID:301501
                         C       CGAAGA

CACC
                    5' TCGCCGC       GCCGCCGCCGCCG  3'      SEQ ID:20604
PEA15                  |||||||       |||||||||||||
BINDING SITE        3' GGCGGCG       CGGCGGCGGCGGC  5'      SEQ ID:301508
                                AAGA

A          GCCG
                    5' GCCGCC CCGCCGCC    CCG   3'          SEQ ID:20604
PEA15                  |||||| ||||||||    |||
BINDING SITE        3' CGGCGG GGCGGCGG    GGC   5'          SEQ ID:301547
                           C         AGAA

- CG A
                    5' TCG C  CC CCGCCGCCGCCGCCG    3       SEQ ID:20604
PEA15                  ||| |  || |||||||||||||||
BINDING SITE        3' AGC G  GG GGCGGCGGCGGCGGC    5       SEQ ID:301572
                         C AG C

CCA
                    5' GCCG    CCGCCGCCGCCGC   3'           SEQ ID:20604
PIM1                   ||||    |||||||||||||
BINDING SITE        3' CGGC    GGCGGCGGCGGCG   5'           SEQ ID:305922
                              CAG

G      A      C
                    5' TC CCGCC CCGCCGC GCCGCCG    3        SEQ ID:20604
PIM1                   || ||||| ||||||| |||||||
BINDING SITE        3' AG GGCGG GGCGGCG CGGTGGC    5        SEQ ID:305956
                       -       C       A

CAC       C
                    5' TCGCCGC    CGCCGC GCCG  3'           SEQ ID:20604
PITPN                  |||||||    |||||| ||||
BINDING SITE        3' AGCGGCG    GCGGCG CGGC  5'           SEQ ID:306515
                              CCA       -

GCCG  AC  C  C
                    5' TC    CC CG CG CGCCGCCG  3'          SEQ ID:20604
POLI                   ||    || || || ||||||||
BINDING SITE        3' AG    GG GC GC GCGGCGGC  5'          SEQ ID:312045
                          AA-- A-  A  A

CAC---
                    5' CGCCGC       CGCCGCCGCCG             SEQ ID:20604
POLRMT                 ||||||       |||||||||||
BINDING SITE        3' GCGGCG       GCGGCGGCGGC             SEQ ID:312593
                              AGGTCC
```

Fig. 26D/34

```
                        CCA-    -
                  5' GCCG    CC GCCGCCGCGC 3'          SEQ ID:20604
PP                   ||||    || ||||||||||
BINDING SITE      3' CGGC    GG CGGCGGCGGCG 5'         SEQ ID:313812
                        CTCA   A

A
                  5' CGCCGCC CCGCCGCCGCCGCCG   C       SEQ ID:20604
CACNA1A              ||||||| ||||||||||||||    |
BINDING SITE      3' GCGGCGG GGCGGCGGCGGCGGC   G       SEQ ID:317209
                             C

A
                  5' CGCCGCC CCGCCGCCGCCGCCG   C       SEQ ID:20604
CACNA1A              ||||||| ||||||||||||||    |
BINDING SITE      3' GCGGCGG GGCGGCGGCGGCGGC   G       SEQ ID:317209
                             C

A
                  5' CGCCGCC CCGCCGCCGCCGCCG   C       SEQ ID:20604
PPP3CA               ||||||| ||||||||||||||    |
BINDING SITE      3' GCGGCGG GGCGGCGGCGGCGGC   G       SEQ ID:317209
                             C

A         C
                  5' CGCCGCC CCGCCGCCGC GC   3'        SEQ ID:20604
GABRB3               ||||||| |||||||||| ||
BINDING SITE      3' GCGGCGG GGCGGCGGCG CG   5'        SEQ ID:317210
                             C         -

A         C
                  5' CGCCGCC CCGCCGCCGC GC   3'        SEQ ID:20604
PPP3CA               ||||||| |||||||||| ||
BINDING SITE      3' GCGGCGG GGCGGCGGCG CG   5'        SEQ ID:317210
                             C         -

C    A
                  5' TCG CGCC CCGCCGCCGCCGCCG 3'       SEQ ID:20604
PPP3CA               ||| |||| |||||||||||||||
BINDING SITE      3' AGT GCGG GGCGGCGGCGGCGGC 5'       SEQ ID:317246
                         T    C

CA------
                  5' GCCGC        CCGCCGCCGCCGCCG      SEQ ID:20604
PRKAA2               |||||        |||||||||||||||
BINDING SITE      3' CGGCG        GGCGGCGGCGGCGGC      SEQ ID:318787
                         AGGCGATC

CG       -    CCGC
                  5' TCGC CCACCGCC GCCG       3'       SEQ ID:20604
PRKAA2               |||| |||||||| ||||
BINDING SITE      3' AGCG GGTGGCGG CGGC       5'       SEQ ID:318794
                         A-       A
```

Fig. 26D/35

```
                              A    C
                     5' TCGCCGCC CCGC GCCGCCG    3'      SEQ ID:20604
PSEN1                   ||||||||  ||||  |||||||
BINDING SITE         3' GGCGGCGG GGCG CGGCGGC    5'      SEQ ID:322696
                                 -  A

CA
                     5' TCGCCGC    CCGCCGCCGCCGCCG  3'   SEQ ID:20604
PTEN                    |||||||    |||||||||||||||
BINDING SITE         3' GGCGGCG    GGCGGCGGCGGCGGC  5'   SEQ ID:324380
                                CC

A      C
                     5' CGCC CCGC GCCGCCGCCG   3'        SEQ ID:20604
PTEN                    ||||  ||||  ||||||||||
BINDING SITE         3' GCGG GGCG CGGCGGCGGC   5'        SEQ ID:324398
                          C    A

CA             C-
                     5' CGCCGC  CCGCCGCCGC   GCCG   3'   SEQ ID:20604
PTEN                    ||||||  ||||||||||   ||||
BINDING SITE         3' GCGGCG  GGCGGCGGCG   CGGC   5'   SEQ ID:324399
                            AC             TC

A
                     5' GCCGCC CCGCCGCCGCCG    3'        SEQ ID:20604
PTEN                    ||||||  |||||||||||||
BINDING SITE         3' CGGCGG GGCGGCGGCGGC    5'        SEQ ID:324417
                              C

A
                     5' GCCGCC CCGCCGCCGCCG    3'        SEQ ID:20604
PTEN                    ||||||  |||||||||||||
BINDING SITE         3' CGGCGG GGCGGCGGCGGC    5'        SEQ ID:324417
                              C

G  GCCA----
                     5' TC  CC          CCGCCGCCGCCGCCG  SEQ ID:20604
PTEN                    ||  ||           ||||||||||||||
BINDING SITE         3' AG  GG          GGCGGCGGCGGCGGC  SEQ ID:324452
                            -  ACCTACAC

CACC     CG   -
                     5' TCGCCGC    GCGC  CC GCCG   3     SEQ ID:20604
PTP4A2                  |||||||    ||||  ||  ||||
BINDING SITE         3' GGCGGCG    CGCG  GG CGGC   5     SEQ ID:326495
                              A---     A-  T

CA  G     C
                     5' TCGCCGC  CC CCGC GCCGCCG    C    SEQ ID:20604
PTP4A2                  |||||||  || ||||  |||||||   |
BINDING SITE         3' GGCGGCG  GG GGCG CGGCGGC    G    SEQ ID:326499
                              AC  A     A
```

Fig. 26D/36

```
                        CACCG-- - C
               5' TCGCCGC       CC GC GCCGCCG          SEQ ID:20604
PTP4A2            |||||||       || || |||||||
BINDING SITE   3' GGCGGCG       GG CG CGGCGGC          SEQ ID:326500
                        ACGCAGA  A  A

C  A   C           CG
               5' TCGC GCC CCGC GCCGCCGC    3          SEQ ID:20604
PTP4A2            |||| ||| |||| ||||||||
BINDING SITE   3' GGCG CGG GGCG CGGCGGCG    5          SEQ ID:326502
                     A   A   A         AC

-  CA         C  G
               5' CC GC CCGCCGC GCC CCG    3'          SEQ ID:20604
PTP4A2            || || ||||||| ||| |||
BINDING SITE   3' GG CG GGCGGCG CGG GGC    5'          SEQ ID:326511
                  A  AC         A   A

CCA    -         C
               5' CGCCG   CCG CCGCCGC GCCG    3'       SEQ ID:20604
PTP4A2            |||||   ||| ||||||| ||||
BINDING SITE   3' GCGGC   GGC GGCGGCG CGGC    5'       SEQ ID:326515
                      ACG  C          A

ACC     C
               5' TCGCCGCC    GCCGC GC    3'           SEQ ID:20604
PTPN1             ||||||||    ||||| ||
BINDING SITE   3' GGCGGCGG    CGGCG CG    5'           SEQ ID:326697
                          GAT    A

CG
               5' TCGCCGCCACCGC  CCGCCG    3'          SEQ ID:20604
PTPRF             |||||||||||||  ||||||
BINDING SITE   3' GGCGGCGGTGGCG  GGCGGC    5'          SEQ ID:327695
                              AG

CA    C
               5' CCGC   CCGC GCCGCCGCCG    3'         SEQ ID:20604
PURA              ||||   |||| ||||||||||
BINDING SITE   3' GGCG   GGCG CGGCGGCGGC    5'         SEQ ID:328884
                      AC

A
               5' CGCC CCGCCGCC GCCG    3'             SEQ ID:20604
PURA              |||| |||||||| ||||
BINDING SITE   3' GCGG GGCGGCGG CGGC    5'             SEQ ID:328886
                            C    A

------- CA
               5' CGCC      GC CCGCCGCCGCCGCC          SEQ ID:20604
PX19              ||||      || ||||||||||||
BINDING SITE   3' GCGG      CG GGCGGCGGCGGCGG          SEQ ID:329171
                      GTTCGT  AC
```

Fig. 26D/37

```
                          A
              5' CGCCGCC CCGCCGCCGCCG 3'              SEQ ID:20604
PX19             ||||||| ||||||||||||
BINDING SITE  3' GCGGCGG GGCGGCGGCGGT 5'              SEQ ID:329172
                          C

C  A
              5' GC GCC CCGCCGCCGCCGCCG    C          SEQ ID:20604
PX19             || ||| ||||||||||||||||   |
BINDING SITE  3' CG CGG GGCGGCGGCGGCGGC    G          SEQ ID:329182
                  A   C

GCC
              5' TCGCCGCCACCGCCGCC    GC 3'           SEQ ID:20604
RAB1A            ||||||||||||||||     ||
BINDING SITE  3' GGCGGCGGTGGCGGCGG    CG 5'           SEQ ID:330375
                                GAA

A
              5' GCGCC CCGCCGCCGCCG 3'                SEQ ID:20604
RAB1A            |||||| ||||||||||||
BINDING SITE  3' CGGCGG GGCGGTGGCGGC 5'               SEQ ID:330388
                        C

C  CACC   C
              5' TCGC GC     GC GCCGCCGCCG 3'         SEQ ID:20604
RAB1A            |||| ||     || |||||||||||
BINDING SITE  3' AGTG CG     CG CGGCGGCGGC 5'         SEQ ID:330410
                     A  T---   A

C  CA  -
              5' CGC GC  CC GCCGCCGCCG 3'             SEQ ID:20604
RAB33A           ||| ||  || |||||||||||
BINDING SITE  3' GCG CG  GG CGGCGGCGGC 5'             SEQ ID:330765
                    A  A-  T

G   A       C  CC
              5' TC CCGCC CCGCCGC GCCG 3'             SEQ ID:20604
RAD21            || ||||| |||||||| ||||
BINDING SITE  3' AG GGCGG GGCGGTG CGGC 5'             SEQ ID:333078
                    -      C    T

G  A
              5' TCGCC CC CCGCCGCCGCCGCCG 3'          SEQ ID:20604
RASGRP1          ||||| || ||||||||||||||||
BINDING SITE  3' AGCGG GG GGTGGTGGCGGCGGC 5'          SEQ ID:336440
                        G  C

C
              5' TCGCCGC ACCGCCGCCGCCG 3'             SEQ ID:20604
LAF4             ||||||| ||||||||||||
BINDING SITE  3' GGCGGCG TGGCGGCGGCGGC 5'             SEQ ID:338574
                         A
```

Fig. 26D/38

```
                           C
                   5' TCGCCGC ACCGCCGCCGCCG 3'       SEQ ID:20604
RECK                  ||||||| |||||||||||||
BINDING SITE       3' GGCGGCG TGGCGGCGGCGGC 5'       SEQ ID:338574
                           A

C
                   5' TCGCCGC ACCGCCGCCGCCG 3'       SEQ ID:20604
RECK                  ||||||| |||||||||||||
BINDING SITE       3' GGCGGCG TGGCGGCGGCGGC 5'       SEQ ID:338574
                           A

CACC       C
                   5' GCCGC    GCCGC GCCGCCG 3'      SEQ ID:20604
RECK                  |||||    ||||| |||||||
BINDING SITE       3' CGGCG    CGGCG CGGCGGC 5'      SEQ ID:338585
                         T---       A

--   A         C
                   5' GCC  GCC CCGCCGC GCCGCCG 3'    SEQ ID:20604
RENT1                 |||  ||| ||||||| |||||||
BINDING SITE       3' CGG  CGG GGCGGCG CGGCGGC 5'    SEQ ID:339175
                        CT  C         A

A
                   5' TCGCCGCC CCGCCGCCGCCGCCG 3'    SEQ ID:20604
REPS2                 |||||||| |||||||||||||||
BINDING SITE       3' GGCGGCGG GGCGGTGGTGGCGGC 5'    SEQ ID:339240
                              C

A   C     G
                   5' CCGCC CCGC GCCGCC CCG 3'       SEQ ID:20604
REPS2                 ||||| |||| |||||| |||
BINDING SITE       3' GGCGG GGCG CGGCGG GGT 5'       SEQ ID:339246
                         C   A     A

CA      C
                   5' GCCGC  CCGC GCCGCCGCCG 3'      SEQ ID:20604
REPS2                 |||||  |||| ||||||||||
BINDING SITE       3' CGGCG  GGCG CGGCGGCGGC 5'      SEQ ID:339265
                       AC     A

-  GC   CC-
                   5' TCG CC CA    GCCGCCGCCGCCG 3'  SEQ ID:20604
REPS2                 ||| || ||    |||||||||||||
BINDING SITE       3' AGC GG GT    CGGCGGCGGCGGC     SEQ ID:339278
                       C  A-  CGA

-  ---  CA
                   5' TCG CC   GC  CCGCCGCCGCCGCCG 3' SEQ ID:20604
REPS2                 ||| ||   ||  |||||||||||||||
BINDING SITE       3' AGC GG   CG  GGCGGCGGCGGCGGC 5' SEQ ID:339279
                       C  AGT  AC
```

Fig. 26D/39

```
                          C    C
                    5' GCCGCCAC GC GCCGCCGCCG 3'         SEQ ID:20604
REV3L                  |||||||| || ||||||||||
BINDING SITE        3' CGGCGGTG CG CGGTGGCGGC 5'         SEQ ID:339991
                          A    -

A
                    5' CCGCC CCGCCGCCGCCGCCG 3'          SEQ ID:20604
RGS19IP1               ||||| ||||||||||||||
BINDING SITE        3' GGCGG GGCGGCGGCGGCGGC 5'          SEQ ID:341338
                          C

A          C      G
                    5' CGCCGCC CCGCCGC GCC CCG 3'        SEQ ID:20604
RGS19IP1               ||||||| ||||||| ||| |||
BINDING SITE        3' GCGGCGG GGCGGCG CGG GGC 5'        SEQ ID:341352
                          C       A   A

-    C              -
                    5' CC GCCA CGCCGCC GCCG 3'           SEQ ID:20604
RNF14                  || |||| ||||||| ||||
BINDING SITE        3' GG CGGT GCGGCGG CGGC 5'           SEQ ID:342895
                       A  A       T

C    CCGC       CCG
                    5' TCGC GCCA      CGCCGCCG 3'        SEQ ID:20604
ROCK2                  |||| ||||      ||||||||
BINDING SITE        3' GGCG CGGT      GCGGCGGC 5'        SEQ ID:344223
                            A   ACCA

C
                    5' CGCCGCCACCGCCGC GCC 3'            SEQ ID:20604
ROCK2                  |||||||||||||| |||
BINDING SITE        3' GCGGCGGTGGCGGCG CGG 5'            SEQ ID:344231
                                       C

A    C
                    5' GCCGCC CCGC GCCGCCGCCG 3'         SEQ ID:20604
RORA                   |||||| |||| ||||||||||
BINDING SITE        3' CGGCGG GGCG CGGCGGCGGC 5'         SEQ ID:344515
                          C   -

CCA
                    5' CCG    CCGCCGCCGCCGCC 3'          SEQ ID:20604
RPS6KA1                |||    ||||||||||||||
BINDING SITE        3' GGC    GGCGGCGGCGGCGG 5'          SEQ ID:346249
                              A--

C   C         C
                    5' CGCCACCGC GC GC GCC 3'            SEQ ID:20604
RRAS                   ||||||||| || || |||
BINDING SITE        3' GCGGTGGCG CG CG CGG 5'            SEQ ID:346568
                                 A  A  A
```

Fig. 26D/40

```
                     C   ACC            C
                 5' GC GCC     GCCGCCGC GCCG  3'      SEQ ID:20604
RRAS2               || |||     |||||||| ||||
BINDING SITE     3' CG CGG     CGGCGGCG CGGC  5'      SEQ ID:346598
                      -  CT-           A

C   CACC
                 5' GC GC       GCCGCCGCCGCCG 3'      SEQ ID:20604
RTN4                || ||       |||||||||||||
BINDING SITE     3' CG CG       CGGCGGCGGCGGC 5'      SEQ ID:347317
                     T  ACGA

C   A     CC
                 5' GC GCC CCGCCGCC  GCCG  3'         SEQ ID:20604
RTN4                || ||| ||||||||  ||||
BINDING SITE     3' CG CGG GGCGGCGG  CGGC  5'         SEQ ID:347318
                         A  C       CC
                       ˎ
                         CCA
                 5' CCG     CCGCCGCCGCCGCCG  3'       SEQ ID:20604
SAS                 |||     |||||||||||||||
BINDING SITE     3' GGC     GGCGGCGGCGGCGGC  5'       SEQ ID:349188
                         C--

A     C  C
                 5' CGCC CCGCCGC GC GC  3'            SEQ ID:20604
SERPINB8            |||| ||||||| || ||
BINDING SITE     3' GCGG GGCGGCG CG CG  5'            SEQ ID:353985
                         C      A  A

A
                 5' GCCGCC CCGCCGCCGCCGC  3'          SEQ ID:20604
REPS2               |||||| |||||||||||||
BINDING SITE     3' CGGCGG GGCGGCGGCGGCG  5'          SEQ ID:353987
                            C

A
                 5' GCCGCC CCGCCGCCGCCGC  3'          SEQ ID:20604
SERPINB8            |||||| |||||||||||||
BINDING SITE     3' CGGCGG GGCGGCGGCGGCG  5'          SEQ ID:353987
                            C

C  CA
                 5' GC GC   CCGCCGCCGCCGCCG  3'       SEQ ID:20604
GABRB3              || ||   |||||||||||||||
BINDING SITE     3' CG CG   GGCGGCGGCGGCGGC  5'       SEQ ID:353989
                     A  AC

C  CA
                 5' GC GC   CCGCCGCCGCCGCCG  3'       SEQ ID:20604
SERPINB8            || ||   |||||||||||||||
BINDING SITE     3' CG CG   GGCGGCGGCGGCGGC  5'       SEQ ID:353989
                     A  AC
```

Fig. 26D/41

```
                        --    A
                   5' GCC   GCC  CCGCCGCCGCCGCCG  3'         SEQ ID:20604
SFRP5                 |||   |||  |||||||||||||||
BINDING SITE       3' TGG   CGG  GGCGGCGGCGGCGGC  5'         SEQ ID:355430
                        GT    C

G    CA
                   5' TC CCGC     CCGCCGCCGCCG  3'           SEQ ID:20604
SGCB                  || ||||     ||||||||||||
BINDING SITE       3' AG GGCG     GGCGGCGGCGGC  5'           SEQ ID:356034
                         -    CG

ACC
                   5' CCGCC      GCCGCCGCCGCC  3'            SEQ ID:20604
SLC1A1                |||||      ||||||||||||
BINDING SITE       3' GGCGG      CGGCGGCGGTGG  5'            SEQ ID:362965
                              CAA

---            ---
                   5' TCGCCGCC    ACCGCCGCC    GCCGC         SEQ ID:20604
SLC1A1                ||||||||    |||||||||    |||||
BINDING SITE       3' AGCGGCGG    TGGTGGCGG    CGGCG         SEQ ID:362996
                                  CAG         CAA

GC   -
                   5' CC  CA  CCGCCGCCGCCGCCG  3'            SEQ ID:20604
SMARCB1               ||  ||  |||||||||||||||
BINDING SITE       3' GG  GT  GGCGGCGGCGGCGGC  5'            SEQ ID:370333
                        A-   C

C      CG
                   5' GCCGCCAC  GCCGC   CC   3'              SEQ ID:20604
SMARCC1               ||||||||  |||||   ||
BINDING SITE       3' CGGCGGTG  CGGCG   GG   5'              SEQ ID:370474
                              A       AA

CGCCACC   C
                   5' TCGC         GC  GCCGCCGCC    3        SEQ ID:20604
SNX3                  ||||         ||  |||||||||
BINDING SITE       3' AGCG         CG  CGGCGGCGG    5        SEQ ID:373083
                          ACATCGA   A

A           GCC
                   5' CCGCC  CCGCCGCC     GCCG  3'           SEQ ID:20604
SOX10                 |||||  ||||||||     ||||
BINDING SITE       3' GGCGG  GGCGGCGG     CGGC  5'           SEQ ID:374793
                         C           AGC

G  A-
                   5' TCGCC CC  CCGCCGCCGCCGCCG  3           SEQ ID:20604
SOX10                 ||||| ||  |||||||||||||||
BINDING SITE       3' AGCGG GG  GGCGGCGGCGGCGGC  5           SEQ ID:374849
                         G  CC
```

Fig. 26D/42

```
                            C   AC              CC
              5' TCGC GCC    CGCCGCCGCCG    3'         SEQ ID:20604
SOX11            |||| |||    |||||||||||
BINDING SITE  3' AGCG CGG    GCGGCGGCGGC    5'         SEQ ID:375242
                       - GC

C   A         CC    G
              5' TCGC GCC    CCGCCGCCG   GCC           SEQ ID:20604
SPG4             |||| |||    |||||||||   |||
BINDING SITE  3' AGTG CGG    GGCGGCGGT   TGG           SEQ ID:376880
                       A  C              AT GC

C   A    C         CC
              5' TCGC GCC    CCGC  GCCGCCG    3'       SEQ ID:20604
ST7              |||| |||    ||||  |||||||
BINDING SITE  3' AGCG CGG    GGCG  CGGCGGC    5'       SEQ ID:380179
                       -      C     -

C  CACC        C    CG
              5' TCGC GC        GCCGCCGC  GC       3   SEQ ID:20604
STAR             |||| ||        ||||||||  ||
BINDING SITE  3' GGCG CG        CGGCGGCG  CG       5   SEQ ID:380380
                       A  ACGA        A   AC

CACC    C
              5' GCCGC      GC GCCGCCGC      3'        SEQ ID:20604
STAR             |||||      || ||||||||
BINDING SITE  3' CGGCG      CG CGGCGGCG      5'        SEQ ID:380387
                    ACGA   A

C  CACC    C   C
              5' CGC GC          GC  GC  GCCGCCG  3'   SEQ ID:20604
STC1             ||| ||          ||  ||  |||||||
BINDING SITE  3' GCG CG          CG  CG  CGGTGGC  5'   SEQ ID:381482
                    A   ACGA   A   A

C              C   C
              5' GC GCCACCGCCGC GC GC       3'         SEQ ID:20604
STC1             || ||||||||||| || ||
BINDING SITE  3' CG CGGTGGCGGCG CG CG       5'         SEQ ID:381506
                    A            A   A

C   A    C    C   C
              5' GC GCC  CCGC  GC  GC  GC   3'         SEQ ID:20604
STC1             || |||  ||||  ||  ||  ||
BINDING SITE  3' CG CGG  GGCG  CG  CG  CG   5'         SEQ ID:381507
                     A   C     A   A   A

C   CA       C    C
              5' GC GC    CCGCCGC  GC  GC   3'         SEQ ID:20604
STAR             || ||    |||||||  ||  ||
BINDING SITE  3' CG CG    GGCGGCG  CG  CG   5'         SEQ ID:381508
                     A  AC         A   A
```

Fig. 26D/43

```
                              C  CA         C   C
                        5' GC GC  CCGCCGC  GC  GC  3'      SEQ ID:20604
STC1                       || ||  |||||||  ||  ||
BINDING SITE            3' CG CG  GGCGGCG  CG  CG  5'      SEQ ID:381508
                           A  AC           A   A

CG-       CC               CC
                        5' TCGC    CCA    GCCGCCGCCG          3'      SEQ ID:20604
SYK                        ||||    |||    ||||||||||
BINDING SITE            3' AGCG    GGT    CGGCGGCGGC          5'      SEQ ID:384918
                                   AGA    --

C    A      C
                        5' TCG CGCC CCGC GCCGCCGCCG    3      SEQ ID:20604
SYNGR2                     ||| |||| |||| ||||||||||
BINDING SITE            3' GGC GCGG GGCG CGGCGGCGGC    5      SEQ ID:385461
                               A    C    A

ACC
                        5' TCGCCGCC    GCCGCCGCCGC    3'     SEQ ID:20604
SYNGR2                     ||||||||    |||||||||||
BINDING SITE            3' AGCGGCGG    CGGCGGCGGCG    5'     SEQ ID:385484
                               CGA

CCA          C
                        5' TCGCCG    CCGCCGC GCCGCCG    3'     SEQ ID:20604
SYNGR2                     ||||||    ||||||| |||||||
BINDING SITE            3' AGCGGC    GGCGGCG CGGCGGC    5'     SEQ ID:385485
                                AGC         A

A       CG    -
                        5' GCCGCC  CCGCCGC  CC  GC   3'      SEQ ID:20604
TBL3                       ||||||  |||||||  ||  ||
BINDING SITE            3' CGGCGG  GGCGGCG  GG  CG   5'      SEQ ID:388909
                               C        A-   T

5' TCGCCGCCACCGCCGCCGCC    3'      SEQ ID:20604
TCF4                       ||||||||||||||||||||
BINDING SITE            3' GGCGGCGGTGGCGGCGGCGG    5'      SEQ ID:390926

A
                        5' CCGCC CCGCCGCCGCCGCCG    3'      SEQ ID:20604
TCF4                       ||||| |||||||||||||||
BINDING SITE            3' GGCGG GGCGGTGGCGGCGGC    5'      SEQ ID:390929
                                 C

G  A
                        5' GCC CC CCGCCGCCGCCGCCG    3'      SEQ ID:20604
TCF4                       ||| || |||||||||||||||
BINDING SITE            3' CGG GG GGCGGCGGCGGCGGC    5'      SEQ ID:390953
                               A  -
```

Fig. 26D/44

```
                        G     A
              5' TC CCGCC  CCGCCGCCGCCG      C       SEQ ID:20604
TCF4             || |||||  ||||||||||||      |
BINDING SITE  3' AG GGCGG  GGCGGCGGCGGC      G       SEQ ID:390956
                        G     C

C
              5' TCGCCGCCACCGCCGCCGC GCCG  3'        SEQ ID:20604
THOP1            |||||||||||||||||||| ||||
BINDING SITE  3' GGCGGCGGTGGCGGCGGTG CGGC  5'        SEQ ID:396604
                                         C

-   ACC
              5' CC GCC    GCCGCCGCCG  3'            SEQ ID:20604
TIF1             || |||    ||||||||||
BINDING SITE  3' GG CGG    CGGCGGCGGC  5'            SEQ ID:397065
                    A    GAA

CACC           C
              5' GCCGC    GCCGCCGC GCCG  3'          SEQ ID:20604
TIMP3            |||||    |||||||| ||||
BINDING SITE  3' CGGCG    CGGCGGCG CGGC  5'          SEQ ID:397666
                   ACGA           A

C  A   C   CC
              5' GC GCC CCGC GCCG  GC  3'            SEQ ID:20604
TIMP3            || ||| |||| ||||  ||
BINDING SITE  3' CG CGG GGCG CGGC  CG  5'            SEQ ID:397672
                 A   C   A   CC

A    -   C
              5' GCCGCC CCGC CGC GCCG  3'            SEQ ID:20604
TMPO             |||||| |||| ||| ||||
BINDING SITE  3' CGGCGG GGCG GTG CGGC  5'            SEQ ID:400315
                      C    A   -

G   A-          C
              5' TC CCGCC  CCGCCGCCG GCCG  3         SEQ ID:20604
U2AF1            || |||||  ||||||||| ||||
BINDING SITE  3' AG GGTGG  GGCGGCGGC CGGC  5         SEQ ID:411863
                     -     GC         A

CGCCAC-
              5' TCGC       CGCCGCCGCCG              SEQ ID:20604
UBE2B            ||||       |||||||||||
BINDING SITE  3' AGTG       GCGGCGGCGGC              SEQ ID:412149
                     ACACCTA

A
              5' TCGCCGCC CCGCCGCCGCCGCCG   C        SEQ ID:20604
MLLT1            |||||||| |||||||||||||||   |
BINDING SITE  3' AGCGGCGG GGCGGCGGCGGCGGC   G        SEQ ID:412156
                                        C
```

Fig. 26D/45

```
                              A
                 5' TCGCCGCC CCGCCGCCGCCG       C      SEQ ID:20604
UBE2B               |||||||| ||||||||||||      |
BINDING SITE     3' AGCGGCGG GGCGGCGGCGGC       G      SEQ ID:412156
                              C

A          CCG
                 5' TCGCCGCC CCGCCGCCG         C       SEQ ID:20604
UBE2B               |||||||| |||||||||         |
BINDING SITE     3' AGCGGCGG GGCGGCGGC         G       SEQ ID:412157
                              C         G

ACC      C
                 5' GCCGCC    GCCGC GCCGCCG    C       SEQ ID:20604
UFD1L               ||||||    ||||| |||||||    |
BINDING SITE     3' CGGCGG    CGGCG CGGCGGC    G       SEQ ID:414051
                         CGA      A

CA       C       --
                 5' GCCGC  CCGCCGC GCC  GCCG  3'       SEQ ID:20604
UFD1L               |||||  ||||||| |||  ||||
BINDING SITE     3' CGGCG  GGCGGCG CGG  CGGC  5'       SEQ ID:414052
                       AC       -       TT

G  -  A    C       C
                 5' TC CC GCC CCGC GCCGC GCCG          SEQ ID:20604
UFD1L               || || ||| |||| ||||| ||||
BINDING SITE     3' AG GG CGG GGCG CGGCG CGGC          SEQ ID:414064
                       -  T  C    A       A

C   A    C    GC
                 5' GC GCC CCGC GCC  CGCCG   3'        SEQ ID:20604
UNC119              || ||| |||| |||  |||||
BINDING SITE     3' CG CGG GGCG CGG  GCGGC   5'        SEQ ID:414673
                       A   C    A    AC

C  CACC          C
                 5' GC GC       GCCGCCG GCC   3'       SEQ ID:20604
UNC119              || ||       ||||||| |||
BINDING SITE     3' CG CG       CGGCGGCG CGG  5'       SEQ ID:414674
                       A  A---          A

-  CACC   C
                 5' TCGCC GC   GC GCCGCCGC  3'         SEQ ID:20604
UNC119              ||||| ||   || ||||||||
BINDING SITE     3' AGCGG CG   CG CGGCGGCG  5'         SEQ ID:414696
                       A  A--- A

A    CC
                 5' GCCGCC CCG  GCCGCCG   3'           SEQ ID:20604
USP11               |||||| |||  |||||||
BINDING SITE     3' CGGCGG GGT  CGGCGGC   5'           SEQ ID:415547
                            C   AT
```

Fig. 26D/46

```
                          ACC         C
                  5' TCGCCGCC    GCCGCCGC GCCG  3'        SEQ ID:20604
UVRAG                ||||||||    |||||||| ||||
BINDING SITE      3' GGCGGCGG    CGGCGGCG CGGC  5'        SEQ ID:416390
                                 CGA         A

CA         C
                  5' TCGCCGC  CCGCCGC GCCGCCG  3'         SEQ ID:20604
UVRAG                |||||||  ||||||| |||||||
BINDING SITE      3' GGCGGCG  GGCGGCG CGGCGGC  5'         SEQ ID:416391
                           AC        A

CA         CC
                  5' TCGCCGC  CCGCC  GCCGCCG  3'          SEQ ID:20604
UVRAG                |||||||  |||||  |||||||
BINDING SITE      3' GGCGGCG  GGCGG  CGGCGGC  5'          SEQ ID:416392
                           AC        AA

CA          C
                  5' CCGC  CCGCCGC GCCGCCG  3'            SEQ ID:20604
UVRAG                ||||  ||||||| |||||||
BINDING SITE      3' GGCG  GGCGGCG CGGCGGC  5'            SEQ ID:416394
                        AC         A

C   A   CC         CG
                  5' TCGC GCC CCG    GCCGCCGC   3         SEQ ID:20604
UVRAG                |||| ||| |||    ||||||||
BINDING SITE      3' GGCG CGG GGC    CGGCGGCG   5         SEQ ID:416396
                        A   C   AA         AC

A       C
                  5' GCCGCC CCGC GCCGCCGC  3'             SEQ ID:20604
UVRAG                |||||| |||| ||||||||
BINDING SITE      3' CGGCGG GGCG CGGCGGCG  5'             SEQ ID:416411
                           C       A

ACC         CC
                  5' GCCGCC    GCCGCCG  GCCG   3'         SEQ ID:20604
UVRAG                ||||||    |||||||  ||||
BINDING SITE      3' CGGCGG    CGGCGGC  CGGC   5'         SEQ ID:416412
                           CGA         AA

C  CACC
                  5' CGC GC       GCCGCCGCCGCC  3'        SEQ ID:20604
VAMP5                ||| ||       ||||||||||||
BINDING SITE      3' GCG CG       CGGCGGCGGCGG  5'        SEQ ID:416481
                         A A---

A---       CG-
                  5' TCGCCGCC    CCGC    CCGCCGCCG        SEQ ID:20604
VEGF                 ||||||||    ||||    |||||||||
BINDING SITE      3' AGCGGCGG    GGTG    GGCGGCGGC        SEQ ID:417797
                             CGCA       ACA
```

Fig. 26D/47

```
                            A      ------
                  5' TCGCCGCC CCGCC      GCCGCCGC          SEQ ID:20604
WHSC1L1              ||||||||  |||||     ||||||||
BINDING SITE      3' GGCGGCGG GGCGG      CGGCGGCG          SEQ ID:422800
                            C      AGAGGG

A      G---
                  5' TCGCCGCC CCGCC      CCGCCGCCG         SEQ ID:20604
WHSC1L1              ||||||||  |||||    |||||||||
BINDING SITE      3' GGCGGCGG GGCGG     GGCGGCGGC          SEQ ID:422801
                            C      AGAG

CACC           C
                  5' TCGCCGC     GCCGCCGC GC    3'         SEQ ID:20604
WHSC1L1              |||||||     ||||||||  ||
BINDING SITE      3' AGCGGCG     CGGCGGCG CG    5'         SEQ ID:422875
                       ----            A

C  CACC           CCG
                  5' TCGC GC     GCCGCCGCCG    3'          SEQ ID:20604
YWHAH                |||| ||     ||||||||||
BINDING SITE      3' AGCG CG     CGGCGGCGGC    5'          SEQ ID:426949
                       A  CCTC

A     G    CC
                  5' TCGCCGCC CCGCC CCG  GCCG  3'          SEQ ID:20604
ZNF6                 ||||||||  |||||  |||  ||||
BINDING SITE      3' GGCGGCGG GGCGG GGC  CGGC  5'          SEQ ID:432632
                            C     A    A-

ACC
                  5' TCGCCGCC    GCCGCCGCCGC   3'          SEQ ID:20604
ZNF6                 ||||||||    ||||||||||
BINDING SITE      3' GGCGGCGG    CGGCGGCGGCG   5'          SEQ ID:432637
                              CGA

CA
                  5' TCGCCGC   CCGCCGCCGCCGCCG  3'         SEQ ID:20604
ADARB1               |||||||   |||||||||||||||
BINDING SITE      3' GGCGGCG   GGCGGCGGCGGCGGC  5'         SEQ ID:432641
                              AC

CA
                  5' TCGCCGC   CCGCCGCCGCCGCCG  3'         SEQ ID:20604
BCL11B               |||||||   |||||||||||||||
BINDING SITE      3' GGCGGCG   GGCGGCGGCGGCGGC  5'         SEQ ID:432641
                              AC

CA
                  5' TCGCCGC   CCGCCGCCGCCGCCG  3'         SEQ ID:20604
BCR                  |||||||   |||||||||||||||
BINDING SITE      3' GGCGGCG   GGCGGCGGCGGCGGC  5'         SEQ ID:432641
                              AC
```

Fig. 26D/48

```
                          CA
                   5' TCGCCGC   CCGCCGCCGCCGCCG 3'      SEQ ID:20604
BCR                   |||||||   |||||||||||||||
BINDING SITE       3' GGCGGCG   GGCGGCGGCGGCGGC 5'      SEQ ID:432641
                          AC

CA
                   5' TCGCCGC   CCGCCGCCGCCGCCG 3'      SEQ ID:20604
ZNF6                  |||||||   |||||||||||||||
BINDING SITE       3' GGCGGCG   GGCGGCGGCGGCGGC 5'      SEQ ID:432641
                          AC

CA            C
                   5' TCGCCGC   CCGCCGCCGC GCCG 3'      SEQ ID:20604
ZNF6                  |||||||   |||||||||| ||||
BINDING SITE       3' GGCGGCG   GGCGGCGGCG CGGC 5'      SEQ ID:432642
                          AC             A

C   A
                   5' TCGC GCC CCGCCGCCGCCGCCG  3      SEQ ID:20604
ADARB1                |||| ||| |||||||||||||||
BINDING SITE       3' GGCG CGG GGCGGCGGCGGCGGC  5      SEQ ID:432644
                        A   C

C   A
                   5' TCGC GCC CCGCCGCCGCCGCCG  3      SEQ ID:20604
BCL11B                |||| ||| |||||||||||||||
BINDING SITE       3' GGCG CGG GGCGGCGGCGGCGGC  5      SEQ ID:432644
                        A   C

C   A
                   5' TCGC GCC CCGCCGCCGCCGCCG  3      SEQ ID:20604
BCR                   |||| ||| |||||||||||||||
BINDING SITE       3' GGCG CGG GGCGGCGGCGGCGGC  5      SEQ ID:432644
                        A   C

C   A
                   5' TCGC GCC CCGCCGCCGCCGCCG  3      SEQ ID:20604
BCR                   |||| ||| |||||||||||||||
BINDING SITE       3' GGCG CGG GGCGGCGGCGGCGGC  5      SEQ ID:432644
                        A   C

C   A
                   5' TCGC GCC CCGCCGCCGCCGCCG  3      SEQ ID:20604
REPS2                 |||| ||| |||||||||||||||
BINDING SITE       3' GGCG CGG GGCGGCGGCGGCGGC  5      SEQ ID:432644
                        A   C

C   A
                   5' TCGC GCC CCGCCGCCGCCGCCG  3      SEQ ID:20604
ZNF6                  |||| ||| |||||||||||||||
BINDING SITE       3' GGCG CGG GGCGGCGGCGGCGGC  5      SEQ ID:432644
                        A   C
```

Fig. 26D/49

```
                      C   A        C
              5' TCGC GCC CCGCCGC GCCGCCG      3'        SEQ ID:20604
ZNF6             |||| |||  ||||||| |||||||
BINDING SITE  3' GGCG CGG GGCGGCG CGGCGGC      5'        SEQ ID:432645
                      A   C        A

A       C
              5' GCCGCC CCGC GCCGCCGCCG        3'        SEQ ID:20604
ZNF6             |||||| ||||  ||||||||||
BINDING SITE  3' CGGCGG GGCG CGGCGGCGGC        5'        SEQ ID:432654
                        C   A

A       C
              5' GCCGCC CCGC GCCGCCGCCG        3'        SEQ ID:20604
ZNF6             |||||| ||||  ||||||||||
BINDING SITE  3' CGGCGG GGCG CGGCGGCGGC        5'        SEQ ID:432654
                        C   A

C   A        C
              5' GC GCC CCGCCGC GCCGCCG        3'        SEQ ID:20604
ZNF6             || ||| ||||||| |||||||
BINDING SITE  3' CG CGG GGCGGCG CGGCGGC        5'        SEQ ID:432655
                    A   C        A

A         C
              5' CCGCC CCGCCGCCGC GC           3'        SEQ ID:20604
RELN             ||||| |||||||||| ||
BINDING SITE  3' GGCGG GGCGGCGGCG CG           5'        SEQ ID:547115
                           C       -

CA    C
              5' CCGC CCGC GCCGCCGCCG          3'        SEQ ID:20604
DR1              |||| ||||  ||||||||||
BINDING SITE  3' GGCG GGCG CGGCGGCGGC          5'        SEQ ID:625767
                      AC   A

A          GC
              5' CCGCC CCGCCGCCGCC C           3'        SEQ ID:20604
SOX10            ||||| |||||||||||| |
BINDING SITE  3' GGCGG GGCGGCGGCGG G           5'        SEQ ID:717573
                         C          A

G   A
              5' TC CCGCC CCGCCGCCGCCGCCG      C         SEQ ID:20604
ADRBK1           || |||||  ||||||||||||||||   |
BINDING SITE  3' AG GGCGG GGCGGCGGCGGCGGC      G         SEQ ID:816521
                         -       C

G   A
              5' TC CCGCC CCGCCGCCGCCGCCG      C         SEQ ID:20604
PEA15            || |||||  ||||||||||||||||   |
BINDING SITE  3' AG GGCGG GGCGGCGGCGGCGGC      G         SEQ ID:816521
                         -       C
```

Fig. 26D/50

```
                           A
                  5' TCGCCGCC CCGCCGCCGCCGCCG   C      SEQ ID:20604
ADRBA1               |||||||| |||||||||||||||   |
BINDING SITE      3' GGCGGCGG GGCGGCGGCGGCGGC   G      SEQ ID:844404
                           C

A
                  5' TCGCCGCC CCGCCGCCGCCGCCG   C      SEQ ID:20604
FOXF1                |||||||| |||||||||||||||   |
BINDING SITE      3' GGCGGCGG GGCGGCGGCGGCGGC   G      SEQ ID:844404
                           C

5' TCGCCGCCACCGCCGCCG   3'          SEQ ID:20604
CHIC2                ||||||||||||||||||
BINDING SITE      3' AGCGGCGGTGGCGGCGGC   5'          SEQ ID:893635

A
                  5' TCGCCGCC CCGCCGCCGCCGC   3'      SEQ ID:20604
MAP4K5               |||||||| |||||||||||||
BINDING SITE      3' AGCGGCGG GGCGGCGGCGGCG   5'      SEQ ID:918189
                           C

CA   C     C
                  5' CCGC  CCGC GCCGC GCCG   3'       SEQ ID:20604
ATP2B2               ||||  |||| ||||| ||||
BINDING SITE      3' GGCG  GGCG CGGCG CGGC   5'       SEQ ID:947819
                         AC   A     A

C    CACC
                  5' GC GC       GCCGCCGCCGCCG   3'   SEQ ID:20604
SERPINB8             || ||       |||||||||||||
BINDING SITE      3' CG CG       CGGCGGCGGCGGC   5'   SEQ ID:950359
                        A    ACGA

C    CACC   C
                  5' GC GC      GC GCCGCCGCCG   3'    SEQ ID:20604
SERPINB8             || ||      || ||||||||||
BINDING SITE      3' CG CG      CG CGGCGGCGGC   5'    SEQ ID:950360
                        A    ACGA  A

G    A
                  5' TC CCGCC CCGCCGCCGCCGCCG   C     SEQ ID:20604
FOXF1                || ||||| |||||||||||||||   |
BINDING SITE      3' GG GGCGG GGCGGCGGCGGCGGC   G     SEQ ID:969275
                        G    C

G    A
                  5' TC CCGCC CCGCCGCCGCCGCCG   C     SEQ ID:20604
MMP2                 || ||||| |||||||||||||||   |
BINDING SITE      3' GG GGCGG GGCGGCGGCGGCGGC   G     SEQ ID:969275
                        G    C
```

Fig. 26D/51

```
                              A
                5' TCGCCGCC CCGCCGCCGCCGC 3'         SEQ ID:20604
CACNA1A            |||||||| |||||||||||||
BINDING SITE    3' GGCGGCGG GGCGGCGGCGGCG 5'         SEQ ID:969284
                              C

A
                5' TCGCCGCC CCGCCGCCGCCGC 3'         SEQ ID:20604
CAMK4              |||||||| |||||||||||||
BINDING SITE    3' GGCGGCGG GGCGGCGGCGGCG 5'         SEQ ID:969284
                              C

A
                5' TCGCCGCC CCGCCGCCGCCGC 3'         SEQ ID:20604
FGF18              |||||||| |||||||||||||
BINDING SITE    3' GGCGGCGG GGCGGCGGCGGCG 5'         SEQ ID:969284
                              C

A
                5' TCGCCGCC CCGCCGCCGCCGC 3'         SEQ ID:20604
RGS19IP1           |||||||| |||||||||||||
BINDING SITE    3' GGCGGCGG GGCGGCGGCGGCG 5'         SEQ ID:969284
                              C

A         C
                5' TCGCCGCC CCGCCGCCGC GCCG 3'       SEQ ID:20604
LRP8               |||||||| |||||||||| ||||
BINDING SITE    3' GGCGGCGG GGCGGCGGCG CGGC 5'       SEQ ID:969288
                              C         A

A         C
                5' TCGCCGCC CCGCCGCCGC GCCG 3'       SEQ ID:20604
REPS2              |||||||| |||||||||| ||||
BINDING SITE    3' GGCGGCGG GGCGGCGGCG CGGC 5'       SEQ ID:969288
                              C         A

A           C
                5' CGCC CCGCCGCCGC GC 3'             SEQ ID:20604
CRAT               |||| |||||||||| ||
BINDING SITE    3' GCGG GGCGGCGGCG CG 5'             SEQ ID:982983
                          C           C

A
                5' CCGCC CCGCCGCCGCCG 3'             SEQ ID:20604
PX19               ||||| |||||||||||||
BINDING SITE    3' GGCGG GGCGGCGGCGGT 5'             SEQ ID:993966
                              C

C   ACC
                5' TCGC GCC    GCCGCCGCCGG 3'        SEQ ID:20604
ADAM10             |||| |||    |||||||||||
BINDING SITE    3' GGCG CGG    CGGCGGCGGCC 5'        SEQ ID:993970
                       A   CGA
```

Fig. 26D/52

```
                         C   ACC
                      5' TCGC GCC    GCCGCCGCCGCCG      3        SEQ ID:20604
REPS2                    |||| |||    |||||||||||||
BINDING SITE          3' GGCG CGG    CGGCGGCGGCGGC      5        SEQ ID:993970
                         A    CGA

A
                      5' CCGCC CCGCCGCCGCCGCC    C   3           SEQ ID:20604
EXTL3                    ||||| |||||||||||||||   |
BINDING SITE          3' GGCGG GGCGGCGGCGGCGGC   G   5           SEQ ID:1065873
                               C

A              C
                      5' CGCC CCGCCGCCGC GCC    3'                SEQ ID:20604
CAMK4                    |||| |||||||||| |||
BINDING SITE          3' GCGG GGCGGCGGCG CGG    5'                SEQ ID:1295963
                            C              A

A
                      5' CGCC CCGCCGCCGCCGCC    3'                SEQ ID:20604
EXTL3                    |||| ||||||||||||||
BINDING SITE          3' GCGG GGCGGCGGCGGCGG    5'                SEQ ID:1310953
                            C

CA
                      5' GCCGC    CCGCCGCCGCCGCCG    3'           SEQ ID:20604
REPS2                    |||||    |||||||||||||||
BINDING SITE          3' CGGCG    GGCGGCGGCGGCGGC    5'           SEQ ID:1323750
                              AC

A
                      5' CGCCGCC CCGCCGCCGCCG    3'               SEQ ID:20604
FAF1                     ||||||| ||||||||||||
BINDING SITE          3' GTGGCGG GGCGGCGGCGGC    5'               SEQ ID:46198
                             C

A
                      5' CGCCGCC CCGCCGCCGCCG    3'               SEQ ID:20604
FLJ12377                 ||||||| ||||||||||||
BINDING SITE          3' GTGGCGG GGCGGCGGCGGC    5'               SEQ ID:46198
                             C

A
                      5' TCGCCGCC CCGCCGCCGCCGCCG    3'           SEQ ID:20604
CHSY1                    |||||||| |||||||||||||||
BINDING SITE          3' GGCGGCGG GGCGGCGGCGGCGGC    5'           SEQ ID:94853
                              C

A
                      5' TCGCCGCC CCGCCGCCGCCGCCG    3'           SEQ ID:20604
CHSY1                    |||||||| |||||||||||||||
BINDING SITE          3' GGCGGCGG GGCGGCGGCGGCGGC    5'           SEQ ID:94853
                              C
```

Fig. 26D/53

```
                              A
              5' TCGCCGCC CCGCCGCCGCCGCCG 3'        SEQ ID:20604
FLJ21588         |||||||| ||||||||||||||||
BINDING SITE  3' GGCGGCGG GGCGGCGGCGGCGGC 5'        SEQ ID:94853
                              C

A
              5' TCGCCGCC CCGCCGCCGCCGCCG 3'        SEQ ID:20604
MGC10702         |||||||| ||||||||||||||||
BINDING SITE  3' GGCGGCGG GGCGGCGGCGGCGGC 5'        SEQ ID:94853
                              C

A
              5' TCGCCGCC CCGCCGCCGCCGCCG 3'        SEQ ID:20604
QKI              |||||||| ||||||||||||||||
BINDING SITE  3' GGCGGCGG GGCGGCGGCGGCGGC 5'        SEQ ID:94853
                              C

A
              5' TCGCCGCC CCGCCGCCGCCGCCG 3'        SEQ ID:20604
STK39            |||||||| ||||||||||||||||
BINDING SITE  3' GGCGGCGG GGCGGCGGCGGCGGC 5'        SEQ ID:94853
                              C

A
              5' TCGCCGCC CCGCCGCCGCCGCCG 3'        SEQ ID:20604
STK39            |||||||| ||||||||||||||||
BINDING SITE  3' GGCGGCGG GGCGGCGGCGGCGGC 5'        SEQ ID:94853
                              C

A
              5' TCGCCGCC CCGCCGCCGCCGCCG 3'        SEQ ID:20604
STK39            |||||||| ||||||||||||||||
BINDING SITE  3' GGCGGCGG GGCGGCGGCGGCGGC 5'        SEQ ID:94853
                              C

A
              5' GCCGCC CCGCCGCCGCCGCCG   C        SEQ ID:20604
FLJ10996         |||||| ||||||||||||||||  |
BINDING SITE  3' CGGCGG GGCGGCGGCGGCGGC   G        SEQ ID:94860
                            C

A
              5' GCCGCC CCGCCGCCGCCGCCG   C        SEQ ID:20604
FLJ21588         |||||| ||||||||||||||||  |
BINDING SITE  3' CGGCGG GGCGGCGGCGGCGGC   G        SEQ ID:94860
                            C

A
              5' GCCGCC CCGCCGCCGCCGCCG   C        SEQ ID:20604
MGC4796          |||||| ||||||||||||||||  |
BINDING SITE  3' CGGCGG GGCGGCGGCGGCGGC   G        SEQ ID:94860
                            C
```

Fig. 26D/54

```
                          G    A
                     5' TC CCGCC CCGCCGCCGCCGCCG 3'      SEQ ID:20604
OATPRP4                 || ||||| |||||||||||||||
BINDING SITE         3' GG GGCGG GGCGGCGGCGGCGGC 5'      SEQ ID:163380
                          A         C

A                G
                     5' CGCCGCC CCGCCGCCGCC CCG 3'       SEQ ID:20604
FLJ10996                ||||||| |||||||||||| |||
BINDING SITE         3' GCGGCGG GGCGGCGGCGG GGC 5'       SEQ ID:167722
                             C              A

C  CACC   C  C
                     5' GC GC    GC GC GCCGCCG 3'        SEQ ID:20604
KIAA1483                || ||    || || |||||||
BINDING SITE         3' CG CG    CG CG CGGCGGC 5'        SEQ ID:193594
                        A  A---  A  A

A
                     5' GCCGCC CCGCCGCCGCCGCCG 3'        SEQ ID:20604
FLJ20539                |||||| |||||||||||||||
BINDING SITE         3' CGGCGG GGCGGCGGCGGCGGC 5'        SEQ ID:241978
                               C

A
                     5' GCCGCC CCGCCGCCGCCGCCG 3'        SEQ ID:20604
MGC2599                 |||||| |||||||||||||||
BINDING SITE         3' CGGCGG GGCGGCGGCGGCGGC 5'        SEQ ID:241978
                               C

A
                     5' GCCGCC CCGCCGCCGCCGCCG 3'        SEQ ID:20604
TSLL2                   |||||| |||||||||||||||
BINDING SITE         3' CGGCGG GGCGGCGGCGGCGGC 5'        SEQ ID:241978
                               C

A
                     5' TCGCCGCC CCGCCGCCGCCG 3'         SEQ ID:20604
KIAA0995                |||||||| ||||||||||||
BINDING SITE         3' AGCGGCGG GGCGGCGGCGGC 5'         SEQ ID:245294
                                 C

A
                     5' TCGCCGCC CCGCCGCCGCCG 3'         SEQ ID:20604
PMX2B                   |||||||| ||||||||||||
BINDING SITE         3' AGCGGCGG GGCGGCGGCGGC 5'         SEQ ID:245294
                                 C

A
                     5' GCCGCC CCGCCGCCGCCG 3'           SEQ ID:20604
CLSTN1                  |||||| ||||||||||||
BINDING SITE         3' CGGCGG GGCGGCGGCGGC 5'           SEQ ID:324417
                               C
```

Fig. 26D/55

```
                        A
              5' GCCGCC CCGCCGCCGCCG    3'              SEQ ID:20604
FLJ10996         ||||||  ||||||||||||
BINDING SITE  3' CGGCGG GGCGGCGGCGGC    5'              SEQ ID:324417
                        C

A
              5' GCCGCC CCGCCGCCGCCG    3'              SEQ ID:20604
MGC4170          ||||||  ||||||||||||
BINDING SITE  3' CGGCGG GGCGGCGGCGGC    5'              SEQ ID:324417
                        C

A
              5' TCGCCGCC CCGCCGCCGCCG     C            SEQ ID:20604
SSBP3            ||||||||  ||||||||||||    |
BINDING SITE  3' AGCGGCGG GGCGGCGGCGGCGG   G            SEQ ID:412156
                          C

G  C  -
              5' TC CCG CA CCGCCGCCGC   3'              SEQ ID:20604
ADAR3            || ||| || ||||||||||||
BINDING SITE  3' AG GGC GT GGCGGCGGCGGCG  5'            SEQ ID:436814
                 -    C  C

A -----  C
              5' GCCGCC CCG     CCG CGCCGCCG            SEQ ID:20604
ADPRTL2          ||||||  |||     |||  ||||||||
BINDING SITE  3' CGGCGG GGC     GGC GCGGCGGC            SEQ ID:437139
                         C CACGA  A

GC    ACC         CC
              5' TC  CGCC    GCCGCCGCCG    3'           SEQ ID:20604
ADPRTL2          ||  ||||    ||||||||||
BINDING SITE  3' AG  GCGG    CGGCGGCGGC    5'           SEQ ID:437144
                    A-    GA-

C
              5' CGCCG CACCGCCGCCGCCGCCG    C           SEQ ID:20604
AKAP9            |||||  |||||||||||||||||   |
BINDING SITE  3' GCGGC GTGGCGGCGGCGGCGGC    G           SEQ ID:439691
                      A

A    CG     C
              5' CGCCGCC CCGC   CCGC GCCG   3'          SEQ ID:20604
ALTE             |||||||  ||||   ||||  ||||
BINDING SITE  3' GCGGCGG GGCG   GGCG CGGC   5'          SEQ ID:440959
                          C    AA     -

CACC     GC
              5' GCCGC    GCC   CGCCGCCG    3'          SEQ ID:20604
AP1GBP1          |||||     |||   ||||||||
BINDING SITE  3' CGGCG    CGG   GCGGCGGC    5'          SEQ ID:442346
                      A---    AA
```

Fig. 26D/56

```
                           A      ------
                     5' CGCCGCC CCGCC       GCCGCCGCC
AP4E1                   ||||||| |||||       |||||||||       SEQ ID:20604
BINDING SITE         3' GCGGCGG GGCGG          CGGCGGCGG
                           C      GCGCTA                    SEQ ID:443308

A         C--
                     5' CGCCGCC CCGCCGC    GCCG  3'
ARF6                    ||||||| |||||||    ||||              SEQ ID:20604
BINDING SITE         3' GCGGCGG GGCGGCG    TGGC  5'
                           C         CTT                     SEQ ID:445874

C  C
                     5' GCCG CA CGCCGCCGCCGCCG  3'
ARF6                    |||| || ||||||||||||||                SEQ ID:20604
BINDING SITE         3' CGGT GT GCGGCGGCGGCGGC  5'
                          T  T                                SEQ ID:445885

C
                     5' TCGCCGCCACCGCCGC GCCGCCG  3'
ARTS-1                  ||||||||||||||||| |||||||            SEQ ID:20604
BINDING SITE         3' GGCGGCGGTGGTGGTG CGGCGGC  5'
                                       A                     SEQ ID:449602

C   CAC   C
                     5' CG CGC    CGC GCCGCCGCCG  3'
ATE1                    || |||    ||| ||||||||||              SEQ ID:20604
BINDING SITE         3' GC GCG    GCG CGGCGGCGGC  5'
                            A   ATC   C                      SEQ ID:450724

G  A  G  GC
                     5' TCGCC CC CC CC    CGCCGCCG  3'
ATP6V1B2                ||||| || || ||    ||||||||           SEQ ID:20604
BINDING SITE         3' AGCGG GG GG GG    GCGGCGGC  5'
                            -  C  G  AA                      SEQ ID:451749

A    CC-
                     5' CGCCGCC CCG    GCCGCCG  3'
AWP1                    ||||||| |||    |||||||               SEQ ID:20604
BINDING SITE         3' GCGGCGG GGC    CGGCGGC  5'
                           C    CAT                          SEQ ID:452398

C  CAC
                     5' CGC GC    CGCCGCCGCCG  3'
AWP1                    ||| ||    |||||||||||                SEQ ID:20604
BINDING SITE         3' GCG CG    GCGGCGGCGGC  5'
                         A  C--                              SEQ ID:452399

A   CGC
                     5' GCC CCGC    CGCCGCCG  3'
BA108L7.2               ||| ||||    ||||||||                 SEQ ID:20604
BINDING SITE         3' CGG GGCG    GCGGCGGC  5'
                           A   ACA                           SEQ ID:453226
```

Fig. 26D/57

```
                          CCG   AC-
                   5' TCG    CC    CGCCGCCGCCG 3'        SEQ ID:20604
BC-2                  |||    ||    |||||||||||
BINDING SITE       3' AGC    GG    GCGGCGGCGGC 5'        SEQ ID:454363
                          CA-   ACA

CACCGC
                   5' TCGCCGC       CGCCGCC 3'           SEQ ID:20604
BEX1                  |||||||       |||||||
BINDING SITE       3' AGCGGTG       GCGGCGG 5'           SEQ ID:455564
                            CTCCAC

CGC      CC-
                   5' TCGCCGCCAC    CGCCG    GCCG 3      SEQ ID:20604
BLCAP                 ||||||||||    |||||    ||||
BINDING SITE       3' GGCGGCGGTG    GCGGC    CGGC 5      SEQ ID:457198
                                ACA      AGA

A       CGC
                   5' CGCCGCC CCGC     CGCCG 3'          SEQ ID:20604
BLCAP                 ||||||| ||||     |||||
BINDING SITE       3' GCGGCGG GGTG     GCGGC 5'          SEQ ID:457204
                            C       ACA

C      GCC
                   5' TCGCCGCCA CGCC     GCCG 3'         SEQ ID:20604
BTBD1                 |||||||||| ||||    ||||
BINDING SITE       3' GGCGGCGGT GCGG     CGGC 5'         SEQ ID:460514
                              A      GTC

CA                 ---
                   5' CCGC    CCGCCGCCGCC    GCC 3'      SEQ ID:20604
C12orf22              ||||    |||||||||||    |||
BINDING SITE       3' GGCG    GGCGGCGGCGG    CGG 5'      SEQ ID:463154
                         AC                 GAT A      C
                   5' GCCGCC CCGC GCCGCCGCCG 3'          SEQ ID:20604
C12orf22              |||||| |||| ||||||||||
BINDING SITE       3' CGGCGG GGCG CGGCGGCGGC 5'          SEQ ID:463178
                           G      A CCG   C-  C-         CCG
                   5' TCG    CCA  CG    CGCCGCCG         SEQ ID:20604
C20orf124             |||    |||  ||    ||||||||
BINDING SITE       3' AGC    GGT  GC    GCGGCGGC         SEQ ID:468753
                         AA-   AA  CC ACC    -
                   5' GCCGCC    GC CGCCGCCG 3'           SEQ ID:20604
C20orf139             ||||||    || |||||||||
BINDING SITE       3' CGGCGG    CG GCGGCGGC 5'           SEQ ID:469119
                         GA-    C
```

Fig. 26D/58

```
                       CA    -
              5' TCGCCGC  CC GCCGCCG 3'              SEQ ID:20604
C20orf178       |||||||  || |||||||
BINDING SITE  3' GGCGGCG  GG CGGCGGC 5'              SEQ ID:470891
                       AG  A A        -  C
              5' TCGCCGCC CCGCCGC CG CG 3'           SEQ ID:20604
C2orf7          |||||||| ||||||| || ||
BINDING SITE  3' AGCGGCGG GGCGGCG GC GC 5'           SEQ ID:476575
                         -       C  A C   AC  -
              5' TCGC GCC  C GCCGCCGCCGCCG           SEQ ID:20604
C4S-2           |||| |||  | ||||||||||||
BINDING SITE  3' AGCG CGG  G CGGCGGCGGCGGC           SEQ ID:477108
                      -   GC T

-      ----
              5' GC CGCC     ACCGCCGCCGCCGCCG        SEQ ID:20604
CAMTA1           || ||||     ||||||||||||||||
BINDING SITE  3' CG GCGG     TGGCGGCGGCGGCGGC        SEQ ID:483028
                    C        AGCA

--   A
              5' CC  GCC  CCGCCGCCGCCGCCG 3'         SEQ ID:20604
CARM1           ||  |||  |||||||||||||||
BINDING SITE  3' GG  CGG  GGCGGCGGCGGCGGC 5'         SEQ ID:483979
                     TC  -

A       C  C
              5' CGCCGCC CCGCCGC GC GCC 3'           SEQ ID:20604
CARM1           ||||||| ||||||| || |||
BINDING SITE  3' GCGGCGG GGCGGCG CG CGG 5'           SEQ ID:483989
                         C       A  -

CCA    C  C
              5' CG   CCGC GC GCCGCCG 3'             SEQ ID:20604
CBLN1           ||   |||| || |||||||
BINDING SITE  3' GC   GGCG CG CGGCGGC 5'             SEQ ID:485030
                  CAG    A  A

G    CACC         G  G
              5' TC CCGC      GCCGCCGCC CC  3        SEQ ID:20604
CBLN1           || ||||      ||||||||| ||
BINDING SITE  3' AG GGCG      CGGCGGCGG GG  5        SEQ ID:485054
                  -     ACGA            A  A

C  CA
              5' GC GC  CCGCCGCCGCCG 3'              SEQ ID:20604
CDC14A          || ||  ||||||||||||
BINDING SITE  3' CG CG  GGCGGCGGCGGC 5'              SEQ ID:487263
                    A  A-
```

Fig. 26D/59

```
                         C  CA
                 5' GC GC    CCGCCGCCGCCG    3'         SEQ ID:20604
CDC14A              || ||    ||||||||||||
BINDING SITE     3' CG CG    GGCGGCGGCGGC    5'         SEQ ID:487263
                    A  A-

-   CACC
                 5' GCC GC      GCCGCCGCCGCCG  3'       SEQ ID:20604
CDC16               ||| ||      |||||||||||||
BINDING SITE     3' CGG CG      CGGCGGCGGCGGC  5'       SEQ ID:487765
                    A  T---

A  -     C C  C
                 5' TCGCCGCC CCG CCGC G CG CG   3       SEQ ID:20604
CDC42BPB            |||||||| ||| ||||  | || ||
BINDING SITE     3' AGCGGCGG GGC GGCG C GC GC   5       SEQ ID:487991
                          -      A   - A  A

CA      -----
                 5' TCGCCGC   CCGCCG       CCGCCGC      SEQ ID:20604
CDCA4               |||||||   ||||||       |||||||
BINDING SITE     3' GGCGGCG   GGCGGT       GGCGGCG      SEQ ID:488095
                           AC         CGAAG

G   CACC  C              -
                 5' TC CCGC     GC GCCGCCGC CG   3      SEQ ID:20604
CECR2               || ||||     || |||||||| ||
BINDING SITE     3' AG GGCG     CG CGGCGGCG GC   5      SEQ ID:489555
                        -       A---         A

C   CA       C
                 5' TCG CGC    CCGCCG CGCCGCCG   3      SEQ ID:20604
CGGBP1              ||| |||    |||||| ||||||||
BINDING SITE     3' GGC GCG    GGCGGC GCGGCGGC   5      SEQ ID:492176
                        A   AC       A

C    A   C
                 5' TCGC GCC CCG CGCCGCCG    3'         SEQ ID:20604
CGGBP1              |||| ||| ||| ||||||||
BINDING SITE     3' AGCG CGG GGC GCGGCGGC    5'         SEQ ID:492221
                        A   C   A

A        C-    G
                 5' TCGCCGCC CCGCCGC   GCC CCG    3     SEQ ID:20604
CHSY1               |||||||| |||||||   ||| |||
BINDING SITE     3' GGCGGCGG GGCGGCG   CGG GGC    5     SEQ ID:494504
                                   C       TC  -

--    A
                 5' TCGCC   GCC  CCGCCGCCGCCGCCG        SEQ ID:20604
CHSY1               |||||   |||  |||||||||||||||
BINDING SITE     3' GGCGG   CGG  GGCGGCGGCGGCGGC        SEQ ID:494516
                         CC    C
```

Fig. 26D/60

```
                              A     C- -
                    5' CGCCGCC CCGCCGC  GCC GCCG  3'      SEQ ID:20604
CHSY1                  ||||||| |||||||  ||| ||||
BINDING SITE        3' GCGGCGG GGCGGCG  CGG CGGC  5'      SEQ ID:494532
                                         CC   G

CC    AC          CCG
                    5'   TCG  GCC   CGCCGCCGCCG    3'     SEQ ID:20604
CHSY1                    |||  |||   |||||||||||
BINDING SITE        3'   AGC  CGG   GCGGCGGCGGC    5'     SEQ ID:494603
                              AT    CC

A             C--
                    5' CGCCGCC CCGCCGCC     CGC   3'      SEQ ID:20604
CLSTN1                 ||||||| ||||||||     |||
BINDING SITE        3' GCGGCGG GGCGGCGG     GCG   5'      SEQ ID:496944
                              C             ACT

CGCCACCGC
                    5' TCGC             CGCCGCCGCCG  3'   SEQ ID:20604
CNNM3                  ||||             |||||||||||
BINDING SITE        3' AGCG             GCGGCGGCGGC  5'   SEQ ID:498002
                       ACATCCCCA

CG-   ACC         C
                    5' GC    CC    GCCGCCGCC CG   3'      SEQ ID:20604
COASTER                ||    ||    ||||||||| ||
BINDING SITE        3' CG    GG    CGGCGGCGG GC   5'      SEQ ID:498924
                          ACA   GAA         A

C  -           ---
                    5' GCCG CA CCGCCGCCGCC    GCCG    SEQ ID:20604
COL4A3BP               |||| || |||||||||||    ||||
BINDING SITE        3' CGGC GT GGCGGCGGCGG    CGGC    SEQ ID:499352
                            A  C            CAG

A       C
                    5' CGCCGCC CCGCCGC GCCG   3'          SEQ ID:20604
CTCF                   ||||||| ||||||| ||||
BINDING SITE        3' GTGGCGG GGCGGCG CGGC   5'          SEQ ID:503528
                              C       A

-
                    5' CGCCG CCACCGCCGCCGCCGC    3'       SEQ ID:20604
CTCF                   ||||| |||||||||||||||||
BINDING SITE        3' GTGGC GGTGGCGGCGGCGGCG    5'       SEQ ID:503529
                              C

A    G G
                    5' TCGCCGCC CCGCCGCC CC CCG   3'      SEQ ID:20604
DDM36                  |||||||| |||||||| || |||
BINDING SITE        3' GGCGGCGG GGCGGCGG GG GGC   5'      SEQ ID:508506
                              C          A -
```

Fig. 26D/61

```
                    CC   A
              5' TCG   GCC  CCGCCGCCGCCGCCG  3'         SEQ ID:20604
DDM36            |||   |||  |||||||||||||||
BINDING SITE  3' AGC   CGG  GGCGGCGGCGGCGGC  5'         SEQ ID:508575
                       C-   C

A           CG   -
              5' CGCCGCC  CCGCCGC  CC GC     3'         SEQ ID:20604
DKFZP434D1335    |||||||  |||||||  || ||
BINDING SITE  3' GCGGCGG  GGCGGCG  GG CG     5'         SEQ ID:516151
                    C           AG T

AC  C-
              5' TCGCCGCC  CG  CGCCG         3'         SEQ ID:20604
DKFZP434J154     |||||||  ||  |||||
BINDING SITE  3' AGCGGCGG  GC  GCGGC         5'         SEQ ID:520474
                       A-  CA

CC-
              5' TCGCCGCCA    GCGCCG         3'         SEQ ID:20604
DKFZP434N093     |||||||||    ||||||
BINDING SITE  3' GGCGGCGGT    CGGCGGC        5'         SEQ ID:522414
                          ACA

ACC    -   C
              5' GCCGCC   GC CGC GCCGCCG      3'        SEQ ID:20604
DKFZP434P106     ||||||   || |||  |||||||
BINDING SITE  3' CGGCGG   CG GTG CGGCGGC      5'        SEQ ID:523992
                          ---  A  T

ACCG
              5' GCCGCC      CCGCCGCCGCCG     3'        SEQ ID:20604
DKFZP566A1524    ||||||      ||||||||||||
BINDING SITE  3' CGGCGG      GGCGGCGGCGGC     5'        SEQ ID:531199
                        GCGA

CCAC           -
              5' CGCCG      CGCCGCCG CCG      3'        SEQ ID:20604
DKFZP566K1924    |||||      |||||||| |||
BINDING SITE  3' GCGGC      GCGGCGG  GGC      5'        SEQ ID:532863
                        A---        A

G    A            CC
              5' TC CCGCC  CCGCCGCCGCCG       3'        SEQ ID:20604
DKFZp761B0514    || |||||  ||||||||||||
BINDING SITE  3' AG GGCGG  GGCGGCGGCGGC       5'        SEQ ID:536448
                        -          -

C--  CA     C
              5' GC    GC   CCGC GCCGCCG      3'        SEQ ID:20604
DKFZp762E1511    ||    ||   |||| |||||||
BINDING SITE  3' CG    CG   GGCG CGGCGGCG     5'        SEQ ID:539970
                     ACC  AC     A
```

Fig. 26D/62

```
                        C   C
                5' GCCA CGC GCCGCCGCCG 3'          SEQ ID:20604
Dlc2               |||| ||| ||||||||||
BINDING SITE    3' CGGT GCG CGGCGGCGGT 5'          SEQ ID:540962
                        A   A

A         C  C
                5' CCGCC CCGCCGC GC GCC 3'         SEQ ID:20604
E46L               ||||| ||||||| || |||
BINDING SITE    3' GGCGG GGCGGCG CG CGG 5'         SEQ ID:545962
                        C         A  T

GCC
                5' CC    ACCGCCGCCGCCGC 3'         SEQ ID:20604
E46L               ||    ||||||||||||||
BINDING SITE    3' GG    TGGCGGCGGCGGCG 5'         SEQ ID:545966
                      AT-

A         C
                5' CCGCC CCGCCGCCG GC 3'           SEQ ID:20604
EHM2               ||||| ||||||||| ||
BINDING SITE    3' GGCGG GGCGGCGGCG CG 5'          SEQ ID:547115
                                   C         -

CA    C  C
                5' GCCGC  CCGC GC GCCGCCG 3'       SEQ ID:20604
EHM2               |||||  |||| || |||||||
BINDING SITE    3' CGGCG  GGCG CG CGGCGGC 5'       SEQ ID:547149
                     AC       A  -

-  A-
                5' GCCG CC  CCGCCGCCGCCGCCG 3'     SEQ ID:20604
EHM2               |||| ||  |||||||||||||||
BINDING SITE    3' CGGC GG  GGCGGCGGCGGCGGC 5'     SEQ ID:547151
                     A  GC

CG
                5' TCGCCGCCAC   CCGCCGCCGCCG   C  SEQ ID:20604
ELKS               ||||||||||   ||||||||||||   |
BINDING SITE    3' GGCGGCGGTG   GGCGGCGGCGGC   G  SEQ ID:548280
                             AT

C   CAC
                5' TCGC GC   CGCCGCCGCCG 3'        SEQ ID:20604
ELKS               |||| ||   |||||||||||
BINDING SITE    3' GGCG CG   GCGGCGGCGGC 5'        SEQ ID:548281
                        - ACA

---     A     C
                5' CGC   CGCC CCGCCGC GCCG 3'      SEQ ID:20604
ELKS               |||   |||| ||||||| ||||
BINDING SITE    3' GCG   GCGG GGCGGCG CGGC 5'      SEQ ID:548286
                   ACA        C       C
```

Fig. 26D/63

```
                                AC--
                       5' GCCGCC      CGCCGCCGCCGCCG    C       SEQ ID:20604
ELKS                      ||||||      ||||||||||||||   |
BINDING SITE           3' CGGCGG      GTGGCGGCGGCGGC    G       SEQ ID:548299
                                GCCC

A              CG
                       5' GCCGCC CCGCCGCCGC     CCG  3'         SEQ ID:20604
ELL2                      |||||| ||||||||||     |||
BINDING SITE           3' CGGCGG GGCGGCGGCG     GGC  5'         SEQ ID:548421
                                 C              A-

G    CCA--
                       5' TC CCG        CCGCCGCCGCCGCCG         SEQ ID:20604
ELL2                      || |||        |||||||||||||||
BINDING SITE           3' AG GGC        GGCGGCGGCGGCGGC         SEQ ID:548442
                             G    CCCAC

A             C-
                       5' CGCCGCC CCGCCGCC    CGCCG  3'         SEQ ID:20604
FAF1                      ||||||| ||||||||    |||||
BINDING SITE           3' GCGGCGG GGCGGCGG    GCGGC  5'         SEQ ID:552942
                                 C             CC

5' TCGCCGCCACCGCCGCCGCCGCCG    C         SEQ ID:20604
FAF1                      |||||||||||||||||||||||||   |
BINDING SITE           3' AGCGGCGGTGGCGGCGGCGGCGGC    G         SEQ ID:552963

C  C   C
                       5' CGCCACCGC GC GC GCCG  3'              SEQ ID:20604
FEM1B                     |||||||| || || ||||
BINDING SITE           3' GCGGTGGCG CG CG CGGC  5'              SEQ ID:556003
                                  A  T   A

C  A     CGCC-
                       5' GC GCC CCGCCGC     GCCG  3'           SEQ ID:20604
FJX1                      || ||| |||||||     ||||
BINDING SITE           3' CG CGG GGCGGCG     CGGC  5'           SEQ ID:557158
                             -  C     AAGTT

----                    C
                       5' CC     GCCACCGCCGCCGCCG CG  3         SEQ ID:20604
FLJ10211                  ||     ||||||||||||||| ||
BINDING SITE           3' GG     CGGTGGCGGCGGCGGC GC  5         SEQ ID:562466
                            AGTC                 A

-
                       5' TCGCCGCCACCGCCGCCGC CG  3'             SEQ ID:20604
FLJ10211                  |||||||||||||||||||| ||
BINDING SITE           3' AGCGGCGGTGGCGGCGGCG GC  5'            SEQ ID:562496
                                                A
```

Fig. 26D/64

```
                                    CCGCC
                    5'  TCGCCGCCACCGCCGCCG        3'       SEQ ID:20604
FLJ10211                |||||||||||||||||
BINDING SITE        3'  AGCGGCGGTGGCGGCGGC        5'       SEQ ID:562509
                          A                G

A         C
                    5' TCGCCGCC CCGCCGC GCCGC      3'       SEQ ID:20604
FLJ10244               |||||||| ||||||| |||||
BINDING SITE        3' GGCGGCGG GGCGGCG CGGCG      5'       SEQ ID:562895
                                C         A

A     C      C
                    5' TCGCCGCC CCGC GCCGC GCCG    3'       SEQ ID:20604
FLJ10244               |||||||| |||| ||||| ||||
BINDING SITE        3' GGCGGCGG GGCG CGGCG CGGC    5'       SEQ ID:562897
                                C    A     A

CACC       C             -
                    5' CGCCGC     GCCGC GCCGC CG    3'       SEQ ID:20604
FLJ10244               ||||||     ||||| ||||| ||
BINDING SITE        3' GCGGCG     CGGCG CGGCG GC    5'       SEQ ID:562906
                         A---       A     A

A            C
                    5' GCCGCC CCGCCGCCGC GCCG      C        SEQ ID:20604
FLJ10244               |||||| |||||||||| ||||      |
BINDING SITE        3' CGGCGG GGCGGCGGCG CGGC      G        SEQ ID:562923
                          C         A

C
                    5' TCGCCGCCAC GCCGCCGCCG      3'        SEQ ID:20604
FLJ10244               |||||||||| ||||||||||
BINDING SITE        3' AGTGGCGGTG CGGCGGCGGC      5'        SEQ ID:562943
                                  C

CA      C   G
                    5' CCGC  CCGCCGC GCC CCG      3'        SEQ ID:20604
FLJ10342               ||||  ||||||| ||| |||
BINDING SITE        3' GGCG  GGCGGCG CGG GGC      5'        SEQ ID:564347
                        AC          A   A

C  A---   G
                    5' TCGC GCC   CC CCGCCGCCGCCG           SEQ ID:20604
FLJ10648               |||| |||   || ||||||||||||
BINDING SITE        3' GGCG CGG   GG GGCGGCGGCGGC           SEQ ID:569200
                        A   CAGC  A

A    CG
                    5' TCGCCGCC CCGC CCGCCGCCG    3'        SEQ ID:20604
FLJ10709               |||||||| |||| |||||||||
BINDING SITE        3' GGCGGCGG GGCG GGCGGCGGC    5'        SEQ ID:570431
                                C    AT
```

Fig. 26D/65

```
                              CA
                  5' CGCCGC   CCGCCGCCGCCGCCG    C        SEQ ID:20604
FLJ10856             ||||||   |||||||||||||||    |
BINDING SITE      3' GCGGCG   GGCGGCGGCGGCGG     G        SEQ ID:574295
                              AC

CCAC           G
                  5' TCGCCG       CGCCGCCGCC CC  3'       SEQ ID:20604
FLJ10925             ||||||       |||||||||| ||
BINDING SITE      3' AGCGGC       GCGGCGGCGG GG  5'       SEQ ID:575621
                              C---           G

CGC          CC       -
                  5' GC      CACCGCCG    GCC GC  3'       SEQ ID:20604
FLJ10996             ||      ||||||||    ||| ||
BINDING SITE      3' CG      GTGGTGGT    CGG CG  5'       SEQ ID:576651
                         ACA          T-    A

--       C
                  5' GCCA  CCGCCGC GCCGCCG   3'           SEQ ID:20604
FLJ11700             ||||  ||||||| |||||||
BINDING SITE      3' CGGT  GGCGGCG CGGCGGC   5'           SEQ ID:582367
                         CC        A

A            C
                  5' CGCC  CCGCCGC  GCCGC   3'            SEQ ID:20604
FLJ12363             ||||  |||||||  |||||
BINDING SITE      3' GCGG  GGCGGCG  CGGCG   5'            SEQ ID:587504
                         C            A

CA            C
                  5' CGCCGC   CCGCCGCCGC  GCCG   3'       SEQ ID:20604
FLJ12363             ||||||   ||||||||||  ||||
BINDING SITE      3' GCGGCG   GGCGGCGGCG  CGGC   5'       SEQ ID:587507
                              C-            A

5' TCGCCGCCACCGCCGCCGCCGCCG    3'       SEQ ID:20604
FLJ12377             ||||||||||||||||||||||||
BINDING SITE      3' GGCGGTGGTGGCGGCGGCGGCGGC    5'       SEQ ID:587654

G ----     A
                  5' TC CC     GCC  CCGCCGCCGCCGCCG       SEQ ID:20604
FLJ12697             || ||     |||  |||||||||||||||
BINDING SITE      3' AG GG     CGG  GGCGGCGGCGGCGGC       SEQ ID:592585
                         G    GAGC   C

CCAC
                  5' GCCG     CGCCGCCGCCGC   3'           SEQ ID:20604
FLJ12750             ||||     ||||||||||||
BINDING SITE      3' CGGC     GCGGTGGCGGCG   5'           SEQ ID:593299
                              AGCA
```

Fig. 26D/66

```
                          -  A  GC-
                   5' GCCG CC CC    CGCCGCCGCCG 3'        SEQ ID:20604
FLJ13189              |||| || ||    |||||||||||
BINDING SITE       3' CGGC GG GG    GCGGCGGCGGC 5'        SEQ ID:599594
                          A  -  AAA

A     GC
                   5' TCGCCGCC CCGCC CGCCG 3'             SEQ ID:20604
FLJ13189              |||||||| ||||| |||||
BINDING SITE       3' AGCGGCGG GGCGG GTGGC 5'             SEQ ID:599628
                            C        --

G    A    C C---
                   5' TC CCGCC CCGC GC    GCCGCCG         SEQ ID:20604
FLJ13194              || ||||| |||| ||    |||||||
BINDING SITE       3' AG GGCGG GGCG CG    CGGCGGC         SEQ ID:600122
                         -    C    - AACA

CC             C
                   5' CCG  ACCGCCGCCGC GCCG 3'            SEQ ID:20604
FLJ13340              |||  |||||||||||| ||||
BINDING SITE       3' GGC  TGGCGGCGGCG CGGC 5'            SEQ ID:601522
                        --             A

CC             C
                   5' CCG  ACCGCCGCCGC GCCG 3'            SEQ ID:20604
TBDN100               |||  |||||||||||| ||||
BINDING SITE       3' GGC  TGGCGGCGGCG CGGC 5'            SEQ ID:601522
                        --             A

CCA             C
                   5' CCG    CCGCCGCCGC GCCG 3'           SEQ ID:20604
FLJ13855              |||    |||||||||| ||||
BINDING SITE       3' GGC    GGCGGCGGCG CGGC 5'           SEQ ID:605857
                        TTG            A

ACC-
                   5' CCGCC    GCCGCCGCCG 3'              SEQ ID:20604
FLJ13855              |||||    ||||||||||
BINDING SITE       3' GGCGG    CGGCGGCGGC 5'              SEQ ID:605858
                        GCGA

A
                   5' TCGCCGCC CCGCCGCCGCCGC 3'           SEQ ID:20604
FLJ14299              |||||||| ||||||||||||
BINDING SITE       3' GGCGGCGG GGCGGTGGCGGCG 5'           SEQ ID:610393
                                     C

A  CC--- C  C
                   5' TCGCCGCC CCG    GC GC GCCG          SEQ ID:20604
FLJ14451              |||||||| |||    || || ||||
BINDING SITE       3' GGCGGCGG GGC    CG CG CGGC          SEQ ID:612603
                            C  ATCAA  A  A
```

Fig. 26D/67

```
                         C  CACC----
                  5' CGC GC      GCCGCCGCCGCCG       SEQ ID:20604
FLJ14451             ||| ||      |||||||||||||
BINDING SITE      3' GCG CG      CGGCGGCGGCGGC       SEQ ID:612607
                         A  ACCCAAGA

CA    C
                  5' GCCGC  CCGC GCCGCCGCC 3'        SEQ ID:20604
FLJ20288             |||||  |||| |||||||||
BINDING SITE      3' TGGCG  GGCG CGGCGGCGGC 5'       SEQ ID:625741
                         AC    A

CA
                  5' CCGC    CCGCCGCCGCC 3'          SEQ ID:20604
FLJ20288             ||||    |||||||||||
BINDING SITE      3' GGCG    GGCGGCGGCGGCG 5'        SEQ ID:625764
                         AC

CA    C
                  5' CCGC    CCGC GCCGCCGCCG 3'      SEQ ID:20604
PCAF                 ||||    |||| |||||||||
BINDING SITE      3' GGCG    GGCG CGGCGGCGGC 5'      SEQ ID:625767
                         AC    A

A     C  C
                  5' GCCGCC CCGCCGC GC GCCG 3'       SEQ ID:20604
FLJ20288             |||||| ||||||| || ||||
BINDING SITE      3' CGGCGG GGCGGCG CG CGGC 5'       SEQ ID:625783
                           C       A  A

CA
                  5' GCCGC    CCGCCGCCGCCGC 3'       SEQ ID:20604
FLJ20288             |||||    |||||||||||||
BINDING SITE      3' CGGCG    GGCGGCGGCGGCG 5'       SEQ ID:625785
                           AC

CGC
                  5' TCGC    CACCGCCGCCGC 3'         SEQ ID:20604
FLJ20288             ||||    |||||||||||
BINDING SITE      3' AGCG    GTGGCGGCGGCG 5'         SEQ ID:625802
                           CCA

G    A   C
                  5' TC CCGCC CCG CGCCGCCGCCG  C     SEQ ID:20604
FLJ20400             || ||||| ||| |||||||||||  |
BINDING SITE      3' AG GGCGG GGC GCGGCGGCGGC  G     SEQ ID:629258
                        -     C   A

C    A-
                  5' TCG CGCC  CCGCCGCCGCCGCCG 3     SEQ ID:20604
FLJ20421             ||| ||||  |||||||||||||||
BINDING SITE      3' GGT GCGG  GGCGGCGGCGGCGGC 5     SEQ ID:629645
                          C    GC
```

Fig. 26D/68

```
                       A             C
              5' TCGCCGCC CCGCCGC GCCGCCG  3'        SEQ ID:20604
FLJ20421         ||||||||  |||||||  |||||||
BINDING SITE  3' GGCGGCGG GGCGGCG CGGCGGC  5'       SEQ ID:629655
                              C       T

A              C
              5' CGCCGCC CCGCCGCCGC GCCG  3'        SEQ ID:20604
FLJ20421         |||||||  ||||||||||  ||||
BINDING SITE  3' GCGGCGG GGCGGCGGCG CGGC  5'       SEQ ID:629660
                              C       T

A   -  GC-
              5' TCGCCGCC CC GCC    CGCCG  3'        SEQ ID:20604
FLJ20425         ||||||||  ||  |||       |||||
BINDING SITE  3' AGCGGCGG GG CGG    GCGGC  5'       SEQ ID:629739
                          C  T  GTC

G  -  A
              5' TC CCG CC CCGCCGCCGCCGCCG  3       SEQ ID:20604
FLJ20539         ||  |||  ||  ||||||||||||||||
BINDING SITE  3' AG GGC GG GGCGGCGGCGGCGGC   5      SEQ ID:632084
                      -   C  C

ACC   C         GC
              5' TCGCCGCC    GC GCCGCC    C  3'     SEQ ID:20604
FLJ20718         ||||||||    ||  ||||||    |
BINDING SITE  3' AGCGGCGG    CG CGGCGG    G  5'    SEQ ID:635286
                         ---    T         A

A              CCG
              5' GCCGCC CCGCCGCCGCCG        C       SEQ ID:20604
FLJ21588         ||||||  ||||||||||||         |
BINDING SITE  3' CGGCGG GGCGGCGGCGGC        G      SEQ ID:641646
                      C                    GC

ACC
              5' CGCCGCC    GCCGCCGCCG  3'          SEQ ID:20604
FLJ21613         |||||||    ||||||||||
BINDING SITE  3' GCGGCGG    CGGCGGCGGC  5'         SEQ ID:641999
                            AGC

ACC---
              5' CGCC          GCCGCCGCCGCCG  3'    SEQ ID:20604
FLJ22393         ||||           |||||||||||||
BINDING SITE  3' GCGG          CGGCGGCGGCGGC  5'   SEQ ID:649088
                       GCCCCA

A GC    G
              5' TCGCCGCC CC CGCC CCGC  3'          SEQ ID:20604
FLJ23251         ||||||||  ||   ||||  ||||
BINDING SITE  3' AGCGGCGG GG   GCGG GGTG  5'       SEQ ID:657789
                          C AA       -
```

Fig. 26D/69

```
                          CAC
                  5' CGCCGC      CGCCGCCGCCGCCG 3'         SEQ ID:20604
FLJ31564             ||||||      ||||||||||||||
BINDING SITE      3' GCGGCG      GCGGCGGCGGTGGC 5'         SEQ ID:665686
                          ACA

-  -  A              CCG
                  5' TCG CCG CC CCGCCGCCGCCG               SEQ ID:20604
FLJ31978             ||| ||| || ||||||||||||
BINDING SITE      3' AGC GGC GG GGCGGCGGCGGC               SEQ ID:666546
                       T   C  -

G   CCAC
                  5' TC CCG      CGCCGCCGCCGCCG 3'         SEQ ID:20604
FOXO3A               || |||      ||||||||||||||
BINDING SITE      3' AG GGC      GCGGCGGCGGCGGC 5'         SEQ ID:669368
                       -   CC--

G  A        ---
                  5' TCGCC CC CCGCC    GCCGCCGCCG          SEQ ID:20604
FUBP3                ||||| || |||||    ||||||||||
BINDING SITE      3' GGCGG GG GGCGG    CGGCGGCGGC          SEQ ID:670361
                          G  C        CAG

A      C
                  5' TCGCCGCC CCGCCG CGCCG 3'              SEQ ID:20604
FUBP3                |||||||| |||||| |||||
BINDING SITE      3' AGCGGCGG GGCGGC GCGGC 5'              SEQ ID:670394
                            C      T

C  C      GCC      CC
                  5' TCG CG CACCGCC    GCCG 3'             SEQ ID:20604
GIOT-3               ||| || |||||||    ||||
BINDING SITE      3' GGC GC GTGGCGG    CGGC 5'             SEQ ID:674988
                     A  A              GC-

A       C  C
                  5' CGCC CCGCCG CG CGCCG 3'               SEQ ID:20604
GIOT-3               |||| |||||| || |||||
BINDING SITE      3' GCGG GGCGGC GC GTGGC 5'               SEQ ID:674995
                        A       A  A

A
                  5' GCCGCC CCGCCGCCGCC 3'                 SEQ ID:20604
MGC14425             |||||| |||||||||||
BINDING SITE      3' CGGCGG GGCGGCGGCGG 5'                 SEQ ID:676856
                            C

A          --
                  5' GCCGCC CCGCCGCCGCC   GCCG 3'          SEQ ID:20604
GNA13                |||||| |||||||||||   ||||
BINDING SITE      3' CGGCGG GGCGGCGGCGG   CGGC 5'          SEQ ID:676857
                            C              AG
```

Fig. 26D/70

```
                            CGCCA              CC
                   5' TCGC       CCGCCGCCGCCG      3'        SEQ ID:20604
GOLPH2                || ||       ||||||||||||
BINDING SITE       3' AGCG       GGCGGCGGCGGC      5'        SEQ ID:677940
                            AGAG-

CA         G  G
                   5' TCGCCGC   CCGCCGCC CC  CCG   3'        SEQ ID:20604
GSK3A                 |||||||   |||||||| ||  |||
BINDING SITE       3' GGCGGCG   GGCGGCGG GG  GGC   5'        SEQ ID:681389
                               AC         A  G

---      A          C
                   5' GCC    GCC CCGCCGC GCCGCCG   3         SEQ ID:20604
GSK3A                 |||    ||| ||||||| |||||||
BINDING SITE       3' CGG    CGG GGCGGCG CGGCGGC   5         SEQ ID:681400
                      GGT     C          A

C   A     C
                   5' GC GCC CCGC GCCGCCGCCG       3'        SEQ ID:20604
GTF2A1                || ||| |||| ||||||||||
BINDING SITE       3' CG CGG GGCG CGGCGGTGGC       5'        SEQ ID:681625
                           - C    A

CA ---         C
                   5' TCGCCGC  CC    GCCGCCGC GCCG           SEQ ID:20604
GTF2A1                |||||||  ||    |||||||| ||||
BINDING SITE       3' AGTGGCG  GG    CGGCGGCG CGGC           SEQ ID:681632
                            AG ACG            A

C   A--       C
                   5' TCGC GCC    CCGC GCCGCCGCCG  SEQ ID:20604
H2AV                  |||| |||    |||| ||||||||||
BINDING SITE       3' GGCG CGG    GGCG CGGCGGCGGC  SEQ ID:683857
                           A   CTG      -

C  C            -
                   5' TCGC GC ACCG CCGCCGCCGCCG    SEQ ID:20604
H2AV                  |||| || |||| ||||||||||||
BINDING SITE       3' AGCG CG TGGC GGCGGCGGCGGC    SEQ ID:683934
                           T        -    T

CCAC--        C
                   5' CCG     CGCCG CGCCGCCG       3'        SEQ ID:20604
HNRPA0                |||     ||||| ||||||||
BINDING SITE       3' GGC     GCGGC GCGGCGGC       5'        SEQ ID:689726
                      TCCAAA        A

A            G
                   5' CCGCC CCGCCGCCGCC CC         3'        SEQ ID:20604
HRIHFB2122            ||||| ||||||||||| ||
BINDING SITE       3' GGCGG GGCGGCGGCGG GG         5'        SEQ ID:691356
                            C              -
```

Fig. 26D/71

```
                        CACC    C
                    5'  GCCGC     GC GCCGCCGCCG  3'           SEQ ID:20604
HS6ST1                  |||||     || ||||||||||
BINDING SITE        3'  CGGCG     CG CGGCGGCGGC  5'           SEQ ID:691939
                             ----  C

AC       C--
                    5'  TCGCCGCC  CGCCGC     GCCG  3'          SEQ ID:20604
HSPC195                 ||||||||  ||||||     ||||
BINDING SITE        3'  GGCGGCGG  GCGCGC     CGGC  5'          SEQ ID:696302
                               CA       CTC

C
                    5'  GCCGCCACCGCCGCCG CGCCG    CG           SEQ ID:20604
HSPC195                 ||||||||||||||| |||||    ||
BINDING SITE        3'  CGGCGGTGGCGGCGGC GCGGC    GC           SEQ ID:696329
                                          A

A        -
                    5'  GCCGCC  CCGCCGC  CGCC  3'              SEQ ID:20604
HSPC195                 ||||||  |||||||  ||||
BINDING SITE        3'  CGGCGG  GGCGGCG  GCGG  5'              SEQ ID:696330
                                C        C

ACC
                    5'  GCCGCC      GCCGCCGCCGCCG  3'          SEQ ID:20604
HSPC195                 ||||||      |||||||||||||
BINDING SITE        3'  CGGCGG      CGGCGGCGGCGGC  5'          SEQ ID:696332
                              AGA

ACC   C
                    5'  GCCGCC      GC GCCGCCG  3'             SEQ ID:20604
HSPC195                 ||||||      || |||||||
BINDING SITE        3'  CGGCGG      CG CGGCGGC  5'             SEQ ID:696333
                              AGA   A

CC  C  CG
                    5'  TCGCCG   AC GC   CCGCCGCCG  3'         SEQ ID:20604
HUMAGCGB                ||||||   || ||   |||||||||
BINDING SITE        3'  AGCGGC   TG CG   GGCGGCGGC  5'         SEQ ID:698714
                              --    A  AG

-    CACC
                    5'  TCG CCGC      GCCGCCGCCG  3            SEQ ID:20604
ILF3                    ||| ||||      ||||||||||
BINDING SITE        3'  AGC GGCG      CGGCGGCGGC  5            SEQ ID:701811
                             T    T---

-   CA--
                    5'  GC CGC      CCGCCGCCGCCG  3            SEQ ID:20604
ITPK1                   || |||      ||||||||||||
BINDING SITE        3'  CG GCG      GGCGGCGGCGGC  5            SEQ ID:704065
                            C   TCAG
```

Fig. 26D/72

```
                         C   A       G
                  5' GC GCC CCGCC CCGCCGCCG 3'        SEQ ID:20604
KCNT1                || ||| ||||| |||||||||
BINDING SITE      3' CG CGG GGCGG GGTGGCGGC 5'        SEQ ID:707411
                         A   G

C    CGC
                  5' GCCG CAC    CGCCGCCG 3'          SEQ ID:20604
KIAA0082             |||| |||    ||||||||
BINDING SITE      3' CGGC GTG    GCGGCGGCG 5'         SEQ ID:710416
                         T   ACA

ACC      CC
                  5' TCGCCGCC    GCCG  GCCGCCG 3'     SEQ ID:20604
KIAA0082             ||||||||    ||||  |||||||
BINDING SITE      3' AGCGGCGG    CGGT  CGGCGGC 5'     SEQ ID:710439
                         CGA      CT

A       -  -
                  5' TCGCCGCC CCGCCGC CG CCGCCG       SEQ ID:20604
KIAA0084             |||||||| ||||||| || ||||||
BINDING SITE      3' GGCGGCGG GGCGGCG GC GGCGGC       SEQ ID:710507
                                     C   C  A

C   A
                  5' CGC GCC CCGCCGCCGCCGCCG 3'       SEQ ID:20604
KIAA0084             ||| ||| |||||||||||||||
BINDING SITE      3' GCG CGG GGCGGCGGCGGCGGC 5'       SEQ ID:710522
                         -    G

AC        C
                  5' TCGCCGCC  CGCCGC GCCGCCG 3'      SEQ ID:20604
KIAA0191             ||||||||  |||||| |||||||
BINDING SITE      3' GGCGGCGG  GCGGCG CGGCGGC 5'      SEQ ID:715434
                                CA    A

AC         C
                  5' CCGCC  CGCCGC GCCGCCG 3'         SEQ ID:20604
KIAA0191             |||||  |||||| |||||||
BINDING SITE      3' GGCGG  GCGGCG CGGCGGC 5'         SEQ ID:715436
                              CA    A

A  -   C
                  5' CCGCC CC GC GCCGCCGCCG 3'        SEQ ID:20604
KIAA0191             ||||| || || ||||||||||
BINDING SITE      3' GGCGG GG CG CGGCGGCGGC 5'        SEQ ID:715438
                           A  A  A

CA       CGCC-
                  5' CCGC CCGCCGC      GCCG 3'        SEQ ID:20604
KIAA0191             |||| |||||||      ||||
BINDING SITE      3' GGCG GGCGGCG      CGGC 5'        SEQ ID:715439
                        AC       ACCTC
```

Fig. 26D/73

```
                      A    C      C
          5' GCCGCC CCG CGCCGC GCCG 3'        SEQ ID:20604
KIAA0191     ||||||  |||  ||||||| ||||
BINDING SITE 3' CGGCGG GGC GCGGCG CGGC 5'     SEQ ID:715444
                      C    A      A

C  A      C
          5' GC GCC CCGCCG CGCCGC 3'          SEQ ID:20604
KIAA0191     ||  |||  ||||||  ||||||
BINDING SITE 3' CG CGG GGCGGC GCGGCG 5'       SEQ ID:715447
                   A  C      A

A        GC
          5' CCGCC CCGCCGCCGCC  C  3'         SEQ ID:20604
KIAA0227     |||||  |||||||||||  |
BINDING SITE 3' GGCGG GGCGGCGGCGG  G  5'      SEQ ID:717573
                   C           A

A    GC  C-
          5' TCGCCGCC CCGCC  CG  CGCCG  3     SEQ ID:20604
KIAA0227     ||||||||  |||||   ||  |||||
BINDING SITE 3' GGCGGCGG GGCGG  GC  GCGGC  5  SEQ ID:717578
                        C    A-  CT

CG       -
          5' GC  CCA -CCGCCGCCGCCGCCG  3'     SEQ ID:20604
KIAA0227     ||   |||  |||||||||||||||
BINDING SITE 3' CG  GGT  GGCGGCGGCGGCGGC  5'  SEQ ID:717615
                A-       C

C
          5' GCCGCCAC GCCGCCGCCGCCG  3'       SEQ ID:20604
KIAA0252     ||||||||  |||||||||||||
BINDING SITE 3' TGGCGGTG CGGCGGCGGCGGC  5'    SEQ ID:718931
                         A

C  A       CG
          5' TCGC GCC CCGCCGCCGCCGC    3      SEQ ID:20604
KIAA0252     ||||  |||  ||||||||||||||
BINDING SITE 3' GGTG CGG GGCGGCGGCGGCG    5   SEQ ID:718993
                     A  C        AC

A       C  -
          5' CGCCGCC CCGCCGC GC CG  3'        SEQ ID:20604
KIAA0252     |||||||  ||||||| ||  ||
BINDING SITE 3' GCGGCGG GGCGGCG CG GC  5'     SEQ ID:719014
                    C        A A

G       CCG      CC
          5' TC CCGCCA    CCGCCGCCG   3'      SEQ ID:20604
KIAA0336     ||  ||||||   |||||||||
BINDING SITE 3' AG GGCGGT    GGCGGCGGC   5'   SEQ ID:724234
                 A        CG-
```

Fig. 26D/74

```
                              G  - A-
                     5' TC CCG CC  CCGCCGCCGCCGCCG          SEQ ID:20604
KIAA0397                || ||| ||  |||||||||||||||
BINDING SITE         3' AG GGC GG  GGCGGCGGCGGCGGC          SEQ ID:726863
                            -  C  GC

C       GCC-       CCG
                     5' TCGC GCCACCGCC      GCCG       3    SEQ ID:20604
KIAA0406                |||| ||||||||       ||||
BINDING SITE         3' GGCG CGGTGGCGG      CGGC       5    SEQ ID:726937
                        A            ATAC

CG AC
                     5' GC  CC  CGCCGCCGCCG  3'             SEQ ID:20604
KIAA0441                ||  ||  |||||||||||
BINDING SITE         3' CG  GG  GCGGCGGCGGC  5'             SEQ ID:730328
                        A-  AC

A   -
                     5' TCGCCGCC CC GCCGCCGCCGCCG  3        SEQ ID:20604
KIAA0475                |||||||| || |||||||||||||
BINDING SITE         3' AGTGGCGG GG CGGCGGCGGCGGC  5        SEQ ID:734620
                                 G  T

C
                     5' TCGCCGCCACCGC GCCG  3'              SEQ ID:20604
KIAA0633                |||||||||||| ||||
BINDING SITE         3' GGCGGCGGTGGCG CGGC  5'              SEQ ID:744516
                                      A

ACC           G
                     5' CGCCGCC    GCCGCCGCC CCG  3'        SEQ ID:20604
KIAA0649                |||||||    ||||||||| |||
BINDING SITE         3' GCGGCGG    CGGCGGCGG GGC  5'        SEQ ID:745411
                                CGA           -

G  CA-        C
                     5' TC CCGC   CCGCCGC GCCGCCG           SEQ ID:20604
KIAA0649                || ||||   ||||||| |||||||
BINDING SITE         3' AG GGCG   GGCGGCG CGGCGGC           SEQ ID:745444
                           G   CGC        A

C         C     CCG
                     5' TCGC GCCACCGC GCCGCCG      3'       SEQ ID:20604
KIAA0700                |||| |||||||| |||||||
BINDING SITE         3' GGCG CGGTGGCG CGGTGGC      5'       SEQ ID:747790
                             A        A

C  CACC  C  C
                     5' GC GC    GC GC GCCGCCG  3'          SEQ ID:20604
KIAA0844                || ||    || || |||||||
BINDING SITE         3' CG CG    CG CG CGGCGGC  5'          SEQ ID:754642
                        A  A---  A  T
```

Fig. 26D/75

```
                            CCA       C
                    5' GCCG    CCGC GCCGCCGCCG 3'        SEQ ID:20604
KIAA0960               ||||    |||| ||||||||||
BINDING SITE        3' CGGC    GGCG CGGCGGCGGC 5'        SEQ ID:760740
                            ACC       A

C  CA          -    CG
                    5' TCGC GC CCGCCGC CGC  CCG          SEQ ID:20604
KIAA0963               |||| || ||||||| |||  |||
BINDING SITE        3' AGCG CG GGCGGCG GTG  GGC          SEQ ID:761105
                          T  AC        A    AA

G   CCA-
                    5' TC CCG     CCGCCGCCGCCG  3        SEQ ID:20604
KIAA0979               || |||     ||||||||||||
BINDING SITE        3' AG GGC     GGCGGCGGCGGC  5        SEQ ID:762065
                          A   CCTA

AC
                    5' TCGCCGCC  CGCCGCCGCCGCCG 3'       SEQ ID:20604
FUBP3                  ||||||||  ||||||||||||||
BINDING SITE        3' GGCGGCGG  GCGGCGGCGGCGGC 5'       SEQ ID:763022
                                 CA

AC
                    5' TCGCCGCC  CGCCGCCGCCGCCG 3'       SEQ ID:20604
KIAA0995               ||||||||  ||||||||||||||
BINDING SITE        3' GGCGGCGG  GCGGCGGCGGCGGC 5'       SEQ ID:763022
                                 CA

CCA
                    5' TCGCCG    CCGCCGCCGCCGCCG 3'      SEQ ID:20604
KIAA0995               ||||||    |||||||||||||||
BINDING SITE        3' GGCGGC    GGCGGCGGCGGCGGC 5'      SEQ ID:763026
                             AGC

C    A     C
                    5' TCG CGCC CCGCCG CGCCGCCG 3'       SEQ ID:20604
KIAA0995               ||| |||| |||||| ||||||||
BINDING SITE        3' GGC GCGG GGCGGC GCGGCGGC 5'       SEQ ID:763030
                          C    C      A

C    A
                    5' TCG CGCC CCGCCGCCGCCGCCG 3        SEQ ID:20604
KIAA0995               ||| |||| ||||||||||||||
BINDING SITE        3' GGC GCGG GGCGGCGGCGGCGGC 5        SEQ ID:763031
                          A    C

A  C
                    5' CGCCGCC CCG CGCCGCCGCCG  C        SEQ ID:20604
KIAA0995               ||||||| ||| |||||||||||  |
BINDING SITE        3' GCGGCGG GGC GCGGCGGCGGC  G        SEQ ID:763039
                             C  A
```

Fig. 26D/76

```
                          C                    G
              5' TCGC  GCCACCGCCGCCGCC            SEQ ID:20604
KIAA1016         ||||  |||||||||||||||
BINDING SITE  3' GGCG  CGGTGGCGGCGGTGGTGG         SEQ ID:764057
                    A                 GC

C    CACC
              5' TCGC GC        GCCGCCGCCGCC  3'  SEQ ID:20604
KIAA1061         |||| ||        ||||||||||||
BINDING SITE  3' GGCG CG        CGGTGGCGGCGGC 5'  SEQ ID:768364
                     A  ACA-

-    AC
              5' TCGCC GCC   CGCCGCCGCCGCCG    3  SEQ ID:20604
KIAA1079         ||||| |||   ||||||||||||||
BINDING SITE  3' GGCGG CGG   GCGGCGGCGGCGGC    5  SEQ ID:769234
                       G     AC

G    A      CG
              5' TC CCGCC CCGCCGC   CCG       3'  SEQ ID:20604
KIAA1091         || ||||| |||||||   |||
BINDING SITE  3' AG GGCGG GGCGGCG   GGC       5'  SEQ ID:769882
                  -       C         AT

C   A
              5' CGC GCC CCGCCGCCGCCGC         3' SEQ ID:20604
KIAA1140         ||| ||| ||||||||||||||
BINDING SITE  3' GCG CGG GGCGGCGGCGGCG         5' SEQ ID:771839
                      A   C

C  CA
              5' GC GC   CCGCCGCCGCCGCCG       3' SEQ ID:20604
KIAA1140         || ||   |||||||||||||||
BINDING SITE  3' CG CG   GGCGGCGGCGGCGGC       5' SEQ ID:771842
                   - AC

G  A--         C
              5' TCGCC CC   CCGCCG CGCCGCCG       SEQ ID:20604
KIAA1194         ||||| ||   |||||| ||||||||
BINDING SITE  3' AGCGG GG   GGCGGC GCGGCGGC       SEQ ID:776042
                      A  CGC        A

CAC
              5' CGCCGC    CGCCGCCGCCGCCG      3' SEQ ID:20604
KIAA1233         ||||||    |||||||||||||||
BINDING SITE  3' GCGGCG    GCGGCGGCGGCGGC      5' SEQ ID:779098
                           TCA

A       C  C
              5' CGCCGCC CCGCCGC GC GC         3' SEQ ID:20604
KIAA1332         ||||||| ||||||| || ||
BINDING SITE  3' GCGGCGG GGCGGCG CG CG         5' SEQ ID:785691
                         C       T  A
```

Fig. 26D/77

```
                         A          G
              5' TCGCCGCC CCGCCGCC CCGCCG 3'       SEQ ID:20604
KIAA1458         |||||||| |||||||| ||||||
BINDING SITE  3' GGCGGCGG GGCGGCGG GGCGGC 5'       SEQ ID:791465
                         C          A

-  A
              5' CCG CC CCGCCGCCGCCGCCG 3'         SEQ ID:20604
KIAA1458         ||| || |||||||||||||||
BINDING SITE  3' GGC GG GGCGGCGGCGGCGGC 5'         SEQ ID:791473
                   C  -

CG-  A  G
              5' GC   CC CC CCGCCGCCGCCG 3'        SEQ ID:20604
KIAA1483         ||   || || ||||||||||||
BINDING SITE  3' CG   GG GG GGCGGCGGCGGC 5'        SEQ ID:792995
                    ACA  A  -

C  CACC   C   C   C
              5' TCGC GC   GC  GC  GC GCCG    C    SEQ ID:20604
KIAA1483         |||| ||   ||  ||  || ||||    |
BINDING SITE  3' AGCG CG   CG  CG  CG CGGC    G    SEQ ID:793014
                    A  ACGA   A   A   A

A    GCC
              5' TCGCCGCC CC    GCCGCCGCCG 3'      SEQ ID:20604
KIAA1542         |||||||| ||    ||||||||||
BINDING SITE  3' GGCGGCGG GG    CGGCGGCGGC 5'      SEQ ID:795954
                         C    AGA

CAC        -
              5' CGC   CGC CGCCGCCGC 3'            SEQ ID:20604
KIAA1542         |||   ||| |||||||||
BINDING SITE  3' GCG   GCG GCGGCGGCG 5'            SEQ ID:795958
                    CTC        A

ACC    C   -   -
              5' TCGCCGCC  GC  GC  CG CCG 3'       SEQ ID:20604
KIAA1542         ||||||||  ||  ||  || |||
BINDING SITE  3' AGCGGCGG  CG  CG  GC GGC 5'       SEQ ID:795963
                    ---    A   T   T

A          G
              5' TCGCCGCC CCGCCGCC CCG 3'          SEQ ID:20604
KIAA1608         |||||||| |||||||| |||
BINDING SITE  3' AGCGGCGG GGCGGCGG GGT 5'          SEQ ID:799200
                         C          A

CG   AC
              5' TCGC  CC CCGCCGCCGCCG 3'         SEQ ID:20604
KIAA1608         ||||  || ||||||||||||
BINDING SITE  3' AGCG  GG GCGGCGGCGGCGG 5'        SEQ ID:799201
                    A-   GA
```

Fig. 26D/78

```
                              AC
                      5' TCGCCGCC  CGCCGCCGCCG   3'         SEQ ID:20604
KIAA1766                 ||||||||  |||||||||||
BINDING SITE          3' AGCGGCGG  GCGGCGGCGGC   5'         SEQ ID:808833
                              GA

G       A
                      5' TC CCGCC CCGCCGCCGCCG   C          SEQ ID:20604
KIAA1893                 || |||||  ||||||||||||  |
BINDING SITE          3' AG GGCGG GGCGGCGGCGGC   G          SEQ ID:816521
                          -    C

CA
                      5' TCGCCGC  CCGCCGCCGCCG   3'         SEQ ID:20604
KIAA1966                 |||||||  ||||||||||||
BINDING SITE          3' GGCGGCG  GGTGGCGGCGGC   5'         SEQ ID:822274
                              AC

C
                      5' TCGC GCCACCGCCGCCGC   3'           SEQ ID:20604
KIAA1966                 |||| ||||||||||||||
BINDING SITE          3' GGCG CGGTGGCGGCGGCG   5'           SEQ ID:822277
                            A

G
                      5' TCGCCGCCACCGCC CCGC   3'           SEQ ID:20604
KIAA1981                 ||||||||||||| ||||
BINDING SITE          3' AGTGGCGGTGGCGG GGCG   5'           SEQ ID:823610
                                   G

A        G
                      5' CGCC CCGCCGCCGCC CC   3'           SEQ ID:20604
LANCL2                   |||| ||||||||||| ||
BINDING SITE          3' GCGG GGCGGCGGCGG GG   5'           SEQ ID:828560
                          -              A

CCA       G
                      5' TCGCCG  CCGCC CCGCCGCCG   3'       SEQ ID:20604
LANO                     ||||||  ||||| |||||||||
BINDING SITE          3' AGCGGC  GGCGG GGCGGCGGC   5'       SEQ ID:828789
                             AGC     G

AC  C   C   C
                      5' TCGCCGCC  CG CG CGC GC   3'        SEQ ID:20604
LAP1B                    ||||||||  || || ||| ||
BINDING SITE          3' GGCGGCGG  GC GC GCG CG   5'        SEQ ID:828926
                              AC  A   A   A

-    CG
                      5' TCGCCG CCAC  CCGCCGCCGCC  3        SEQ ID:20604
LSM4                     |||||| ||||  ||||||||||||
BINDING SITE          3' AGCGGC GGTG  GGCGGCGGCGGC 5        SEQ ID:834693
                              C    AA
```

Fig. 26D/79

```
                    5' TCGCCGCCACCGCCGCCG    3'              SEQ ID:20604
MAP2K7                 ||||||||||||||||||
BINDING SITE        3' GGCGGCGGTGGCGGCGGC    5'              SEQ ID:838581

C   G
                    5' GCCGCCACCGC GCC CCG   3'              SEQ ID:20604
MAPK8IP3               |||||||||||  |||  |||
BINDING SITE        3' CGGCGGTGGCG CGG GGC   5'              SEQ ID:839431
                             A   -

CA    C      ---
                    5' TCGCCGC  CCGC GCC    GCCGCCG          SEQ ID:20604
MESDC1                 |||||||  |||| |||    |||||||
BINDING SITE        3' GGCGGCG  GGCG CGG    CGGCGGC          SEQ ID:842805
                          AC    C      TGA

CGCCAC
                    5' GC        CGCCGCCGCCGCCG  3'          SEQ ID:20604
MESDC1                 ||        ||||||||||||||
BINDING SITE        3' CG        GCGGCGGCGGCGGC  5'          SEQ ID:842838
                          ACCAA-

A
                    5' TCGCCGCC CCGCCGCCGCCGCCG   C          SEQ ID:20604
OATPRP4                |||||||| ||||||||||||||||  |
BINDING SITE        3' GGCGGCGG GGCGGCGGCGGCGGC   G          SEQ ID:844404
                                C

A
                    5' TCGCCGCC CCGCCGCCGCCGCCG   C          SEQ ID:20604
SLC21A11               |||||||| ||||||||||||||||  |
BINDING SITE        3' GGCGGCGG GGCGGCGGCGGCGGC   G          SEQ ID:844404
                                C

G    C
                    5' TC CCGC ACCGCCGCCGCCGCCG   C          SEQ ID:20604
MGC10702               || |||| ||||||||||||||||   |
BINDING SITE        3' GG GGCG TGGCGGCGGCGGCGGC   G          SEQ ID:844408
                          A    A

ACC  C  C
                    5' TCGCCGCC   GC GC GCCG   3'            SEQ ID:20604
MGC13159               ||||||||   || || ||||
BINDING SITE        3' AGCGGCGG   CG CG CGGC   5'            SEQ ID:851324
                              CCT  A  A

.    G    CA
                    5' TC CCGC   CCGCCGCCGCCGCCG   C         SEQ ID:20604
MGC14425               || ||||   ||||||||||||||||  |
BINDING SITE        3' AG GGCG   GGCGGCGGCGGCGGC   G         SEQ ID:852921
                             -   AC
```

Fig. 26D/80

```
                      AC       C
              5' TCGCCGCC  CGCCGC GCC    3'           SEQ ID:20604
MGC15396         |||||||| |||||| |||
BINDING SITE  3' GGCGGCGG  GCGGCG CGG    5'           SEQ ID:853827
                      CA       C

C    A        C
              5' TCG CGCC CCGCCG CGCCG    3'          SEQ ID:20604
MGC15396         ||| |||| |||||| |||||
BINDING SITE  3' AGT GCGG GGCGGC GCGGC    5'          SEQ ID:853851
                      C   C        A

ACC
              5' CGCCGCC    GCCGCCGCCGCCG    3'       SEQ ID:20604
MGC17347         ||||||| |||||||||||||
BINDING SITE  3' GCGGCGG    CGGCGGCGGTGGC    5'       SEQ ID:858358
                         CGA

A     C
              5' GCCGCC CCGC GCCGCC    3'             SEQ ID:20604
MGC17347         |||||| |||| ||||||
BINDING SITE  3' CGGCGG GGCG CGGCGG    5'             SEQ ID:858360
                      C     A

G              C  CG
              5' TC CCGCCACCGCCGCCGC GC         3    SEQ ID:20604
MGC1842          || |||||||||||||||| ||
BINDING SITE  3' AG GGCGGTGGCGGCGGCG CG         5    SEQ ID:858800
                   A                A  C

G   AC  CC  C
              5' TC CCGCC  CG  GC GCCGCCG   3'       SEQ ID:20604
MGC22679         || |||||  ||  || |||||||
BINDING SITE  3' AG GGCGG  GC  CG CGGCGGC   5'       SEQ ID:861565
                       -   CA  --  T

ACC
              5' TCGCCGCC    GCCGCCG    3'           SEQ ID:20604
MGC2594          ||||||||    |||||||
BINDING SITE  3' AGCGGCGG    CGGCGGC    5'           SEQ ID:864289
                         AGC

5' TCGCCGCCACCGCCGCCGCCG    3'          SEQ ID:20604
MGC26684         |||||||||||||||||||||
BINDING SITE  3' GGCGGCGGTGGCGGTGGCGGC    5'          SEQ ID:865556

C   A      GC   C
              5' TCGC GCC CCGCC CGC GC    3'          SEQ ID:20604
MGC3222          |||| ||| ||||| ||| ||
BINDING SITE  3' AGCG CGG GGCGG GCG CG    5'          SEQ ID:870434
                      A   C     A-   -
```

Fig. 26D/81

```
                              A       GCC
                     5' TCGCCGCC CCGCCGCC  GC  3'         SEQ ID:20604
MGC4170                 |||||||| ||||||||  ||
BINDING SITE         3' GGCGGCGG GGCGGCGG  CG  5'         SEQ ID:872011
                              C       AGT

CA-  -
                     5' CCGC    CC GCCGCCGCCGCCG  3'      SEQ ID:20604
MGC4172                 ||||    || |||||||||||||
BINDING SITE         3' GGCG    GG CGGCGGCGGCGGC  5'      SEQ ID:872115
                        AGA  A

C        CG   CC
                     5' TCGC GCCACCGC  CCG  GCCG  3'      SEQ ID:20604
MGC4172                 |||| ||||||||  |||  ||||
BINDING SITE         3' AGCG CGGTGGCG  GGT  CGGC  5'      SEQ ID:872142
                                       A-   A-

C          C
                     5' TCGCCG CACCGCCGC GCCG  3'         SEQ ID:20604
MGC5466                 |||||| ||||||||| ||||
BINDING SITE         3' GGCGGC GTGGTGGCG CGGC  5'         SEQ ID:877031
                              A         A

A--      C
                     5' TCGCCGCC    CCGC GCCGCCGCCG       SEQ ID:20604
MIP-T3                  ||||||||    |||| ||||||||||
BINDING SITE         3' GGCGGCGG    GGCG CGGCGGCGGC       SEQ ID:879055
                                    CCG  -

CACC        C
                     5' GCCGC     GCCGCCGC GCCG  3'       SEQ ID:20604
MIR                     |||||     |||||||| ||||
BINDING SITE         3' CGGCG     CGGCGGTG CGGC  5'       SEQ ID:879086
                           A---            T

C   A
                     5' GC GCC CCGCCGCCGCCGCCG  3'        SEQ ID:20604
MOV34-34KD              || ||| |||||||||||||||
BINDING SITE         3' CG CGG GGCGGCGGCGGCGGC  5'        SEQ ID:881891
                           T   C

C   CA
                     5' GC GC   CCGCCGCCGCCGCCG  3'       SEQ ID:20604
MOV34-34KD              || ||   |||||||||||||||
BINDING SITE         3' CG CG   GGCGGCGGCGGCGGC  5'       SEQ ID:881892
                          A   TC

CC   CACC
                     5' TCG  GC        GCCGCCGCCGCCG  3'  SEQ ID:20604
MOV34-34KD              |||  ||        |||||||||||||
BINDING SITE         3' AGC  CG        CGGCGGCGGCGGC  5'  SEQ ID:881894
                          AT   ACGT
```

Fig. 26D/82

```
                              C  CA---
                         5' TCGC GC      CCGCCGCCGCCGCCG         SEQ ID:20604
MPZL1                       |||| ||      |||||||||||||||
BINDING SITE             3' GGTG CG      GGCGGCGGCGGCGGC         SEQ ID:882046
                            A   TCAGC

A            CG
                         5' CCGCC CCGCCGCCGC  CC   3'            SEQ ID:20604
MPZL1                       ||||| ||||||||||  ||
BINDING SITE             3' GGCGG GGCGGCGGCG  GG   5'            SEQ ID:882049
                                 C            CA

A        C  C
                         5' TCGCCGCC CCGCCGC GC GC    3'         SEQ ID:20604
NCOR1                       |||||||| ||||||| || ||
BINDING SITE             3' GGCGGCGG GGCGGCG CG CG    5'         SEQ ID:889437
                                     C        C  A

CG   -
                         5' TCGC   CCA  CCGCCGCCGCCGCCG          SEQ ID:20604
NCOR1                       ||||   |||  ||||||||||||||
BINDING SITE             3' AGTG   GGT  GGCGGCGGCGGCGGC          SEQ ID:889452
                                A-     C

5' TCGCCGCCACCGCCGCCGCCGC    3'         SEQ ID:20604
NFAT5                       |||||||||||||||||||||||
BINDING SITE             3' AGCGGCGGTGGCGGCGGCGGCG    5'         SEQ ID:892135

AC    C
                         5' CGCC  CGC  GCCGCCGCC    3'           SEQ ID:20604
NIR1                        ||||  |||  |||||||||
BINDING SITE             3' GCGG  GCG  CGGCGGTGG    5'           SEQ ID:893156
                                A-    A

C
                         5' GCCGCCACCGC GCCGCCGCCG    3'         SEQ ID:20604
NIR1                        |||||||||||| |||||||||
BINDING SITE             3' CGGCGGTGGCG CGGCGGCGGC    5'         SEQ ID:893162
                                        T

5' TCGCCGCCACCGCCGCCG    3'             SEQ ID:20604
NKX2B                       |||||||||||||||||||
BINDING SITE             3' AGCGGCGGTGGCGGCGGC    5'             SEQ ID:893635

CAC    C
                         5' TCGCCGC   CGC  GCCGCCGCCG    3'      SEQ ID:20604
NS1-BP                      |||||||   |||  |||||||||||
BINDING SITE             3' AGTGGTG   GCG  CGGCGGCGGC    5'      SEQ ID:896538
                                  CAC    A
```

Fig. 26D/83

```
                            C    AC    C           CG
                    5' TCG CGCC  CGC GCCGCCGC    3'              SEQ ID:20604
NTN4                    ||| ||||  ||| ||||||||
BINDING SITE        3' AGC GCGG  GCG CGGCGGCG    5'              SEQ ID:896979
                            C    --    T           A

A        C   -
                    5' CGCCGCC CCGC GC CGCCG     3'               SEQ ID:20604
OAZ1                    ||||||| |||| || |||||
BINDING SITE        3' GCGGCGG GGCG CG GCGGC     5'               SEQ ID:899518
                               C     A A

G    CACC
                    5' TC CCGC      GCCGCCGCCGC  3'              SEQ ID:20604
OAZ1                    || ||||     |||||||||||
BINDING SITE        3' AG GGCG      CGGCGGCGGCG  5'              SEQ ID:899526
                        A          ----

C
                    5' GCCG CACCGCCGCCGCCGCCG      C             SEQ ID:20604
OAZ2                   |||| ||||||||||||||||||      |
BINDING SITE        3' CGGC GTGGCGGCGGCGGCGG      G             SEQ ID:899599
                            A

A
                    5' TCGCCGCC CCGCCGCCGCCGCCG  3'             SEQ ID:20604
OAZ2                   |||||||| |||||||||||||||
BINDING SITE        3' AGTGGCGG GGCGGCGGCGGCGGC  5'             SEQ ID:899619
                                C

C   A  G
                    5' CGC GCC CC CCGCCGCCGC     3'              SEQ ID:20604
OSBPL1A                ||| ||| || ||||||||||
BINDING SITE        3' GCG CGG GG GGCGGCGGCG     5'              SEQ ID:902150
                                A   -  A

CC-
                    5' TCGCCGCCACCGCCG       GC   3'             SEQ ID:20604
PARG1                  ||||||||||||||||      ||
BINDING SITE        3' GGCGGCGGTGGCGGC       CG   5'             SEQ ID:907038
                                             TCC

CA
                    5' CCGC    CCGCCGCCGCCGC    3'               SEQ ID:20604
PCAF                   ||||    |||||||||||||
BINDING SITE        3' GGCG    GGCGGCGGCGGTG    5'               SEQ ID:908148
                               AC

CAC
                    5' GC    CGCCGCCGCCGCCG     3'               SEQ ID:20604
PCCX2                  ||    |||||||||||||||
BINDING SITE        3' CG    GCGGCGGCGGCGGC     5'               SEQ ID:908515
                       CC-
```

Fig. 26D/84

```
                        A     C
              5' CGCCGCC CCG CGCCGCCG 3'            SEQ ID:20604
PELI2            ||||||| ||| ||||||||
BINDING SITE  3' GCGGCGG GGC GCGGCGGC 5'            SEQ ID:912193
                         C   T

AC
              5' GCCGCC    CGCCGCCGCCG 3'           SEQ ID:20604
PELI2            ||||||    |||||||||||
BINDING SITE  3' CGGCGG    GCGGCGGCGGC 5'           SEQ ID:912206
                           CT

AC-
              5' CCGCC    CGCCGCCGCCGCCG 3'         SEQ ID:20604
PF1              |||||    ||||||||||||||
BINDING SITE  3' GGCGG    GCGGCGGCGGCGGC 5'         SEQ ID:912812
                          AGA

G    A      GCC-
              5' TC CCGCC CCGCC    GCCGCCG          SEQ ID:20604
PLCL2            || ||||| |||||    |||||||
BINDING SITE  3' AG GGCGG GGCGG    CGGCGGC          SEQ ID:917013
                      G    C      AGCC

A       CC
              5' CCGCC CCGCCG  GCCGCCG 3'           SEQ ID:20604
PM5              |||||  ||||||  |||||||
BINDING SITE  3' GGCGG  GGCGGT  CGGCGGC 5'          SEQ ID:917719
                        C       CT

CA---
              5' CCGC      CCGCCGCCGCCGCCG 3'       SEQ ID:20604
PMX2B            ||||      ||||||||||||||
BINDING SITE  3' GGCG      GGCGGCGGCGGCGGC 5'       SEQ ID:918145
                    ACAGC

-  CAC
              5' TCGCC GC   CGCCGCCGCCGCCG          SEQ ID:20604
PMX2B            ||||| ||   ||||||||||||||
BINDING SITE  3' AGCGG CG   GCGGCGGCGGCGGC          SEQ ID:918187
                      G ACA

A
              5' TCGCCGCC CCGCCGCCGCCGC 3'          SEQ ID:20604
PMX2B            |||||||| ||||||||||||||
BINDING SITE  3' AGCGGCGG GGCGGCGGCGGCG 5'          SEQ ID:918189
                          C

A-   CC  C--    C
              5' GCCGCC CCG GC  GCCG CG 3           SEQ ID:20604
PRDM8            ||||||  |||  ||  ||||  ||
BINDING SITE  3' CGGCGG GGC  CG  CGGC GC 5          SEQ ID:924600
                         CG  AC  CTA  A
```

Fig. 26D/85

```
                        CA           CC
              5' CGCCGC  CCGCCGCCG  GC  3'         SEQ ID:20604
PSIP2            ||||||  |||||||||  ||
BINDING SITE  3' GCGGCG  GGCGGCGGC  CG  5'         SEQ ID:933689
                        AC           AT

-----    A      C
              5' TCGC      CGCC  CCGC  GCCGCCGCC   SEQ ID:20604
PSIP2            ||||      ||||  ||||  |||||||||
BINDING SITE  3' AGCG      GCGG  GGCG  CGGCGGCGG   SEQ ID:933709
                   TTGGC    C     A

A      C
              5' CCGCC CCGC GCCGCCGCCG 3'          SEQ ID:20604
PTR4             ||||| |||| ||||||||||
BINDING SITE  3' GGCGG GGCG CGGCGGCGGC 5'          SEQ ID:937407
                       C    C

-     A
              5' TCGCC GCC CCGCCGCCGCCGCCG  3      SEQ ID:20604
QKI              ||||| |||  ||||||||||||||
BINDING SITE  3' GGCGG CGG GGCGGCGGCGGCGGC  5      SEQ ID:938140
                       G   C

A       GCC
              5' CGCCGCC CCGCC    GCCG  3'         SEQ ID:20604
QKI              ||||||| |||||    ||||
BINDING SITE  3' GCGGCGG GGCGG    CGGC  5'         SEQ ID:938170
                        C       ACA

ACC       C
              5' CGCC    GCCGC GCCGCCG  3'         SEQ ID:20604
QKI              ||||    ||||| |||||||
BINDING SITE  3' GCGG    CGGCG CGGCGGC  5'         SEQ ID:938172
                   AGA       A

CA         C  CG
              5' GCCGC  CCGCCGC GC  CCG  3'        SEQ ID:20604
QKI              |||||  ||||||| ||  |||
BINDING SITE  3' CGGCG  GGCGGCG CG  GGC  5'        SEQ ID:938196
                    AC         -  A-

CACC    C   C----
              5' TCGCCGC    GC GC    GCCGCCG       SEQ ID:20604
RAB2             |||||||    || ||    |||||||
BINDING SITE  3' GGCGGCG    CG CG    CGGCGGC       SEQ ID:939662
                    A---    A  A  ACAGT

AC
              5' CGCCGCC  CGCCGCCGCCGC  3'         SEQ ID:20604
RAB2             |||||||  ||||||||||||
BINDING SITE  3' GCGGCGG  GCGGCGGCGGCG  5'         SEQ ID:939672
                           --
```

Fig. 26D/86

```
                        AC
              5' CGCCGCC   CGCCGCCGCCGC  3'         SEQ ID:20604
RAB2             |||||||   ||||||||||||
BINDING SITE  3' GCGGCGG   GCGGCGGCGGCG  5'         SEQ ID:939672
                        --

CCACC
              5' CCG        GCCGCCGCCGCCG  3'       SEQ ID:20604
RAB22A           |||        |||||||||||||
BINDING SITE  3' GGC        CGGCGGCGGCGGC  5'       SEQ ID:939920
                     CCT--

CACC              -
              5' CGCCGC     GCCGCCGC  CG  3'        SEQ ID:20604
RAB22A           ||||||     ||||||||  ||
BINDING SITE  3' GCGGCG     CGGCGGCG  GC  5'        SEQ ID:939925
                   A---              T

-     CCA
              5' TCG CCG    CCGCCGCCGCCGCCG  3      SEQ ID:20604
RAB5EP           ||| |||    |||||||||||||||
BINDING SITE  3' AGT GGC    GGCGGCGGCGGCGGC  5      SEQ ID:941423
                   T   TC-

C    AC
              5' TCG CGCC  CGCCGCCGC  3'            SEQ ID:20604
RALY             ||| ||||  |||||||||
BINDING SITE  3' AGC GCGG  GCGGCGGCG  5'            SEQ ID:943042
                     A    CA

C    AC        CG
              5' TCG CGCC  CGCCGCCGC  CCG  3        SEQ ID:20604
RALY             ||| ||||  |||||||||  |||
BINDING SITE  3' AGC GCGG  GCGGCGGCG  GGC  5        SEQ ID:943043
                     A    CA        AT

C  CCAC    C
              5' TCG CG    CGCCG CGCCGCCG  3        SEQ ID:20604
RALY             ||| ||    ||||| ||||||||
BINDING SITE  3' AGC GC    GCGGC GCGGCGGC  5        SEQ ID:943044
                     A  AGCA    A

GCC
              5' CC    ACCGCCGCCGCCG  3'            SEQ ID:20604
RC3              ||    ||||||||||||||
BINDING SITE  3' GG    TGGCGGCGGCGGC  5'            SEQ ID:945022
                       AGC

C  CACC
              5' GC GC      GCCGCCGCCGCCG  3'       SEQ ID:20604
RNPC2            || ||      |||||||||||||
BINDING SITE  3' CG CG      CGGCGGCGGCGGC  5'       SEQ ID:950359
                     A  ACGA
```

Fig. 26D/87

```
                        C  CACC      C
                   5' GC GC       GC GCCGCCGCCG  3'      SEQ ID:20604
RNPC2                 || ||       || ||||||||||
BINDING SITE       3' CG CG       CG CGGCGGCGGC  5'      SEQ ID:950360
                      A  ACGA     A

ACC
                   5' TCGCCGCC     GCCGCCGCCG  3'        SEQ ID:20604
RPS6KC1               ||||||||     ||||||||||
BINDING SITE       3' GGCGGCGG     CGGCGGCGGC  5'        SEQ ID:952575
                            AGA

---   A    C---
                   5' TCGCC   GCC  CCGC    GCCGCCGC      SEQ ID:20604
SERP1                 |||||   |||  ||||    ||||||||
BINDING SITE       3' GGCGG   CGG  GGCG    CGGCGGCG      SEQ ID:963975
                         CAG    C     AAAC

AC
                   5' CGCCGCC   CGCCGCCGC  3'            SEQ ID:20604
SERP1                 |||||||   |||||||||
BINDING SITE       3' GCGGCGG   GCGGCGGCG  5'            SEQ ID:963978
                             CA

GC    CA        C
                   5' TC  CGC   CCGCCG CGCCGCCG  3'      SEQ ID:20604
SERP1                 ||  |||   |||||| ||||||||
BINDING SITE       3' AG  GCG   GGCGGC GCGGCGGC  5'      SEQ ID:964015
                         A-    C-       A

CA-       --
                   5' TCGCCGC   CCGC   CGCCGCCGCCG       SEQ ID:20604
SFRS9                 |||||||   ||||   |||||||||||
BINDING SITE       3' GGCGGCG   GGTG   GCGGCGGCGGC       SEQ ID:964985
                          TCG       CA

CAC              - C
                   5' CCGC    CGCCGCCG C GCC  3'         SEQ ID:20604
SH2D3C                ||||    |||||||| | |||
BINDING SITE       3' GGCG    GCGGCGGC G TGG  5'         SEQ ID:965802
                         ACA              C T

C-  CACC      C
                   5' TCGC  GC      GC GCCGCCGCCG        SEQ ID:20604
SHANK3                ||||  ||      || ||||||||||
BINDING SITE       3' AGCG  CG      CG CGGCGGCGGC        SEQ ID:966276
                        CC  CTT-    A

- C          C
                   5' GCCG C ACCGCCGC GC  3'             SEQ ID:20604
SHARP                 |||| | |||||||| ||
BINDING SITE       3' CGGC G TGGCGGCG CG  5'             SEQ ID:966487
                         C C          A
```

Fig. 26D/88

```
                        A-    C  C
              5' TCGCCGCC  CCGC GC GC   3'          SEQ ID:20604
SIAT8A           ||||||||  |||| || ||
BINDING SITE  3' AGCGGCGG  GGCG CG CG   5'          SEQ ID:966899
                        AG    -  A

AC        -
              5' CCGCC   CGCC GCCGCCGC  3'          SEQ ID:20604
SLC16A3          |||||   |||| ||||||||
BINDING SITE  3' GGCGG   GTGG CGGCGGCG  5'          SEQ ID:968639
                   A-        A

G     A
              5' TC CCGCC CCGCCGCCGCCG      C       SEQ ID:20604
SLC21A11         || ||||| |||||||||||||     |
BINDING SITE  3' GG GGCGG GGCGGCGGCGGCGGC   G       SEQ ID:969275
                    G     C

A                )
              5' TCGCCGCC CCGCCGCCGCCGC  3'         SEQ ID:20604
OATPRP4          |||||||| |||||||||||||
BINDING SITE  3' GGCGGCGG GGCGGCGGCGGCG  5'         SEQ ID:969284
                         C

A
              5' TCGCCGCC CCGCCGCCGCCGC  3'         SEQ ID:20604
SLC21A11         |||||||| |||||||||||||
BINDING SITE  3' GGCGGCGG GGCGGCGGCGGCG  5'         SEQ ID:969284
                         C

A          C
              5' TCGCCGCC CCGCCGCCGC GCCG  3'       SEQ ID:20604
SLC21A11         |||||||| |||||||||| ||||
BINDING SITE  3' GGCGGCGG GGCGGCGGCG CGGC  5'       SEQ ID:969288
                         C          A

A   C    CG-
              5' CCGCC CCGC GCCGC    CC  3'         SEQ ID:20604
SLC21A11         ||||| |||| |||||    ||
BINDING SITE  3' GGCGG GGCG CGGCG    GG  5'         SEQ ID:969292
                   C   A    AAA

A            )
              5' TCGCCGCC CCGCCGCCG  3'             SEQ ID:20604
SLC21A11         |||||||| |||||||||
BINDING SITE  3' AGCGGCGG GGCGGCGGC  5'             SEQ ID:969328
                          C

CA    CC
              5' TCGCCGC CCG GCCGCCG  3'            SEQ ID:20604
SLC21A11         ||||||| ||| |||||||
BINDING SITE  3' AGCGGCG GGC CGGCGGC  5'            SEQ ID:969329
                       A-    --
```

Fig. 26D/89

```
                            CA      C
                    5' CGC  CCGC GCCGCCGC   3'           SEQ ID:20604
SRF                    |||  |||| ||||||||
BINDING SITE        3' GCG  GGCG CGGCGGCG   5'           SEQ ID:979150
                            AC      C

--   A--
                    5' CGCC   GCC     CCGCCGCCGCCGCCG    SEQ ID:20604
SSBP3                  ||||   |||     |||||||||||||||
BINDING SITE        3' GCGG   CGG     GGCGGCGGCGGCGGC    SEQ ID:980403
                           CT    AGC

A              CG
                    5' CGCCGCC CCGCCGCCGC   CCG   3'     SEQ ID:20604
SSBP3                  ||||||| ||||||||||   |||
BINDING SITE        3' GCGGCGG GGCGGCGGCG   GGC   5'     SEQ ID:980404
                              C              AT

A             CCG
                    5' TCGCCGCC CCGCCGCCGCCG       C     SEQ ID:20604
SSBP3                  |||||||| ||||||||||||       |
BINDING SITE        3' AGCGGCGG GGCGGCGGCGGC       G     SEQ ID:980415
                              C             GC

CG   C
                    5' GC   CCAC GCCGCCGCCGCCG   3'      SEQ ID:20604
SSBP4                  ||   |||| ||||||||||||
BINDING SITE        3' CG   GGTG CGGCGGCGGCGGC   5'      SEQ ID:980450
                           A-   -

A          C
                    5' CGCC  CCGCCGCCGC GC   3'          SEQ ID:20604
STIM2                  ||||  |||||||||| ||
BINDING SITE        3' GCGG  GGCGGCGGCG CG   5'          SEQ ID:982983
                             C          C

-   A
                    5' TCGCC GCC CCGCCGCCGCCGCCG         SEQ ID:20604
STK39                  ||||| ||| |||||||||||||||
BINDING SITE        3' GGCGG CGG GGCGGCGGCGGCGGC         SEQ ID:983798
                            G   C

A       - G
                    5' TCGCCGCC CCGCCG CC CCGCCG  3      SEQ ID:20604
STK39                  |||||||| |||||| || ||||||
BINDING SITE        3' GGCGGCGG GGCGGC GG GGCGGC  5      SEQ ID:983808
                              C       A -

A          G
                    5' CGCCGCC CCGCCGCCG CC CCG   3'     SEQ ID:20604
KIAA0995               ||||||| ||||||||| || |||
BINDING SITE        3' GCGGCGG GGCGGCGGC GG GGC   5'     SEQ ID:983814
                             C          A -
```

Fig. 26D/90

```
                          A      -  G
              5' CGCCGCC CCGCCGCCG CC CCG   3'        SEQ ID:20604
STK39            ||||||  |||||||||  ||  |||
BINDING SITE  3' GCGGCGG GGCGGCGGC GG GGC   5'        SEQ ID:983814
                          C         A  -

G    CA           CC
              5' TC CCGC  CCGCCGCCGCCG      3'        SEQ ID:20604
STRBP            || ||||  ||||||||||||
BINDING SITE  3' AG GGCG  GGCGGCGGCGGC      5'        SEQ ID:984349
                   -    A-

AC      C
              5' TCGCCGCC   CGCCG CGCCGCCG  3'        SEQ ID:20604
SULT4A1          ||||||||   |||||  ||||||||
BINDING SITE  3' GGCGGCGG   GCGGC GCGGCGGC  5'        SEQ ID:985480
                         CA      A

CCA      C
              5' TCGCCG    CCG CGCCGCCGCCG  3'        SEQ ID:20604
SULT4A1          ||||||    |||  ||||||||||||
BINDING SITE  3' GGCGGC    GGC GCGGCGGCGGC  5'        SEQ ID:985482
                       AGC    A

A    C     C
              5' GCCGCC CCG CGCCG CGCCG     3'        SEQ ID:20604
SULT4A1          ||||||  |||  |||||  |||||
BINDING SITE  3' CGGCGG GGC GCGGC GCGGC     5'        SEQ ID:985499
                         C    A     A

CCAC
              5' TCGCCG       CGCCGCCGCCGCC 3'        SEQ ID:20604
SULT4A1          ||||||       ||||||||||||||
BINDING SITE  3' AGCGGC       GCGGCGGCGGCGG 5'        SEQ ID:985516
                          A---

A
              5' TCGCCGCC CCGCCGCCG         3'        SEQ ID:20604
TBLR1            ||||||||  ||||||||
BINDING SITE  3' AGCGGCGG GGCGGTGGC         5'        SEQ ID:989703
                            C

A    C  -  C
              5' TCGCCGCC CCGC GC CG CGCCG  3        SEQ ID:20604
TIEG             ||||||||  ||||  ||  ||  |||||
BINDING SITE  3' GGCGGCGG GGCG CG GT GCGGC  5        SEQ ID:993412
                          C    -  A  C

CA
              5' CGCCGC  CCGCCGCCGCCG       3'        SEQ ID:20604
TIEG             ||||||  ||||||||||||
BINDING SITE  3' GCGGCG  GGCGGCGGCGGC       5'        SEQ ID:993414
                   AG
```

Fig. 26D/91

```
                              C   ACC
                         5' TCGC GCC    GCCGCCGCCGCCG 3'         SEQ ID:20604
FLJ20288                    |||| |||    |||||||||||||
BINDING SITE             3' GGCG CGG    CGGCGGCGGCGGC 5'         SEQ ID:993970
                              A   CGA

C   ACC
                         5' TCGC GCC    GCCGCCGCCGCCG 3'         SEQ ID:20604
TIP120A                     |||| |||    |||||||||||||
BINDING SITE             3' GGCG CGG    CGGCGGCGGCGGC 5'         SEQ ID:993970
                              A   CGA

-  CA   C
                         5' GCC GC  CCGC GCCGCCGCCG 3'            SEQ ID:20604
TIP120A                     ||| ||  |||| ||||||||||
BINDING SITE             3' CGG CG  GGCG CGGCGGCGGC 5'            SEQ ID:993979
                              G  AC   A

A
                         5' GCCGCC CCGCCGCCGCCGC 3'               SEQ ID:20604
TIP120A                     |||||| |||||||||||||
BINDING SITE             3' CGGCGG GGCGGCGGCGGTG 5'               SEQ ID:993980
                                   C

CA
                         5' GC  CCGCCGCCGCCGCCG 3'                SEQ ID:20604
TLK2                        ||  |||||||||||||||
BINDING SITE             3' CG  GGCGGCGGCGGCGGC 5'                SEQ ID:994634
                              AC

GC   C  -
                         5' TC CGC AC CGCCGCCGCCGCCG               SEQ ID:20604
TPARL                       || ||| || ||||||||||||||
BINDING SITE             3' AG GTG TG GCGGCGGCGGCGGC               SEQ ID:997782
                              GA   C  A

A           C--
                         5' CCGCC CCGCCGCCGC    GCCG 3'           SEQ ID:20604
TRIM28                      ||||| ||||||||||    ||||
BINDING SITE             3' GGCGG GGCGGCGGCG    CGGC 5'           SEQ ID:1000325
                                C           CTC

CA
                         5' GCCGC    CCGCCGCCGCCGCCG    C         SEQ ID:20604
TRIM28                      |||||    |||||||||||||||    |
BINDING SITE             3' CGGCG    GGCGGCGGCGGCGGC    G         SEQ ID:1000339
                              AC

CC------          C
                         5' TCGCCGCCA        GCCGC GCCGC          SEQ ID:20604
TRIM28                      |||||||||        ||||| |||||
BINDING SITE             3' AGCGGCGGT        CGGCG CGGCG          SEQ ID:1000350
                                TGACGACC       A
```

Fig. 26D/92

```
                           AC--
              5' TCGCCGCC    CGCCGCCGCCGCCG        SEQ ID:20604
TRIM33           ||||||||    ||||||||||||||
BINDING SITE  3' GGCGGCGG    GCGGCGGCGGCGGC        SEQ ID:1000528
                           GGCA

A          G
              5' TCGCCGCC CCGCCGCC CCG        3'   SEQ ID:20604
TRIM33           |||||||| |||||||| |||
BINDING SITE  3' AGCGGCGG GGCGGCGG GGT        5'   SEQ ID:1000533
                         C          G

CA
              5' GC   CCGCCGCCGCCGCCG         3'   SEQ ID:20604
TRIP10           ||   |||||||||||||||
BINDING SITE  3' CG   GGCGGCGGCGGCGGC         5'   SEQ ID:1001537
                 AG

CA
              5' GC   CCGCCGCCGCCGCCG         3'   SEQ ID:20604
ZDHHC3           ||   |||||||||||||||
BINDING SITE  3' CG   GGCGGCGGCGGCGGC         5'   SEQ ID:1001537
                 AG

G   ACC         C
              5' CGCC CC   GCCGCCGC GC         3'  SEQ ID:20604
WBSCR21          |||| ||   |||||||| ||
BINDING SITE  3' GCGG GG   CGGCGGCG CG         5'  SEQ ID:1012104
                     G   AGC         A

C    A  ---       C  CG
              5' TCG CGCC CC    GCCGCCGC GC        SEQ ID:20604
WBSCR21          ||| |||| ||    |||||||| ||
BINDING SITE  3' AGC GCGG GG    CGGCGGCG CG        SEQ ID:1012156
                     C    G  AGC       A  ACG

AC    CCGC
              5' CCGCC CG     CGCCGCCG       3'    SEQ ID:20604
ZDHHC5           ||||| ||     ||||||||
BINDING SITE  3' GGCGG GC     GTGGCGGC       5'    SEQ ID:1016404
                    CA    AACA

CCGC         G-
              5' TCG    CACCGCCGCC  CCG      3'    SEQ ID:20604
ZDHHC5           |||    ||||||||||  |||
BINDING SITE  3' AGC    GTGGCGGCGG  GGC      5'    SEQ ID:1016478
                        AACA         AG

CA         C
              5' CGCCGC CCGCCGC GCCGCCG       3'   SEQ ID:20604
ZER6             |||||| ||||||| |||||||
BINDING SITE  3' GCGGCG GGCGGCG CGGTGGC       5'   SEQ ID:1016788
                        AC       A
```

Fig. 26D/93

```
                             ACC       C
                    5' TCGCCGCC  GCCGCCGC  GCC  3'        SEQ ID:20604
ZER6                   ||||||||  ||||||||  |||
BINDING SITE        3' AGCGGCGG  CGGCGGCG  CGG  5'        SEQ ID:1016846
                             CGA       A

C   ACCGC--
                    5' GC GCC           CGCCGCCGCCG  3'   SEQ ID:20604
ZF                     || |||           |||||||||||
BINDING SITE        3' CG CGG           GCGGCGGCGGC  5'   SEQ ID:1016945
                           C·  CCCTCTA

CGCCAC
                    5' GC           CGCCGCCGCCGCC  3'     SEQ ID:20604
ZNF364                 ||           |||||||||||||
BINDING SITE        3' CG           GCGGCGGCGGCGG  5'     SEQ ID:1023294
                             TCAGCA

C   A           GC
                    5' TCG CGCC CCGCCGCCGCC  CG   3       SEQ ID:20604
ZNF364                 ||| |||| |||||||||||  ||
BINDING SITE        3' AGC GCGG GGCGGCGGCGG  GC   5       SEQ ID:1023303
                          A   C           A-

C         C
                    5' GCCGCCAC GCCGCCG CGCCG  3'         SEQ ID:20604
ZTL1                   |||||||| ||||||| |||||
BINDING SITE        3' CGGCGGTG CGGCGGC GCGGC  5'         SEQ ID:1023979
                              A         A

C         C
                    5' GCCGCCAC GCCGCCG CGCCG  3'         SEQ ID:20604
ZTL1                   |||||||| ||||||| |||||
BINDING SITE        3' CGGCGGTG CGGCGGC GCGGC  5'         SEQ ID:1023979
                              A         A

A     C
                    5' CCGCC CCGC GCCGCCG  3'             SEQ ID:20604
CTCF                   ||||| |||| |||||||
BINDING SITE        3' GGCGG GGCG CGGCGGT  5'             SEQ ID:1037665
                             C     A

A
                    5' CCGCC CCGCCGCCGCCGCC  C   3        SEQ ID:20604
ERIHFB2122             ||||| |||||||||||||||  |
BINDING SITE        3' GGCGG GGCGGCGGCGGCGGC  G   5       SEQ ID:1065873
                                             C

A
                    5' CCGCC CCGCCGCCGCCGCC  C   3        SEQ ID:20604
KIAA0397               ||||| |||||||||||||||  |
BINDING SITE        3' GGCGG GGCGGCGGCGGCGGC  G   5       SEQ ID:1065873
                                             C
```

Fig. 26D/94

```
                           A     C
                  5' TCGCCGCC CCGCCG CGCCGCCG 3'          SEQ ID:20604
FUBP3                ||||||||  ||||||  ||||||||
BINDING SITE      3' AGCGGCGG GGCGGC GCGGCGGC 5'          SEQ ID:1190283
                           C      T

-  AC
                  5' GCCG CC  CGCCGCCGCCGCCG 3'           SEQ ID:20604
H2AV                 |||| ||  ||||||||||||||
BINDING SITE      3' CGGC GG  GCGGCGGCGGCGGC 5'           SEQ ID:1303366
                        T  GC

A
                  5' CGCC CCGCCGCCGCCGCC 3'               SEQ ID:20604
FLJ20539             |||| |||||||||||||||
BINDING SITE      3' GCGG GGCGGCGGCGGCGG 5'               SEQ ID:1310953
                        C

A
                  5' CGCC CCGCCGCCGCCGCC 3'               SEQ ID:20604
KIAA1893             |||| |||||||||||||||
BINDING SITE      3' GCGG GGCGGCGGCGGCGG 5'               SEQ ID:1310953
                        C

A
                  5' CGCC CCGCCGCCGCCGCC 3'               SEQ ID:20604
RINZF                |||| |||||||||||||||
BINDING SITE      3' GCGG GGCGGCGGCGGCGG 5'               SEQ ID:1310953
                        C

CA
                  5' GCCGC  CCGCCGCCGCCGCCG 3'            SEQ ID:20604
TIP120A              |||||  |||||||||||||||
BINDING SITE      3' CGGCG  GGCGGCGGCGGCGGC 5'            SEQ ID:1323750
                        AC

A
                  5' TCGCCGCC CCGCCGCCGCCGCCG 3'          SEQ ID:20604
LOC146223            ||||||||  |||||||||||||||
BINDING SITE      3' GGCGGCGG GGCGGCGGCGGCGGC 5'          SEQ ID:94853
                               C

A
                  5' TCGCCGCC CCGCCGCCGCCGCCG 3'          SEQ ID:20604
LOC255426            ||||||||  |||||||||||||||
BINDING SITE      3' GGCGGCGG GGCGGCGGCGGCGGC 5'          SEQ ID:94853
                               C

A
                  5' TCGCCGCC CCGCCGCCGCCGCCG 3'          SEQ ID:20604
LOC255426            ||||||||  |||||||||||||||
BINDING SITE      3' GGCGGCGG GGCGGCGGCGGCGGC 5'          SEQ ID:94853
                               C
```

Fig. 26D/95

```
                         A
                5' TCGCCGCC CCGCCGCCGCCGCCG 3'        SEQ ID:20604
LOC255426          ||||||||  |||||||||||||||
BINDING SITE    3' GGCGGCGG GGCGGCGGCGGCGGC 5'        SEQ ID:94853
                         C

A
                5' TCGCCGCC CCGCCGCCGCCGCCG 3'        SEQ ID:20604
LOC255426          ||||||||  |||||||||||||||
BINDING SITE    3' GGCGGCGG GGCGGCGGCGGCGGC 5'        SEQ ID:94853
                         C

A
                5' TCGCCGCC CCGCCGCCGCCGCCG 3'        SEQ ID:20604
LOC255426          ||||||||  |||||||||||||||
BINDING SITE    3' GGCGGCGG GGCGGCGGCGGCGGC 5'        SEQ ID:94853
                         C

A
                5' TCGCCGCC CCGCCGCCGCCGCCG 3'        SEQ ID:20604
LOC255426          ||||||||  |||||||||||||||
BINDING SITE    3' GGCGGCGG GGCGGCGGCGGCGGC 5'        SEQ ID:94853
                         C

C  A
                5' GC GCC CCGCCGCCGCCGCCG 3'          SEQ ID:20604
LOC122525          ||  |||  |||||||||||||||
BINDING SITE    3' CG CGG GGCGGCGGCGGCGGC 5'          SEQ ID:173934
                    A   C

A
                5' GCCGCC CCGCCGCCGCCGCCG 3'         SEQ ID:20604
LOC122525          ||||||  |||||||||||||||
BINDING SITE    3' CGGCGG GGCGGCGGCGGCGGC 5'         SEQ ID:241978
                         C

GCCA
                5' CC   CCGCCGCCGCCGCC 3'            SEQ ID:20604
LOC146057          ||   ||||||||||||||
BINDING SITE    3' GG   GGCGGCGGCGGCGG 5'            SEQ ID:264106
                   AC--

A
                5' CGCCGCC CCGCCGCCGCCGCCG    C      SEQ ID:20604
LOC203197          |||||||  ||||||||||||||    |
BINDING SITE    3' GCGGCGG GGCGGCGGCGGCGGC    G      SEQ ID:317209
                         C

A
                5' TCGCCGCC CCGCCGCCGCCGCCG    C     SEQ ID:20604
LOC146223          ||||||||  |||||||||||||||   |
BINDING SITE    3' AGCGGCGG GGCGGCGGCGGCGGC    G     SEQ ID:412156
                         C
```

Fig. 26D/96

```
                         C   A
              5' TCGC GCC  CCGCCGCCGCCGCCG    3'      SEQ ID:20604
LOC256905        ||||  |||  ||||||||||||||| 
BINDING SITE  3' GGCG CGG  GGCGGCGGCGGCGGC    5'      SEQ ID:432644
                         A   C

G  A        ---
              5' TCGCC CC CCGCC      GCCGCCGCCG       SEQ ID:20604
LOC158301        |||||  || |||||      ||||||||||
BINDING SITE  3' GGCGG GG GGCGG      CGGCGGCGGC       SEQ ID:670361
                   G  C         CAG

A     C
              5' TCGCCGCC CCGCCG CGCCG     3'         SEQ ID:20604
LOC158301        ||||||||  ||||||  |||||
BINDING SITE  3' AGCGGCGG GGCGGC GCGGC     5'         SEQ ID:670394
                              C      T

C   A--      C
              5' TCGC GCC    CCGC GCCGCCGCCG          SEQ ID:20604
LOC254573        ||||  |||    ||||  ||||||||||
BINDING SITE  3' GGCG CGG    GGCG CGGCGGCGGC          SEQ ID:683857
                      A   CTG       -

AC
              5' TCGCCGCC   CGCCGCCGCCGCCG   3'       SEQ ID:20604
LOC158301        ||||||||   |||||||||||||||
BINDING SITE  3' GGCGGCGG   GCGGCGGCGGCGGC   5'       SEQ ID:763022
                          CA

5' TCGCCGCCACCGCCGCCGCCG        3'      SEQ ID:20604
LOC57795         ||||||||||||||||||||||
BINDING SITE  3' GGCGGCGGTGGCGGTGGCGGC        5'      SEQ ID:865556

A
              5' TCGCCGCC  CCGCCGCCGCCGC     3'       SEQ ID:20604
LOC122525        ||||||||   |||||||||||||
BINDING SITE  3' GGCGGCGG  GGCGGCGGCGGCG     5'       SEQ ID:969284
                           C

C-   CA
              5' CGC  GC   CCGCCGCCGCCGCCG    3'      SEQ ID:20604
LOC112609        |||   ||   |||||||||||||||
BINDING SITE  3' GCG  CG   GGCGGCGGCGGCGGC    5'      SEQ ID:1024445
                 CT   C-

A         C
              5' TCGCCGCC CCGCCGC GCCGCG     3'       SEQ ID:20604
LOC121536        ||||||||  |||||||  |||||||
BINDING SITE  3' GGCGGCGG GGTGGCG CGGCGGC    5'       SEQ ID:1036323
                          G       A
```

Fig. 26D/97

```
                         CC    AC  C
                     5' TCG   GCC  CG CGCCGCCGC 3'        SEQ ID:20604
LOC121536               |||   |||  || |||||||||
BINDING SITE         3' GGC   CGG  GC GCGGCGGCG 5'        SEQ ID:1036334
                         AT    GA  A

CA      G
                     5' GC   CCGCC CCGCCGCCG 3'           SEQ ID:20604
LOC121536               ||   ||||| |||||||||
BINDING SITE         3' CG   GGCGG GGCGGCGGC 5'           SEQ ID:1036375
                           AC      G

CA    C
                     5' TCGCCGC   CCG CGCCGCCGCCG 3'      SEQ ID:20604
LOC122525               |||||||   ||| |||||||||||
BINDING SITE         3' GGCGGCG   GGC GCGGCGGCGGC 5'      SEQ ID:1036926
                              TG    A

A        CG -
                     5' CGCCGCC CCGCCGC  C CG 3'          SEQ ID:20604
LOC124944               ||||||| |||||||  | ||
BINDING SITE         3' GCGGCGG GGCGGCG  G GC 5'          SEQ ID:1041522
                            C        AT T

A        CG-
                     5' CCGCC CCGCCGC   CCGCCG 3'         SEQ ID:20604
LOC125228               ||||| |||||||   ||||||
BINDING SITE         3' GGCGG GGCGGCG   GGCGGC 5'         SEQ ID:1042173
                           C        AAG

CACC
                     5' CGC     GCCGCCGCCGCCG 3'          SEQ ID:20604
LOC125228               |||     |||||||||||||
BINDING SITE         3' GCG     CGGCGGCGGCGGC 5'          SEQ ID:1042179
                          ACCT

ACC  C
                     5' TCGCCGCC  GC GCCGCCG 3'           SEQ ID:20604
LOC126432               ||||||||  || |||||||
BINDING SITE         3' AGCGGCGG  CG CGGCGGC 5'           SEQ ID:1044359
                            ---  T

A     GCC  C
                     5' CGCCGCC CCGCC  GC GCCG 3'         SEQ ID:20604
LOC126917               ||||||| |||||  || ||||
BINDING SITE         3' GCGGCGG GGCGG  CG CGGC 5'         SEQ ID:1045771
                            C     GCA  -

A    C    C
                     5' CCGCC CCGC GCCGC GCCG 3'          SEQ ID:20604
LOC130367               ||||| |||| ||||| ||||
BINDING SITE         3' GGCGG GGCG CGGTG CGGC 5'          SEQ ID:1051475
                           C    A     -
```

Fig. 26D/98

```
                              A
                     5' CCGCC CCGCCGCCGCCG    C  3       SEQ ID:20604
LOC143243               ||||| ||||||||||||    |
BINDING SITE         3' GGCGG GGCGGCGGCGGC    G  5       SEQ ID:1065873
                              C

CACC     C
                     5' GCCGC     GC GCCGCCGCCG  3'      SEQ ID:20604
LOC143891               |||||     || ||||||||||
BINDING SITE         3' CGGCG     CG CGGCGGCGGC  5'      SEQ ID:1068561
                              CGA-   A

C   A          --
                     5' TCGC GCC CCGCCGCC GCCGCCG        SEQ ID:20604
LOC145173               |||| ||| |||||||| |||||||
BINDING SITE         3' GGCG CGG GGCGGCGG CGGCGGC        SEQ ID:1077948
                          A   C          GA

CA          --
                     5' CGCCGC  CCGCCGCCGCC  GCCG  3     SEQ ID:20604
LOC145173               ||||||  |||||||||||  ||||
BINDING SITE         3' GCGGCG  GGCGGCGGCGG  CGGC  5     SEQ ID:1077952
                              AC          GA

-    C         C
                     5' CC GCCAC GCCGCCGC GCC  3'        SEQ ID:20604
LOC145581               || ||||| |||||||| |||
BINDING SITE         3' GG CGGTG CGGCGGCG CGG  5'        SEQ ID:1081817
                              A        A    A

5' TCGCCGCCACCGCCGCCGCCGCCG   C     SEQ ID:20604
LOC145990               |||||||||||||||||||||||||  |
BINDING SITE         3' GGTGGCGGTGGCGGCGGCGGCGGC   G     SEQ ID:1089127

A         G
                     5' CCGCC CCGCCGCCGCC CCG  3'        SEQ ID:20604
LOC145990               ||||| ||||||||||| |||
BINDING SITE         3' GGCGG GGCGGCGGCGG GGC  5'        SEQ ID:1089148
                              C         A

GCC
                     5' GCCGCCACCGCCGCC    GCCG  3'      SEQ ID:20604
LOC145990               |||||||||||||||    ||||
BINDING SITE         3' CGGCGGTGGCGGCGG    CGGC  5'      SEQ ID:1089170
                                   AGA

G    A     G
                     5' TC CCGCC CCGCC CCGCCG  3'        SEQ ID:20604
LOC145990               || ||||| ||||| ||||||
BINDING SITE         3' AG GGCGG GGCGG GGCGGC  5'        SEQ ID:1089181
                          G    C     G
```

Fig. 26D/99

```
                          G  A   -
                      5'  CC CC CC GCCGCCGCCGCCG   3'         SEQ ID:20604
LOC146057                 || || ||  ||||||||||||
BINDING SITE          3'  GG GG GG CGGCGGCGGCGGC   5'         SEQ ID:1089542
                          G  A  A

-  G         CG   C
                      5'  TCG CC CCACCGC   CCG CGCCG          SEQ ID:20604
LOC146057                 ||| || |||||||   ||| |||||
BINDING SITE          3'  AGC GG GGTGGCG   GGT GCGGC          SEQ ID:1089568
                          A   -        AG    A   GA

CAC
                      5'  TCGCCGC   CGCCGCCGCCGCCG   3'       SEQ ID:20604
LOC146223                 |||||||   ||||||||||||||
BINDING SITE          3'  GGCGGCG   GCGGCGGCGGCGGC   5'       SEQ ID:1090768
                                 TA-

GCCA    C--
                      5'  TCGCC    CCG   CGCCGCCG    3'       SEQ ID:20604
LOC147057                 |||||    |||   ||||||||
BINDING SITE          3'  AGCGG    GGC   GCGGCGG     5'       SEQ ID:1102464
                             AAG-    CCA

GCCAC    C
                      5'  GCC     CGC  GCCGCCGCC    3'        SEQ ID:20604
LOC147409                 |||     |||  |||||||||
BINDING SITE          3'  CGG     GCG  CGGCGGCGGC   5'        SEQ ID:1105742
                             ATTTT    A

C  CA
                      5'  TCGC GC   CCGCCGCCGCCGCCG   3       SEQ ID:20604
LOC147808                 |||| ||   |||||||||||||||
BINDING SITE          3'  GGCG CG   GGCGGCGGCGGCGGC   5       SEQ ID:1108755
                               A   CG

CG     C-
                      5'  TCGCCGCCACCGC  CCGC  GC    3'       SEQ ID:20604
LOC150984                 |||||||||||||  ||||  ||
BINDING SITE          3'  GGCGGCGGTGGCG  GGCG  CG    5'       SEQ ID:1144920
                                    A-     AT

-         C    C
                      5'  CC GCCAC GC GCCGCCG        3'       SEQ ID:20604
LOC151517                 || ||||| || |||||||
BINDING SITE          3'  GG CGGTG CG CGGCGGC        5'       SEQ ID:1151083
                          A        -     A

C     A      C  CG
                      5'  TCG CGCC CCGC GC   CCG     3'       SEQ ID:20604
LOC152048                 ||| |||| |||| ||   |||
BINDING SITE          3'  AGC GCGG GGCG CG   GGC     5'       SEQ ID:1155173
                              A      C      C  AG
```

Fig. 26D/100

```
                         C   A
              5' TCGC GCC CCGCCGCCGCCGCCG 3'          SEQ ID:20604
LOC154743        ||||  |||  ||||||||||||||||
BINDING SITE  3' AGCG CGG GGCGGCGGCGGCGGC  5'         SEQ ID:1174818
                         T   C

-----     A
              5' TCGCCG      CC CCGCCGCCGCCGCC        SEQ ID:20604
LOC154807        ||||||      ||  ||||||||||||||
BINDING SITE  3' GGCGGT      GG GGCGGCGGCGGCGG        SEQ ID:1175671
                    AGAAG   C

G
              5' TCGCCGCCACCGCCGCC CCG  3'            SEQ ID:20604
LOC154807        |||||||||||||||||  |||
BINDING SITE  3' GGCGGCGGTGGCGGCGG GGC  5'            SEQ ID:1175672
                                    A

A            C
              5' GCCGCC CCGCCGCCG CGCCG  3'           SEQ ID:20604
LOC158301        ||||||  ||||||||| |||||
BINDING SITE  3' TGGCGG GGCGGCGGC GCGGC  5'           SEQ ID:1190223
                       G            A

A         C
              5' TCGCCGCC CCGCCG CGCCGCCG 3'          SEQ ID:20604
LOC158301        ||||||||  ||||||  ||||||||
BINDING SITE  3' AGCGGCGG GGCGGC GCGGCGGC  5'         SEQ ID:1190283
                                C       T

--      A---
              5' GCC GCC     CCGCCGCCGCCGCCG          SEQ ID:20604
LOC158856        |||  |||    ||||||||||||||||
BINDING SITE  3' CGG CGG     GGCGGCGGCGGCGGC          SEQ ID:1195246
                     CC    AAGC

C        C   C CCG
              5' TCGC GCCACCGC GCCG CG    3'          SEQ ID:20604
LOC161635        ||||  ||||||||  ||||  ||
BINDING SITE  3' GGCG CGGTGGTG CGGC GC    5'          SEQ ID:1199731
                      A        A    A

AC        C
              5' TCGCCGCC  CGCCGCCGC GC   3'          SEQ ID:20604
LOC162417        ||||||||  ||||||||| ||
BINDING SITE  3' AGCGGCGG  GCGGCGGCG CG   5'          SEQ ID:1201175
                                     --  -

CA-  GC   C
              5' CCGC  CC  CGC GCCGCCG   3'           SEQ ID:20604
LOC162762        ||||   ||  |||  |||||||
BINDING SITE  3' GGCG  GG  GCG CGGCGGC   5'           SEQ ID:1201432
                    ACA  A-   A
```

Fig. 26D/101

```
                        C   A        G
                 5' TCGC GCC CCGCCGCC CCG 3'          SEQ ID:20604
LOC162762           |||| ||| |||||||| |||
BINDING SITE     3' AGCG CGG GGCGGTGG GGT 5'          SEQ ID:1201436
                        A   C        -

G  ACC   C
                 5' CC CC    GC GCCGCCGCC 3'          SEQ ID:20604
LOC163126           || ||    || |||||||||
BINDING SITE     3' GG GG    CG CGGCGGCGG 5'          SEQ ID:1201784
                      -  AC-  A

G   GCCA
                 5' TC CC     CCGCCGCCGCCGCCG 3'      SEQ ID:20604
LOC163126           || ||     |||||||||||||||
BINDING SITE     3' AG GG     GGCGGCGGCGGCGGC 5'      SEQ ID:1201817
                     -   ACC-

A    C     C
                 5' CGCCGCC CCGC GCCGC GCCG 3'        SEQ ID:20604
LOC165257           ||||||| |||| ||||| ||||
BINDING SITE     3' GCGGCGG GGCG CGGTG CGGC 5'        SEQ ID:1205008
                            C    A     T

C  CCACC              C
                 5' TCG CG     GCCGCCGCCG 3'          SEQ ID:20604
LOC165333           ||| ||     ||||||||||
BINDING SITE     3' AGC GC     CGGCGGCGGC 5'          SEQ ID:1205096
                     A  AT---

CA    C
                 5' GC   CCGC GCCGCCGCC 3'            SEQ ID:20604
LOC165552           ||   |||| |||||||||
BINDING SITE     3' CG   GGCG CGGCGGCGG 5'            SEQ ID:1205248
                       AC    A

A     C
                 5' CGCC CCG CGCCGCCGCC 3'            SEQ ID:20604
LOC196549           |||| ||| ||||||||||
BINDING SITE     3' GCGG GGC GCGGCGGCGG 5'            SEQ ID:1213581
                        -     C

CA         G  -
                 5' CGC  CCGCCGCC CC GC 3'            SEQ ID:20604
LOC202020           |||  |||||||| || ||
BINDING SITE     3' GCG  GGTGGCGG GG CG 5'            SEQ ID:1240261
                     AG         -  T

---    A
                 5' TCGCC   GCC CCGCCGCCGCCGCCG       SEQ ID:20604
LOC203197           |||||   ||| |||||||||||||||
BINDING SITE     3' GGCGG   CGG GGCGGCGGCGGCGGC       SEQ ID:1245216
                           GCG   C
```

Fig. 26D/102

```
                            A           G
                    5' TCGCCGCC  CCGCCGCCGCC CCG 3'        SEQ ID:20604
LOC203197              ||||||||  ||||||||||| |||
BINDING SITE        3' GGCGGCGG  GGCGGCGGTGG GGC 5'        SEQ ID:1245218
                            C                -

AC
                    5' GCCGCC  CGCCGCCGCCGCCG 3'           SEQ ID:20604
LOC203197              ||||||  ||||||||||||||
BINDING SITE        3' CGGCGG  GCGGCGGCGGCGGC 5'           SEQ ID:1245270
                            GC

CGCCACC-             CG
                    5' TCGC        GCCGCCGCC           3'  SEQ ID:20604
LOC203668              ||||        |||||||||
BINDING SITE        3' AGCG        CGGCGGCGG           5'  SEQ ID:1249923
                       CCACAACT             AC

CA    C  C
                    5' TCGCCGC  CCG CG CGCCGCCG 3'         SEQ ID:20604
LOC219333              |||||||  ||| || |||||||||
BINDING SITE        3' GGCGGCG  GGC GC GCGGCGGC 5'         SEQ ID:1253262
                         AC    A  A

CACC         C   G
                    5' CCGC     GCCGCCGC GCC    C  3      SEQ ID:20604
LOC219333              ||||     |||||||| |||    |
BINDING SITE        3' GGCG     CGGCGGCG CGG    G  5      SEQ ID:1253264
                       ACC-          A   CA-

CACC      C
                    5' GCCGC     GCCGC GCCGCCG 3'          SEQ ID:20604
LOC219654              |||||     ||||| |||||||
BINDING SITE        3' CGGCG     CGGCG CGGCGGC 5'          SEQ ID:1256056
                       A---          A

CAC              - -
                    5' CCGC     CGCCGCCGC C GCC 3'         SEQ ID:20604
LOC219899              ||||     ||||||||| | |||
BINDING SITE        3' GGCG     GCGGCGGCG G CGG 5'         SEQ ID:1258777
                       ACA              A T

G    -          CGC
                    5' TC CCG CCACCGC    CGCCGCCG 3       SEQ ID:20604
LOC219899              || ||| |||||||    ||||||||
BINDING SITE        3' AG GGC GGTGGCG    GCGGCGGC 5       SEQ ID:1258810
                       -    C             ACA

--   CA
                    5' CC GC    CCGCCGCCGCC 3'             SEQ ID:20604
LOC220058              || ||    |||||||||||
BINDING SITE        3' GG CG    GGCGGCGGCGGC 5'            SEQ ID:1261177
                       AC A-
```

Fig. 26D/103

```
                           ACC    C   C
              5' TCGCCGCC     GC GC GCCG   3'        SEQ ID:20604
LOC245726        ||||||||     || || ||||
BINDING SITE  3' AGCGGCGG     CG CG CGGC   5'        SEQ ID:1287683
                           AA-   T   -

-  A              C
              5' CC GCC  CCGCCGC GCCGCCG   3'        SEQ ID:20604
LOC253943        || |||  ||||||| |||||||
BINDING SITE  3' GG CGG  GGCGGCG CGGCGGC   5'        SEQ ID:1295954
                      T  C              A

CCA-
              5' CCG      CCGCCGCCGCCGCCG  3'        SEQ ID:20604
LOC253943        |||      |||||||||||||||
BINDING SITE  3' GGC      GGCGGCGGCGGCGGC  5'        SEQ ID:1295956
                     TCTC

A            C
              5' CGCC CCGCCGCCGC GCC   3'            SEQ ID:20604
LOC253943        |||| |||||||||| |||
BINDING SITE  3' GCGG GGCGGCGGCG CGG   5'            SEQ ID:1295963
                         C            A

ACC       C-
              5' CGCCGCC    GCCGCCG   CGC   3'       SEQ ID:20604
LOC253943        |||||||    |||||||   |||
BINDING SITE  3' GCGGCGG    CGGCGGC   GCG   5'       SEQ ID:1295964
                        CGA       AA

CACC          C---
              5' CCGC      GCCGCCG      GCC   3'     SEQ ID:20604
LOC254102        ||||      |||||||      |||
BINDING SITE  3' GGCG      CGGCGGCG     CGG   5'     SEQ ID:1298522
                      A---          ACCC

CA-    C
              5' CGC    CCGC GCCGCCGC   3'           SEQ ID:20604
LOC254102        |||    |||| ||||||||
BINDING SITE  3' GCG    GGCG CGGCGGCG   5'           SEQ ID:1298528
                     AGA    A

G    ACC          CC
              5' TC CCGCC     GCCGCCGCC    3'        SEQ ID:20604
LOC254107        || |||||     |||||||||
BINDING SITE  3' AG GGCGG     CGGCGGCGG    5'        SEQ ID:1298621
                     -         GT-

-  AC
              5' GCCG  CC  CGCCGCCGCCGCCG   3'       SEQ ID:20604
LOC254573        ||||  ||  ||||||||||||||
BINDING SITE  3' CGGC  GG  GCGGCGGCGGCGGC   5'       SEQ ID:1303366
                     T  GC
```

Fig. 26D/104

```
                          G    CACC    C           CCG
                 5' TC CCGC      GC GCCGCCG      3'         SEQ ID:20604
LOC255028           || ||||      || ||||||||
BINDING SITE     3' AG GGCG      CG CGGCGGC      5'         SEQ ID:1306373
                          G    CCCA    A

C    ACC---                 C
                 5' GC GCC         GCCGCCGCCG CG   3          SEQ ID:20604
LOC255056           || |||         |||||||||| ||
BINDING SITE     3' CG CGG         CGGCGGCGGC GC   5          SEQ ID:1307405
                          A    GCTCCC              A

A-
                 5' CGCCGCC    CCGCCGCCGCCG      3'         SEQ ID:20604
LOC255426           |||||||    ||||||||||||
BINDING SITE     3' GCGGCGG    GGCGGCGGCGGC      5'         SEQ ID:1310952
                               GC

A-
                 5' CGCCGCC    CCGCCGCCGCCG      3'         SEQ ID:20604
LOC255426           |||||||    ||||||||||||
BINDING SITE     3' GCGGCGG    GGCGGCGGCGGC      5'         SEQ ID:1310952
                               GC

A
                 5' CGCC    CCGCCGCCGCC       3'            SEQ ID:20604
LOC146223           ||||    |||||||||||
BINDING SITE     3' GCGG    GGCGGCGGCGG       5'            SEQ ID:1310953
                                C

A
                 5' CGCC    CCGCCGCCGCC       3'            SEQ ID:20604
LOC255426           ||||    |||||||||||
BINDING SITE     3' GCGG    GGCGGCGGCGG       5'            SEQ ID:1310953
                                C

AC  C     CCGCC
                 5' TCGCCGCC  CG CG        GCC   3'         SEQ ID:20604
LOC201780           ||||||||  || ||        |||
BINDING SITE     3' AGCGGCGG  GC GC        CGG   5'         SEQ ID:1317863
                            -- A     AAGA-

AC  C     CCGCC
                 5' TCGCCGCC  CG CG        GCC   3'         SEQ ID:20604
LOC256160           ||||||||  || ||        |||
BINDING SITE     3' AGCGGCGG  GC GC        CGG   5'         SEQ ID:1317863
                            -- A     AAGA-

G              C    CCG
                 5' TC CCGCCACCGCCGC GCCG        3'         SEQ ID:20604
LOC256537           || |||||||||||||| ||||
BINDING SITE     3' AG GGCGGTGGCGGCG CGGC        5'         SEQ ID:1321461
                          A              C
```

Fig. 26D/105

```
                            G  A
                      5' CC CC CCGCCGCCGCCGCCG 3'              SEQ ID:20604
LOC256586                || ||  |||||||||||||||
BINDING SITE          3' GG GG GGCGGCGGCGGCGGC 5'              SEQ ID:1321729
                            A  A

A       GC
                      5' CGCCGCC CCGCC  CGCCG 3'               SEQ ID:20604
LOC256812                |||||||  |||||  |||||
BINDING SITE          3' GCGGCGG GGCGG  GCGGC 5'               SEQ ID:1322939
                                 C       A-

A
                      5' CGCCGCC CCGCCGCCGCCGCCG 3'            SEQ ID:20604
LOC256905                |||||||  |||||||||||||||
BINDING SITE          3' GCGGCGG GGCGGCGGCGGTGGC 5'            SEQ ID:1323732
                                 C

A-  ---
                      5' GCCGCC  CC  GCCGCCGCCGCCG             SEQ ID:20604
LOC256905                ||||||  ||  |||||||||||||
BINDING SITE          3' CGGCGG  GG  CGGCGGCGGCGGC             SEQ ID:1323749
                            AC  CGA

CA
                      5' GCCGC  CCGCCGCCGCCGCCG 3'             SEQ ID:20604
LOC256905                |||||  |||||||||||||||
BINDING SITE          3' CGGCG  GGCGGCGGCGGCGGC 5'             SEQ ID:1323750
                               AC

A    C  C
                      5' GCCGCC CCGC GC GCCGC 3'               SEQ ID:20604
LOC257222                ||||||  ||||  ||  |||||
BINDING SITE          3' CGGCGG CGCG CG CGGTG 5'               SEQ ID:1326885
                              C    A  A

CA    --   C-
                      5' CCGC CCGC CGC GCCGC 3'                SEQ ID:20604
LOC257479                ||||  ||||  |||  |||||
BINDING SITE          3' GGCG GGCG GCG CGGCG 5'                SEQ ID:1330681
                            AC    AC   AC

A    C    C
                      5' CGCC CCGC GCCGC GC 3'                 SEQ ID:20604
LOC257479                ||||  ||||  |||||||  ||
BINDING SITE          3' GCGG GGCG CGGCG CG 5'                 SEQ ID:1330687
                             C    A    A

G   ACC  C       CG
                      5' TC CCGCC   GC GCCGCCGC 3'             SEQ ID:20604
LOC257479                ||  |||||| || |||||||||
BINDING SITE          3' AG GGCGG   CG CGGCGGCG 5'             SEQ ID:1330706
                             -   C-- C        A
```

Fig. 26D/106

```
                          CA              G   G
                    5' TCGCCGC  CCGCCGCC  CC  CCG  3'      SEQ ID:20604
LOC257479              |||||||  ||||||||  ||  |||
BINDING SITE        3' AGCGGCG  GGCGGCGG  GG  GGC  5'      SEQ ID:1330708
                          A-              A   A

- CACC-
                    5' TCGCCG  C         GCCGCCGCCGCCG      SEQ ID:20604
LOC51061               ||||||  |         |||||||||||||
BINDING SITE        3' AGCGGC  G         TGGCGGCGGCGGC      SEQ ID:1335336
                            C  AAATA

A
                    5' GCCGCC  CCGCCGCCGCCG   3'            SEQ ID:20604
LOC55829               ||||||  ||||||||||||
BINDING SITE        3' TGGCGG  GGCGGCGGCGGC   5'            SEQ ID:1343670
                           C

A              --
                    5' CCGCC  CCGCCGCCGCC  GCC  3'          SEQ ID:20604
LOC55829               |||||  |||||||||||  |||
BINDING SITE        3' GGCGG  GGCGGCGGCGG  CGG  5'          SEQ ID:1343683
                          C                GT

CC     A
                    5' TCG  GCC  CCGCCGCCGCCGCCG   3        SEQ ID:20604
LOC57795               |||  |||  |||||||||||||||
BINDING SITE        3' AGC  CGG  GGCGGCGGCGGTGGC   5        SEQ ID:1347000
                        CA     C

C    AC
                    5' TCG  CGCC  CGCCGCCGCCGCCG   3        SEQ ID:20604
LOC84548               |||  ||||  |||||||||||||||
BINDING SITE        3' GGC  GCGG  GCGGCGGCGGCGGC   5        SEQ ID:1349247
                         A    CA

C    AC   C
                    5' TCG  CGCC  CGCCG  CGCCGCCG   3       SEQ ID:20604
LOC84548               |||  ||||  |||||  ||||||||
BINDING SITE        3' GGC  GCGG  GCGGC  GCGGCGGC   5       SEQ ID:1349248
                         A    CA   A

CCA
                    5' TCGCCG    CCGCCGCCGCCGCCG   3'       SEQ ID:20604
LOC84548               ||||||    |||||||||||||||
BINDING SITE        3' AGCGGC    GGCGGCGGCGGCGGC   5'       SEQ ID:1349283
                            AGC

CCA   C
                    5' TCGCCG    CCG  CGCCGCCGCCG   3'      SEQ ID:20604
LOC84548               ||||||    |||  |||||||||||
BINDING SITE        3' AGCGGC    GGC  GCGGCGGCGGC   5'      SEQ ID:1349284
                            AGC   A
```

Fig. 26D/107

```
                         -- AC
                   5' CGCC  GCC   CGCCGCCGCCGCCG 3       SEQ ID:20604
LOC86010              ||||  |||   ||||||||||||||
BINDING SITE       3' GCGG  CGG   GCGGCGGCGGCGGC 5       SEQ ID:1349829
                         CT  A-

A       CG
                   5' TCGCCGCC CCGCCGC  CCG 3'           SEQ ID:20604
LOC86010              |||||||| |||||||  |||
BINDING SITE       3' AGCGGCGG GGCGGCG  GGC 5'           SEQ ID:1349832
                               C        AT

G  ACC
                   5' CC CC   GCCGCCGCCGCCG 3'           SEQ ID:20604
LOC90379              || ||   |||||||||||||
BINDING SITE       3' GG GG   CGGCGGCGGCGGC 5'           SEQ ID:1356590
                         G  CCC

-     CAC
                   5' TCG CCGC   CGCCGCCGCCGCCG          SEQ ID:20604
LOC90835              ||| ||||   ||||||||||||||
BINDING SITE       3' AGT GGCG   GCGGCGGCGGCGGC          SEQ ID:1362330
                         A  AAA              AG

A      C    -
                   5' TCGCCGCC CCGCCG CG CCGC 3'         SEQ ID:20604
LOC90835              |||||||| |||||| || ||||
BINDING SITE       3' AGCGGCGG GGCGG  GC GGTG 5'         SEQ ID:1362338
                               C      A A

A  G    C
                   5' CGCCGCC CC CCGC GCCGC 3'           SEQ ID:20604
LOC90874              ||||||| || |||| |||||
BINDING SITE       3' GCGGCGG GG GGCG CGGCG 5'           SEQ ID:1362769
                               C  G    -

CAC
                   5' CGC    CGCCGCCGCCGCC 3'            SEQ ID:20604
LOC91050              |||    ||||||||||||
BINDING SITE       3' GCG    GCGGCGGCGGCGG 5'            SEQ ID:1364688
                         CA-

A     GCC  G
                   5' TCGCCGCC CCGCC   GCC CCG 3'        SEQ ID:20604
LOC91050              |||||||| |||||   ||| |||
BINDING SITE       3' AGCGGCGG GGCGG   CGG GGC 5'        SEQ ID:1364726
                               C       GCC -

C CAC    --
                   5' TCGC GC   CGC  CGCCGCCGCCG         SEQ ID:20604
LOC91050              |||| ||   |||  ||||||||||
BINDING SITE       3' AGCG TG   GCG  GCGGCGGCGGC         SEQ ID:1364727
                         C CA-   CA
```

Fig. 26D/108

```
                       -     CAC
                  5' TCGC CGC    CGCCGCCGCCGCCG        SEQ ID:20604
LOC91300             |||| |||    ||||||||||||||
BINDING SITE     3' AGCG GCG    GCGGCGGCGGCGGC        SEQ ID:1367936
                       T     ACA

-     CAC
                  5' TCGC CGC    CGCCGCCGCCGCCG        SEQ ID:20604
LOC91300             |||| |||    ||||||||||||||
BINDING SITE     3' AGCG GCG    GCGGCGGCGGCGGC        SEQ ID:1367936
                       T     ACA

ACC  CG--      C
                  5' GCCGCC   GC    CCGC GCCG  3'     SEQ ID:20604
LOC91978             ||||||   ||    |||| ||||
BINDING SITE     3' CGGCGG   CG    GGTG CGGC  5'     SEQ ID:1375053
                          ---  AAGA     A

-     CCA
                  5' TCG CCG    CCGCCGCCGCCGCCG  3    SEQ ID:20604
LOC92181             ||| |||    ||||||||||||||
BINDING SITE     3' AGC GGC    GGCGGCGGCGGCGGC  5    SEQ ID:1376487
                       A     CCG

CACC
                  5' TCGCCGC    GCCGCCGCCG  3'        SEQ ID:20604
LOC92299             |||||||    ||||||||||
BINDING SITE     3' GGCGGCG    CGGCGGCGGT  5'        SEQ ID:1377998
                         A---
```

CTGCGGAGCCCGCGTCGCAGCAGCCCGGACAGGAAGATT  SEQ ID: 27
GGTCTGGATGTGGGTCCGGT<u>CTTACAGTCGCGGGCCAGG</u>
<u>ATGAG</u>GGCAGGTTGCGACAGCGCGCACCCGG

CTTACAGTCGCGGGCCAGGATGAG                SEQ ID: 4

```
      C  A  C  -           A-   GGA  GGAAGA              -  -   TC
   CTG GG GC CGC GTCGCAGC  GCCC      CA      TTGGTCTG GA TGTGG3  C
   ||| || || ||| ||||||||  ||||      ||      ''||||'|| || ||||||        SEQ ID: 27
   GGC CC CG GCG CAGCGTTG  CGGG      GT      GACCGGGC CT ACATTC  G
      -  A  C  A           GA   A--  AG----             G  G    TG
```

Fig. 27D/1

```
                      GC---           A
              5' GTC      GGGCCAGG TGAG   3'        SEQ ID:20605
DEC1             |||      |||||||| ||||
BINDING SITE  3' CAG      CCCGGTCC ACTC   5'        SEQ ID:131107
                   AAGGA           C

TCGC     C
              5' CAG    GGGC AGGATGAG     3'        SEQ ID:20605
HD               |||    |||| ||||||||
BINDING SITE  3' GTC    TTCG TCCTACTC     5'        SEQ ID:193353
                   CTTT    A

T  AG GC         A  AG
              5' CT AC TC GGGCCAGG TG      3        SEQ ID:20605
HPN              || || || |||||||| ||
BINDING SITE  3' GA TG GG CCCGGTCC AC      5        SEQ ID:201170
                 C  GA A-         C  CC

A             CAGGA
              5' CTT CAGTCGCGGGC      TGAG  3       SEQ ID:20605
C20orf11         ||| |||||||||||      ||||
BINDING SITE  3' GAA GTCAGCGTCCG      ACTC  5       SEQ ID:468069
                     C             ACTAG 5' CTTACAGTCGCGGGCCAGGATGAG  3'       SEQ ID:20605
FAF1             ||||||||||||||||||||||||
BINDING SITE  3' GAATGTCAGCGCCCGGTCCTACTC  5'       SEQ ID:552947

A  GT--  C   CCA  A
              5' CTT CA   CG GGG   GG TGAG          SEQ ID:20605
FLJ23878         ||| ||   || |||   || ||||
BINDING SITE  3' GAA GT   GC CCC   CC ACTC          SEQ ID:662582
                   A ACTC  A   AAC  C

-  GGGC
              5' AGTC GC     CAGGATGAG  3'          SEQ ID:20605
ODZ2             |||| ||     ||||||||
BINDING SITE  3' TCAG TG     GTCCTACTC  5'          SEQ ID:900303
                     A  AA--

TC   -
              5' AG  GC GGGCCAGGATG  3'             SEQ ID:20605
LOC144231        ||  || |||||||||||
BINDING SITE  3' TC  CG CCCGGTCCTAC  5'             SEQ ID:1069942
                   TC  A

CGC    C
              5' ACAGT    GGGC AGGATGAG  3'         SEQ ID:20605
LOC158156        |||||    |||| ||||||||
BINDING SITE  3' TGTCG    TTCG TCCTACTC  5'         SEQ ID:1187897
                      T--    A
```

FIG. 28A
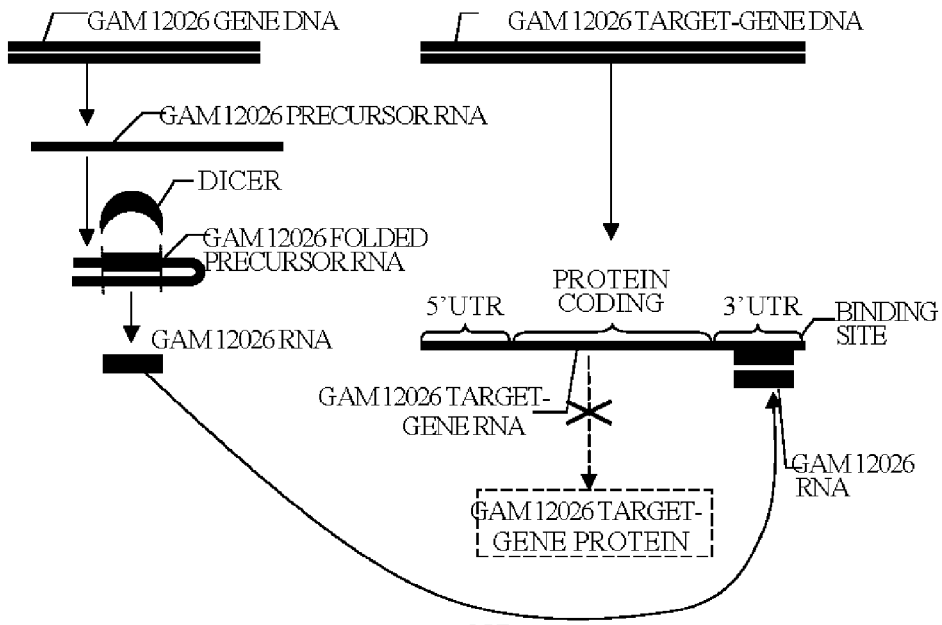
FIG. 28B
GACCUGCGGGACAAGAUUCUUGGUGCCACCAU<u>UGAGAAC</u>  SEQ ID NO: 12003
<u>UCCAGGAUUGUCCUGCAGAUC</u>
UGAGAACUCCAGGAUUGUCCUGCA  SEQ ID NO: 42079
FIG. 28C
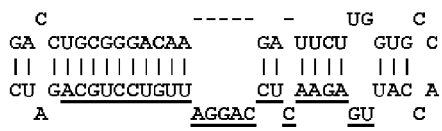
SEQ ID NO: 12003

Fig. 28D/1

```
                              CA   AT   TC
                  5' TGAGAACTC  GG  TG  CTGCA 3'        SEQ ID:28678
ABCC5                ||||||||   ||  ||  |||||
BINDING SITE      3' ACTCTTGAG  CC  GC  GACGT 5'        SEQ ID:42985
                              TG   --   GA

AAC        CCTGCA
                  5' TGAG    TCCAGGATTGT          3'    SEQ ID:28678
AIM1                 ||||    ||||||||||||
BINDING SITE      3' ACTC    AGGTTCTAACG          5'    SEQ ID:53607
                              CTA        AAC

A   C   AT
                  5' GAGA CTC AGG  TGTCCTGC 3'          SEQ ID:28678
AIPL1                |||| ||| |||  ||||||||
BINDING SITE      3' CTCT GAG TTC  ACAGGACG 5'          SEQ ID:53676
                         C   A   --

CCA   TT   C
                  5' TGAGAACT   GGA  GTC TGC 3'         SEQ ID:28678
BSG                  ||||||||   |||  ||| |||
BINDING SITE      3' ACTCTTGA   CCT  TAG ACG 5'         SEQ ID:84013
                              A--   --   A

CA
                  5' TGAGAACTC   GGATTGT 3'             SEQ ID:28678
C7                   |||||||||   |||||||
BINDING SITE      3' ACTTTTGAG   CCTGACA 5'             SEQ ID:86945
                              AC

AA             GTCC
                  5' GAG   CTCCAGGATT      TGCA 3'      SEQ ID:28678
CCND1                |||   ||||||||||      ||||
BINDING SITE      3' CTC   GAGGTCCTGA      ACGT 5'      SEQ ID:95252
                         C-             A---

G      ATTG      C
                  5' TGA  AACTCCAGG    TCCTG 3'         SEQ ID:28678
EPHA8                |||  ||||||||||   |||||
BINDING SITE      3' ACT  TTGAGGTCC    AGGAC 5'         SEQ ID:152819
                         A      ----

GA     A TG C    CA
                  5' TGA   ACTCCAGG T  T CTG    3       SEQ ID:28678
HUNK                 |||   ||||||||| |  | |||
BINDING SITE      3' ACT   TGAGGTCC  G  A GAC   5       SEQ ID:204846
                         TC     - GT A    AT

AA       TT   CC
                  5' TGAG   CTCCAGGA  GT  TGC 3'        SEQ ID:28678
IGFBP3               ||||   ||||||||  ||  |||
BINDING SITE      3' ACTC   GAGGTCCT  CG  ACG 5'        SEQ ID:208615
                              --       --   T-
```

Fig. 28D/2

```
                              ATT   CC
               5' TGAGAACTCCAGG   GT  TG  3'        SEQ ID:28678
JAG1              ||||||||||||   ||  ||
BINDING SITE   3' ACTCTTGAGGTCT   CA  AC  5'        SEQ ID:219150
                              ACT   AA

-      TTGTC
               5' GAA CTCCAGGA     CTGC  3'         SEQ ID:28678
RRP22             ||| ||||||||     ||||
BINDING SITE   3' CTT GAGGTCCT     GACG  5'         SEQ ID:346965
                   C           CGTCC

C        TTGT
               5' TGAGAA TCCAGGA     CCTG  3'       SEQ ID:28678
DKFZP4340125      |||||| |||||||     ||||
BINDING SITE   3' ACTCTT AGGTCTT     GGAC  5'       SEQ ID:523373
                       A           ----

CA   ATTG
               5' TGAGAACTC  GG    TCCT  3'         SEQ ID:28678
DKFZP434P0721     |||||||||  ||    ||||
BINDING SITE   3' ACTCTTGAG  CC    AGGA  5'         SEQ ID:523926
                            AC   GA--

CAGGATT
               5' TGAGAACTC       GTCCTGC  3'       SEQ ID:28678
FLJ20457          |||||||||       |||||||
BINDING SITE   3' ACTCTTGAG       CAGGACG  5'       SEQ ID:630483
                            TT-----

CTC        TC
               5' TGAGAA   CAGGATTG   CTGCA  3'     SEQ ID:28678
FLJ20485          ||||||   ||||||||   |||||
BINDING SITE   3' ACTCTT   GTCCTAAC   GACGT  5'     SEQ ID:630888
                       AAC        GT

CCA-  A
               5' AGAACT    GG  TTGTCCTG  3'        SEQ ID:28678
FLJ21820          ||||||    ||  ||||||||
BINDING SITE   3' TCTTGA    CC  AACAGGAC  5'        SEQ ID:643418
                        ACGA  -

AA     AGGAT
               5' GAG   CTCC    TGTCCTGCA  3'       SEQ ID:28678
HRIHFB2122        |||   ||||    |||||||||
BINDING SITE   3' CTC   GAGG    ACAGGACGT  5'       SEQ ID:691379
                        C-     GG---

AA  CCAGG
               5' TGAG  CT      ATTGTCCTGCA  3'     SEQ ID:28678
KIAA0596          ||||  ||      |||||||||||
BINDING SITE   3' ACTC  GA      TGACAGGACGT  5'     SEQ ID:742690
                        CC  A----
```

Fig. 28D/3

```
                         A    C        TG   TGC
                    5' TG GAA TCCAGGAT  TCC      3'        SEQ ID:28678
MGC23284               || ||| ||||||||  |||
BINDING SITE        3' AC CTT AGGTCTTA  AGG      5'        SEQ ID:861987
                         C    A        --   T

AA           T   -
                    5' GAG   CTCCAGGAT GTC CTGC   3'        SEQ ID:28678
NCK1                   |||   |||||||||  ||| ||||
BINDING SITE        3' CTC   GAGGTCCTG CGG GACG   5'        SEQ ID:889147
                         CC           -   T

C    A
                    5' TGAGAACT CAGG TTGT       3'          SEQ ID:28678
NFASC                  |||||||| |||| ||||
BINDING SITE        3' ACTCTTGA GTCC GACG       5'          SEQ ID:891644
                              C    A

A   C    TT       A
                    5' TGAG ACT CAGGA GTCCTGC   3'          SEQ ID:28678
NUBP2                  |||| ||| ||||| |||||||
BINDING SITE        3' ACTC TGA GTCTT CAGGACG   5'          SEQ ID:897170
                         C   C    --

AAC      ATT   C   CA
                    5' TGAG    TCCAGG   GTC  TG    3'       SEQ ID:28678
SPIB                   ||||    ||||||   |||  ||
BINDING SITE        3' ACTC    GGGTCC   CAG  AC    5'       SEQ ID:976787
                              CTA      CT-   -   A

A      ATTGTC
                    5' TGAG ACTCCAGG      CTGCA    3'       SEQ ID:28678
TIP47                  |||| ||||||||      |||||
BINDING SITE        3' ACTC TGAGGTCT      GACGT    5'       SEQ ID:994148
                              C          CGTGTC

A    C      CCTGC
                    5' TG GAACT CAGGATTGT          3'       SEQ ID:28678
WDR7                   || ||||| |||||||||
BINDING SITE        3' AC CTTGA GTCCTAACG          5'       SEQ ID:1012964
                          C    T          T

A    T
                    5' ACTCCAGG TTG CCTGCA    3'            SEQ ID:28678
ZFPL1                  |||||||| ||| ||||||
BINDING SITE        3' TGAGGTCC GAC GGACGT    5'            SEQ ID:1018178
                               G    C

A        G   GTC
                    5' GAG ACTCCAG ATT   CTG   3'           SEQ ID:28678
KIAA0563               ||| |||||||| |||   |||
BINDING SITE        3' CTC TGAGGTT TAA   GAC   5'           SEQ ID:1235064
                         C        -   AA-
```

Fig. 28D/4

```
                              T  A   -    TCC
                    5' TGAGAAC CC GGA TTG    TGCA    3       SEQ ID:28678
LOC143308              ||||||| || ||| |||    ||||
BINDING SITE        3' ACTCTTG GG CCT GAC    ACGT    5       SEQ ID:1066389
                              -  C   C    CT-

A-    GGA       CC
                    5' TGAGA  CTCCA    TTGT   TGC    3'      SEQ ID:28678
LOC145844              |||||  |||||    ||||   |||
BINDING SITE        3' ACTTT  GGGGT    GACA   ACG    5'      SEQ ID:1087357
                              AA     AG-      AA

CA     ATT
                    5' GAACTC    GG  GTCCTGCA    3'          SEQ ID:28678
LOC146733              ||||||    ||  ||||||||
BINDING SITE        3' CTTGAG    CC  CAGGACGT    5'          SEQ ID:1097577
                                 AC     GGC

AA   C     ATTG
                    5' GAG CTC AGG    TCCTGCA   3'           SEQ ID:28678
LOC146909              ||| ||| |||    |||||||
BINDING SITE        3' TTC GAG TCC    GGGACGT   5'           SEQ ID:1100335
                           CC   A     ----

A   CT     GGATT
                    5' TG GAA   CCA        GTCCTGC   3'      SEQ ID:28678
LOC157931              || |||   |||        |||||||
BINDING SITE        3' AC CTT   GGT        CGGGACG   5'      SEQ ID:1186324
                            C   AC     -----

A       G    GTC
                    5' GAG ACTCCAG ATT    CTG   3'           SEQ ID:28678
LOC201173              ||| |||||||| |||    |||
BINDING SITE        3' CTC TGAGGTT TAA    GAC   5'           SEQ ID:1235064
                            C       -    AA-

A       G    GTC
                    5' GAG ACTCCAG ATT    CTG   3'           SEQ ID:28678
LOC201220              ||| |||||||| |||    |||
BINDING SITE        3' CTC TGAGGTT TAA    GAC   5'           SEQ ID:1235064
                            C       -    AA-
``` ately also
BIOINFORMATICALLY DETECTABLE GROUP OF NOVEL REGULATORY GENES AND USES THEREOF This application is continuation in part of U.S. patent application Ser. No. 10/293,338, filed Nov. 14, 2002, now abandoned entitled "Bioinformatically Detectable Group of Novel Regulatory Genes and Uses Thereof", the disclosure of which application is hereby incorporated by reference, and claims priority therefrom.

FIELD OF THE INVENTION

The present invention relates to a group of bioinformatically detectable novel genes, here identified as "genomic address messenger" or "GAM" genes, which are believed to be related to the micro RNA (miRNA) group of genes.

BRIEF DESCRIPTION OF SEQUENCE LISTING

Reference is made to the appendix submitted on the compact disc. The compact disc contains SEQUENCE LISTING.TXT (201,325 KB, Feb. 14, 2006), which is a replacement Sequence Listing in accordance with 37 C.F.R §§ 1.821-1.825, the contents of which are incorporated by reference herein.

BACKGROUND OF THE INVENTION

Small RNAs are known to perform diverse cellular functions, including post-transcriptional gene expression regulation. The first two such RNA genes, Lin-4 and Let-7, were identified by genetic analysis of *Caenorhabditis Elegans* (*Elegans*) developmental timing, and were termed short temporal RNA (stRNA) (Wightman, B., Ha, I., Ruvkun, G., Cell 75, 855 (1993); Erdmann, V. A. et al., Nucleic Acids Res. 29, 189 (2001); Lee, R. C., Feinbaum, R. L., Ambros, V., Cell 75, 843 (1993); Reinhart, B. et al., Nature 403, 901 (2000)).

Lin-4 and Let-7 each transcribe a ~22 nucleotide (nt) RNA, which acts a post transcriptional repressor of target mRNAs, by binding to elements in the 3'-untranslated region (UTR) of these target mRNAs, which are complimentary to the 22 nt sequence of Lin-4 and Let-7 respectively. While Lin-4 and Let-7 are expressed at different developmental stage, first larval stage and fourth larval stage respectively, both specify the temporal progression of cell fates, by triggering post-transcriptional control over other genes (Wightman, B., Ha, I., Ruvkun, G., Cell 75, 855 (1993); Slack et al., Mol. Cell 5, 659 (2000)). Let-7 as well as its temporal regulation have been demonstrated to be conserved in all major groups of bilaterally symmetrical animals, from nematodes, through flies to humans (Pasquinelli, A., et al. Nature 408, 86 (2000)).

The initial transcription product of Lin-4 and Let-7 is a ~60-80 nt RNA, the nucleotide sequence of the first half of which is partially complimentary to that of its second half, therefore allowing this RNA to fold onto itself, forming a 'hairpin structure'. The final gene product is a ~22 nt RNA, which is 'diced' from the above mentioned 'hairpin structure', by an enzyme called Dicer, which also apparently also mediates the complimentary binding of this ~22 nt segment to a binding site in the 3' UTR of its target gene.

Recent studies have uncovered 93 new genes in this class, now referred to as micro RNA or miRNA genes, in genomes of *Elegans*, Drosophilea, and Human (Lagos-Quintana, M., Rauhut, R., Lendeckel, W., Tuschl, T., Science 294, 853 (2001); Lau, N. C., Lim, L. P., Weinstein, E. G., Bartel, D. P., Science 294, 858 (2001); Lee, R. C., Ambros, V., Science 294, 862 (2001). Like the well studied Lin-4 and Let-7, all newly found MIR genes produce a ~60-80 nt RNA having a nucleotide sequence capable of forming a 'hairpin structure'. Expressions of the precursor ~60-80 nt RNA and of the resulting diced ~22 nt RNA of most of these newly discovered MIR genes have been detected.

Based on the striking homology of the newly discovered MIR genes to their well-studied predecessors Lin-4 and Let-7, the new MIR genes are believed to have a similar basic function as that of Lin-4 and Let-7: modulation of target genes by complimentary binding to the UTR of these target genes, with special emphasis on modulation of developmental control processes. This is despite the fact that the above mentioned recent studies did not find target genes to which the newly discovered MIR genes complementarily bind. While existing evidence suggests that the number of regulatory RNA genes "may turn out to be very large, numbering in the hundreds or even thousands in each genome", detecting such genes is challenging (Ruvkun G., 'Perspective: Glimpses of a tiny RNA world', Science 294, 779 (2001)).

The ability to detect novel RNA genes is limited by the methodologies used to detect such genes. All RNA genes identified so far either present a visibly discernable whole body phenotype, as do Lin-4 and Let-7 (Wightman et. al., Cell 75, 855 (1993); Reinhart et al., Nature 403, 901 (2000)), or produce significant enough quantities of RNA so as to be detected by the standard biochemical genomic techniques, as do the 93 recently detected miRNA genes. Since a limited number clones were sequenced by the researchers discovering these genes, 300 by Bartel and 100 by Tuschl (Bartel et. al., Science 294, 858 (2001); Tuschl et. al., Science 294, 853 (2001)), the RNA genes found can not be much rarer than 1% of all RNA genes. The recently detected miRNA genes therefore represent the more prevalent among the miRNA gene family.

Current methodology has therefore been unable to detect RNA genes which either do not present a visually discernable whole body phenotype, or are rare (e.g. rarer than 0.1% of all RNA genes), and therefore do not produce significant enough quantities of RNA so as to be detected by standard biochemical technique.

SUMMARY OF THE INVENTION

The present invention relates to a novel group of regulatory, non-protein coding genes, which are functional in specifically inhibiting translation of other genes, some of which are known to be involved in various diseases. Each gene in this novel group of genes, here identified as "GAM" or "Genomic Address Messengers", specifically inhibits translation of one of more other 'target' genes by means of complimentary hybridization of a segment of the RNA transcript encoded by GAM2, to an inhibitor site located in the 3' untranslated region of the mRNA of the one or more 'target' genes.

In various preferred embodiments, the present invention seeks to provide improved method and system for specific modulation of expression of specific known 'target' genes involved in significant human diseases, and improved method and system for detection of expression of these target genes.

Accordingly, the invention provides several substantially pure DNAs (e.g., genomic DNA, cDNA or synthetic DNA) each encoding a novel gene of the GAM group of gene, vectors comprising the DNAs, probes comprising the DNAs, a method and system for selectively modulating translation of known 'target' genes utilizing the vectors, and a method and system for detecting expression of known 'target' genes utilizing the probe.

By "substantially pure DNA" is meant DNA that is free of the genes which, in the naturally-occurring genome of the organism from which the DNA of the invention is derived, flank the genes discovered and isolated by the present invention. The term therefore includes, for example, a recombinant DNA which is incorporated into a vector, into an autonomously replicating plasmid or virus, or into the genomic DNA of a prokaryote or eukaryote at a site other than its natural site, or which exists as a separate molecule (e.g., a cDNA or a genomic or cDNA fragment produced by PCR or restriction endonuclease digestion) independent of other sequences. It also includes a recombinant DNA which is part of a hybrid gene encoding additional polypeptide sequence.

"Inhibiting translation" is defined as the ability to prevent synthesis of a specific protein encoded by a respective gene, by means of inhibiting the translation of the mRNA of this gene. "Translation inhibitor site" is defined as the minimal DNA sequence sufficient to inhibit translation.

There is thus provided in accordance with a preferred embodiment of the present invention a bioinformatically detectable novel gene encoding substantially pure DNA wherein: RNA encoded by the bioinformatically detectable novel gene is about 18 to about 24 nucleotides in length, and originates from an RNA precursor, which RNA precursor is about 50 to about 120 nucleotides in length, a nucleotide sequence of a first half of the RNA precursor is a partial inversed-reversed sequence of a nucleotide sequence of a second half thereof, a nucleotide sequence of the RNA encoded by the novel gene is a partial inversed-reversed sequence of a nucleotide sequence of a binding site associated with at least one target gene, the novel gene cannot be detected by either of the following: a visually discernable whole body phenotype, and detection of 99.9% of RNA species shorter than 25 nucleotides expressed in a tissue sample, and a function of the novel gene is bioinformatically deducible.

There is further provided in accordance with another preferred embodiment of the present invention a bioinformatically detectable novel gene encoding substantially pure DNA wherein: RNA encoded by the bioinformatically detectable novel gene includes a plurality of RNA sections, each of the RNA sections being about 50 to about 120 nucleotides in length, and including an RNA segment, which RNA segment is about 18 to about 24 nucleotides in length, a nucleotide sequence of a first half of each of the RNA sections encoded by the novel gene is a partial inversed-reversed sequence of nucleotide sequence of a second half thereof, a nucleotide sequence of each of the RNA segments encoded by the novel gene is a partial inversed-reversed sequence of the nucleotide sequence of a binding site associated with at least one target gene, and a function of the novel gene is bioinformatically deducible from the following data elements: the nucleotide sequence of the RNA encoded by the novel gene, a nucleotide sequence of the at least one target gene, and function of the at least one target gene.

There is still further provided in accordance with another preferred embodiment of the present invention a bioinformatically detectable novel gene encoding substantially pure DNA wherein: RNA encoded by the bioinformatically detectable novel gene is about 18 to about 24 nucleotides in length, and originates from an RNA precursor, which RNA precursor is about 50 to about 120 nucleotides in length, a nucleotide sequence of a first half of the RNA precursor is a partial inversed-reversed sequence of a nucleotide sequence of a second half thereof, a nucleotide sequence of the RNA encoded by the novel gene is a partial inversed-reverse sequence of a nucleotide sequence of a binding site associated with at least one target gene, a function of the novel gene is modulation of expression of the at least one target gene, and the at least one target gene does not encode a protein.

There is additionally provided in accordance with another preferred embodiment of the present invention A bioinformatically detectable novel gene encoding substantially pure DNA wherein: the bioinformatically detectable novel gene does not encode a protein, RNA encoded by the bioinformatically detectable novel gene is maternally transferred by a cell to at least one daughter cell of the cell, a function of the novel gene includes modulation of a cell type of the daughter cell, and the modulation is bioinformatically deducible.

There is moreover provided in accordance with another preferred embodiment of the present invention a bioinformatically detectable novel gene encoding substantially pure DNA wherein: the bioinformatically detectable novel gene does not encode a protein, a function of the novel gene is promotion of expression of the at lease one target gene, and the at least one target gene is bioinformatically deducible.

Further in accordance with a preferred embodiment of the present invention the function of the novel gene is bioinformatically deducible from the following data elements: the nucleotide sequence of the RNA encoded by the bioinformatically detectable novel gene, a nucleotide sequence of the at least one target gene, and a function of the at least one target gene.

Still further in accordance with a preferred embodiment of the present invention the RNA encoded by the novel gene complementarily binds the binding site associated with the at least one target gene, thereby modulating expression of the at least one target gene.

Additionally in accordance with a preferred embodiment of the present invention the binding site associated with at least one target gene is located in an untranslated region of RNA encoded by the at least one target gene.

Moreover in accordance with a preferred embodiment of the present invention the function of the novel gene is selective inhibition of translation of the at least one target gene, which selective inhibition includes complementary hybridization of the RNA encoded by the novel gene to the binding site.

Further in accordance with a preferred embodiment of the present invention the invention includes a vector including the DNA.

Still further in accordance with a preferred embodiment of the present invention the invention includes a method of selectively inhibiting translation of at least one gene, including introducing the vector.

Moreover in accordance with a preferred embodiment of the present invention the introducing includes utilizing RNAi pathway.

Additionally in accordance with a preferred embodiment of the present invention the invention includes a gene expression inhibition system including: the vector, and a vector inserter, functional to insert the vector into a cell, thereby selectively inhibiting translation of at least one gene.

Further in accordance with a preferred embodiment of the present invention the invention includes a probe including the DNA.

Still further in accordance with a preferred embodiment of the present invention the invention includes a method of selectively detecting expression of at least one gene, including using the probe.

Additionally in accordance with a preferred embodiment of the present invention the invention includes a gene expression detection system including: the probe, and a gene expression detector functional to selectively detect expression of at least one gene.

BRIEF DESCRIPTION OF DRAWINGS

FIGS. 2 through 4 are schematic diagrams which when taken together provide an analogy that illustrates a conceptual model of the present invention, addressing the genomic differentiation enigma;

FIG. 21A is an annotated sequence of EST72223 (SEQ ID NO: 1388403) comprising miRNA gene MIR98 and novel gene GAM24 detected by the gene detection system of the present invention;

FIGS. 21B and 21C are pictures of laboratory results, which when taken together demonstrate laboratory confirmation of expression of the bioinformatically detected novel gene GAM24 of FIG. 21A;

FIG. 21D provides pictures of laboratory results, which when taken together demonstrate further laboratory confirmation of expression of the bioinformatically detected novel gene GAM24 of FIG. 21A;

FIG. 22A is an annotated sequence of an EST7929020 (SEQ ID NO: 1388404) comprising novel genes GAM23 and GAM25 detected by the gene detection system of the present invention;

FIG. 22B is a picture of laboratory results, which confirm expression of bioinformatically detected novel genes GAM23 and GAM25 of FIG. 22A;

FIG. 23A is an annotated sequence of an EST1388749 (SEQ ID NO: 1388405) comprising novel gene GAM26 detected by the gene detection system of the present invention;

FIG. 23B are a picture of laboratory results, which confirm expression of the bioinformatically detected novel gene GAM26 of FIG. 23A;

FIGS. 24A through 28D are schematic diagrams illustrating sequences, functions and utilities of 5 specific genes of the novel group of genes of the present invention, detected using the bioinformatic gene detection system described hereinabove with reference to FIGS. 8 through 15.

DETAILED DESCRIPTION OF A PREFERRED EMBODIMENT

Figure 1:
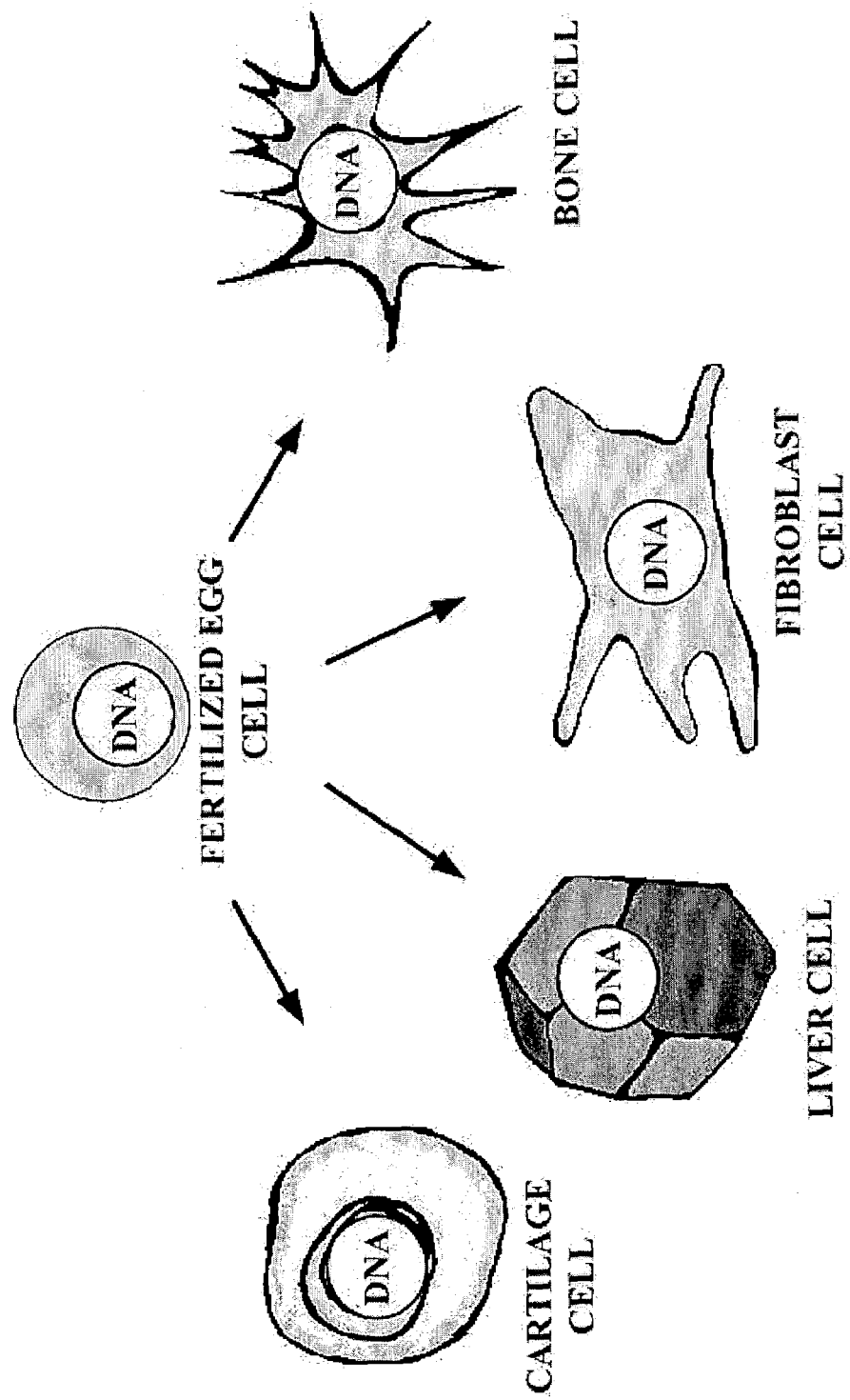
FIG. 1 is a simplified diagram illustrating the genomic differentiation enigma that the present invention addresses.

Reference is now made to FIG. 1, which is a simplified diagram providing a conceptual explanation of a genomic differentiation enigma, which the present invention addresses.

FIG. 1 depicts different cell types in an organism, such as CARTILAGE CELL, LIVER CELL, FIBROBLAST CELL and BONE CELL all containing identical DNA, and deriving from the initial FERTILIZED EGG CELL, and yet each of these cells expressing different proteins, and hence acquiring different shape and function.

The present invention proposes that the inevitable conclusion from this constraint is, however, strikingly simple: the coding system used must be modular. It must comprise multiple modules, or records, one for each cell-type, and a mechanism whereby each cell at its inception is instructed which record to open, and behaves according to instructions in that record.

This modular code concept is somewhat difficult to grasp, since we are strongly habituated to viewing things from an external viewpoint. An architect, for example, looks at a blueprint of a building, which details exactly where each element (block, window, door, electrical switch, etc.) is to be placed relative to all other elements, and then instructs builders to place these elements in their designated places. This is an external viewpoint: the architect is external to the blueprint, which itself is external to the physical building, and its different elements. The architect may therefore act as an 'external organizing agent': seeing the full picture and the relationships between all elements, and being able to instruct from the outside where to place each of them.

Genomics differentiation coding evidently works differently, without any such external organizing agent. It comprises only one smart block (the first cell), which is the architect and the blueprint, and which continuously duplicates itself, somehow knowing when to manifest itself as a block and when as a window, door, or electrical switch.

Figure 3:
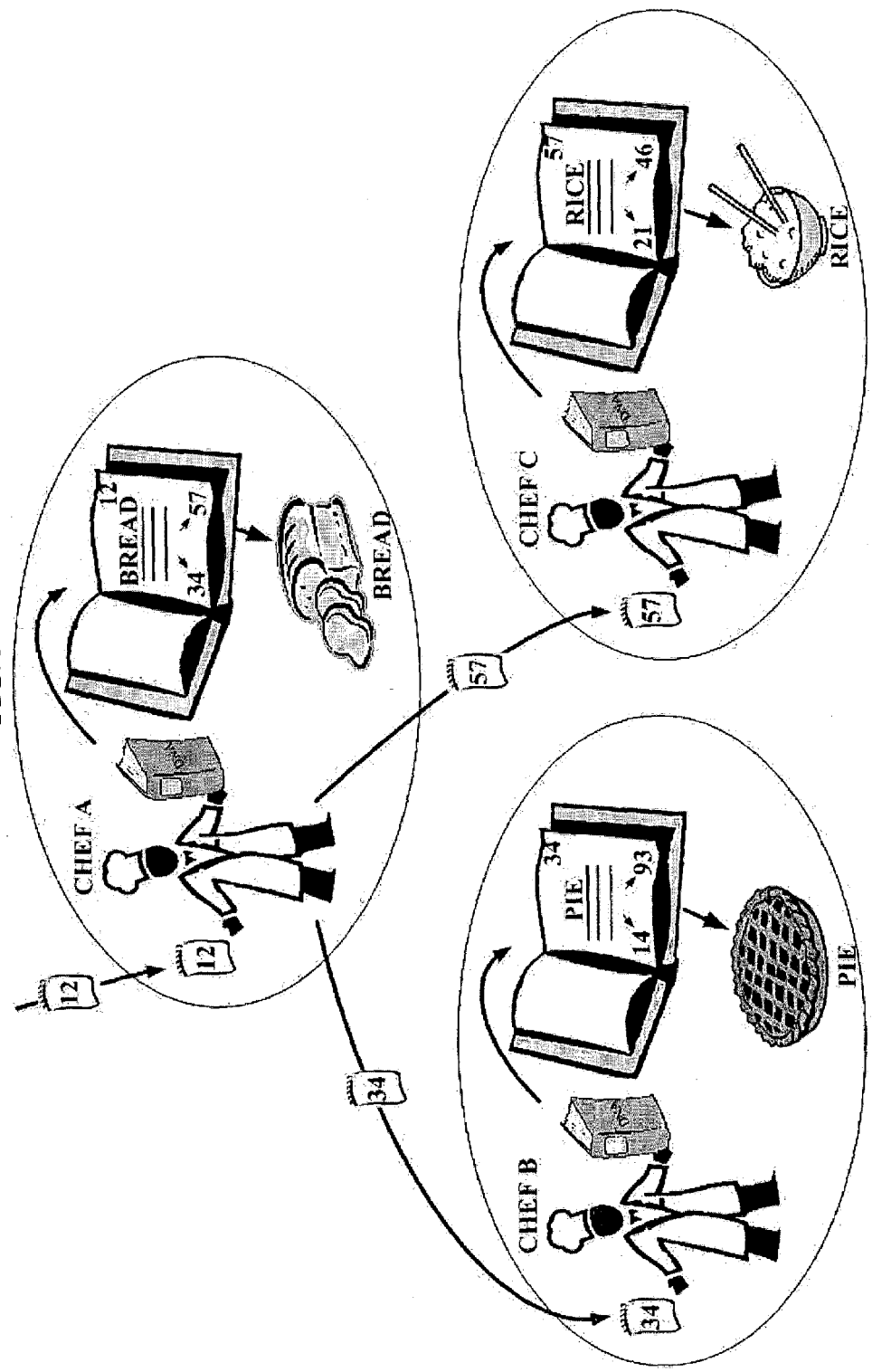
Figure 4:
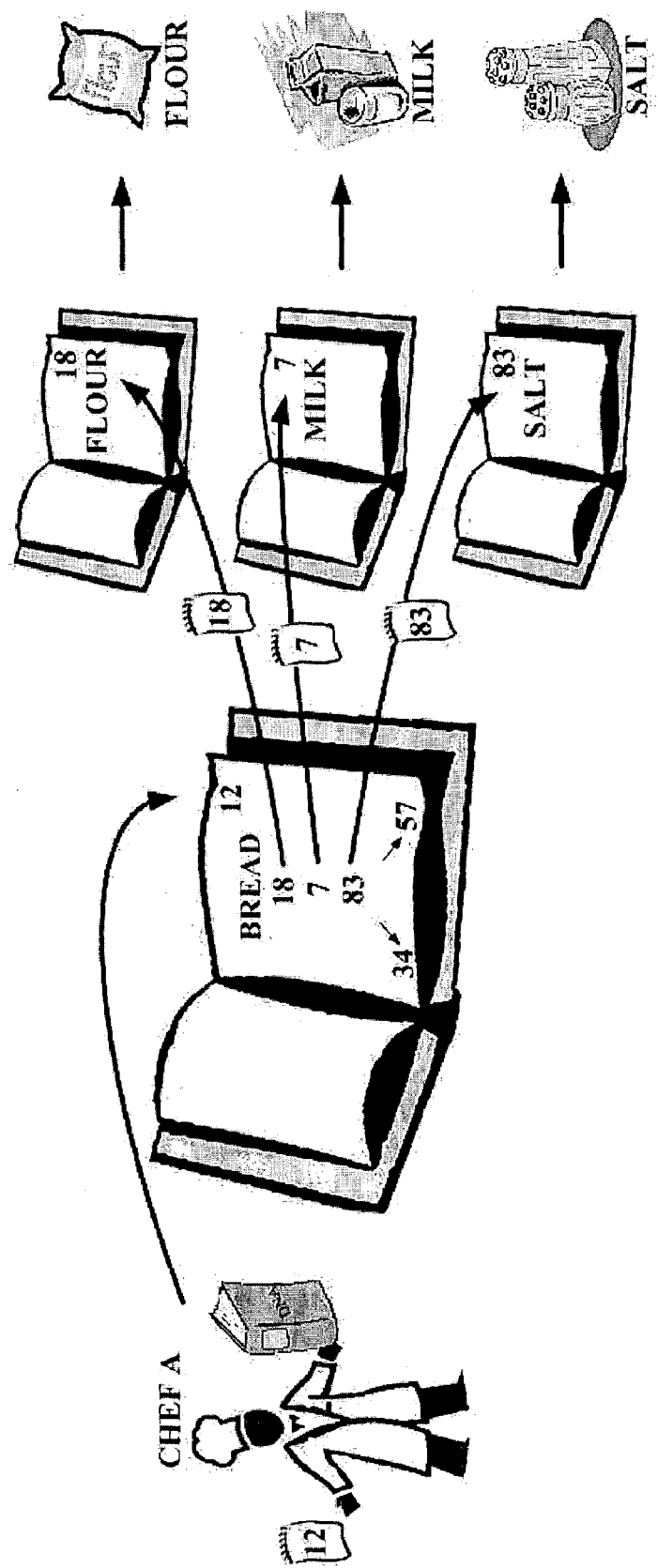

Reference is now made to FIGS. 2 through 4 which are schematic diagrams which when taken together provide an analogy that illustrates a conceptual model of the present invention, addressing the genomic differentiation enigma.

Reference is now made to FIG. 2A. Imagine a very talented chef, capable of preparing any meal provided the is given specific written cooking instructions. This chef is equipped with two items: (a) a thick recipe book, and (b) a small note with a number scribbled on it. The book comprises multiple pages, each page detailing how to prepare a specific meal. The small note indicates the page to be opened, and therefore the meal to be prepared. The chef looks at the page-number written on the note, opens the recipe book at the appropriate page, and prepares the meal according to the written instructions on this page. As an example, FIG. 2A depicts a CHEF holding a note with the number 12 written on it, he opens the book on page 12, and since that page contains the recipe for preparing BREAD, the CHEF prepares a loaf of BREAD.

Reference is now made to FIG. 2B, which depicts two identical chefs, CHEF A and CHEF B, holding an identical recipe book. Despite their identity, and the identity of their recipe book, since CHEF A holds a note numbered 12, and therefore opens the book on page 12 and prepares BREAD, whereas CHEF B holds a note numbered 34 and therefore opens the book on page 34 and prepares a PIE.

Reference is now made to FIG. 3. Imagine the chef of the analogy is also capable of duplicating himself once he has finished preparing the specified meal. The format of the book is such that at the bottom of each page, two numbers are written. When he has finished preparing the meal specified on that page, the chef is trained to do the following: (i) divide himself into two identical duplicate chefs, (ii) duplicate the recipe book and hand a copy to each of his duplicate chefs, and (iii) write down the two numbers found at the bottom of the page of the meal he prepared, on two small notes, handing one note to each of his two duplicate chefs.

Each of the two resulting duplicate chefs are now equipped with the same book, and have the same talent to prepare any meal, but since each of them received a different note, they will now prepare different meals.

FIG. 3 depicts CHEF A holding a recipe book and receiving a note numbered 12. CHEF A therefore opens the book on page 12 and prepares BREAD. When he is finished making bread, CHEF A performs the following actions: (i) divides himself into two duplicate chefs, designated CHEF B and CHEF C, (ii) duplicates his recipe book handing a copy to each of CHEF B and CHEF C, (iii) writes down the numbers found at the bottom of page 12, numbers 34 and 57, on two notes, handing note numbered 34 to CHEF B and note numbered 57 to CHEF C.

Accordingly, CHEF B receives a note numbered 34 and therefore opens the recipe book on page 34 and prepares PIE, whereas CHEF C receives a note numbered 57 and therefore opens the book on page 57 and therefore prepares RICE.

It is appreciated that while CHEF A, CHEF B & CHEF C are identical and hold identical recipe books, they each prepare a different meal. It is also appreciated that the meals prepared by CHEF B and CHEF C are determined CHEF A, and are mediated by the differently numbered notes passed on from CHEF A to CHEF B and CHEF C.

It is further appreciated that the mechanism illustrated by FIG. 3 enables an unlimited lineage of chefs to divide into duplicate, identical chefs and to determine the meals those duplicate chefs would prepare. For example, having been directed to page 34, when CHEF B divides into duplicate chefs (not shown), he will instruct its two duplicate chefs to prepare meals specified on pages 14 and 93 respectively, according to the numbers at the bottom of page 34 to which he was directed. Similarly, CHEF C will instruct its duplicate chefs to prepare meals specified on pages 21 and 46 respectively, etc.

Reference is now made to FIG. 4. Imagine that the cooking instructions on each page of the recipe book are written in shorthand format. The main meal-page to which the chef was directed by the scribbled note, merely contains a list of numbers which direct him to multiple successive pages, each specifying how to prepare an ingredient of that meal.

As an example, FIG. 4 depicts CHEF A of FIGS. 2 and 3, holding a recipe book and a note numbered 12. Accordingly, CHEF A opens the recipe book on page 12, which details the instructions for preparing BREAD. However, the 'instructions' on making BREAD found on page 12 comprise only of 3 numbers, 18, 7 and 83, which 'refer' CHEF A to pages detailing preparation of the ingredients of BREAD-FLOUR, MILK and SALT, respectively.

As illustrated in FIG. 4, turning from the main 'meal page' (—e.g. 12) to respective 'ingredients pages' (e.g. pages 18, 7 & 83) is mediated by scribbled notes with the page-numbers written on them. In this analogy, the scribbled notes are required for seeking the target pages to be turned to—both when turning to main 'meal pages' (e.g. page 12), as well as when turning to 'ingredient pages' (e.g. pages 18, 7 & 83).

The chef in the given analogy, schematically depicted in FIGS. 2 through 4, represents a cell; the thick recipe book represents the DNA; preparing a meal in the given analogy represents the cell manifesting itself as a specific cell-type; and ingredients of a meal represent proteins expressed by that cell-type. Like the chef equipped with the thick recipe book in the given analogy, all cells in an organism contain the same DNA and are therefore each potentially capable of manifesting itself as any cell-type, expressing proteins typical of that cell type.

Figure 5A:
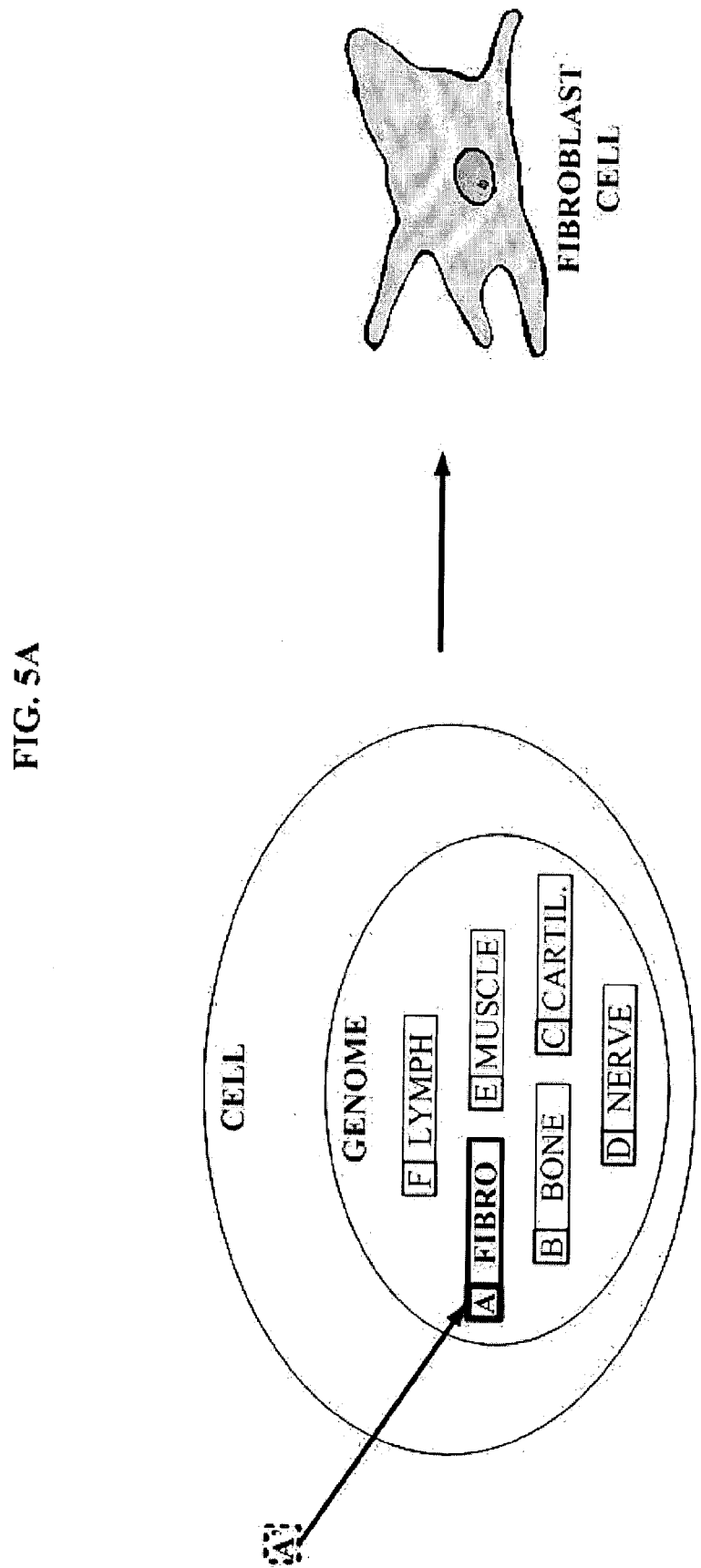
FIGS. 5A and 5B are schematic diagrams, which when taken together illustrate a 'genomic records' concept of the conceptual model of the present invention, addressing the genomic differentiation enigma.
Figure 5B:
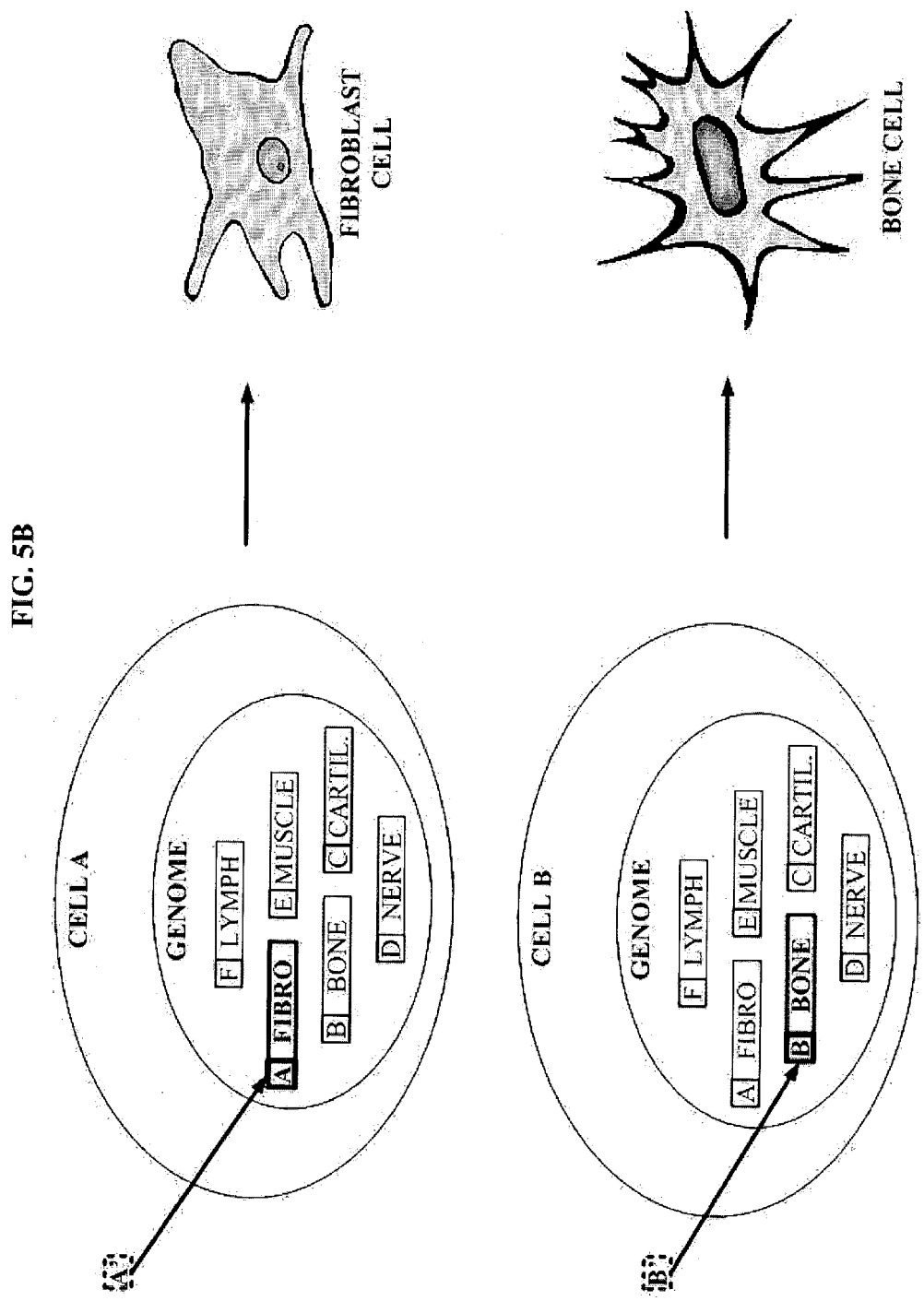

Reference is now made to FIGS. 5A and 5B which are schematic diagrams, which when taken together illustrate a 'genomic records' concept of the conceptual model of the present invention, addressing the genomic differentiation enigma.

The Genomic Records concept asserts that the DNA (the thick recipe book in the illustration) comprises a very large number of Genomic Records (analogous to pages in the recipe book), each containing the instructions for differentiation of a different cell-type, or developmental process. Each Genomic Record is headed by a very short genomic sequence which functions as a 'Genomic Address' of that Genomic Record (analogous to the page number in the recipe book). At its inception, in addition to the DNA, each cell also receives a short RNA segment (the scribbled note in the illustration). This short RNA segment binds complementarily to a 'Genomic Address' sequence of one of the Genomic Records, thereby activating that Genomic Record, and accordingly determining the cell's-fate (analogous to opening the book on the page corresponding to the number on the scribbled note, thereby determining the meal to be prepared).

Reference is now made to FIG. 5A. a CELL is illustrated which comprises a GENOME. The GENOME comprises a plurality of GENOMIC RECORDS, each of which correlates to a specific cell type (for clarity only 6 sample genomic records are shown). Each genomic record comprises genomic instructions on differentiation into a specific cell-type, as further elaborated below with reference to FIG. 7. At cell inception, the CELL receives a maternal short RNA segment, which activates one of the GENOMIC RECORDS, causing the cell to differentiate according to the instructions comprised in that genomic record. As an example, FIG. 5A illustrates reception of a maternal short RNA segment designated A' and outlined by a broken line, which activates the FIBRO genomic record, causing the cell to differentiate into a FIBROBLAST CELL.

Reference is now made to FIG. 5B, which is a simplified schematic diagram, illustrating cellular differentiation mediated by the 'Genomic Records' concept. FIG. 5B depicts 2 cells in an organism, designated CELL A and CELL B, each having a GENOME. It is appreciated that since CELL A and CELL B are cells in the same organism, the GENOME of CELL A is identical to that of CELL B. Despite having an identical GENOME, CELL A differentiates differently from CELL B, due to activation of different genomic records in these two cells. In CELL A the FIBRO GENOMIC RECORD is activated, causing CELL A to differentiate into a FIBROBLAST CELL, whereas in CELL B the BONE GENOMIC RECORD is activated, causing the CELL B to differentiate into a BONE CELL. The cause for activation of different genomic records in these two cells is the different maternal short RNA which they both received: CELL A received a maternal short RNA segment designated A' which activated genomic record FIBRO, whereas CELL B received a maternal short RNA segment designated B' which activated genomic record BONE.

Figure 6:
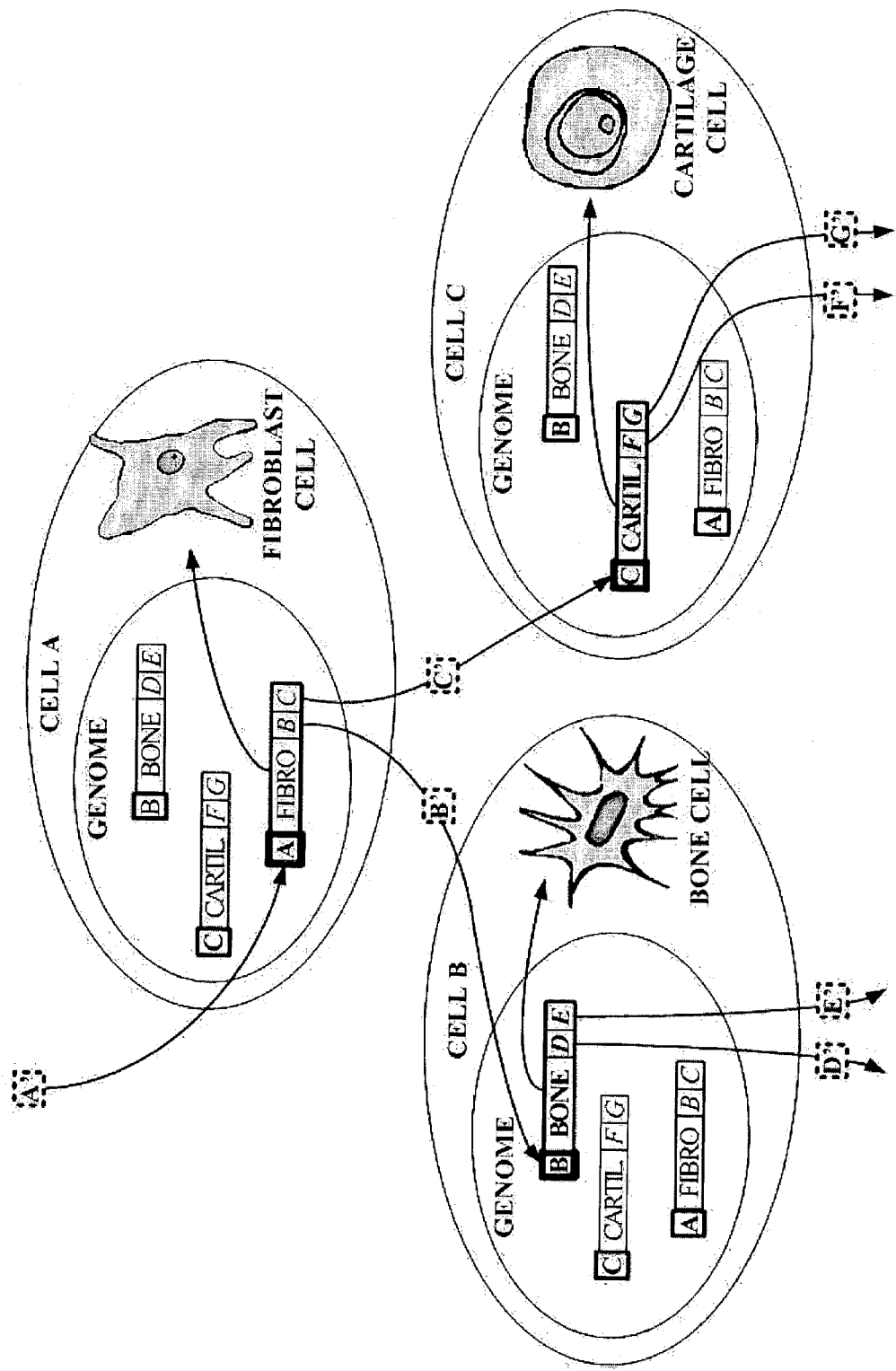
FIG. 6 is a schematic diagram illustrating a 'genomically programmed cell differentiation' concept of the conceptual model of the present invention, addressing the genomic differentiation enigma.

Reference is now made to FIG. 6 which is a schematic diagram illustrating a 'genomically programmed cell differentiation' concept of the conceptual model of the present invention, addressing the genomic differentiation enigma.

A cell designated CELL A divides into 2 cells designated CELL B and CELL C. CELL A, CELL B and CELL C each comprise a GENOME, which GENOME comprises a plurality of GENOMIC RECORDS. It is appreciated that since CELL A, CELL B and CELL C are cells in the same organism, the GENOME of these cells, and the GENOMIC RECORDS comprised therein, are identical.

As described above with reference to FIG. 5B, at its inception, CELL A receives a maternal short RNA segment, designated A' and marked by a broken line, which activates the FIBRO genomic record, thereby causing CELL A to differentiate into a FIBROBLAST CELL. However, FIG. 6 shows further details of the genomic records: each cell genomic record also comprises two short genomic sequences, referred to here as Daughter Cell Genomic Addresses. Blocks designated B and C are Daughter Cell Genomic Addresses of the FIBRO Genomic Record. At cell division, each parent cell transcribes two short RNA segments, corresponding to the two Daughter Cell Genomic Addresses of the Genomic Record of that parent cell, and transfers one to each of its two daughter cells. CELL A of FIG. 6 transcribes and transfers to its two respective daughter cells, two short RNA segments, outlined by a broken line and designated B' and C', corresponding to daughter cell genomic addresses designated B and C comprised in the FIBRO genomic record.

CELL B therefore receives the above mentioned maternal short RNA segment designated B', which binds complementarily to genomic address designated B of genomic record BONE, thereby activating this genomic record, which in turn causes CELL B to differentiate into a BONE CELL. Similarly, CELL C receives the above mentioned maternal short RNA segment designated C', which binds complementarily to genomic address designated C of genomic record CARTIL, thereby activating this genomic record, which in turn causes CELL C to differentiate into a CARTILAGE CELL.

It is appreciated that the mechanism illustrated by FIG. 6 enables an unlimited lineage of cells to divide into daughter cells containing the same DNA, and to determine the cell-fate of these daughter cells. For example, when CELL B and CELL C divide into their respective daughter cells (not shown), they will transfer short RNA segments designated D' & E', and F' & G' respectively, to their respective daughter cells. The cell fate of each of these daughter cells would be determined by the identity of the maternal short RNA segment they receive, which would determine the genomic record activated.

Figure 7:
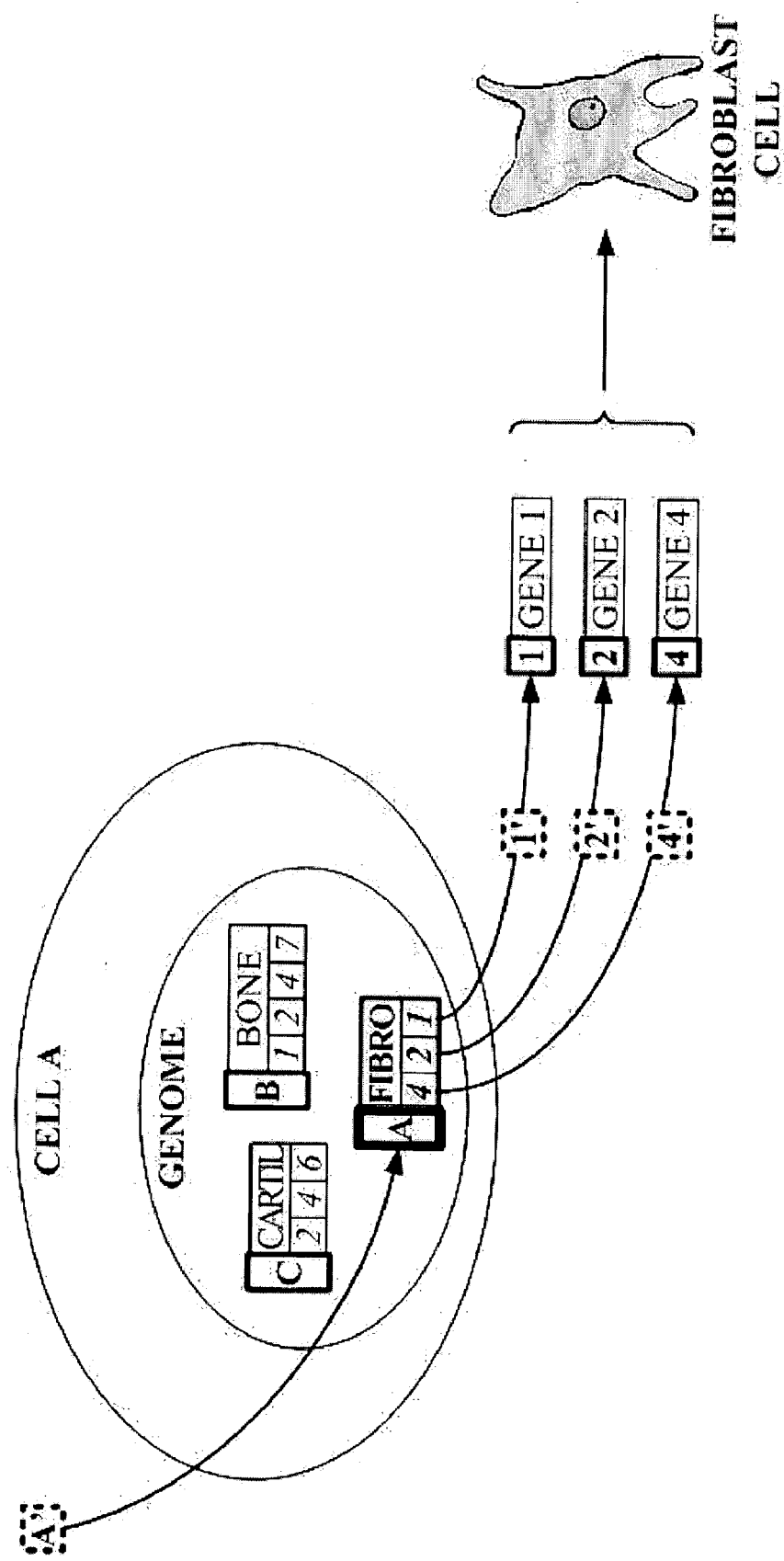
FIG. 7 is a schematic diagram illustrating a 'genomically programmed cell-specific protein expression modulation' concept of the conceptual model of the present invention, addressing the genomic differentiation enigma.

Reference is now made to FIG. 7 which is a schematic diagram illustrating a 'genomically programmed cell-specific protein expression modulation' concept of the conceptual model of the present invention, addressing the genomic differentiation enigma.

Cell A receives a maternal short RNA segment designated A', which activates a genomic record designated FIBRO, by anti-sense binding to a binding site 'header' of this genomic record, designated A. Genomic record FIBRO encodes 3 short RNA segments, designated 1, 2 and 4 respectively, which modulate expression of target genes designated GENE1, GENE2 and GENE4 respectively. Modulation of expression of these genes results in CELL A differentiating into a FIBROBLAST CELL.

Figure 8:
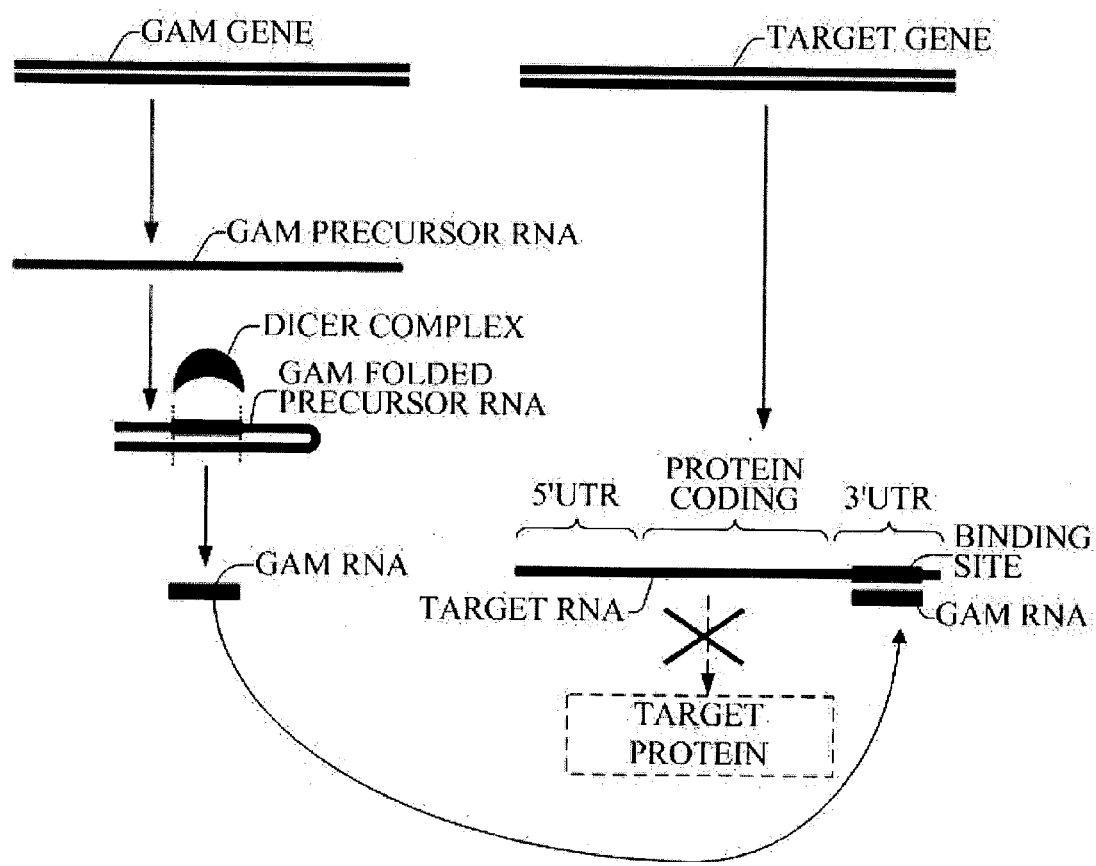
FIG. 8 is a simplified diagram illustrating a mode by which genes of a novel group of genes of the present invention, modulate expression of known target genes.

Reference is now made to FIG. 8 which is a simplified diagram illustrating a mode by which genes of a novel group of genes of the present invention, modulate expression of known target genes.

The novel genes of the present invention are micro RNA (miRNA)-like, regulatory RNA genes, modulating expression of known target genes. This mode of modulation is common to other known miRNA genes, as described hereinabove with reference to the background of the invention section.

GAM GENE and TARGET GENE are two human genes contained in the DNA of the human genome.

GAM GENE encodes a GAM PRECURSOR RNA. However, similar to other miRNA genes, and unlike most ordinary genes, its RNA, GAM PRECURSOR RNA, does not encode a protein.

GAM PRECURSOR RNA folds onto itself, forming GAM FOLDED PRECURSOR RNA. As FIG. 8 illustrates, GAM FOLDED PRECURSOR RNA forms a 'hairpin structure', folding onto itself. As is well known in the art, this 'hairpin structure', is typical genes of the miRNA genes, and is due to the fact that nucleotide sequence of the first half of the RNA of a gene in this group is an accurate or partial inversed-reversed sequence of the nucleotide sequence of its second half. By "inversed-reversed" is meant a sequence which is reversed and wherein each nucleotide is replaced by a complimentary nucleotide, as is well known in the art (—e.g. ATGGC is the inversed-reversed sequence of GCCAT).

An enzyme complex, designated DICER COMPLEX, 'dices' the GAM FOLDED PRECURSOR RNA into a single stranded RNA segment, about 22 nucleotides long, designated GAM RNA. As is known in the art, 'dicing' of the hairpin structured RNA precursor into shorter RNA segments about 22 nucleotides long by a Dicer type enzyme is catalyzed by an enzyme complex comprising an enzyme called Dicer together with other necessary proteins.

TARGET GENE encodes a corresponding messenger RNA, designated TARGET RNA. This TARGET RNA comprises 3 regions: a 5' untranslated region, a protein coding region and a 3' untranslated region, designated 5'UTR, PROTEIN CODING and 3'UTR respectively.

GAM RNA binds complementarily a BINDING SITE, located on the 3'UTR segment of TARGET RNA. This complementarily binding is due to the fact that the nucleotide sequence of GAM RNA is an accurate or partial inversed-reversed sequence of the nucleotide sequence of BINDING SITE.

The complimentary binding of GAM RNA to BINDING SITE inhibits translation of TARGET RNA into TARGET PROTEIN. TARGET PROTEIN is therefore outlined by a broken line.

It is appreciated by one skilled in the art that the mode of transcriptional inhibition illustrated by FIG. 8 with specific reference to GAM genes of the present invention, is in fact common to all other miRNA genes. A specific complimentary binding site has been demonstrated only for Lin-4 and Let-7. All the other 93 newly discovered miRNA genes are also believed by those skilled in the art to modulate expression of other genes by complimentary binding, although specific complimentary binding sites for these genes have not yet been found (Ruvkun G., 'Perspective: Glimpses of a tiny RNA world', Science 294, 779 (2001)). The present invention discloses a novel group of genes, the GAM genes, belonging to the miRNA genes group, and for which a specific a complimentary binding has been determined.

Figure 9:
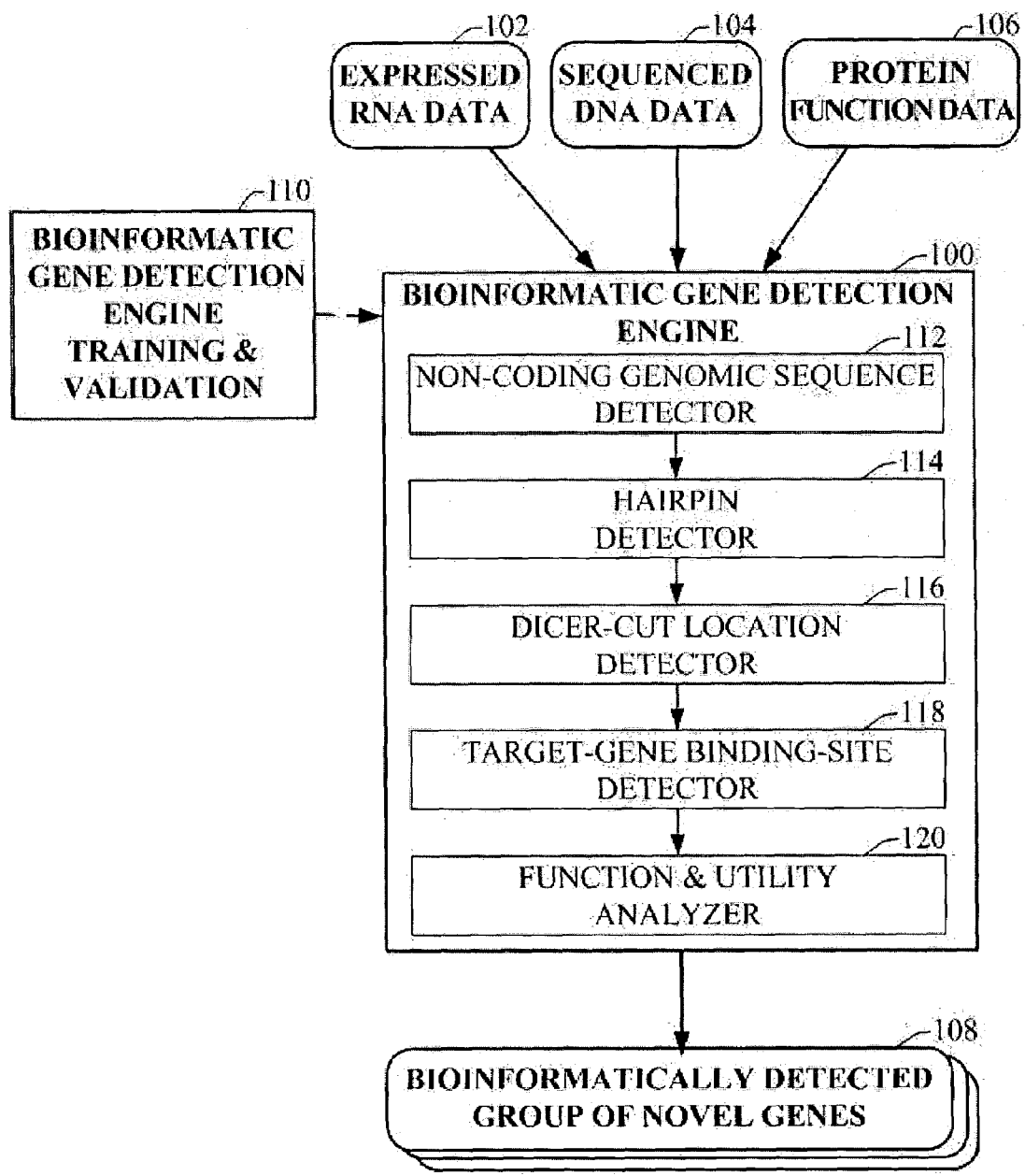
FIG. 9 is a simplified block diagram illustrating a bioinformatic gene detection system capable of detecting genes of the novel group of genes of the present invention, which system is constructed and operative in accordance with a preferred embodiment of the present invention.

Reference is now made to FIG. 9 which is a simplified block diagram illustrating a bioinformatic gene detection system capable of detecting genes of the novel group of genes of the present invention, which system is constructed and operative in accordance with a preferred embodiment of the present invention.

A centerpiece of the present invention is a bioinformatic gene detection engine 100, which is a preferred implementation of a mechanism capable of bioinformatically detecting genes of the novel group of genes of the present invention.

The function of the bioinformatic gene detection engine 100 is as follows: it receives three types of input, expressed RNA data 102, sequenced DNA data 104, and protein function data 106, performs a complex process of analysis of this data as elaborated below, and based on this analysis produces output of a bioinformatically detected group of novel genes designated 108.

Expressed RNA data 102 comprises published expressed sequence tags (EST) data, published mRNA data, as well as other sources of published RNA data. Sequenced DNA data 104 comprises alphanumeric data describing sequenced genomic data, which preferably includes annotation data such as location of known protein coding regions relative to the sequenced data. Protein function data 106 comprises scientific publications reporting studies which elucidated physiological function known proteins, and their connection, involvement and possible utility in treatment and diagnosis of various diseases. Expressed RNA data 102, sequenced DNA data 104 may preferably be obtained from data published by the National Center for Bioinformatics (NCBI) at the National Institute of Health (NIH), as well as from various other published data sources. Protein function data 106 may preferably be obtained from any one of numerous relevant published data sources, such as the Online Mendelian Inherited Disease In Man (OMIM) database developed by John Hopkins University, and also published by NCBI.

Prior to actual detection of bioinformatically detected novel genes 108 by the bioinformatic gene detection engine 100, a process of bioinformatic gene detection engine training & validation designated 110 takes place. This process uses the known miRNA genes as a training set (some 200 such genes have been found to date using biological laboratory means), to train the bioinformatic gene detection engine 100 to bioinformatically recognize miRNA-like genes, and their respective potential target binding sites. Bioinformatic gene detection engine training & validation 110 is further described hereinbelow with reference to FIG. 10.

The bioinformatic gene detection engine 100 comprises several modules which are preferably activated sequentially, and are described as follows:

A non-coding genomic sequence detector 112 operative to bioinformatically detect non-protein coding genomic sequences. The non-coding genomic sequence detector 112 is further described hereinbelow with reference to FIGS. 11A and 11B.

A hairpin detector 114 operative to bioinformatically detect genomic 'hairpin-shaped' sequences, similar to GAM FOLDED PRECURSOR of FIG. 8. The hairpin detector 114 is further described hereinbelow with reference to FIGS. 12A and 12B.

A dicer-cut location detector 116 operative to bioinformatically detect the location on a hairpin shaped sequence which is enzymatically cut by DICER COMPLEX of FIG.

8. The dicer-cut location detector 116 is further described hereinbelow with reference to FIG. 13A.

A target-gene binding-site detector 118 operative to bioinformatically detect target genes having binding sites, the nucleotide sequence of which is partially complementary to that of a given genomic sequence, such as a sequence cut by DICER COMPLEX of FIG. 8. The target-gene binding-site detector 118 is further described hereinbelow with reference to FIGS. 14A and 14B.

A function & utility analyzer 120 operative to analyze function and utility of target genes, in order to identify target genes which have a significant clinical function and utility. The function & utility analyzer 120 is further described hereinbelow with reference to FIG. 15.

Hardware implementation of the bioinformatic gene detection engine 100 is important, since significant computing power is preferably required in order to perform the computation of bioinformatic gene detection engine 100 in reasonable time and cost. As an example, it is estimated that using one powerful 8-processor PC Server, over 30 months of computing time (at 24 hours per day) would be required in order to detect all miRNA genes in human EST data, and their respective binding sites.

For example, in order to address this challenge at reasonable time and cost, a preferred embodiment of the present invention may comprise a cluster of a large number of personal computers (PCs), such as 100 PCs (Pentium IV, 1.7 GHz, with 40 GB storage each), connected by Ethernet to several strong servers, such as 4 servers (2-CPU, Xeon 2.2 GHz, with 200 GB storage each), combined with an 8-processor server (8-CPU, Xeon 550 Mhz w/8 GB RAM) connected via 2 HBA fiber-channels to an EMC Clariion 100-disks, 3.6 Terabyte storage device. Additionally, preferably an efficient database computer program, such as Microsoft™ SQL-Server database computer program is used and is optimized to the specific requirements of bioinformatic gene detection engine 100. Furthermore, the PCs are preferably optimized to operate close to 100% CPU usage continuously, as is known in the art. Using suitable hardware and software may preferably reduce the required calculation time in the abovementioned example from 30 months to 20 days.

It is appreciated that the abovementioned hardware configuration is not meant to be limiting, and is given as an illustration only. The present invention may be implemented in a wide variety of hardware and software configurations.

The present invention discloses 527 novel genes of the GAM group of genes, which have been detected bioinformatically, as described hereinbelow with reference to FIGS. 24 through 550. Laboratory confirmation of 4 genes of the GAM group of genes is described hereinbelow with reference to FIGS. 21A through 23.

Figure 10:
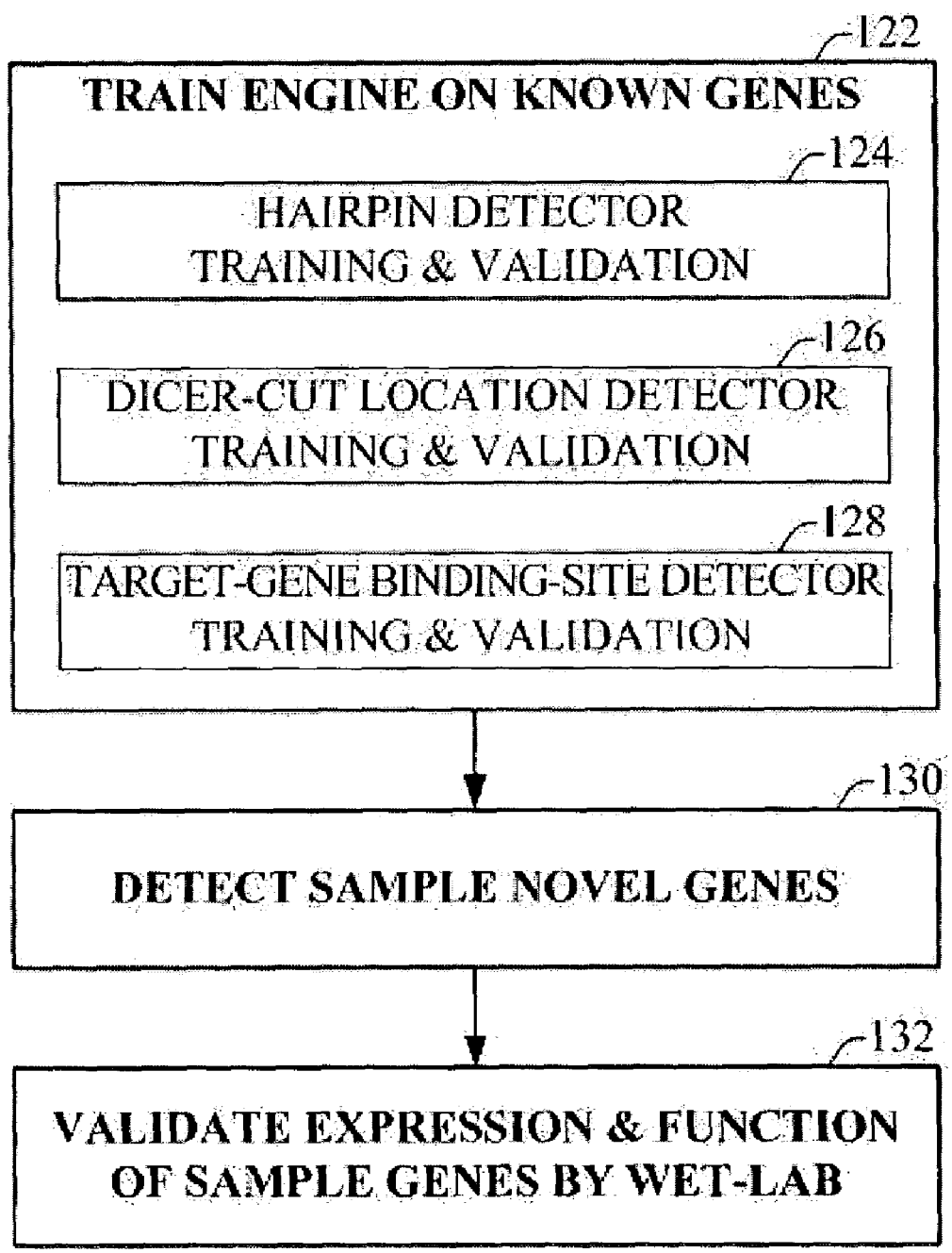
FIG. 10 is a simplified flowchart illustrating operation of a mechanism for training of a computer system to recognize the novel genes of the present invention, which mechanism is constructed and operative in accordance with a preferred embodiment of the present invention.

Reference is now made to FIG. 10 which is a simplified flowchart illustrating operation of a mechanism for training of a computer system to recognize the novel genes of the present invention. This mechanism is a preferred implementation of the bioinformatic gene detection engine training & validation 110 described hereinabove with reference to FIG. 9.

Bioinformatic gene detection engine training & validation 110 of FIG. 9 begins by training the bioinformatic gene detection engine to recognize known miRNA genes, as designated by numeral 122. This training step comprises hairpin detector training & validation 124, further described hereinbelow with reference to FIG. 12A, dicer-cut location detector training & validation 126, further described hereinbelow with reference to FIGS. 13A and 13B, and target-gene binding-site detector training & validation 128, further described hereinbelow with reference to FIG. 14A.

Next, the bioinformatic gene detection engine 100 is used to bioinformatically detect sample novel genes, as designated by numeral 130. An example of a sample novel gene thus detected is described hereinbelow with reference to FIG. 21.

Finally, wet lab experiments are preferably conducted in order to validate expression and preferably function the sample novel genes detected by the bioinformatic gene detection engine 100 in the previous step. An example of wet-lab validation of the abovementioned sample novel gene bioinformatically detected by the system is described hereinbelow with reference to FIGS. 22A and 22B.

Figure 11A:
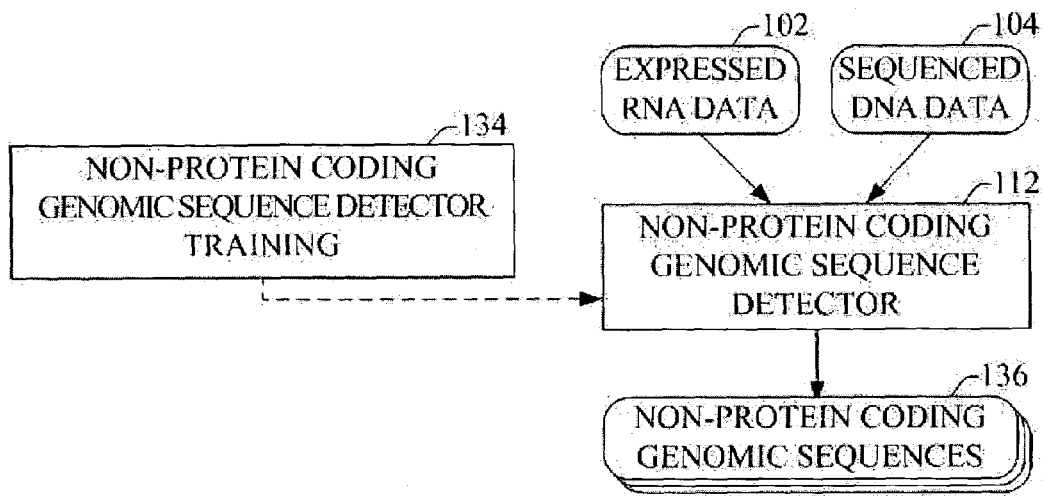
FIG. 11A is a simplified block diagram of a non-coding genomic sequence detector constructed and operative in accordance with a preferred embodiment of the present invention.

Reference is now made to FIG. 11A which is a simplified block diagram of a preferred implementation of the non-coding genomic sequence detector 112 described hereinabove with reference to FIG. 9. Non-protein coding genomic sequence detector 112 of FIG. 9 preferably receives as input at least two types of published genomic data: expressed RNA data 102, including EST data and mRNA data, and sequenced DNA data 104. After its initial training, indicated by numeral 134, and based on the abovementioned input data, the non-protein coding genomic sequence detector 112 produces as output a plurality of non-protein coding genomic sequences 136. Preferred operation of the non-protein coding genomic sequence detector 112 is described hereinbelow with reference to FIG. 11B.

Figure 11B:
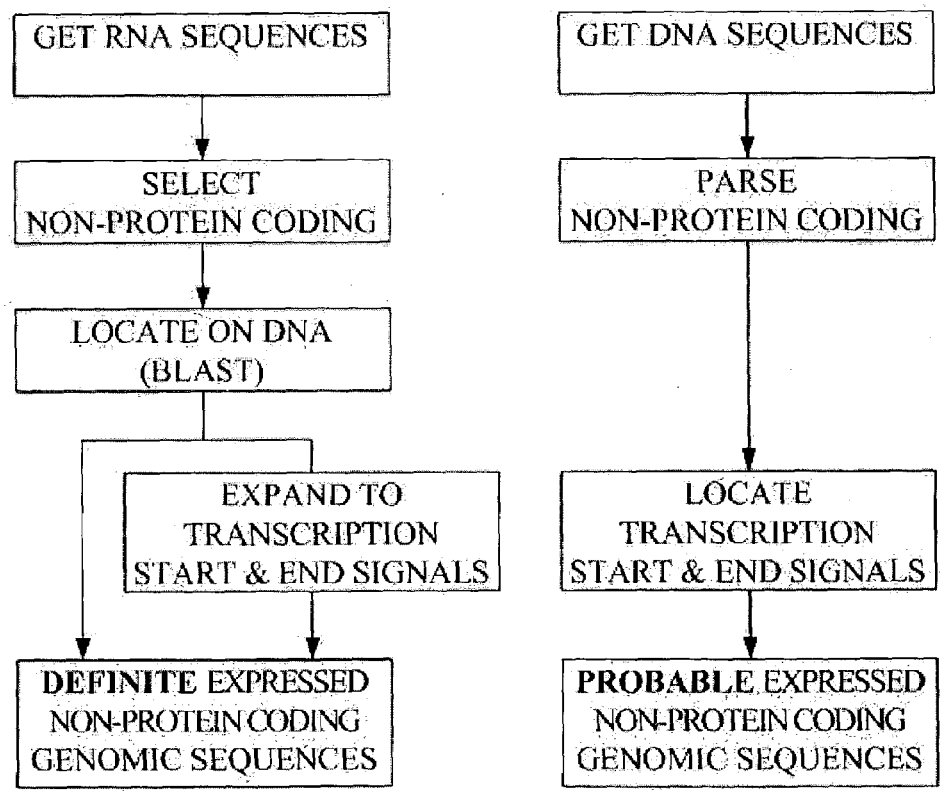
FIG. 11B is a simplified flowchart illustrating operation of a non-coding genomic sequence detector constructed and operative in accordance with a preferred embodiment of the present invention.

Reference is now made to FIG. 11B which is a simplified flowchart illustrating a preferred operation of the non-coding genomic sequence detector 112 of FIG. 9. Detection of non-protein coding genomic sequences to be further analyzed by the system generally preferably progresses in one of the following two paths.

A first path for detecting non-protein coding genomic sequences begins by receiving a plurality of known RNA sequences, such as EST data. Each RNA sequence is first compared to all known protein-coding sequences, in order to select only those RNA sequences which are non-protein coding. This can preferably be performed by BLAST comparison of the RNA sequence to known protein coding sequences. The abovementioned BLAST comparison to the DNA preferably also provides the localization of the RNA on the DNA.

Optionally, an attempt may be made to 'expand' the non-protein RNA sequences thus found, by searching for transcription start and end signals, upstream and downstream of location of the RNA on the DNA respectively, as is well known in the art.

A second path for detecting non-protein coding genomic sequences starts by receiving DNA sequences. The DNA sequences are parsed into non protein coding sequences, based on published DNA annotation data: extracting those DNA sequences which are between known protein coding sequences. Next, transcription start and end signals are sought. If such signals are found, and depending on their 'strength', probable expressed non-protein coding genomic sequences are yielded.

Figure 12A:
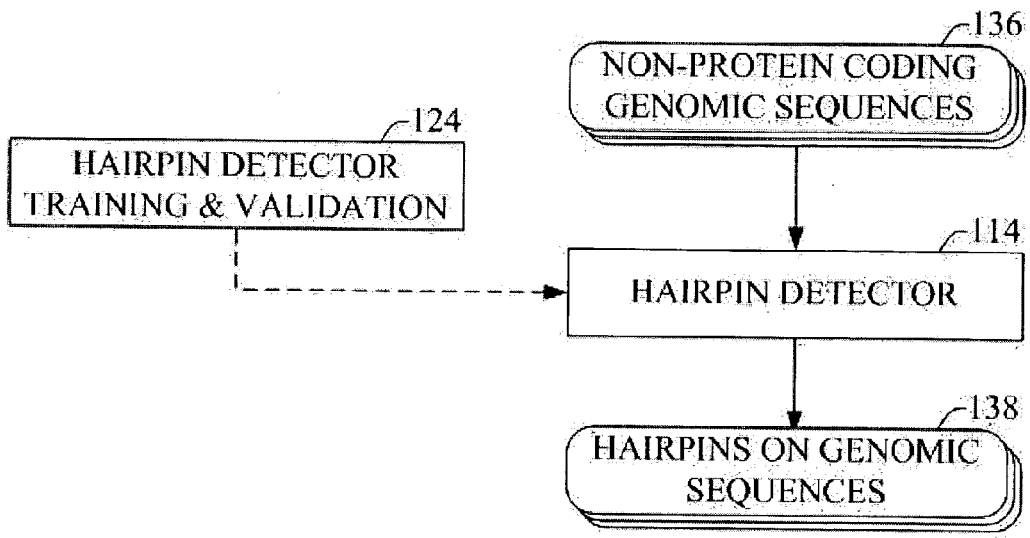
FIG. 12A is a simplified block diagram of a hairpin detector constructed and operative in accordance with a preferred embodiment of the present invention.

Reference is now made to FIG. 12A which is a simplified block diagram of a preferred implementation of the hairpin detector 114 described hereinabove with reference to FIG. 9.

The goal of the hairpin detector 114 is to detect 'hairpin' shaped genomic sequences, similar to those of known miRNA genes. As mentioned hereinabove with reference to FIG. 8, a 'hairpin' genomic sequence refers to a genomic sequence which 'folds onto itself' forming a hairpin like shape, due to the fact that nucleotide sequence of the first half of the nucleotide sequence is an accurate or The hairpin detector 114 of FIG. 9 receives as input a plurality of non-protein coding genomic sequences 136 of FIG. 11A, and after a phase of hairpin detector training & validation 124 of FIG. 10, is operative to detect and output 'hairpin shaped' sequences found in the input expressed non-protein coding sequences, designated by numeral 138.

The phase of hairpin detector training & validation 124 is an iterative process of applying the hairpin detector 114 to known hairpin shaped miRNA genes, calibrating the hairpin detector 114 such that it identifies the training set of known hairpins, as well as sequences which are similar thereto. Preferred operation of the hairpin detector 114 is described hereinbelow with reference to FIG. 12B.

Figure 12B:
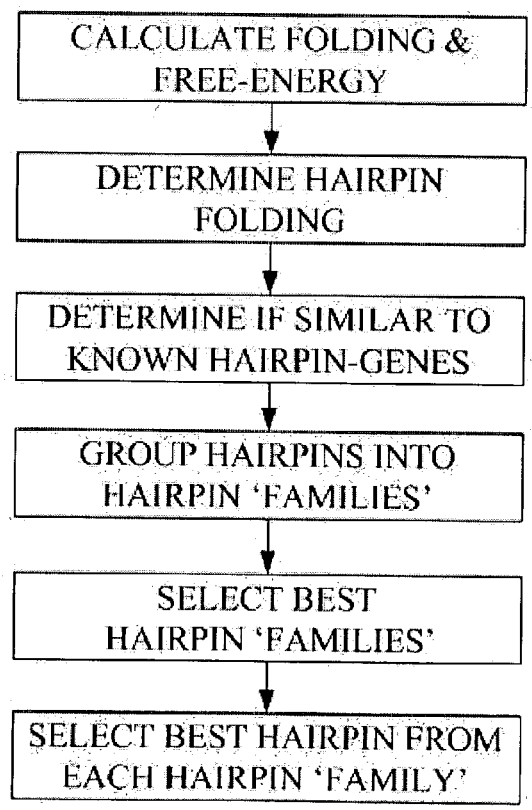
FIG. 12B is a simplified flowchart illustrating operation of a hairpin detector constructed and operative in accordance with a preferred embodiment of the present invention.

Reference is now made to FIG. 12B which is a simplified flowchart illustrating a preferred operation of the hairpin detector 114 of FIG. 9.

A hairpin structure is a two dimensional folding structure, resulting from the nucleotide sequence pattern: the nucleotide sequence of the first half of the hairpin sequence is an inversed-reversed sequence of the second half thereof. Different methodologies are known in the art for detection of various two dimensional and three dimensional hairpin structures.

In a preferred embodiment of the present invention, the hairpin detector 114 initially calculates possible 2-dimensional (2D) folding patterns of a given one of the non-protein coding genomic sequences 136, preferably using a 2D folding algorithm based on free-energy calculation, such as the Zucker algorithm, as is well known in the art.

Next, the hairpin detector 114 analyzes the results of the 2D folding, in order to determine the presence, and location of hairpin structures. A 2D folding algorithm typically provides as output a listing of the base-pairing of the 2D folded shape, i.e. a listing of which all two pairs of nucleotides in the sequence which will bond. The goal of this second step is to assess this base-pairing listing, in order to determine if it describes a hairpin type bonding pattern.

The hairpin detector 114 then assess those hairpin structures found by the previous step, comparing them to hairpins of known miRNA genes, using various parameters such as length, free-energy, amount and type of mismatches, etc. Only hairpins that bear statistically significant resemblance of the population of hairpins of known miRNAs, according to the abovementioned parameters are accepted.

Lastly, the hairpin detector 114 attempts to select those hairpin structures which are as stable as the hairpins of know miRNA genes. This may be achieved in various manners. A preferred embodiment of the present invention utilizes the following methodology comprising three steps.

First, the hairpin detector 114 attempts to group potential hairpins into 'families' of closely related hairpins. As is known in the art, a free-energy calculation algorithm, typically provides multiple 'versions' each describing a different possible 2D folding pattern for the given genomic sequence, and the free energy of such possible folding. The hairpin detector 114 therefore preferably assesses all hairpins found on all 'versions', grouping hairpins which appear in different versions, but which share near identical locations into a common 'family' of hairpins. For example, all hairpins in different versions, the center of which is within 7 nucleotides of each other may preferably be grouped to a single 'family'.

Next, hairpin 'families' are assessed, in order to select only those families which represent hairpins that are as stable as those of known miRNA hairpins. For example, preferably only families which are represented in at least 65% of the free-energy calculation 2D folding versions are considered stable.

Finally, an attempt is made to select the most suitable hairpin from each selected family. For example, preferably the hairpin which appears in more versions than other hairpins, and in versions the free-energy of which is lower, may be selected.

Figure 13A:
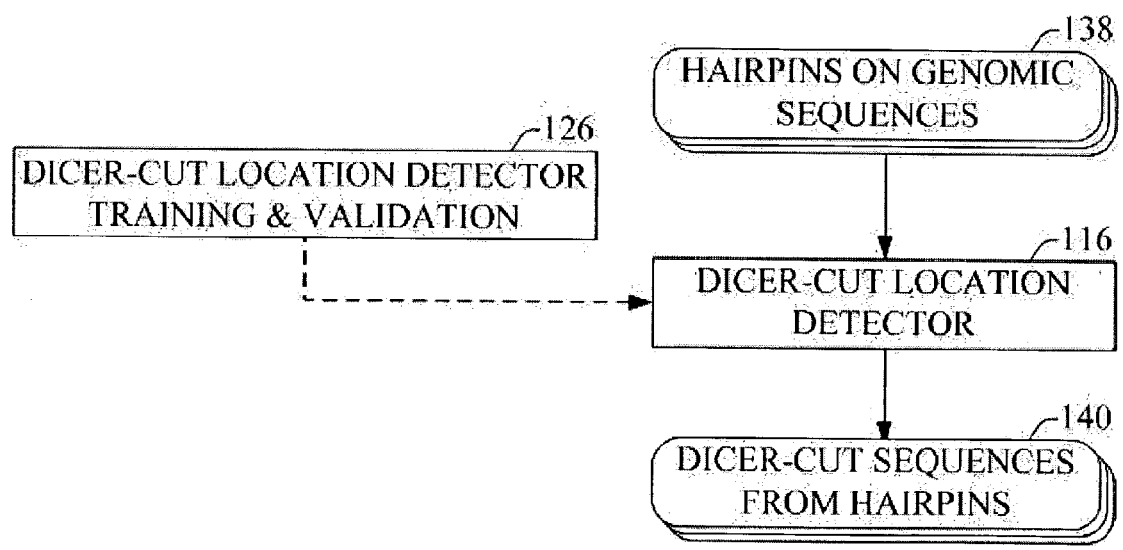
FIG. 13A is a simplified block diagram of a dicer-cut location detector constructed and operative in accordance with a preferred embodiment of the present invention.

Reference is now made to FIG. 13A which is a simplified block diagram of a preferred implementation of the dicer-cut location detector 116 described hereinabove with reference to FIG. 9.

The goal of the dicer-cut location detector 116 is to detect the location in which DICER COMPLEX of FIG. 8, comprising the enzyme Dicer, would 'dice' the given hairpin sequence, similar to GAM FOLDED PRECURSOR RNA, yielding GAM RNA both of FIG. 8.

The dicer-cut location detector 116 of FIG. 9 therefore receives as input a plurality of hairpins on genomic sequences 138 of FIG. 12A, which were calculated by the previous step, and after a phase of dicer-cut location detector training & validation 126 of FIG. 10, is operative to detect a respective plurality of dicer-cut sequences from hairpins 140, one for each hairpin.

In a preferred embodiment of the present invention, the dicer-cut location detector 116 preferably uses a combination of neural networks, Bayesian networks, Markovian modeling, and Support Vector Machines (SVMs) trained on the known dicer-cut locations of known miRNA genes, in order to detect dicer-cut locations. Dicer-cut location detector training & validation 126, which is further described hereinbelow with reference to FIG. 13B.

Figure 13B:
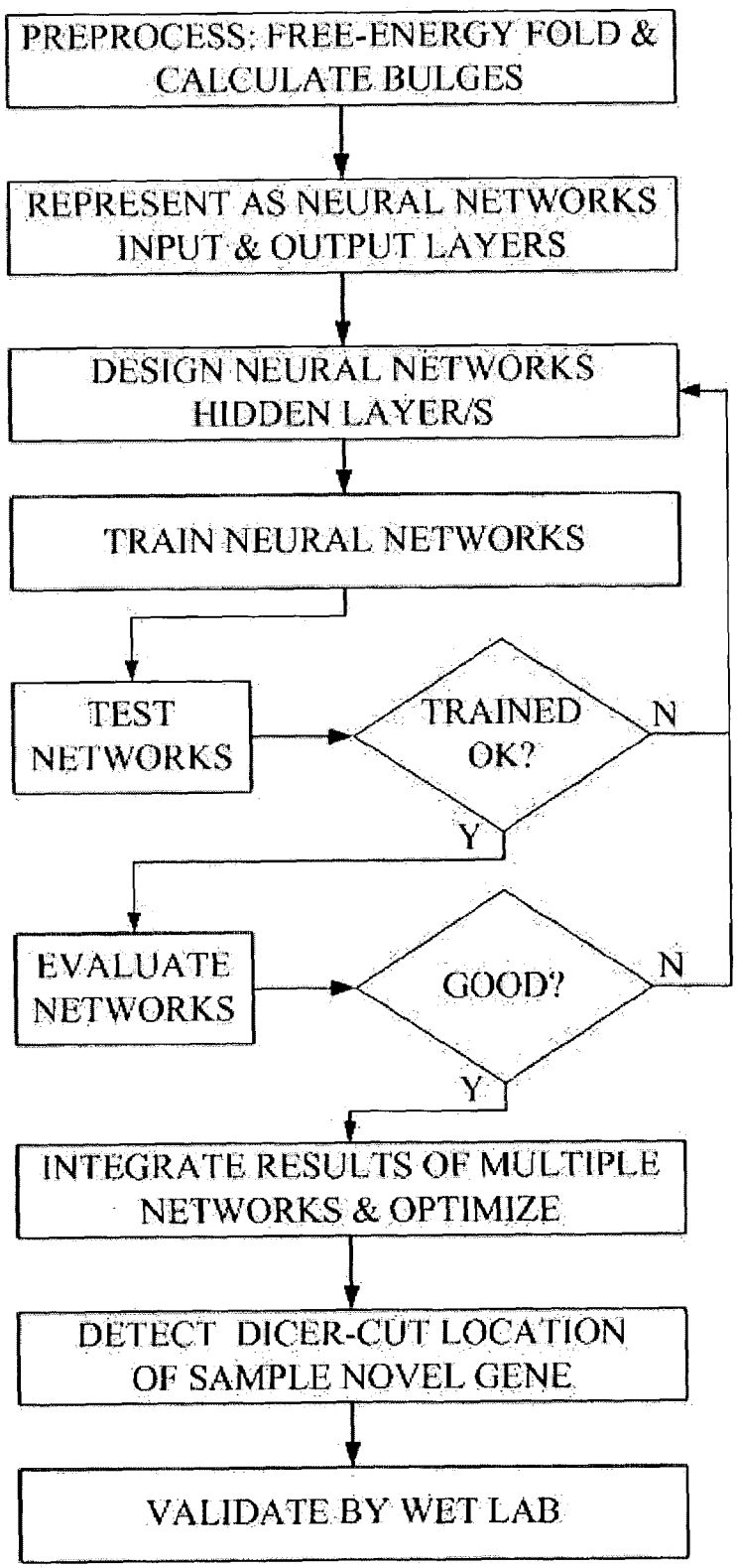
FIG. 13B is a simplified flowchart illustrating training of a dicer-cut location detector constructed and operative in accordance with a preferred embodiment of the present invention.

Reference is now made to FIG. 13B which is a simplified flowchart illustrating a preferred implementation of dicer-cut location detector training & validation 126 of FIG. 10. Dicer-cut location detector 116 first preprocesses known miRNA hairpins and their respective dicer-cut locations, so as to be able to properly analyze them and train the detection system accordingly.

The folding pattern is calculated for each known miRNA, preferably based on free-energy calculation, and the size of the hairpin, the size of the loop at the center of the hairpin, and 'bulges' (i.e. mismatched base-pairs) in the folded hairpin are noted.

The dicer-cut location, which is known for known miRNA genes, is noted relative to the above, as well as to the nucleotides in each location along the hairpin. Frequency of identity of nucleotides, and nucleotide-pairing, relative to their location in the hairpin, and relative to the known dicer-cut location in the known miRNA genes is analyzed and modeled.

Different techniques are well known in the art for analysis of existing pattern from a given 'training set' of species belonging to a genus, which techniques are then capable, to a certain degree, to detect similar patterns in other species not belonging to the training-set genus. Such techniques include, but are not limited to neural networks, Bayesian networks, Support Vector Machines (SVM), Genetic Algorithms, Markovian modeling, and others, as is well known in the art.

Using such techniques, preferably a combination of several of the above techniques, the known hairpins are represented as a several different networks (such as neural, Bayesian, or SVM) input and output layers. Both nucleotide, and 'bulge' (i.e. nucleotide pairing or mismatch) are represented for each position in the hairpin, at the input layer, and a corresponding true/false flag at each position, indicating whether it was diced by dicer at the output layer. Multiple networks are preferably used concurrently, and the results therefrom are integrated and further optimized. Markovian modeling may also be used to validate the results and enhance their accuracy. Finally, the bioinformatic detection of dicer-cut location of a sample novel is confirmed by wet-lab experimentation.

Figure 14A:
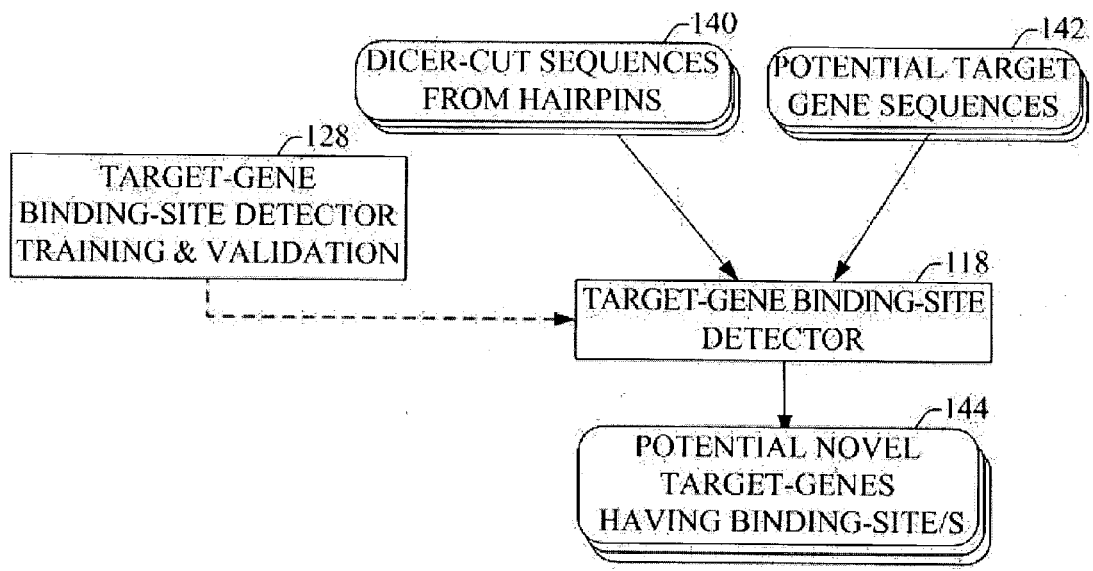
FIG. 14A is a simplified block diagram of a target-gene binding-site detector constructed and operative in accordance with a preferred embodiment of the present invention.

Reference is now made to FIG. 14A which is a simplified block diagram of a preferred implementation of the target-gene binding-site detector 118 described hereinabove with reference to FIG. 9. The goal of the target-gene binding-site detector 118 is to detect a BINDING SITE of FIG. 8, located in an untranslated region of the RNA of a known gene, the nucleotide sequence of which BINDING SITE is at least partially complementary to that of a GAM RNA of FIG. 8, thereby determining that the abovementioned known gene is a target gene of GAM of FIG. 8.

The target-gene binding-site detector 118 of FIG. 9 therefore receives as input a plurality of dicer-cut sequences from hairpins 140 of FIG. 13A which were calculated by the previous step, and a plurality of potential target gene sequences 142 which derive sequence DNA data 104 of FIG. 9, and after a phase of target-gene binding-site detector training & validation 128 of FIG. 10, is operative to detect target-genes having binding site/s 144 the nucleotide sequence of which is at least partially complementary to that of each of the plurality of dicer-cut sequences from hairpins 140. Preferred operation of the target-gene binding-site detector is further described hereinbelow with reference to FIG. 14B.

Figure 14B:
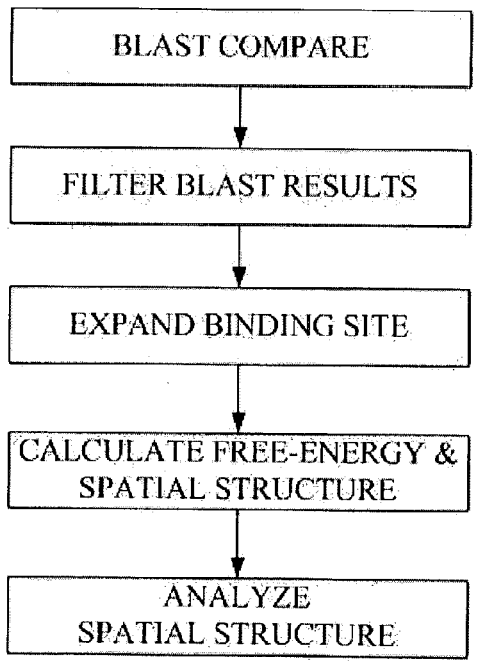
FIG. 14B is a simplified flowchart illustrating operation of a target-gene binding-site detector constructed and operative in accordance with a preferred embodiment of the present invention.

Reference is now made to FIG. 14B which is a simplified flowchart illustrating a preferred operation of the target-gene binding-site detector 118 of FIG. 9. In a preferred embodiment of the present invention, the target-gene binding-site detector 118 first performs a BLAST comparison of the nucleotide sequence of each of the plurality of dicer-cut sequences from hairpins 140, to the potential target gene sequences 142, in order to find crude potential matches. Blast results are then filtered to results which are similar to those of known binding sites (e.g. binding sites of miRNA genes Lin-4 and Let-7 to target genes Lin-14, Lin-41, Lin 28 etc.). Next the binding site is expanded, checking if nucleotide sequenced immediately adjacent to the binding site found by BLAST, may improve the match. Suitable binding sites, then are computed for free-energy and spatial structure. The results are analyzed, selecting only those binding sites, which have free-energy and spatial structure similar to that of known binding sites.

Figure 15:
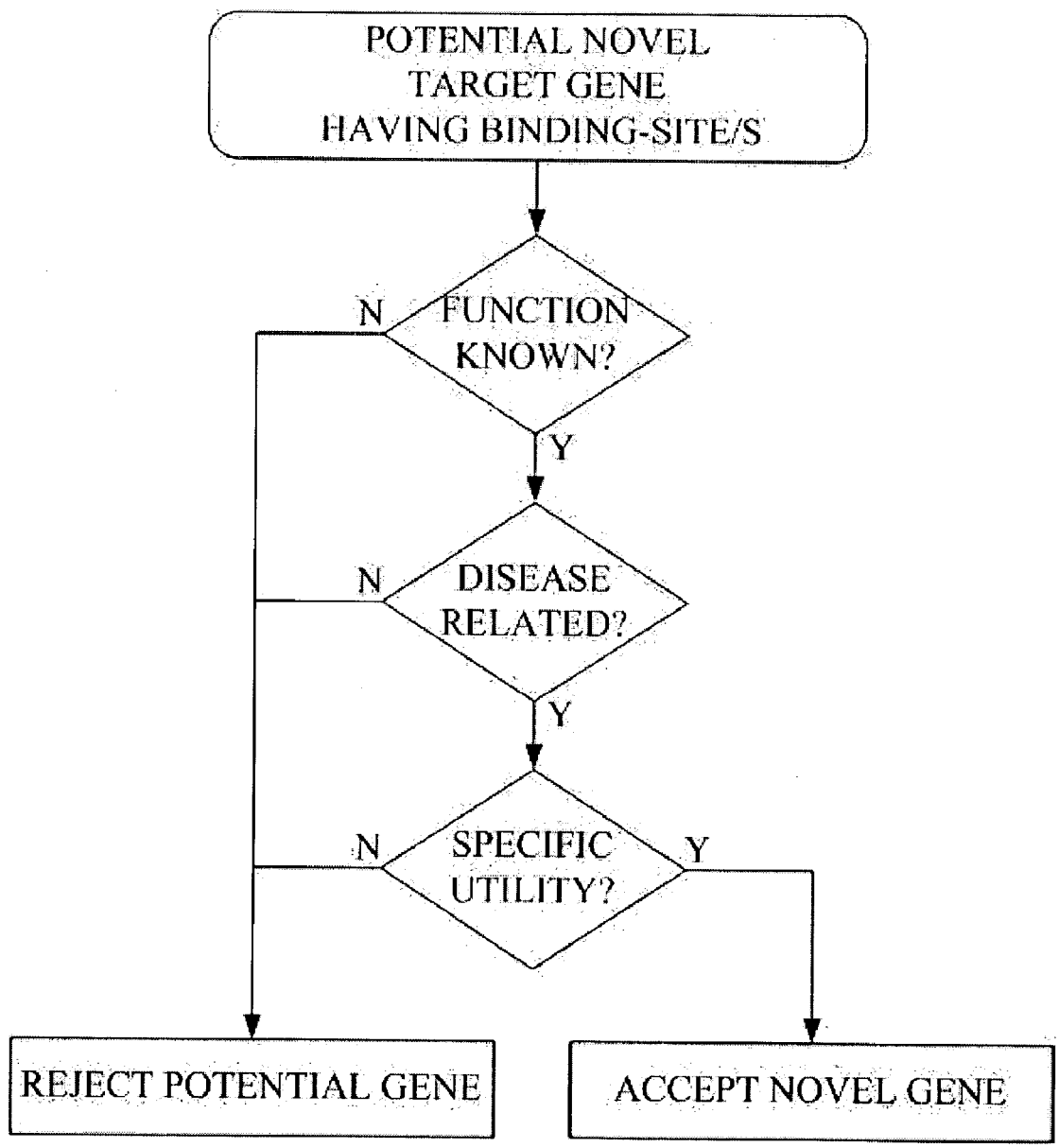
FIG. 15 is a simplified flowchart illustrating operation of a function & utility analyzer constructed and operative in accordance with a preferred embodiment of the present invention.

Reference is now made to FIG. 15 which is a simplified flowchart illustrating a preferred operation of the function & utility analyzer 120 described hereinabove with reference to FIG. 9. The goal of the function & utility analyzer 120 is to determine if a potential target gene is in fact a valid clinically useful target gene. Since a potential novel GAM gene binding a binding site in the UTR of a target gene is understood to inhibit expression of that target gene, and if that target gene is shown to have a valid clinical utility, then in such a case it follows that the potential novel gene itself also has a valid useful function—which is the opposite of that of the target gene.

The function & utility analyzer 120 preferably receives as input a plurality of potential novel target genes having binding-site/s 144, generated by the target-gene binding-site detector 118, both of FIG. 14A. Each potential gene, is evaluated as follows:

First the system first checks to see if the function of the potential target gene is scientifically well established. Preferably, this can be achieved bioinformatically by searching various published data sources presenting information on known function of proteins. Many such data sources exist and are published as is well known in the art.

Next, for those target genes the function of which is scientifically known and is well documented, the system then checks if scientific research data exists which links them to known diseases. For example, a preferred embodiment of the present invention utilizes the OMIM™ database published by NCBI, which summarizes research publications relating to genes which have been shown to be associated with diseases.

Finally, the specific possible utility of the target gene is evaluated. While this process too may be facilitated by bioinformatic means, it might require human evaluation of published scientific research regarding the target gene, in order to determine the utility of the target gene to the diagnosis and or treatment of specific disease. Only potential novel genes, the target-genes of which have passed all three examinations, are accepted as novel genes.

Figure 16:
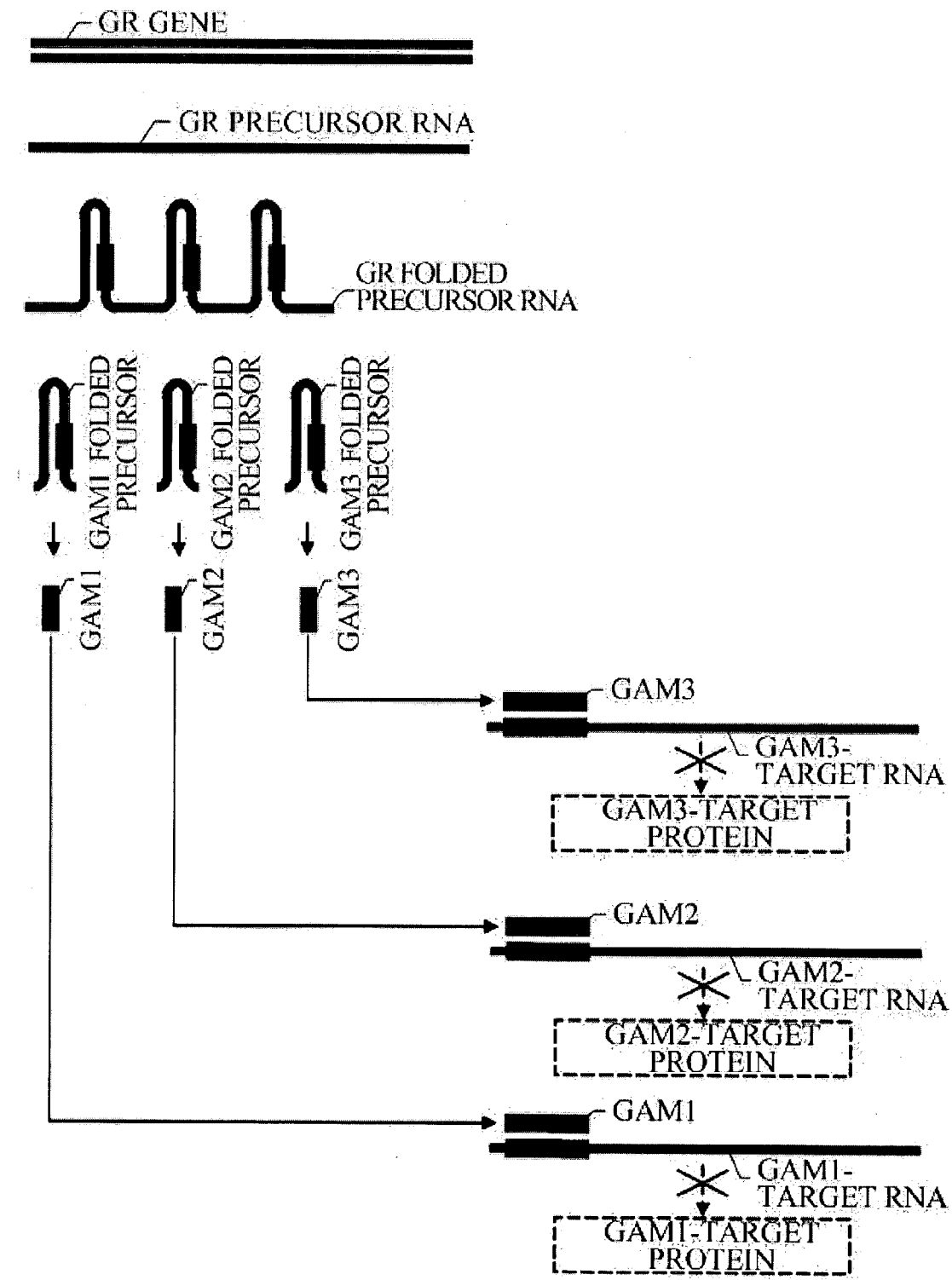
FIG. 16 is a simplified diagram describing a novel bioinformatically detected group of regulatory genes, referred to here as Genomic Record (GR) genes, each of which encodes an 'operon-like' cluster of novel miRNA-like genes, which in turn modulates expression of a plurality of target genes.

Reference is now made to FIG. 16, which is a simplified diagram describing a novel bioinformatically detected group of regulatory genes, referred to here as Genomic Record (GR) genes, that encode an 'operon-like' cluster of novel miRNA-like genes, each modulating expression of a plurality of target genes, the function and utility of which target genes is known.

GR GENE (Genomic Record Gene) is gene of a novel, bioinformatically detected group of regulatory, non protein coding, RNA genes. The method by which GR is detected is described hereinabove with reference to FIGS. 6-15.

GR GENE encodes an RNA molecule, typically several hundred nucleotides long, designated GR PRECURSOR RNA.

GR PRECURSOR RNA folds spatially, as illustrated by GR FOLDED PRECURSOR RNA, into a plurality of what is known in the art as 'hair-pin' structures. The nucleotide sequence of GR PRECURSOR RNA comprises a plurality of segments, the first half of each such segment having a nucleotide sequence which is at least a partial inversed-reversed sequence of the second half thereof, thereby causing formation of a plurality of 'hairpin' structures, as is well known in the art.

GR FOLDED PRECURSOR RNA is naturally processed by cellular enzymatic activity, into 3 separate hairpin shaped RNA segments, each corresponding to GAM PRECURSOR RNA of FIG. 8, designated GAM1 PRECURSOR, GAM2 PRECURSOR and GAM3 PRECURSOR respectively.

The above mentioned GAM precursors, are diced by Dicer of FIG. 8, yielding short RNA segments of about 22 nucleotides in length, each corresponding to GAM RNA of FIG. 8, designated GAM1, GAM2 and GAM3 respectively.

GAM1, GAM2 and GAM3 each bind complementarily to binding sites located in untranslated regions of respective target genes, designated GAM1-TARGET RNA, GAM2-TARGET RNA and GAM3-TARGET RNA respectively. This binding inhibits translation of the respective target proteins designated GAM1-TARGET PROTEIN, GAM2-TARGET PROTEIN and GAM3-TARGET PROTEIN respectively.

The structure of GAM genes comprised in a GR GENE, and their mode of modulation of expression of their respective target genes is described hereinabove with reference to FIG. 8. The bioinformatic approach to detection of GAM genes comprised in a GR GENE is described hereinabove with reference to FIGS. 9 through 15. The present invention discloses 147 novel genes of the GR group of genes, which have been detected bioinformatically, as described hereinbelow with reference to FIGS. 551 through 697. Laboratory confirmation of 3 genes of the GR group of genes is described hereinbelow with reference to FIGS. 21A through 23.

In summary, the current invention discloses a very large number of novel GR genes, each of which encodes a plurality of GAM genes, which in turn may modulate expression of a plurality of target proteins. It is appreciated therefore that the function of GR genes is in fact similar to that of the Genomic Records concept of the present invention addressing the differentiation enigma, described hereinabove with reference to FIG. 7.

Figure 17:
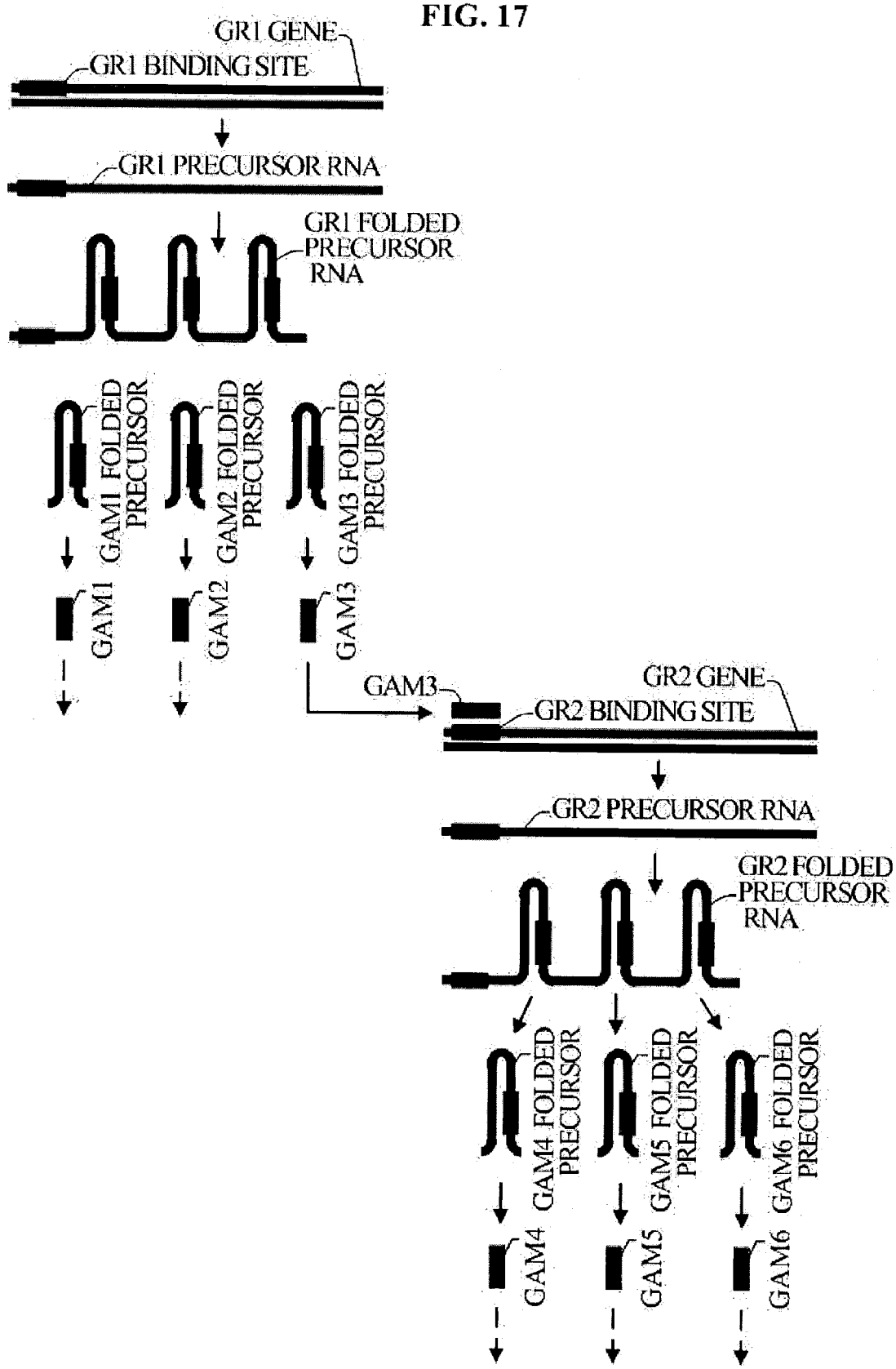
FIG. 17 is a simplified diagram illustrating a mode by which genes of a novel group of operon-like genes of the present invention, modulate expression of other such genes, in a cascading manner.

Reference is now made to FIG. 17 which is a simplified diagram illustrating a mode by which genes of a novel group of operon-like genes, described hereinabove with reference to FIG. 16 of the present invention, modulate expression of other such genes, in a cascading manner.

GR1 GENE and GR2 GENE are two genes of the novel group of operon-like genes designated GR of FIG. 16. As is typical of genes of the GR group of genes, GR1 and GR2 each encode a long RNA precursor, which in turn folds into a folded RNA precursor comprising multiple hairpin shapes, and is cut into respective separate hairpin shaped RNA segments, each of which RNA segments being diced to yield a gene of a group of genes designated GAM of FIG. 8. In this manner GR1 yields GAM1, GAM2 and GAM3, and GR2 yields GAM4, GAM5 and GAM6.

As FIG. 17 shows, GAM 3 which derives from GR1, binds a binding site located adjacent to GR2 GENE, thus modulating expression of GR2, thereby invoking expression of GAM4, GAM5 and GAM6 which derive from GR2.

It is appreciated that the mode of modulation of expression presented by FIG. 17 enables an unlimited 'cascading effect' in which a GR gene comprises multiple GAM genes, each of which may modulate expression of other GR genes, each such GR gene comprising additional GAM genes, etc., whereby eventually certain GAM genes modulate expression of target proteins. This mechanism is in accord with the conceptual model of the present invention addressing the differentiation enigma, described hereinabove with specific reference to FIGS. 6 and 7.

Figure 18:
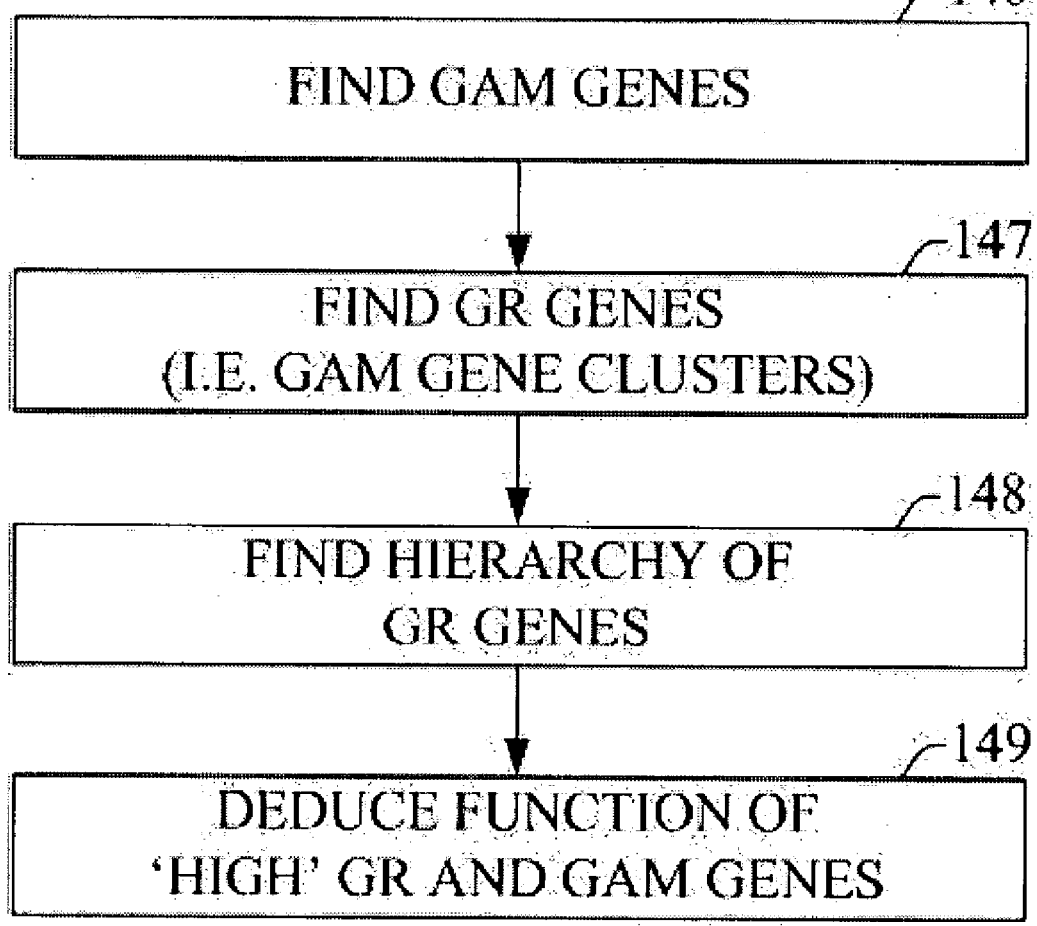
FIG. 18 is a block diagram illustrating an overview of a methodology for finding novel genes and operons of the present invention, and their respective functions.

Reference is now made to FIG. 18 which is a block diagram illustrating an overview of a methodology for finding novel genes and operon-like genes of the present invention, and their respective functions.

According to a preferred embodiment of the present invention, the methodology to finding novel genes of the present invention and their function comprises of the following major steps:

First, genes of the novel group of genes of the present invention, referred to here as GAM genes, are located and their function elicited by detecting target proteins they bind and the function of those target proteins, as described hereinabove with reference to FIGS. 9 through 15.

Next, genes of a novel group of operon-like genes of the present invention, referred to here as GR genes, are located, by locating clusters of proximally located GAM genes, based on the previous step.

Consequently, the hierarchy of GR and GAM genes is elicited: binding sites for non-protein-binding GAM genes comprised in each GR gene found are sought adjacent to other GR genes. When found, such a binding site indicates that the connection between the GAM and the GR the expression of which it modulates, and thus the hierarchy of the GR genes and the GAM genes they comprise.

Lastly, the function of GR genes and GAM genes which are 'high' in the hierarchy, i.e. GAM genes which modulate expression of other GR genes rather than directly modulating expression of target proteins, may be deduced. A preferred approach is as follows: The function of protein-modulating GAM genes is deducible from the proteins which they modulate, provided that the function of these target proteins is known. The function of 'higher' GAM genes may be deduced by comparing the function of protein-modulating GAM genes, with the hierarchical relationships by which the 'higher' GAM genes are connected to the protein-modulating GAM genes. For example, given a group of several protein-modulating GAM genes, which collectively cause a protein expression pattern typical of a certain cell-type, then a 'higher' GAM gene is sought which modulates expression of GR genes which perhaps modulate expression of other genes which eventually modulate expression of the given group of protein-modulating GAM genes. The 'higher' GAM gene found in this manner is taken to be responsible for differentiation of that cell-type, as per the conceptual model of the invention described hereinabove with reference to FIG. 6.

Figure 19:
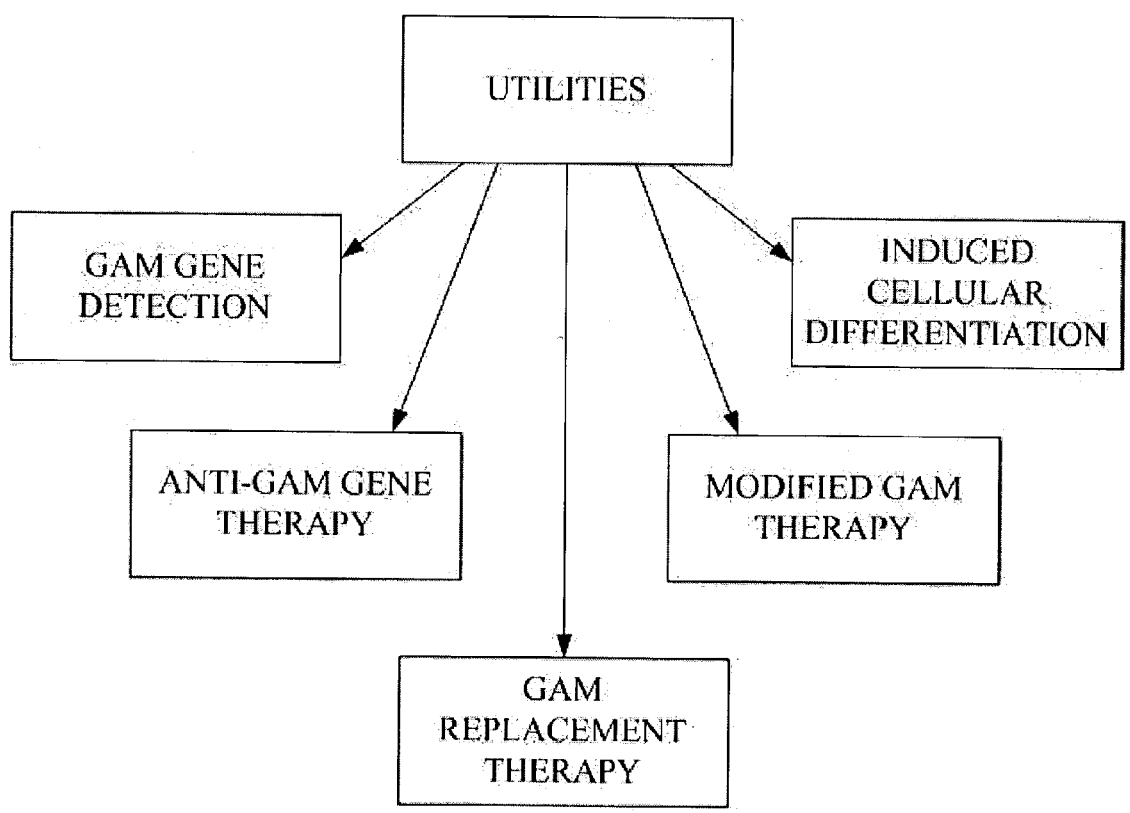
FIG. 19 is a block diagram illustrating different utilities of genes of a novel group of genes, and operons of a novel group of operons, both of the present invention.

Reference is now made to FIG. 19 which is a block diagram illustrating different utilities of genes of the novel group of genes of the present invention referred to here as GAM genes and GR genes.

The present invention discloses a first plurality of novel genes referred to here as GAM genes, and a second plurality of operon-like genes referred to here as GR genes, each of the GR genes encoding a plurality of GAM genes. The present invention further discloses a very large number of known target-genes, which are bound by, and the expression of which is modulated by each of the novel genes of the present invention. Published scientific data referenced by the present invention provides specific, substantial and credible evidence that the abovementioned target genes modulated by novel genes of the present invention, are associated with various diseases. Specific novel genes of the present invention, target genes thereof and diseases associated therewith, are described hereinbelow with reference to FIGS. 24 through 27260. It is therefore appreciated that a function of GAM genes and GR genes of the present invention is modulation of expression of target genes related to known diseases, and that therefore utilities of novel genes of the present invention include diagnosis and treatment of the abovementioned diseases. FIG. 19 describes various types of diagnostic and therapeutic utilities of novel genes of the present invention.

A utility of novel genes of the present invention is detection of GAM genes and of GR genes. It is appreciated that since GAM genes and GR genes modulate expression of disease related target genes, that detection of expression of GAM genes in clinical scenarios associated with said diseases is a specific, substantial and credible utility. Diagnosis of novel genes of the present invention may preferably be implemented by RNA expression detection techniques, including but not limited to biochips, as is well known in the art. Diagnosis of expression of genes of the present invention may be useful for research purposes, in order to further understand the connection between the novel genes of the present invention and the abovementioned related diseases, for disease diagnosis and prevention purposes, and for monitoring disease progress.

Another utility of novel genes of the present invention is anti-GAM gene therapy, a mode of therapy which allows up regulation of a disease related target-gene of a novel GAM gene of the present invention, by lowering levels of the novel GAM gene which naturally inhibits expression of that target gene. This mode of therapy is particularly useful with respect to target genes which have been shown to be under-expressed in association with a specific disease. Anti-GAM gene therapy is further discussed hereinbelow with reference to FIGS. 20A and 20B.

A further utility of novel genes of the present invention is GAM replacement therapy, a mode of therapy which achieves down regulation of a disease related target-gene of a novel GAM gene of the present invention, by raising levels of the GAM gene which naturally inhibits expression of that target gene. This mode of therapy is particularly useful with respect to target genes which have been shown to be over-expressed in association with a specific disease. GAM replacement therapy involves introduction of supplementary GAM gene products into a cell, or stimulation of a cell to produce excess GAM gene products. GAM replacement therapy may preferably be achieved by transfecting cells with an artificial DNA molecule encoding a GAM gene, which causes the cells to produce the GAM gene product, as is well known in the art.

Yet a further utility of novel genes of the present invention is modified GAM therapy. Disease conditions are likely to exist, in which a mutation in a binding site of a GAM gene prevents natural GAM gene to effectively bind inhibit a disease related target-gene, causing up regulation of that target gene, and thereby contributing to the disease pathology. In such conditions, a modified GAM gene is designed which effectively binds the mutated GAM binding site, i.e. is an effective anti-sense of the mutated GAM binding site, and is introduced in disease effected cells. Modified GAM therapy is preferably achieved by transfecting cells with an artificial DNA molecule encoding the modified GAM gene, which causes the cells to produce the modified GAM gene product, as is well known in the art.

An additional utility of novel genes of the present invention is induced cellular differentiation therapy. As aspect of the present invention is finding genes which determine cellular differentiation, as described hereinabove with reference to FIG. 18. Induced cellular differentiation therapy comprises transfection of cell with such GAM genes thereby determining their differentiation as desired. It is appreciated that this approach may be widely applicable, inter alia as a means for auto transplantation—harvesting cells of one cell-type from a patient, modifying their differentiation as desired, and then transplanting them back into the patient. It is further appreciated that this approach may also be utilized to modify cell differentiation in vivo, by transfecting cells in a genetically diseased tissue with a cell-differentiation determining GAM gene, thus stimulating these cells to differentiate appropriately.

Figure 20A:
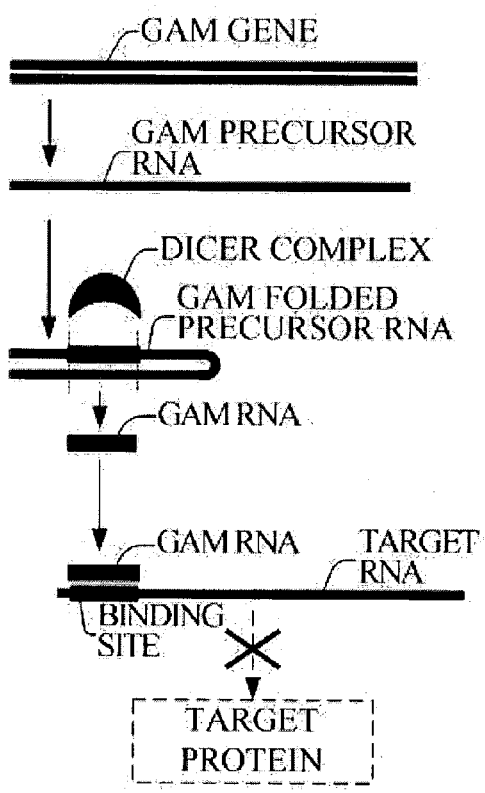
FIGS. 20A and 20B are simplified diagrams, which when taken together illustrate a mode of gene therapy applicable to genes of the novel group of genes of the present invention.
Figure 20B:
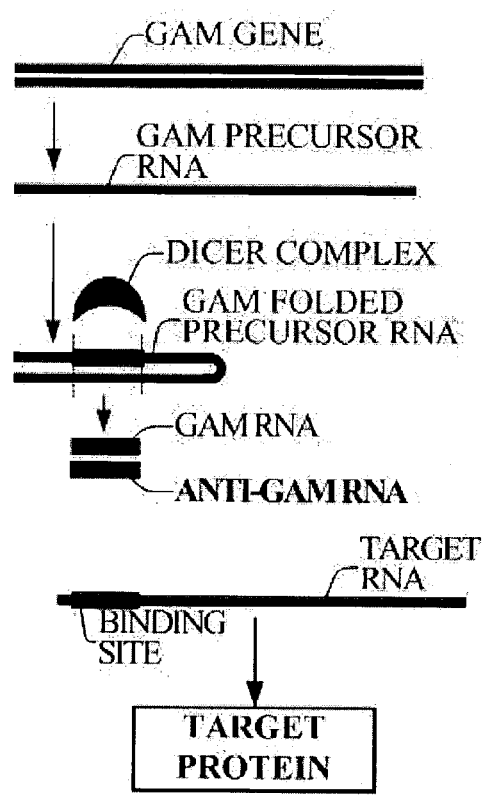

Reference is now made to FIGS. 20A and 20B, simplified diagrams which when taken together illustrate anti-GAM gene therapy mentioned hereinabove with reference to FIG. 19. A utility of novel genes of the present invention is anti-GAM gene therapy, a mode of therapy which allows up regulation of a disease related target-gene of a novel GAM gene of the present invention, by lowering levels of the novel GAM gene which naturally inhibits expression of that target gene. FIG. 20A shows a normal GAM gene, inhibiting translation of a target gene of GAM gene, by binding to a BINDING SITE found in an untranslated region of TARGET RNA, as described hereinabove with reference to FIG. 8.

FIG. 20B shows an example of anti-GAM gene therapy. ANTI-GAM RNA is short artificial RNA molecule the sequence of which is an anti-sense of GAM RNA. Anti-GAM treatment comprises transfecting diseased cells with ANTI-GAM RNA, or with a DNA encoding thereof. The ANTI-GAM RNA binds the natural GAM RNA, thereby preventing binding of natural GAM RNA to its BINDING SITE. This prevents natural translation inhibition of TARGET RNA by GAM RNA, thereby up regulating expression of TARGET PROTEIN.

It is appreciated that anti-GAM gene therapy is particularly useful with respect to target genes which have been shown to be under-expressed in association with a specific disease.

Reference is now made to FIG. 21A which is an annotated sequence of an EST comprising a novel gene detected by the gene detection system of the present invention. FIG. 21A shows the nucleotide sequence of a known human non-protein coding EST (Expressed Sequence Tag), identified as EST72223. It is appreciated that the sequence of this EST comprises sequences of one known miRNA gene, identified as MIR98, and of one novel GAM gene, referred to here as GAM24, detected by the bioinformatic gene detection system of the present invention, described hereinabove with reference to FIG. 9.

Reference is now made to FIGS. 21B and 21C that are pictures of laboratory results, which when taken together demonstrate laboratory confirmation of expression of the bioinformatically detected novel gene of FIG. 21A. Reference is now made to FIG. 21B which is a Northern blot analysis of MIR-98 and EST72223 transcripts. MIR-98 and EST72223 were reacted with MIR-98 and GAM24 probes as indicated in the figure. It is appreciated that the probes of both MIR-98 and GAM24 reacted with EST72223, indicating that EST72223 contains the sequences of MIR-98 and of GAM24. It is further appreciated that the probe of GAM24 does not cross-react with MIR-98.

Reference is now made to FIG. 21C. A Northern blot analysis of EST72223 and MIR-98 transfections were performed, subsequently marking RNA by the MIR-98 and GAM24 probes. Left, Northern reacted with MIR-98, Right, Northern reacted with GAM24. The molecular Sizes of EST72223, MIR-98 and GAM24 are indicated by arrows. Hela are control cells that have not been introduced to exogenous RNA. EST and MIR-98 Transfections are RNA obtained from Hela transfected with EST72223 and MIR-98, respectively. MIR-98 and EST are the transcripts used for the transfection experiment. The results indicate that EST72223, when transfected into Hela cells, is cut yielding known miRNA gene MIR-98 and novel miRNA gene GAM24.

Reference is now made to FIG. 21D, which is a Northern blot of a lisate experiment with MIR-98 and GAM24. Northern blot analysis of hairpins in EST72223. Left, Northern reacted with predicted Mir-98 hairpin probe. Right, Northern reacted with predicted GAM24 hairpin probe. The molecular size of EST is indicated by arrow. The molecular sizes of Mir-98 and GAM24 are 80 nt and 100 nt, respectively as indicated by arrows. The 22 nt molecular marker is indicated by arrow. 1-Hela lysate; 2-EST incubated 4 h with Hela lysate; 3-EST without lysate; 4-Mir transcript incubated 4 h with Hela lysate; 5-Mir transcript incubated overnight with Hela lysate; 6-Mir transcript without lysate; 7-RNA extracted from Hela cells following transfection with Mir transcript.

Technical methods used in experiments, the results of which are depicted in FIGS. 21B, 21C and 21D are as follows:

Transcript preparations: Digoxigenin (DIG) labeled transcripts were prepared from EST72223 (TIGER), MIR98 and predicted precursor hairpins by using a DIG RNA labeling kit (Roche Molecular Biochemicals) according to the manufacture's protocol. Briefly, PCR products with T7 promoter at the 5' end or T3 promoter at the 3'end were prepared from each DNA in order to use it as a template to prepare sense and antisense transcripts, respectively.

MIR-98 was amplified using EST72223 as a template with T7 miR98 forward primer:
5-'TAATACGACTCACTATAGGGTGAGGTAG-TAAGTTGTATTGTT-3' (SEQ ID NO: 1388406) and T3miR98 reverse primer:
5'-AATTAACCCTCACTAAAGGGAAAGTAG-TAAGTTGTATAGTT-3' (SEQ ID NO: 1388407) EST72223 was amplified with T7-EST 72223 forward primer:
5'-TAATACGACTCACTATAGGCCCTTATTA-GAGGATTCTGCT-3' (SEQ ID NO: 1388408) and T3-EST72223 reverse primer:
5'-AATTAACCCTCACTAAAG-GTTTTTTTTTCCTGAGACAGAGT-3'
(SEQ ID NO: 1388409) Bet-4 was amplified using EST72223 as a template with Bet-4 forward primer: 5'-GAGGCAGGAGAATTGCTTGA-3' (SEQ ID NO: 1388410) and T3-EST7223 reverse primer:
5'-AATTAACCCTCACTAAAGGCCTGAGACA-GAGTCTTGCTC-3' (SEQ ID NO: 1388411)

The PCR products were cleaned and used for DIG-labeled or unlabeled transcription reactions with the appropriate polymerase. For transfection experiments, CAP reaction was performed by using a mMassage mMachine kit (Ambion).

Transfection procedure: Transfection of Hela cells was performed by using TransMessenger reagent (Qiagen) according to the manufacture's protocol. Briefly, Hela cells were seeded to 1-2×10^6 cells per plate a day before transfection. Two μg RNA transcripts were mixed with 8 μl Enhancer in a final volume of 100 μl, mixed and incubated at room temperature for 5 min. 16 μl TransMessenger reagent was added to the RNA-Enhancer, mixed and incubated for additional 10 min. Cell plates were washed with sterile PBS twice and then incubated with the transfection mix with 2.5 ml DMEM medium without serum. Cells were incubated with transfection mix for three hours under their normal growth condition (370 C and 5% CO2) before the transfection mix was removed and a fresh DMEM medium containing serum was added to the cells. Cells were left to grow 48 hours before harvesting.

Target RNA cleavage assay: Cap-labeled target RNAs were generated using mMessage mMachine™ (Ambion). Caped RNA transcripts were preincubated at 30° C. for 15 min in supplemented Hela S100 obtained from Computer Cell Culture, Mos, Belgium. After addition of all components, final concentrations were 100 mM target RNA, 1 m M ATP, 0.2 mM GTP, 10 U/ml RNasin, 30 μg/ml creatine kinase, 25 mM creatine phosphate, and 50% S100 extract. Incubation was continued for 4 hours to overnight. Cleavage reaction was stopped by the addition of 8 volumes of proteinase K buffer (200 Mm Tris-Hcl, pH 7.5, 25 m M EDTA, 300 mM NaCl, and 2% SDS). Proteinase K, dissolved in 50 mM Tris-HCl, pH 8, 5 m M CaCl2, and 50% glycerol, was added to a final concentration of 0.6 mg/ml. Sample were subjected to phenol/chloroform extraction and kept frozen until analyzed by urea-TBE PAGE.

Northern analysis: RNAs were extracted from cells by using Tri-reagent according to the manufacture's protocol. The RNAs were dissolved in water and heated to 650 C to disrupt any association of the 25 nt RNA with larger RNA molecules. RNA were placed on ice and incubated for 30 min with PEG (MW=8000) in a final concentration of 5% and NaCl in a final concentration of 0.5M to precipitate high molecular weight nucleic acid. The RNAs were centrifuged at 10,000×g for 10 min to pellet the high molecular weight nucleic acid. The supernatant containing the low molecular weight RNAs was collected and three volumes of ethanol was added. The RNAs were placed at −200 C for at least two hours and then centrifuged at 10,000×g for 10 min. The pellets were dissolved in Urea-TBE buffer (1Xtbe, 7M urea) for further analysis by a Northern blot.

RNA samples were boiled for 5 min before loading on 15%-8% polyacrylamide (19:1) gels containing 7M urea and 1×TBE. Gels were run in 1×TBE at a constant voltage of 300V and then transferred into a nylon membrane. The membrane was exposed to 3 min ultraviolet light to cross link the RNAs to the membrane. Hybridization was performed overnight with DIG-labeled probes at 420 C. Membranes were washed twice with SSC×2 and 0.2% SDS for 10 min. at 420 C and then washed twice with SSC×0.5 for 5 min at room temperature. The membrane was then developed by using a DIG luminescent detection kit (Roche) using anti DIG and CSPD reaction, according to the manufacture's protocol.

It is appreciated that the data presented in FIGS. 21B, 21C and 21D, when taken together validate the function of the bioinformatic gene detection engine 100 of FIG. 9. FIG. 21A shows a novel GAM gene bioinformatically detected by the bioinformatic gene detection engine 100, and FIGS. 21B, 21C and 21D show laboratory confirmation of the expression of this novel gene. This is in accord with the engine training and validation methodology described hereinabove with reference to FIG. 10.

Reference is now made to FIG. 22A which is an annotated sequence of an EST comprising a novel gene detected by the gene detection system of the present invention. FIG. 22A shows the nucleotide sequence of a known human non-protein coding EST (Expressed Sequence Tag), identified as EST 7929020. It is appreciated that the sequence of this EST comprises sequences of two novel GAM genes, referred to here as GAM23 and GAM25, detected by the bioinformatic gene detection system of the present invention, described hereinabove with reference to FIG. 9.

Reference is now made to FIG. 22B which presents pictures of laboratory results that demonstrate laboratory confirmation of expression of the bioinformatically detected novel gene of FIG. 22A. Northern blot analysis of hairpins in EST7929020. Left, Northern reacted with predicted GAM25 hairpin probe, Right, Northern reacted with predicted GAM23 hairpin probe. The molecular size of EST is indicated by arrow. The molecular sizes of GAM23 and GAM25 are 60 nt, as indicated by arrow. The 22 nt molecular marker is indicated by arrow. 1-Hela lysate; 2-EST incubated 4 h with Hela lysate; 3-EST incubated overnight with Hela lysate; 4-EST without lysate; 5-GAM transcript; 6-GAM 22 nt marker; 7-GAM PCR probe; 8-RNA from control Hela cells; 9-RNA extracted from Hela cells following transfection with EST.

Figure 22C:
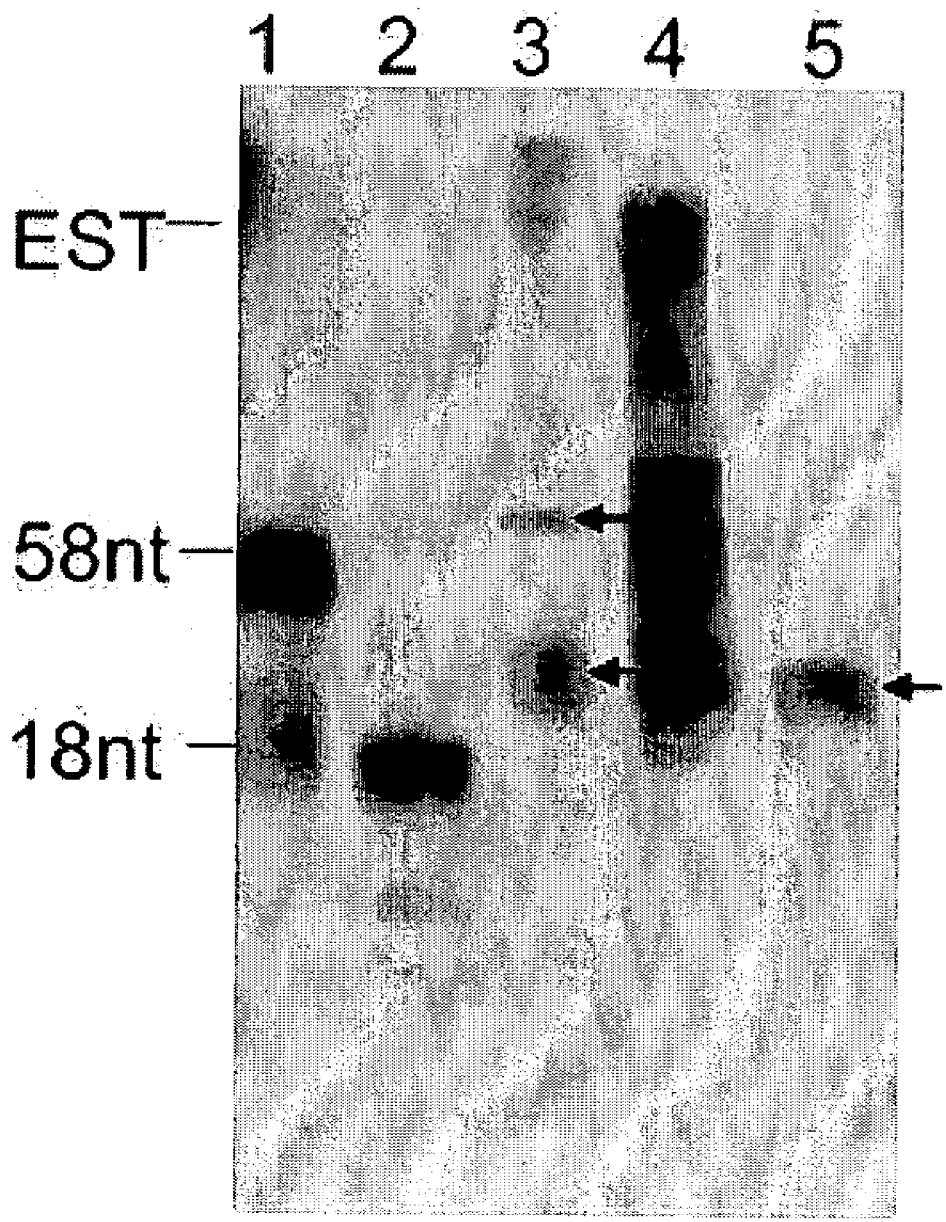
FIG. 22C is a picture of laboratory results, which confirm endogenous expression of bioinformatically detected novel gene GAM25 of FIG. 22A.

Reference is now made to FIG. 22C which is a picture of a Northern blot confirming Endogenous expression of bio-informatically detected gene GAM25 of FIG. 22A from in Hela cells. Northern was reacted with a predicted GAM25 hairpin probe. The molecular size of EST7929020 is indicated. The molecular sizes of GAM25 are 58 nt, as indicated. A 19 nt DNA oligo molecular marker is indicated. Endogenous expression of GAM25 in Hela total RNA fraction and in S-100 fraction is indicated by arrows. 1-GAM25 transcript; 2-GAM25 DNA oligo marker; 3-RNA from control Hela cells; 4-RNA extracted from Hela cells following transfection with EST; 5-RNA extracted from S-100 Hela lysate.

Reference is now made to FIG. 23A which is an annotated sequence of an EST comprising a novel gene detected by the gene detection system of the present invention. FIG. 23A shows the nucleotide sequence of a known human non-protein coding EST (Expressed Sequence Tag), identified as EST 1388749. It is appreciated that the sequence of this EST comprises sequence of a novel GAM gene, referred to here as GAM26, detected by the bioinformatic gene detection system of the present invention, described hereinabove with reference to FIG. 9.

Reference is now made to FIG. 23B which is a picture of Northern blot analysis, confirming expression of novel bioinformatically detected gene GAM26, and natural processing thereof from EST1388749. Northern reacted with predicted GAM26 hairpin probe. The molecular size of EST is indicated by arrow. The molecular sizes of GAM26 are 130 nt, as indicated by arrow. The 22 nt molecular marker is indicated by arrow. 1-Hela lysate; 2-EST incubated 4 h with Hela lysate; 3-EST incubated overnight with Hela lysate; 4-EST without lysate; 5-GAM transcript; 6-GAM 22 nt marker; 7-GAM PCR probe.

Figures 24A, 24B, 24C:
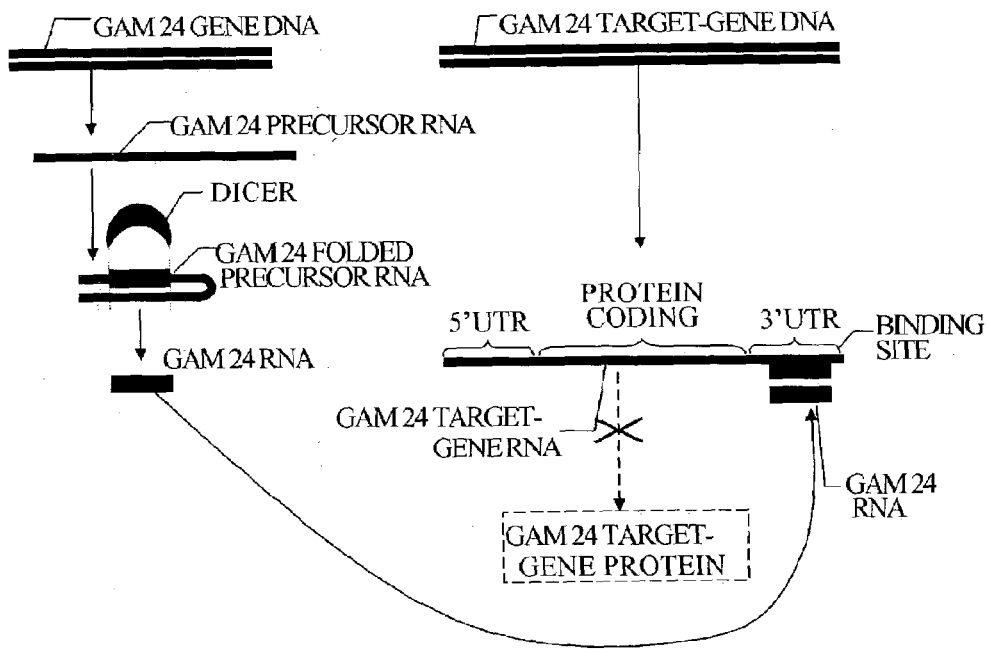

Reference is now made to FIG. 24A, which is a simplified diagram providing a conceptual explanation of the mode by which a novel bioinformatically detected gene, referred to here as GAM24 modulates expression of target genes thereof, the function and utility of which target genes is known in the art.

GAM24 (Genomic Address Messenger 24) is a novel bioinformatically detected regulatory, non protein coding, micro RNA (miRNA) gene. The method by which GAM24 was detected is described hereinabove with reference to FIGS. 6-15.

GAM24 GENE and GAM24-TARGET GENE are two human genes contained in the human genome.

GAM24 GENE encodes a GAM24 PRECURSOR RNA. Similar to other miRNA genes, and unlike most ordinary genes, the RNA transcribed by GAM24, GAM24 PRECURSOR RNA, does not encode a protein.

GAM24 PRECURSOR RNA folds onto itself, forming GAM24 FOLDED PRECURSOR RNA. As FIG. 24 illustrates, GAM24 FOLDED PRECURSOR RNA forms a 'hairpin structure', folding onto itself. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof, By "inversed-reversed" is meant a sequence which is reversed and wherein each nucleotide is replaced by a complimentary nucleotide, as is well known in the art (e.g. ATGGC is the inversed-reversed sequence of GCCAT).

An enzyme complex designated DICER COMPLEX, 'dices' the GAM24 FOLDED PRECURSOR RNA into a single stranded ~22 nt long RNA segment, designated GAM24 RNA. As is known in the art, 'dicing' of a hairpin structured RNA precursor product into short a ~22 nt RNA segment is catalyzed by an enzyme complex comprising an enzyme called Dicer together with other necessary proteins.

GAM24-TARGET GENE encodes a corresponding messenger RNA, designated GAM24-TARGET RNA. GAM24-TARGET RNA comprises three regions, as is typical of mRNA of a protein coding gene: a 5' untranslated region, a protein coding region and a 3' untranslated region, designated 5'UTR, PROTEIN CODING and 3'UTR respectively.

GAM24 RNA binds complimentarily to a BINDING SITE, located on an untranslated region of GAM24-TARGET RNA. This complimentarily binding is due to the fact that the nucleotide sequence of GAM24 RNA is an accurate or a partial inversed-reversed sequence of the nucleotide sequence of BINDING SITE. It is appreciated that while FIG. 24A depicts the BINDING SITE on the 3'UTR region, this is meant as an example only—the BINDING SITE may be located on the 5'UTR region as well.

The complimentary binding of GAM24 RNA to BINDING SITE inhibits translation of GAM24-TARGET RNA into GAM24-TARGET PROTEIN GAM24-TARGET PROTEIN is therefore outlined by a broken line.

It is appreciated that GAM24-TARGET GENE in fact represents a plurality of target genes of GAM24. The mRNA of each of this plurality of target genes of GAM24 comprises a BINDING SITE, having a nucleotide sequence which is at least partly complementary to GAM24 RNA, and which when bound by GAM24 RNA causes inhibition of translation one of a plurality of target proteins of GAM24. The plurality of target genes of GAM24 and their respective binding sites are described hereinbelow with reference to FIG. 24D.

It is appreciated by one skilled in the art that the mode of translational inhibition illustrated by FIG. 24 with specific reference to translational inhibition exerted by GAM24 on one or more target genes of GAM24 is in fact common to other known miRNA genes. As mentioned hereinabove with reference to the background section, although a specific complimentary binding site has been demons only for miRNA genes Lin-4 and Let-7, all other recently discovered miRNA genes are also believed by those skilled in the art to modulate expression of other genes by complimentary binding, although specific complimentary binding sites of these genes have not yet been found (Ruvkun G., 'Perspective: Glimpses of a tiny RNA world', Science 294, 779 (2001)).

Reference is now made to FIG. 24B which shows the nucleotide sequence of GAM24 PRECURSOR RNA of FIG. 24A, designated SEQ ID:1, and a probable nucleotide sequence of GAM24 RNA of FIG. 24A, designated SEQ ID:20602. The nucleotide sequence of SEQ ID:20602, which is highly likely (over 0.878955%) to be identical or highly similar to that of GAM24, is marked by an underline within the sequence of GAM24 PRECURSOR RNA.

Reference is now made to FIG. 24C, which shows the secondary folding of GAM24 PRECURSOR RNA, forming a 'hairpin structure' designated GAM24 FOLDED PRECURSOR RNA, both of FIG. 24A. A probable (>0.878955%) nucleotide sequence of GAM24 RNA, designated SEQ ID:20602 of FIG. 24B, is marked by an underline on GAM24 FOLDED PRECURSOR RNA. It is appreciated that the complimentary base-paring is not perfect, with 'bulges', as is well known in the art with respect to the RNA folding of all known miRNA genes.

Reference is now made to FIG. 24D, which is a table showing binding sites found in untranslated regions of a plurality of target genes of GAM24, each binding site corresponding to BINDING SITE of FIG. 24A, and their complementarity to SEQ ID:20602, which is highly likely (>0.878955%) to be identical or highly similar to the nucleotide sequence of GAM24 RNA of FIG. 24A.

It is appreciated that the functions, and accordingly the utilities, of GAM24 correlate with, and may be deduced from, the identity of the target genes which GAM24 binds and inhibits, and the function of these target genes, as elaborated hereinbelow.

Reference is now made to DCLRE1A BINDING SITE. DCLRE1A is a target gene of GAM24, corresponding to GAM24-TARGET GENE of FIG. 24A. DCLRE1A BINDING SITE is a binding site found in an untranslated region of DCLRE1A, corresponding to BINDING SITE of FIG. 24A. FIG. 24D illustrates the complementarity of the nucleotide sequence of DCLRE1A BINDING SITE, designated SEQ ID:507529, to the nucleotide sequence of GAM24 RNA of FIG. 24A, designated SEQ ID:20602 a function of GAM24 is therefore inhibition of (DCLRE1A). Accordingly, utilities of GAM24 include diagnosis and treatment diseases and clinical conditions with which DCLRE1A is associated.

Reference is now made to DKFZP586I2223 BINDING SITE. DKFZP586I2223 is a target gene of GAM24, corresponding to GAM24-TARGET GENE of FIG. 24A. DKFZP586I2223 BINDING SITE is a binding site found in an untranslated region of DKFZP586I223, corresponding to BINDING SITE of FIG. 24A. FIG. 24D illustrates the complementarity of the nucleotide sequence of DKFZP586I2223 BINDING SITE, designated SEQ ID:534456, to the nucleotide sequence of GAM25 RNA of FIG. 24A, designated SEQ ID:20602. Yet another function of GAM24 is therefore inhibition of (DKFZP586I2223). Accordingly, utilities of GAM24 include diagnosis and treatment of diseases and clinical conditions with which DKFZP586I2223 is associated.

Reference is now made to FLJ13725 BINDING SITE. FLJ13725 is a target gene of GAM24, corresponding to GAM24-TARGET GENE of FIG. 24A. FLJ13725 BINDING SITE is a binding site found in an untranslated region of FLJ13725, corresponding to BINDING SITE of FIG. 24A. FIG. 24D illustrates the complementarity of the nucleotide sequence of FLJ13725 BINDING SITE, designated SEQ ID:604594, to the nucleotide sequence of GAM24 RNA of FIG. 24A, designated SEQ ID:20602. An additional function of GAM24 is therefore inhibition of (FLJ13725). Accordingly, utilities of GAM24 include diagnosis and treatment of diseases and clinical conditions with which FLJ13725 is associated.

Reference is now made to PASK BINDING SITE. PASK is a target gene of GAM24, corresponding to GAM24-TARGET GENE of FIG. 24A. PASK BINDING SITE is a binding site found in an untranslated region of PASK, corresponding to BINDING SITE of FIG. 24A. FIG. 24D illustrates the complementarity of the nucleotide sequence of PASK BINDING SITE, designated SEQ ID:907327, to the nucleotide sequence of GAM24 RNA of FIG. 24A, designated SEQ ID:20602. A further function of GAM24 is therefore inhibition of (PASK). Accordingly, utilities of GAM24 include diagnosis and treatment of diseases and clinical conditions with which PASK is associated.

Reference is now made to TIGD5 BINDING SITE. TIGD5 is a target gene of GAM24, corresponding to GAM24-TARGET GENE of FIG. 24A. TIGD5 BINDING SITE is a binding site found in an untranslated region of TIGD5, corresponding to BINDING SITE of FIG. 24A FIG. 24D illustrates the complementarity of the nucleotide sequence of TIGD5 BINDING SITE, designated SEQ ID:993571, to the nucleotide sequence of GAM24 RNA of FIG. 24A, designated SEQ ID:20602. Yet a further function of GAM24 is therefore inhibition of (TIGD5). Accordingly, utilities of GAM24 include diagnosis and treatment of diseases and clinical conditions with which TIGD5 is associated.

Reference is now made to LOC151556 BINDING SITE. LOC151556 is a target gene of GAM24, corresponding to GAM24-TARGET GENE of FIG. 24A. LOC151556 BINDING SITE is a binding site found in an untranslated region of LOC151556, corresponding to BINDING SITE of FIG. 24A. FIG. 24D illustrates the complementarity of the nucleotide sequence of LOC151556 BINDING SITE, designated SEQ ID:1151343, to the nucleotide sequence of GAM24 RNA of FIG. 24A, designated SEQ ID:20602. Another function of GAM24 is therefore inhibition of (LOC151556). Accordingly, utilities of GAM24 include diagnosis and treatment of diseases and clinical conditions with which LOC151556 is associated.

Reference is now made to LOC196812 BINDING SITE. LOC196812 is a target gene of GAM24, corresponding to GAM24-TARGET GENE of FIG. 24A. LOC196812 BINDING SITE is a binding site found in an untranslated region of LOC196812, corresponding to BINDING SITE of FIG. 24A. FIG. 24D illustrates the complementarity of the nucleotide sequence of LOC196812 BINDING SITE, designated SEQ ID:1214315, to the nucleotide sequence of GAM24 RNA of FIG. 24A, designated SEQ ID:20602. Yet another function of GAM24 is therefore inhibition of (LOC196812). Accordingly, utilities of GAM24 include diagnosis and treatment of diseases and clinical conditions with which LOC196812 is associated.

Reference is now made to LOC256158 BINDING SITE. LOC256158 is a target gene of GAM24, corresponding to GAM24-TARGET GENE of FIG. 24A LOC256158 BINDING SITE is a binding site found in an untranslated region of LOC256158, corresponding to BINDING SITE of FIG. 24A. FIG. 24D illustrates the complementarity of the nucleotide sequence of LOC256158 BINDING SITE, designated SEQ ID:1317257, to the nucleotide sequence of GAM24 RNA of FIG. 24A, designated SEQ ID:20602. An additional function of GAM24 is therefore inhibition of (LOC256158). Accordingly, utilities of GAM24 include diagnosis and treatment of diseases and clinical conditions with which LOC256158 is associated.

Reference is now made to LOC90342 BINDING SITE. LOC90342 is a target gene of GAM24, corresponding to GAM24-TARGET GENE of FIG. 24A. LOC90342 BINDING SITE is a binding site found in an untranslated region of LOC90342, corresponding to BINDING SITE of FIG. 24A. FIG. 24D illustrates the complementarity of the nucleotide sequence of LOC90342 BINDING SITE, designated SEQ ID:1356067, to the nucleotide sequence of GAM24 RNA of FIG. 24A, designated SEQ ID:20602. A further function of GAM24 is therefore inhibition of (LOC90342). Accordingly, utilities of GAM24 include diagnosis and treatment of diseases and clinical conditions with which LOC90342 is associated.

Figures 25A, 25B, 25C:
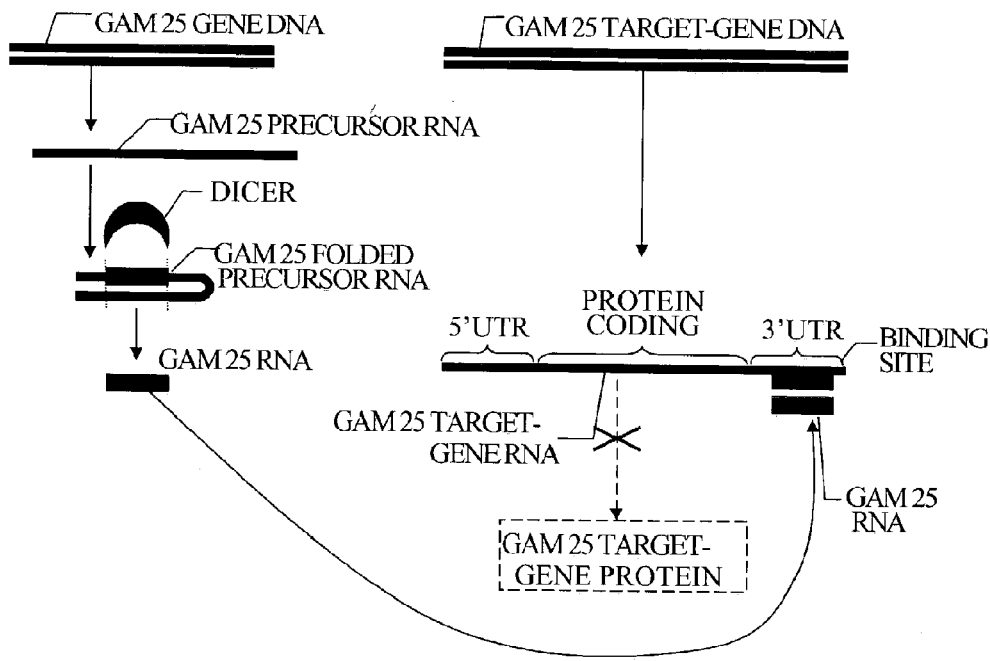

Reference is now made to FIG. 25A, which is a simplified diagram providing a conceptual explanation of the mode by which a novel bioinformatically detected gene, referred to here as GAM25 modulates expression of target genes thereof, the function and utility of which target genes is known in the art.

GAM25 (Genomic Address Messenger 25) is a novel bioinformatically detected regulatory, non protein coding, micro RNA (miRNA) gene. The method by which GAM25 was detected is described hereinabove with referent to FIGS. 6-15.

GAM25 GENE and GAM25-TARGET GENE are two human genes contained in the human genome.

GAM25 GENE encodes a GAM25 PRECURSOR RNA. Similar to other miRNA genes, and unlike most ordinary genes, the RNA transcribed by GAM25, GAM25 PRECURSOR RNA, does not encode a protein.

GAM25 PRECURSOR RNA folds onto itself, forming GAM25 FOLDED PRECURSOR RNA. As FIG. 25 illustrates, GAM25 FOLDED PRECURSOR RNA forms a 'hairpin structure', folding onto itself. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof. By "inversed-reversed" is meant a sequence which is reversed and wherein each nucleotide is replaced by a complimentary nucleotide, as is well known in the art (e.g. ATGGC is the inversed-reversed sequence of GCCAT).

An enzyme complex designated DICER COMPLEX 'dices' the GAM25 FOLDED PRECURSOR RNA into a single stranded ~22 long RNA segment, designated GAM25 RNA. As is known in the art, 'dicing' of a hairpin structured RNA precursor product into short a ~22 nt RNA segment is catalyzed by an enzyme complex comprising an enzyme called Dicer together with other necessary proteins.

GAM25-TARGET GENE encodes a corresponding messenger RNA, designated GAM25-TARGET RNA. GAM25-TARGET RNA comprises three regions, as is typical of mRNA of a protein coding gene: a 5' untranslated region, a protein coding region and a 3' untranslated region, designated 5'UTR, PROTEIN CODING and 3'UTR respectively.

GAM25 RNA binds complimentarily to a BINDING SITE, located on an untranslated region of GAM25-TARGET RNA. This complimentarily binding is due to the fact that the nucleotide sequence of GAM25 RNA is an accurate or a partial inversed-reversed sequence of the nucleotide sequence of BINDING SITE. It is appreciated that while FIG. 25A depicts the BINDING SITE on the 3'UTR region, this is meant as an example only—the BINDING SITE may be located on the 5'UTR region as well.

The complimentary binding of GAM25 RNA to BINDING SITE inhibits translation of GAM25-TARGET RNA into GAM25-TARGET PROTEIN. GAM25-TARGET PROTEIN is therefore outlined by a broken line.

It is appreciated that GAM25-TARGET GENE in fact represents a plurality of target genes of GAM25. The mRNA of each of this plurality of target genes of GAM25 comprises a BINDING SITE, having a nucleotide sequence which is at least partly complementary to GAM25 RNA, and which when bound by GAM25 RNA causes inhibition of translation of one of a plurality of target proteins of GAM25. The plurality of target genes of GAM25 and their respective binding sites are described hereinbelow with reference to FIG. 25D.

It is appreciated by one skilled in the art that the mode of translational inhibition illustrated by FIG. 25 with specific reference to translational inhibition exerted by GAM25 on one or more target genes of GAM25 is in fact common to other known miRNA genes. As mentioned hereinabove with reference to the background section, although a specific complimentary binding site has been demonstrated only for miRNA genes Lin-4 and Let-7, all other recently discovered miRNA genes are also believed by those skilled in the art to modulate expression of other genes by complimentary binding, although specific complimentary binding sites of these genes have not yet been found (Ruvkun G., 'Perspective: Glimpses of a tiny RNA world', Science 294, 779 (2001)).

Reference is now made to FIG. 25B which shows the nucleotide sequence of GAM25 PRECURSOR RNA of FIG. 25A, designated SEQ ID:2, and a probable nucleotide sequence of GAM25 RNA of FIG. 25A, designated SEQ ID:29474. The nucleotide sequence of SEQ ID:29474, which is highly likely (over 0.25%) to be identical or highly similar to that of GAM25, is marked by an underline within the sequence of GAM25 PRECURSOR RNA.

Reference is now made to FIG. 25C, which shows the secondary folding of GAM25 PRECURSOR RNA, forming a 'hairpin structure' designated GAM25 FOLDED PRECURSOR RNA, both of FIG. 25A. A probable (>0.25%) nucleotide sequence of GAM25 RNA, designated SEQ ID:29474 of FIG. 25B, is marked by an underline on GAM25 FOLDED PRECURSOR RNA. It is appreciated that the complimentary base-paring is not perfect, with 'bulges', as is well known in the art with respect to the RNA folding of all known miRNA genes.

Reference is now made to FIG. 25D, which is a table showing binding sites found in untranslated regions of a plurality of target genes of GAM25, each binding site corresponding to BINDING SITE of FIG. 25A, and their complementarity to SEQ ID:29474, which is highly likely (>0.25%) to be identical or highly similar to the nucleotide sequence of GAM25 RNA of FIG. 25A.

It is appreciated that the functions, and accordingly the utilities, of GAM25 correlate with, and may be deduced from, the identity of the target genes which GAM25 binds and inhibits, and the function of these target genes, as elaborated hereinbelow.

Reference is now made to EED BINDING SITE. Embryonic ectoderm development (EED) is a target gene of GAM25, corresponding to GAM25-TARGET GENE of FIG. 25A. EED BINDING SITE is a binding site found in an untranslated region of EED, corresponding to BINDING SITE of FIG. 25A. FIG. 25D illustrates the complementarity of the nucleotide sequence of EED BINDING SITE, designated SEQ ID:144323, to the nucleotide sequence of GAM25 RNA of FIG. 25A, designated SEQ ID:29474.

A function of GAM25 is therefore inhibition of embryonic ectoderm development (EED), a gene which encodes a transcription factor that may be a transcriptional repressor involved in embryonic development. Accordingly, utilities of GAM25 include diagnosis and treatment of the above-mentioned diseases and clinical conditions.

The function of EED has been established by previous studies. In *Drosophila*, the Polycomb-group (PcG) and trithorax-group (trxG) genes are part of a cellular memory system responsible for the stable inheritance of gene activity. PcG and trxG genes are repressors and activators, respectively, of *Drosophila* homeotic gene expression. ENX1 (EZH2; 601573) is a mammalian homolog of the *Drosophila* 'enhancer of zest' gene and has domains with sequence homology to both PcG and trxG genes. Using a yeast 2-hybrid screen with ENX1 as bait, followed by screening a fetal brain cDNA library, Sewalt et al. (1998) isolated a cDNA encoding EED. EED is the human homolog of Eed, a murine PcG gene homologous to the *Drosophila* homeotic gene, 'extra sex combs.' The predicted 535-amino acid human EED protein is 100% identical to the murine protein. The N-terminal region of EED contains a putative PEST sequence, which is implicated in protein degradation, and there are 5 WD40 domains throughout the EED protein. WD40 domains are involved in protein-protein interactions, and Sewalt et al. (1998) showed that all 5 are necessary for the ENX1-EED interaction to occur. Northern blot analysis detected 1.5- and 2.0-kb EED transcripts in all tissues and cell lines tested; larger transcripts were detected in normal human tissues only, but at much lower levels. Highest expression was found in testis, spleen, prostate, ovary, and small intestine, as well as in colorectal adenocarcinoma, chronic myeloid leukemia, and osteosarcoma cell lines, with lower levels in thymus, colon, and peripheral blood leukocytes.

Animal model experiments lend further support to the function of EED. In marsupials and the extraembryonic region of the mouse, X inactivation is imprinted: the paternal X chromosome is preferentially inactivated whereas the maternal X is always active. Having more than 1 active X chromosome is deleterious to extraembryonic development in the mouse. Wang et al. (2001) showed that the eed gene is required for primary and secondary trophoblast giant cell development in female embryos. Results from mice carrying a paternally inherited X-linked GFP transgene implicated eed in the stable maintenance of imprinted X inactivation in extraembryonic tissues. Based on the recent finding that the EED protein interacts with histone deacetylases, Wang et al. (2001) suggested that this maintenance activity involves hypoacetylation of the inactivated paternal X chromosome in the extraembryonic tissues.

It is appreciated that the abovementioned animal model for EED is acknowledged by those skilled in the art as a scientifically valid animal model, as can be further appreciated from the publications sited hereinbelow.

Full details of the abovementioned studies are described in the following publications, the disclosure of which are hereby incorporated by reference:

Sewalt, R. G. A. B.; van der Vlag, J.; Gunster, M. J.; Hamer, K. M.; den Blaauwen, J. L.; Satijn, D. P. E.; Hendrix, T.; van Driel, R.; Otte, A. P.: Characterization of interactions between the mammalian Polycomb-group proteins Enx1/EZH2 and EED suggests the existence of different mammalian Polycomb-group protein complexes. Molec. Cell. Biol. 18: 3586-3595, 1998. PubMed ID: 9584199 5. Wang, J.; Mager, J.; Chen, Y.; Schneider, E.; Cross, J. C.; Nagy, A.; Magnuson, T.: Imprinted X inactivation maintained by a mouse Polycomb group gene. Nature Genet. 28: 371-375, 2001.

Further studies establishing the function and utilities of EED are found in John Hopkins OMIM database record ID 605984, and in references numbered 1-5 listed hereinbelow.

Reference is now made to MLPH BINDING SITE. (MLPH) is a target gene of GAM25, corresponding to GAM25-TARGET GENE of FIG. 25A. MLPH BINDING SITE is a binding site found in an untranslated region of MLPH, corresponding to BINDING SITE of FIG. 25A. FIG. 25D illustrates the complementarity of the nucleotide sequence of MLPH BINDING SITE, designated SEQ ID:256513, to the nucleotide sequence of GAM25 RNA of FIG. 25A, designated SEQ ID:29474.

Yet another function of GAM25 is therefore inhibition of (MLPH), a gene which encodes a transcription factor that is a member of the Rab effector family, and is associated with Griscelli syndrome. Accordingly, utilities of GAM25 include diagnosis and treatment of the abovementioned diseases and clinical conditions.

The function of MLPH has been established by previous studies. In 3 pigment mutations of the mouse, dilute (d), ashen (ash), and leaden (ln), melanin synthesis is normal but melanosome transport is impaired, resulting the clumping of the melanosomes in the Perinuclear region of the cell (Silvers, 1979). Genetic evidence suggested that these loci encode proteins that function in the same or overlapping pathways. All 3 mutations have identical phenotypes. In addition, Matesic et al. (2001) stated that the doubly and triply homozygous mutant combinations on a nonagouti background have phenotypes that are indistinguishable from any of the single mutations alone. Furthermore, all 3 mutations are suppressed by the cell autonomous, semidominant 'dilute suppressor' (dsu). By positional cloning, Matesic et al. (2001) identified in mouse a gene, which they designated melanophilin (Mlph), encoding a novel member of the Rab effector family. Northern blot analysis demonstrated expression of 3 Mlph transcripts in most adult tissues, with highest expression in epithelial-enriched tissues such as kidney, lung, skin, small intestine, and stomach. Matesic et al. (2001) determined that the Mlph gene is mutated in leaden mice. Mutations in ashen and dilute in the Rab27a (603868) and myosin Va (160777) genes, respectively. Matesic et al. (2001) suggested that Mlph may function as part of a transport complex with MyoVa and Rab27a. Matesic et al. (2001) noted that all characterized patients with Griscelli syndrome (214450) carry mutations in the MYOVA or the RAB27A gene. Thus, it would not be surprising to find patients with Griscelli syndrome, or patients with other hypopigmentation disorders, with mutations in the MLPH gene.

Full details of the abovementioned studies are described in the following publications, the disclosure of which are hereby incorporated by reference:

Matesic, L. E.; Yip, R.; Reuss, A. E.; Swing, D. A.; O'Sullivan, T. N.; Fletcher, C. F.; Copeland N. G.; Jenkins, N. A.: Mutations in Mlph, encoding a member of the Rab effector family, cause the melanosome transport defects observed in leaden mice. Proc. Nat. Acad. Sci. 98: 10238-10243, 2001. PubMed ID: 1504925 2. Silvers, W. K.: The Coat Colors of Mice. New York: Springer, 1979.

Further studies establishing the function and utilities of MLPH are found in John Hopkins OMIM database record ID 606526, and in references numbered 6-7 listed hereinbelow.

Reference is now made to NPY2R BINDING SITE. Neuropeptide Y receptor Y2 (NPY2R) is a target gene of GAM25, corresponding to GAM25-TARGET GENE of FIG. 25A. NPY2R BINDING SITE is a binding site found in an untranslated region of NPY2R, corresponding to BINDING SITE of FIG. 25A. FIG. 25D illustrates the complementarity of the nucleotide sequence of NPY2R BINDING SITE, designated SEQ ID:277186, to the nucleotide sequence of GAM25 RNA of FIG. 25A, designated SEQ ID:29474.

An additional function of GAM25 is therefore inhibition of neuropeptide Y receptor Y2 (NPY2R), a gene which encodes a receptor that stimulates intracellular calcium flux and may modulate psychomotor activity, food intake, endocrine secretion and vasoconstriction. Accordingly, utilities of GAM25 include diagnosis and treatment of the abovementioned diseases and clinical conditions.

The function of NPY2R has been established by previous studies. Neuropeptide Y (NPY) signals through a family of G protein-coupled receptors present in the brain and sympathetic neurons. At least 3 types of neuropeptide Y receptor have been defined on the basis of pharmacologic criteria, tissue distribution, and structure of the encoding gene; see 162641 and 162643. Rose et al. (1995) reported the expression cloning in COS cells of a cDNA for the human type 2 receptor, NPY2R. Transfected cells showed high affinity for NPY (162640), peptide YY (PYY; 600781), and a fragment of NPY including amino acids 13 to 36. The predicted 381-amino acid protein has 7 transmembrane domains characteristic of G protein-coupled receptors and is only 31% identical to the human Y1 receptor (NPY1R; 162641). A 4-kb mRNA was detected on Northern blots of tissue samples from several regions of the nervous system. Gerald et al. (1995) cloned the cDNA corresponding to the human Y2 receptor from a human hippocampal cDNA expression library using a radiolabeled PYY-binding assay. They expressed the Y2 gene in COS-7 cells and performed a hormone binding assay which showed that the Y2 receptor binds (from highest to lowest affinity) PYY, NPY, and pancreatic polypeptide (PP; 167780) hormones.

Full details of the abovementioned studies are described in the following publications, the disclosure of which are hereby incorporated by reference:

Gerald, C.; Walker, M. W.; Vaysse, P. J. -J.; He, C.; Branchek, T. A.; Weinshank, R. L.: Expression cloning and pharmacological characterization of a human hippocampal neuropeptide Y/peptide YY Y2 receptor subtype. J. Biol. Chem. 270: 26758-26761, 1995. PubMed ID: 7592910 4. Rose, P. M.; Fernandes, P.; Lynch, J. S.; Frazier, S. T.; Fisher, S. M.; Kodukula, K.; Kienzle, B.; Seethala, R.: Cloning and functional expression of a cDNA encoding a human type 2 neuropeptide Y receptor. J. Biol. Chem. 270: 22661-22664, 1995.

Further studies establishing the function and utilities of NPY2R are found in John Hopkins OMIM database record ID 162642, and in references numbered 8-11 listed hereinbelow.

Reference is now made to NR1I2 BINDING SITE. Nuclear receptor subfamily 1, group I, member 2 (NR1I2) is a target gene of GAM25, corresponding to GAM25-TARGET GENE of FIG. 25A. NR1I2 BINDING SITE is a binding site found in an untranslated region of NR1I2, corresponding to BINDING SITE of FIG. 25A. FIG. 25D illustrates the complementarity of the nucleotide sequence of NR1I2 BINDING SITE, designated SEQ ID:277734, to the nucleotide sequence of GAM5 RNA of FIG. 25A, designated SEQ ID:29474.

A further function of GAM25 is therefore inhibition of nuclear receptor subfamily 1, group I, member 2 (NR1I2), a gene which encodes a protein that binds to a response element in the cyp3a4 gene promoter and activates its expression in response to a wide variety of endobiotics and xenobiotics. Accordingly, utilities of GAM25 include diagnosis and treatment of the abovementioned diseases and clinical conditions.

The function of NR1I2 has been established by previous studies. Lehmann et al. (1998) identified a nuclear receptor, termed PXR, that binds to the rifampicin/dexamethasone response element in the CYP3A4 (124010) promoter as a heterodimer with the 9-cis retinoic acid receptor RXR (see 180245). The human PXR is related to the mouse Pxr1, which they had cloned and shown to be activated by dexamethasone, pregnenolone 16-alpha-carbonitrile (PCN), and other compounds known to induce expression of the CYP3A1 gene, the predominant form of CYP3A in rat liver and intestine. Lehmann al. (1998) isolated PXR clones from a human liver cDNA library. Amino acid sequence comparison showed that human PXR shared 96% and 76% sequence identity with mouse Pxr1 in the DNA-binding and ligand-binding domains, respectively. Initiation of translation at a CUG initiation codon would yield a protein of 434 amino acids. Northern blot analysis detected most abundant expression in liver, colon, and small intestine; transcripts of 2.6, 4.3, and 5 kb were present in each of these tissues. Lehmann et al. (1998) provided several lines of evidence indicating that human PXR serves as a key transcriptional regulator of the CYP3A4 gene.

Animal model experiments lend further support to the function of NR1I2. The induction of CYP3A enzymes is species-specific and believed to involve 1 or more cellular factors, or receptor-like xenosensors. Xie et al. (2000) identified one such factor as the nuclear receptor Pxr and its human homolog SXR. Xie et al. (2000) showed that targeted disruption of the mouse Pxr gene abolished induction of CYP3A by prototypic inducers such as dexamethasone or pregnenolone-16-alpha-carbonitrile. In Pxr-null mice carrying a transgene for an activated form of human SXR, there was constitutive upregulation of CYP3A gene expression and enhanced protection against toxic xenobiotic compounds. Xie et al. (2000) demonstrated that species origin of the receptor, rather than the promoter structure of the CYP3A genes, dictates the species-specific pattern of CYP3A inducibility. Thus, they could generate 'humanized' transgenic mice that were responsive to human-specific inducers such as the antibiotic rifampicin. Xie et al. (2000) concluded that the SXR/Pxr genes encode the primary species-specific xenosensors that mediate the adaptive hepatic response, and may represent the critical biochemical mechanism of human xenoprotection.

It is appreciated that the abovementioned animal model for NR1I2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Lehmann, J. M.; McKee, D. D.; Watson, M. A.; Wilson, T. M.; Moore, J. T.; Kliewer, S. A.: The human orphan nuclear receptor PXR is activated by compounds that regulate CYP3A4 gene expression and cause drug interactions. J. Clin. Invest 102: 1016-1023, 1998. PubMed ID: 9727070 6. Xie, W.; Barwick, J. L.; Downes, M.; Blumberg, B.; Simon, C. M.; Nelson, M. C.; Neuschwander-Tetri, B. A.; Brunt, E. M.; Guzelian, P. S.; Evans, R. M.: Humanized xenobiotic response in mice expressing nuclear receptor SXR. Nature 406: 435-439, 2000.

Further studies establishing the function and utilities of NR1I2 are found in John Hopkins OMIM database record ID 603065, and in references numbered 12-18 listed hereinbelow.

Reference is now made to dJ383J4.3 BINDING SITE. DJ383J4.3 is a target gene of GAM25, corresponding to GAM25-TARGET GENE of FIG. 25A. DJ383J4.3 BINDING SITE is a binding site found in an untranslated region of dJ383J4.3, corresponding to BINDING SITE of FIG. 25A. FIG. 25D illustrates the complementarity of the nucleotide sequence of dJ383J4.3 BINDING SITE, designated SEQ ID:512554, to the nucleotide sequence of GAM25 RNA of FIG. 25A, designated SEQ ID:29474. Yet a further function of GAM25 is therefore inhibition of (dJ383J4.3). Accordingly, utilities of GAM25 include diagnosis and treatment of diseases and clinical conditions with which dJ383J4.3 is associated.

Reference is now made to FLJ4280 BINDING SITE. FLJ14280 is a target gene of GAM25, corresponding to GAM25-TARGET GENE of FIG. 25A. FLJ14280 BINDING SITE is a binding site found in an untranslated region of FLJ14280, corresponding to BINDING SITE of FIG. 25A. FIG. 25D illustrates the complementarity of the nucleotide sequence of FLJ14280 BINDING SITE, designated SEQ ID:610221, to the nucleotide sequence of GAM25 RNA of FIG. 25A, designated SEQ ID:29474. Another function of GAM25 is therefore inhibition of (FLJ14280). Accordingly, utilities of GAM25 include diagnosis and treatment of diseases and clinical conditions with which FLJ14280 is associated.

Reference is now made to KIAA1678 BINDING SITE. KIAA1678 is a target gene of GAM25, corresponding to GAM25-TARGET GENE of FIG. 25A. KIAA1678 BINDING SITE is a binding site found in an untranslated region of KIAA1678, corresponding to BINDING SITE of FIG. 25A. FIG. 25D illustrates the complementarity of the nucleotide sequence of KIAA1678 BINDING SITE, designated SEQ ID:803886, to the nucleotide sequence of GAM25 RNA of FIG. 25A, designated SEQ ID:29474. Yet another function of GAM25 is therefore inhibition of (KIAA1678). Accordingly, utilities of GAM25 include diagnosis and treatment of diseases and clinical conditions with which KIAA1678 is associated.

Reference is now made to KIAA1724 BINDING SITE. KIAA1724 is a target gene of GAM25, corresponding to GAM25-TARGET GENE of FIG. 25A. KIAA1724 BINDING SITE is a binding site found in an untranslated region of KIAA1724, corresponding to BINDING SITE of FIG. 25A. FIG. 25D illustrates the complementarity of the nucleotide sequence of KIAA1724 BINDING SITE, designated SEQ ID:806213, to the nucleotide sequence of GAM25 RNA of FIG. 25A, designated SEQ ID:29474. An additional function of GAM25 is therefore inhibition of (KIAA1724). Accordingly, utilities of GAM25 include diagnosis and treatment of diseases and clinical conditions with which KIAA1724 is associated.

Reference is now made to KIAA1949 BINDING SITE. KIAA1949 is a target gene of GAM25, corresponding to GAM25-TARGET GENE of FIG. 25A. KIAA1949 BINDING SITE is a binding site found in an untranslated region of KIAA1949, corresponding to BINDING SITE of FIG. 25A. FIG. 25D illustrates the complementarity of the nucleotide sequence of KIAA1949 BINDING SITE, designated SEQ ID:820868, to the nucleotide sequence of GAM25 RNA of FIG. 25A, designated SEQ ID:29474. A further function of GAM25 is therefore inhibition of (KIAA1949). Accordingly, utilities of GAM25 include diagnosis and treatment of diseases and clinical conditions with which KIAA1949 is associated.

Reference is now made to RoXaN BINDING SITE. RoXaN is a target gene of GAM25, corresponding to GAM25-TARGET GENE of FIG. 25A. RoXaN BINDING SITE is a binding site found in an untranslated region of RoXaN, corresponding to BINDING SITE of FIG. 25A. FIG. 25D illustrate the complementarity of the nucleotide sequence of RoXaN BINDING SITE, designated SEQ ID:950975, to the nucleotide sequence of GAM25 RNA of FIG. 25A, designated SEQ ID:29474. Yet a further function of GAM25 is therefore inhibition of (RoXaN). Accordingly, utilities of GAM25 include diagnosis and treatment of diseases and clinical conditions with which RoXaN is associated.

Reference is now made to SERP1 BINDING SITE. SERP1 is a target gene of GAM25; corresponding to GAM25-TARGET GENE of FIG. 25A. SERP1 BINDING SITE is a binding site found in an untranslated region of SERP1, corresponding to BINDING SITE of FIG. 25A. FIG. 25D illustrates the complementarity of the nucleotide sequence of SERP1 BINDING SITE, designated SEQ ID:963990, to the nucleotide sequence of GAM25 RNA of FIG. 25A, designated SEQ ID:29474. Another function of GAM25 is therefore inhibition of (SERP1). Accordingly, utilities of GAM25 include diagnosis and treatment of diseases and clinical conditions with which SERP1 is associated.

Reference is now made to SYNE-1 BINDING SITE. SYNE-1 is a target gene of GAM25, corresponding to GAM25-TARGET GENE of FIG. 25A. SYNE-1 BINDING SITE is a binding site found in an untranslated region of SYNE-1, corresponding to BINDING SITE of FIG. 25A. FIG. 25D illustrates the complementarity of the nucleotide sequence of SYNE-1 BINDING SITE, designated SEQ ID:986316, to the nucleotide sequence of GAM25 RNA of FIG. 25A, designated SEQ ID:29474. Yet another function of GAM25 is therefore inhibition of (SYNE-1). Accordingly, utilities of GAM25 include diagnosis and treatment of diseases and clinical conditions with which SYNE-1 is associated.

Reference is now made to TNRC4 BINDING SITE. TNRC4 is a target gene of GAM25, corresponding to GAM25-TARGET GENE of FIG. 25A. TNRC4 BINDING SITE is a binding site found in an untranslated region of TNRC4, corresponding to BENDING SITE of FIG. 25A. FIG. 25D illustrates the complementarity of the nucleotide sequence of TNRC4 BINDING SITE, designate SEQ ID:996086, to the nucleotide sequence of GAM25 RNA of FIG. 25A, designate SEQ ID:29474. An additional function of GAM25 is therefore inhibition of (TNRC4). Accordingly, utilities of GAM25 include diagnosis and treatment of diseases and clinical conditions with which TNRC4 is associated.

Reference is now made to LOC196047 BINDING SITE. LOC196047 is a target gene of GAM25, corresponding to GAM25-TARGET GENE of FIG. 25A. LOC196047 BINDING SITE is a binding site found in an untranslated region of LOC196047, corresponding to BINDING SITE of FIG. 25A. FIG. 25D illustrates the complementarity of the nucleotide sequence of LOC196047 BINDING SITE, designated SEQ ID:1210373, to the nucleotide sequence of GAM25 RNA of FIG. 25A, designated SEQ ID:29474. A further function of GAM25 is therefore inhibition of (LOC196047). Accordingly, utilities of GAM25 include diagnosis and treatment of diseases and clinical conditions with which LOC196047 is associated.

Reference is now made to LOC221540 BINDING SITE. LOC221540 is a target gene of GAM25, corresponding to GAM25-TARGET GENE of FIG. 25A. LOC221540 BINDING SITE is a binding site found in an untranslated region of LOC221540, corresponding to BINDING SITE of FIG. 25A. FIG. 25D illustrates the complementarity of the nucleotide sequence of LOC221540 BINDING SITE, designated SEQ ID:1274947, to the nucleotide sequence of GAM25 RNA of FIG. 25A, designated SEQ ID:29474. Yet a further function of GAM25 is therefore inhibition of (LOC221540). Accordingly, utilities of GAM25 include diagnosis and treatment of diseases and clinical conditions with which LOC221540 is associated.

Reference is now made to LOC257545 BINDING SITE. LOC257545 is a target gene of GAM25, corresponding to GAM25-TARGET GENE of FIG. 25A. LOC257545 BINDING SITE is a binding site found in an untranslated region of LOC257545, corresponding to BINDING SITE of FIG. 25. FIG. 25D illustrates the complementarity of the nucleotide sequence of LOC257545 BINDING SITE, designated SEQ ID:1274947, to the nucleotide sequence of GAM25 RNA of FIG. 25A, designated SEQ ID:29474. Another function of GAM25 is therefore inhibit of (LOC257545). Accordingly, utilities of GAM25 include diagnosis and treatment of diseases and clinical conditions with which LOC257545 is associated.

Reference is now made to LOC257598 BINDING SITE. LOC257598 is a target gene of GAM25, corresponding to GAM25-TARGET GENE of FIG. 25A. LOC257598 BINDING SITE is a binding site found in an untranslated region of LOC257598, corresponding to BINDING SITE of FIG. 25A. FIG. 25D illustrates the complementarity of the nucleotide sequence of LOC257598 BINDING SITE, designated SEQ ID:1274947, to the nucleotide sequence of GAM25 RNA of FIG. 25A, designated SEQ ID:29474. Yet another function of GAM25 is therefore inhibition of (LOC257598). Accordingly, utilities of GAM25 include diagnosis and treatment of diseases and clinical conditions with which LOC257598 is associated.

Reference is now made to LOC63928 BINDING SITE. LOC63928 is a target gene of GAM25, corresponding to GAM25-TARGET GENE of FIG. 25A. LOC63928 BINDING SITE is a binding site found in an untranslated region of LOC63928, corresponding to BINDING SITE of FIG. 25A. FIG. 25D illustrates the complementarity of the nucleotide sequence of LOC63928 BINDING SITE, designated SEQ ID:1347928, to the nucleotide sequence of GAM25 RNA of FIG. 25A, designated SEQ ID:29474. An additional function of GAM25 is therefore inhibition of (LOC63928). Accordingly, utilities of GAM25 include diagnosis and treatment of diseases and clinical conditions with which LOC63928 is associated.

Figures 26A, 26B, 26C:
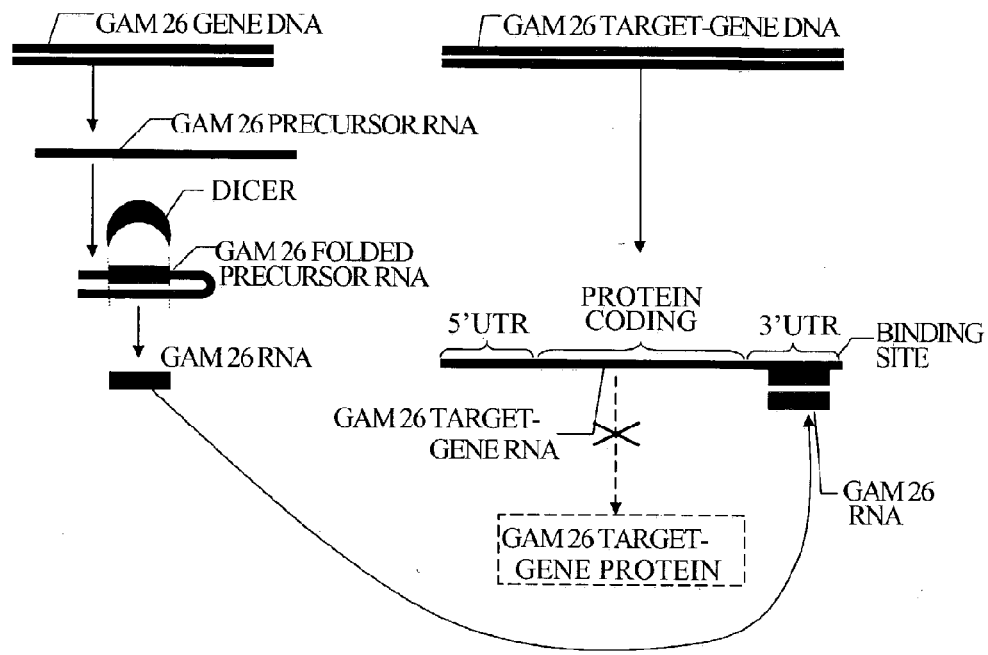

Reference is now made to FIG. 26A, which is a simplified diagram providing a conceptual explanation of the mode by which a novel bioinformatically detected gene, referred to here as GAM26 modulates expression of target genes thereof, the function and utility of which target genes is known in the art.

GAM26 (Genomic Address Messenger 26) is a novel bioinformatically detected regulatory, non protein coding, micro RNA (miRNA) gene. The method by which GAM26 was detected is described hereinabove with reference to FIGS. 6-15.

GAM26 GENE and GAM26-TARGET GENE are two human genes contained in the human genome.

GAM26 GENE encodes a GAM26 PRECURSOR RNA. Similar to other miRNA genes, and unlike most ordinary genes, the RNA transcribed by GAM26, GAM26 PRECURSOR RNA, does not encode a protein.

GAM26 PRECURSOR RNA folds onto itself, forming GAM26 FOLDED PRECURSOR RNA. As FIG. 26 illustrates, GAM26 FOLDED PRECURSOR RNA forms a 'hairpin structure', folding onto itself. As is well known in the art, this 'hairpin structure', is typical of RNA encoded by miRNA genes, and is due to the fact that the nucleotide sequence of the first half of the RNA encoded by a mRNA gene is an accurate or partial inversed-reversed sequence of the nucleotide sequence of the second half thereof. By "inversed-reversed" is meant a sequence which is reversed and wherein each nucleotide is replaced by a complimentary nucleotide, as is well known in the art (e.g. ATGGC is the inversed-reversed sequence of GCCAT).

An enzyme complex designated DICER COMPLEX, 'dices' the GAM26 FOLDED PRECURSOR RNA into a single stranded ~22 nt long RNA segment, designated GAM26 RNA. As is known in the art, 'dicing' of a hairpin structured RNA precursor product into short a ~22 nt RNA segment is catalyzed by an enzyme complex comprising an enzyme called Dicer together with other necessary proteins.

GAM26-TARGET GENE encodes a corresponding messenger RNA, designated GAM26-TARGET RNA. GAM26-TARGET RNA comprises three regions, as is typical of mRNA of a protein coding gene: a 5' untranslated region, a protein coding region and a 3' untranslated region, designated 5'UTR, PROTEIN CODING and 3'UTR respectively.

GAM26 RNA binds complimentarily to a BINDING SITE, located on an untranslated region of GAM26-TARGET RNA. This complimentarily binding is due to the fact that the nucleotide sequence of GAM26 RNA is an accurate or a partial inversed-reversed sequence of the nucleotide sequence of BINDING SITE. It is appreciated that while FIG. 26A depicts the BINDING SITE on the 3'UTR region this is meant as an example only—the BINDING SITE may be located on the 5'UTR region as well.

The complimentary binding of GAM26 RNA to BINDING SITE inhibits translation of GAM26-TARGET RNA into GAM26-TARGET PROTEIN. GAM26-TARGET PROTEIN is therefore outlined by a broken line.

It is appreciated that GAM26-TARGET GENE in fact represents a plurality of target genes of GAM26. The mRNA of each of this plurality of target genes of GAM26 comprises a BINDING SITE, having a nucleotide sequence which is at least partly complementary to GAM26 RNA, and which when bound by GAM26 RNA causes inhibition of translation of one of a plurality of target proteins of GAM26. The plurality of target genes of GAM26 and their respective binding sites are described hereinbelow with reference to FIG. 26D.

It is appreciated by one skilled in the art that the mode of translational inhibition illustrated by FIG. 26 with specific reference to translational inhibition exerted by GAM26 on one or more target genes of GAM26 is in fact common to other known miRNA genes. As mentioned hereinabove with reference to the background section, although a specific complimentary binding site has been demonstrated only for miRNA genes Lin-4 and Let-7, all other recently discovered miRNA genes are also believed by those skilled in the art to modulate expression of other genes by complimentary binding, although specific complimentary binding sites of these genes have not yet been found (Ruvkun G., 'Perspective: Glimpses of a tiny RNA world', Science 294, 779 (2001)).

Reference is now made to FIG. 26B which shows the nucleotide sequence of GAM26 PRECURSOR RNA of FIG. 26A, designated SEQ ID:3, and a probable nucleotide sequence of GAM26 RNA of FIG. 26A, designated SEQ ID:20604. The nucleotide sequence of SEQ ID:20604, which is highly likely (over 0.801122%) to be identical or highly similar to that of GAM26, is marked by an underline within the sequence of GAM26 PRECURSOR RNA.

Reference is now made to FIG. 26C, which shows the secondary folding of GAM26 PRECURSOR RNA, forming a 'hairpin structure' designed GAM26 FOLDED PRECURSOR RNA, both of FIG. 26A. A probable (>0.801122%) nucleotide sequence of GAM26 RNA, designated SEQ ID:20604 of FIG. 26B, is marked by an underline on GAM26 FOLDED PRECURSOR RNA. It is appreciated that the complimentary base-paring is not perfect, with 'bulges', as is well known in the art with respect to the RNA folding of all known miRNA genes.

Reference is now made to FIG. 26D, which is a table showing binding sites found in untranslated regions of a plurality of target genes of GAM26, each binding site corresponding to BINDING SITE of FIG. 26A, and their complementarity to SEQ ID:20604, which is highly likely (>0.801122%) to be identical or highly similar to the nucleotide sequence of GAM26 RNA of FIG. 26A.

It is appreciated that the functions, and accordingly the utilities, of GAM26 correlate with, and may be deduced from, the identity of the target genes which GAM26 binds and inhibits, and the function of these target genes, as elaborated hereinbelow.

Reference is now made to ACVR1B BINDING SITE. Activin A receptor, type IB (ACVR1B) is a target gene of GAM26, corresponding to GAM26-TARGET GENE of FIG. 26A. ACVR1B BINDING SITE is a binding site found in an untranslated region of ACVR1B, corresponding to BINDING SITE of FIG. 26A. FIG. 26D illustrates the complementarity of the nucleotide sequence of ACVR1B BINDING SITE, designated SEQ ID:46182, to the nucleotide sequence of GAM26 RNA of FIG. 26A, designated SEQ ID:20604.

A function of GAM26 is therefore inhibition of activin A receptor, type IB (ACVR1B), a gene which encodes a receptor that Activin receptor-like kinase; similar to activin, TGF-beta, and *C. elegans* daf-1 receptors. Accordingly utilities of GAM26 include diagnosis and treatment of the abovementioned diseases and clinical conditions.

The function of ACVR1B has been established by previous studies. See ACVRL1 (601284). Human cDNA clones encoding 4 putative transmembrane ser/thr kinases were identified by ten Dijke et al. (1993). Using degenerate DNA primers based on the human activin receptor type II (see 102581) and *C. elegans* Daf-1 gene products, they PCR-amplified mRNA from human erythroleukemia (HEL) cells, a cell type known to respond both to activin (147290) and TGF-beta (190180). Their partial clone of the ALK4 gene encodes a 383-amino acid polypeptide with a truncated extracellular domain but sequence and structural domain similarities with the other 3 ALK genes they cloned. ALK1, ALK2 (102576), ALK3 (601299), and ALK4 share approximately 40% sequence identity with activin receptors type II and IIB, TGF-beta receptor (see 190181), and Daf-1 in their kinase domains but share 60 to 790% sequence identity among themselves, suggesting to ten Dijke et al. (1993) that the ALK gene products form a subfamily of receptor ser/thr kinases. By Northern analysis, ten Dijke et al. (1993) showed that ALK4 is expressed in many tissues, most strongly in human kidney, pancreas, brain, lung, and liver. Su et al. (2001) described the gene structure and novel somatic mutations of the activin type IB receptor in pancreatic cancer. This was the first description of ACVR1B as a tumor suppressor gene.

Full details of the abovementioned studies are described in the following publications, the disclosure of which are hereby incorporated by reference:

Ten Dijke, P.; Ichijo, H.; Franzen, P.; Schulz, P.; Saras, J.; Toyoshima, H.; Heldin, C. -H.; Miyazono, K.: Activin receptor-like kinases: a novel subclass of cell-surface receptors with predicted serine/threonine kinase activity. Oncogene 8: 2879-2887, 1993. PubMed ID: 8397373 3.

Su, G. H.; Bansal, R.; Murphy, K. M.; Montgomery, E.; Yeo, C. J.; Hruban, R. H.; Kern, S. E.: ACVR1B (ALK4, activin receptor type 1B) gene mutations in pancreatic carcinoma. Proc. Nat. Acad. Sci. 98: 3254-3257, 2001.

Further studies establishing the function and utilities of ACVR1B are found in John Hopkins OMIM database record ID 601300, and in references numbered 19-24 listed hereinbelow.

Referring now to ACVR1B BINDING SITE. Activin A receptor, type IB (ACVR1B) is target gene of GAM26, corresponding to GAM26-TARGET GENE of FIG. 26A. ACVR1B BINDING SITE is a binding site found in an untranslated region of ACVR1B, corresponding to BINDING SITE of FIG. 26A. FIG. 26D illustrates the complementarity of the nucleotide sequence of ACVR1B BINDING SITE, designated SEQ ID:46198, to the nucleotide sequence of GAM26 RNA of FIG. 26A, designated SEQ ID:20604.

Yet another function of GAM26 is therefore inhibition of activin A receptor, type IB (ACVR1B), a gene which encodes a receptor that Activin receptor-like kinase; similar to activin, TGF-beta, and *C. elegans* daf-1 receptors. Accordingly, utilities of GAM26 include diagnosis and treatment of the abovementioned diseases and clinical conditions. The function and utilities of ACVR1B have been established by previous studies, as described hereinabove with reference to FIG. 26D.

Reference is now made to DLG3 BINDING SITE. Discs large (*Drosophila*) homolog (neuroendocrine-dlg) (DLG3) is a target gene of GAM26, corresponding to GAM26-TARGET GENE of FIG. 26A. DLG3 BINDING SITE is a binding site found in an untranslated region of DLG3, corresponding to BINDING SITE of FIG. 26. FIG. 26D illustrates the complementarity of the nucleotide sequence of DLG3 BINDING SITE, designated SEQ ID:46198, to the nucleotide sequence of GAM26 RNA of FIG. 26A, designated SEQ ID:20604.

An additional function of GAM26 is therefore inhibition of discs, large (Drosophila) homolog 3 (neuroendocrine-dlg) (DLG3), a gene which encodes a protein that mediates protein-protein interactions at the cytoplasmic surface of the cell membrane. Accordingly, utilities of GAM26 include diagnosis and treatment of the abovementioned diseases and clinical conditions.

The function of DLG3 has been established by previous studies. The discs-large family is a collection of proteins first described in *Drosophila* that have a common structural organization and are thought to be involved in signal transduction and mediating protein-protein interactions at the cytoplasmic surface of the cell membrane. Each protein has 3 distinct structural domains: an N-terminal segment comprising 1 or more discs-large homologous regions (DHRs); a SRC oncogene (190090) homology motif 3 (SH3); and a C-terminal domain with homology to guanylate kinase (139270). The defining member of this group of proteins is the gene product of the *Drosophila* lethal (1) discs-large 1 locus (601014), which was originally identified by the analysis of recessive lethal mutants. Germline mutations in the *Drosophila* gene dlg result in loss of apical-basal lateral polarity, disruption of normal cell-cell adhesion, and neoplastic overgrowth of the imaginal disc epithelium. The DLG1 gene maps to human 3q29; the MPP2 gene (600723) maps to 17q12-21. Smith et al. (1996) isolated and characterized another human gene, MPP3, which they called DLG3, with the structural characteristics of the discs-large family. The putative MPP3 gene product has a molecular weight of 66 kD and is located on chromosome 17 in the same segment, 17q12-q21, as MPP2. The products of the MPP2 and MPP3 genes show 36% identity and 58% similarity to each other, and both show nearly 60% sequence similarity to the EMP55 (305360) gene which encodes an erythroid phosphoprotein that is a component of the red cell membrane.

Full details of the abovementioned studies are described in the following publications, the disclosure of which are hereby incorporated by reference:

Smith, S. A.; Holik, P.; Stevens, J.; Mazoyer, S.; Melis, A.; Williams, B.; White, R.; Albertsen, H.: Isolation of a gene (DLG3) encoding a second member of the discs-large family on chromosome 17q12-q21. Genomics 31: 145-150, 1996.

Further studies establishing the function and utilities DLG3 are found in John Hopkins OMIM database record ID 601114, and in reference numbered 26 listed hereinbelow.

Reference is now made to ADARB1 BINDING SITE. Adenosine deaminase, RNA-specific, B1 (homolog of rat RED1) (ADARB1) is a target gene of GAM26, corresponding to GAM26-TARGET GENE of FIG. 26A. ADARB1 BINDING SITE is a binding site found in an untranslated region of ADARB1, corresponding to BINDING SITE of FIG. 6A FIG. 26D illustrates the complementarity of the nucleotide sequence of ADARB1 BINDING SITE, designated SEQ ID:48568, to the nucleotide sequence of GAM26 RNA of FIG. 26A, designated SEQ ID:20604.

A further function of GAM26 is therefore inhibition of adenosine deaminase, RNA-specific, B1 (homolog of rat RED1) (ADARB1), a gene which encodes enzyme that RNA editing involves the deamination of adenosines at specific sites. Accordingly, utilizes of GAM26 include diagnosis and treatment of the abovementioned diseases and clinical conditions.

The function of ADARB1 has been established by previous studies. RNA editing involves the deamination of adenosines at specific sites, the result of which can be a change in the amino acid sequence of the protein so that it differs from that predicted by the sequence of the DNA. Editing of the glutamate receptor B (GluRB; 138247) pre-mRNA has been shown to alter a codon (referred to as the Q/R site) for a channel determinant that controls the calcium permeability of the AMPA glutamate receptors. Melcher et al. (1996) tested the candidate dsRNA adenosine deaminase DRADA (601059) and showed that when coexpressed with a GluR-B minigene in HEK 293 cells, DRADA produced low-level editing at the GluR-B Q/R site. The authors then screened a rat brain cDNA library with the predicted catalytic domain of rat DRADA to identify other potential editing enzymes. A cDNA encoding a predicted 711 amino acid protein was isolated that gave about 90% of the expected activity in their editing assay. Melcher et al. (1996) designated this novel mammalian RNA editing protein RNA-editing enzyme-1 (RED1). Rat RED1 and DRADA share about 31% overall identity primarily due to their conservation in the C-terminal catalytic domain. Northern blots showed highest expression of RED1 in rat brain. Melcher et al. (1996) further observed that while RED1 was more efficient at deaminating some sites, DRADA had stronger activity at others. They speculated that a combination of these and perhaps other editing enzymes may be involved in determining the overall editing process for a give transcript. Higuchi et al. (2000) studied ADAR2-mediated RNA editing by generating mice that were homozygous for a targeted functional null allele. Editing in Adar2 −/− mice was substantially reduced at most of 25 positions in diverse transcripts; the mutant mice became prone to seizures and died young. The impaired phenotype appeared to result entirely from a single underedited position, since it reverted to normal when both alleles for the underedited transcript were substituted with alleles encoding the edited version exonically. The critical position specifies an ion channel determinant, the Q/R site, in AMPA receptor GluRB premessenger RNA. Higuchi et al. (2000) concluded that this transcript is physiologically the most important substrate of ADAR2.

Full details of the abovementioned studies are described in the following publications, the disclosure of which are hereby incorporated by reference:

Melcher, T.; Maas, S.; Herb, A.; Sprengel, R.; Seeburg, P. H.; Higuchi, M.: A mammalian RNA editing enzyme. Nature 379: 460-463, 1996. PubMed ID: 8559253 1. Higuchi, M.; Maas, S.; Single, F. N.; Hartner, J.; Rozov, A.; Burnashev, N.; Feldmeyer, D.; Sprengel, R.; Seeburg, P. H.: Point mutation in an AMPA receptor gene rescues lethality in mice deficient in the RNA-editing enzyme ADAR2. Nature 406: 78-81, 2000.

Further studies establishing the function and utilities of ADARB1 are found in John Hopkins OMIM database record ID 601218, and in references numbered 28-34 listed hereinbelow.

Referring now to ADARB1 BINDING SITE. Adenosine deaminase, RNA-specific, B1 (homolog of rat RED1) (ADARB1) is a target gene of GAM26, corresponding to GAM26-TARGET GENE of FIG. 26A. ADARB1 BINDING SITE is a binding site found in an untranslated region of ADARB1, corresponding to BINDING SITE of FIG. 26A. FIG. 26D illustrates the complementarity of the nucleotide sequence of ADARB1 BINDING SITE, designated SEQ ID:48568, to the nucleotide sequence of GAM26 RNA of FIG. 26A, designated SEQ ID:20604.

Yet a further function of GAM26 is therefore inhibition of adenosine deaminase, RNA-specific B1 (homolog of rat RED1) (ADARB1), a gene which encodes enzyme that RNA editing involves the deamination of adenosines at specific sites. Accordingly, utilities of GAM26 include diagnosis and treatment of the abovementioned diseases and clinical conditions. The function and utilities of ADARB1 have been established by previous studies, as described hereinabove with reference to FIG. 26D.

Reference is now made to ADRBK1 BINDING SITE. Adrenergic, beta, receptor kinase 1 (ADRBK1) is a target gene of GAM26, corresponding to GAM26-TARGET GENE of FIG. 26A. ADRBK1 BINDING SITE is a binding site found in an untranslated region of ADRBK1, corresponding to BINDING SITE of FIG. 26A. FIG. 26 illustrates the complementarity of the nucleotide sequence of ADRBK1 BINDING SITE, designated SEQ ID:51719, to the nucleotide sequence of GAM26 RNA of FIG. 26A, designated SEQ ID:20604.

Another function of GAM26 is therefore inhibition of adrenergic, beta, receptor kinase 1 (ADRBK1), a gene which encodes an enzyme that regulates desensitization of b-adrenergic receptors and related GPCRs. Accordingly, utilities of GAM26 include diagnosis and treatment of the abovementioned diseases and clinical conditions.

The function of ADRBK1 has been established by previous studies. Beta-adrenergic receptor kinase (BARK) phosphorylates the beta-2-adrenergic receptor (109690) and appears to mediate agonist-specific desensitization observed at high agonist concentrations. BARK is a ubiquitous cytosolic enzyme that specifically phosphorylates the activated form of the beta-adrenergic and related G protein-coupled receptors. Benovic et al. (1991) used the bovine BARK cDNA to screen a human retina library and isolate the human cDNA. They showed that it encodes a protein of 689 amino acids with an overall 98% amino acid and 92.5% nucleotide identity with bovine BARK. By study of rodent/human hybrid cells retaining various human chromosomes and parts of chromosomes, Benovic et al. (1991) demonstrated that the ADRBK1 gene segregates with the long arm of chromosome 11, centromeric to 11q13, i.e., 11cen-q13. Benovic et al. (1991) mapped the homologous gene to mouse chromosome 19.

Animal model experiments lend further support to the function of ADRBK1. Rockman et al. (1998) mated transgenic mice with cardiac-restricted overexpression of either a peptide inhibitor of beta-ARK1 or the beta-2-AR into a genetic model of murine heart failure. They found that overexpression of the inhibitor prevented the development of cardiomyopathy in this murine model of heart failure.

It is appreciated that the abovementioned animal model for ADRBK1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Enovic, J. L.; Stone, W. C.; Huebner, K.; Croce, C.; Caron, M. G.; Lefkowitz, R. J.: cDNA cloning and chromosomal localization of the human beta-adrenergic receptor kinase. FEBS Lett. 283: 122-126, 1991. PubMed ID: 2037065 4.

Rockman, H. A.; Chien, K. R.; Choi, D. -J.; Iaccarino, G.; Hunter, J. J.; Ross, J., Jr.; Lefkowitz, R. J.; Koch, W. J.: Expression of a beta-adrenergic receptor kinase 1 inhibitor prevents the development of myocardial failure in gene-targeted mice. Proc. Nat. Acad. Sci. 95: 7000-7005, 1998.

Further studies establishing the function and utilities of ADRBK1 are found in John Hopkins OMIM database record ID 109635, and in references numbered 35-39 listed hereinbelow.

Referring now to ADRBK1 BINDING SITE. Adrenergic beta, receptor kinase 1 (ADRBK1) is a target gene of GAM26, corresponding to GAM26-TARGET GENE of FIG. 26A. ADRBK1 BINDING SITE is a binding site found in an untranslated region of ADRBK1, corresponding to BINDING SITE of FIG. 26A. FIG. 26D illustrates the complementarity of the nucleotide sequence of ADRBK1 BINDING SITE, designated SEQ ID:51737, to the nucleotide sequence of GAM2 RNA of FIG. 26A, designated SEQ ID:20604.

Yet another function of GAM26 is therefore inhibition of adrenergic, beta, receptor kinase 1 (ADRBK1), a gene which encodes an enzyme that regulates desensitization of b-adrenergic receptors and related GPCRs. Accordingly, utilities of GAM26 include diagnosis and treatment of the abovementioned diseases and clinical conditions. The function and utilities of ADRBK1 have been established by previous studies, as described hereinabove with reference to FIG. 26D.

Referring now to ADRBK1 BINDING SITE. Adrenergic beta, receptor kinase 1 (ADRBK1) is a target gene of GAM26, corresponding to GAM26-TARGET GENE of FIG. 26A. ADRBK1 BINDING SITE is a binding site found in an untranslated region of ADRBK1, corresponding to BINDING SITE of FIG. 26A. FIG. 26D illustrates the complementarity of the nucleotide sequence of ADRBK1 BINDING SITE, designated SEQ ID:51737, to the nucleotide sequence of GAM26 RNA of FIG. 26A, designated SEQ ID:20604.

An additional function of GAM26 is therefore inhibition of adrenergic, beta, receptor kinase 1 (ADRBK1), a gene which encodes an enzyme that regulates desensitization of b-adrenergic receptors and related GPCRs. Accordingly, utilities of GAM26 include diagnosis and treatment of the abovementioned diseases and clinical conditions. The function and utilities of ADRBK1 have been established by previous studies, as described hereinabove with reference to FIG. 26D.

Reference is now made to AKAP13 BINDING SITE. A kinase (PRKA) anchor protein 13 (AKAP13) is a target gene of GAM26, corresponding to GAM26-TARGET GENE of FIG. 26A. AKAP13 BINDING SITE is a binding site found in an untranslated region of AKAP13, corresponding to BINDING SITE of FIG. 26A. FIG. 26D illustrates the complementarity of the nucleotide sequence of AKAP13 BINDING SITE, designated SEQ ID:54490, to the nucleotide sequence of GAM26 RNA of FIG. 26A, designated SEQ ID:20604.

A further function of GAM26 is therefore inhibition of A kinase (PRKA) anchor protein 13 (AKAP13), a gene which encodes a protein that regulates subcellular localization of type II cAMP-dependent PKA. Accordingly, utilities of GAM26 include diagnosis and treatment of the abovementioned diseases and clinical conditions.

The function of AKAP13 has been established by previous studies. Gene map locus 15q24q25 A-kinase anchor proteins (AKAPs; see 602449), such as AKAP13, direct the activity of protein kinase A (PKA; see 176911) by tethering the enzyme near its physiologic substrates. AKAP13 is also known as LBC. Catalytic GDP-GTP exchange factors (GEFs), such as LBC, play an important role in regulating the Rho/Rac GTPase cycle. The Rho/Rac family of small GTPases mediates cytoskeletal reorganization, gene transcription, and cell cycle progression through unique signal transduction pathways. By probing a breast cancer expression library using an interaction cloning strategy for proteins that bind RXR (see 180245), Rubino et al. (1998) obtained a full-length cDNA encoding LBC, which they called BRX (breast cancer cDNA-encoded nuclear receptor-binding auxiliary protein). The deduced 1,428-amino acid BRX protein contains a region of identity to the LBC sequence identified by Toksoz and Williams (1994) that is preceded by 3 novel regions. A fifth, C-terminal region binds the estrogen receptor (ESR1; 133430). In addition to the tissues detected by Toksoz and Williams (1994), Northern blot analysis by Rubino et al. (1998) revealed BRX mRNA expression in reproductive tissues (ovary and placenta), and a 5.3-kb BRX transcript was detected in breast cancer cell lines, normal breast, and testis. Western blot and immunohistochemic analysis showed that BRX is expressed as a 170-kD protein in mammary epithelial cell lobules and terminal ducts. Binding analysis determined that BRX binds to ESR1, RXR, PPAR (170998), and THR (see 190120). Regions 4 and 5 of BRX were shown to bind independently to the ligand-binding domain near the C terminus of ESR1 without the requirement of other bridging proteins. Overexpression of BRX in the presence of estrogen augmented the activity of an estrogen response element. ESR activation by BRX could be inhibited by a dominant-negative mutant of CDC42 (116952). By genomic sequence and somatic cell hybrid analyses, Sterpetti et al. (1999) determined that proto-LBC and onco-LBC both contain N-terminal DH and PH domains; however, proto-LBC has a distinct C terminus absent in the oncoprotein. FISH with onco-LBC probes localized the LBC gene to 15q24-q25 and showed that onco-LBC represents a chimera derived from fusion with an unrelated sequence on 7q36. Northern blot analysis detected variably sized LBC transcripts and extended the known tissue distribution to spleen and a number of cancer cell lines. Immunoblot and thin-layer chromatography analysis showed that both proto- and onco-LBC can promote the formation of GTP-bound RHOA (ARHA; 165390). Mutation analysis indicated that the transforming activity of proto-LBC is increased by truncation of the C terminus, and that the DH and PH domains, but not the chromosome 7 sequence, are required for transformation. Immunoblot analysis determined that the proto-LBC form is in the membrane fraction, while the majority of the onco-LBC product is cytosolic, indicating that the C terminus may play a major role in the subcellular localization and regulation of LBC. Using FISH with onco-LBC probes, Sterpetti et al. (1999) localized the LBC gene to 15q24-q25 and showed that onco-LBC represents a chimera derived from fusion with an unrelated sequence on 7q36.

Full details of the abovementioned studies are described in the following publications, the disclosure of which are hereby incorporated by reference:

Rubino, D.; Driggers, P.; Arbit, D.; Kemp, L.; Miller, B.; Coso, O.; Pagliai, K.; Gray, K.; Gutkind, S.; Segars, J.: Characterization of Brx, a novel Dbl family member that modulates estrogen receptor action. Oncogene 16: 2513-2526, 1998. PubMed ID: 96271174. Sterpetti, P.; Hack, A. A.; Bashar, M. P.; Park, B.; Cheng, S. -D.; Knoll, J. H. M.; Urano, T.; Feig, L. A.; Toksoz, D.: Activation of the Lbc Rho exchange factor proto-oncogene by truncation of an extended C terminus that regulates transformation and targeting. Molec. Cell. Biol. 19: 1334-1345, 1999.

Further studies establishing the function and utilities of AKAP13 are found in John Hopkins OMIM database record ID 604686, and in references numbered 40-44 listed hereinbelow.

Reference is now made to AMD1 BINDING SITE. S-adenosylmethionine decarboxylase 1 (AMD1) is a target gene of GAM26, corresponding to GAM26-TARGET GENE of FIG. 26A. AMD1 BINDING SITE is a binding site found in an untranslated region of AMD1, corresponding to BINDING SITE of FIG. 26A. FIG. 26D illustrates the complementarity of the nucleotide sequence of AMD1 BINDING SITE, designated SEQ ID:57140, to the nucleotide sequence of GAM26 RNA of FIG. 26A, designated SEQ ID:20604.

Yet a further function of GAM26 is therefore inhibition of S-adenosylmethionine decarboxylase 1 (AMD1), a gene which encodes an enzyme that catalyzes the removal of the carboxylate group of S-adenosylmethionine in the polyamine biosynthesis pathway. Accordingly, utilities of GAM26 include diagnosis and treatment of the abovementioned diseases and clinical conditions.

The function of AMD1 has been established by previous studies. The polyamines spermine, spermidine, and putrescine are low molecular weight aliphatic amines essential for cellular proliferation and tumor promotion. Omithine decarboxylase (ODC; 165640) and S-adenosylmethionine decarboxylase (AdoMetDC) catalyze the rate-limiting steps in polyamine biosynthesis. A concordant rise in ODC and AdoMetDC activity is seen in various neoplastic conditions including colon cancer and benign colonic polyps. A rat cDNA clone for AdoMetDC was used by Radford et al (1987, 1989) in mouse-human somatic cell hybrid experiments to map the AMD gene to chromosomes 6 and X. They demonstrated that the gene on chromosome 6, symbolized AMD1, is not amplified in colon neoplasia. The sequence on X, symbolized AMD2, was localized to Xq22-q28 and may represent a pseudogene. That AMD2 is indeed a pseudogene was indicated by the findings of Maric et al. (1992) that the X-chromosome gene lacks introns which are present in the chromosome 6 gene. The gene on chromosome 6 encompasses at least 22 kb and comprises 9 exons and 8 introns, in contrast to the corresponding rat gene that has only 8 exons. Other aspects of the structure and organization were presented by Maric et al. (1992). Pulkka et al. (1993) characterized 2 AMD genes in the rat and localized both to rat chromosome 20 by mouse-rat somatic cell hybrids. They showed a high degree of conservation of sequence and structural organization in the coding portions but the 5-prime flanking regions were totally different Maric et al. (1995) characterized the AMD pseudogene on the X chromosome. It lacks all the introns present in AMD1 and has numerous mutations in the protein-coding region. By fluorescence in situ hybridization, they mapped AMD1 to 6q21-q22 and the pseudogene, which they referred to as AMD2, to Xq28.

Full details of the abovementioned studies are described in the following publications, the disclosure of which are hereby incorporated by reference:

Maric, S. C.; Crozat, A.; Janne, O. A.: Structure and organization of the human S-adenosylmethionine decarboxylase gene. J. Biol. Chem. 267: 18915-18923, 1992. PubMed ID: 1527020 2. Maric, S. C.; Crozat, A.; Louhimo, J.; Knuutila, S.; Janne, O. A.: The human S-adenosylmethionine decarboxylase gene: nucleotide sequence of a pseudogene and chromosomal localization of the active gene (AMD1) and the pseudogene (AMD2). Cytogenet. Cell Genet. 70: 195-199, 1995.

Further studies establishing the function and utilities of AMD1 are found in John Hopkins OMIM database record ID 180980, and in references numbered 45-49 listed hereinbelow.

Reference is now made to APP BINDING SITE. Amyloid beta (A4) precursor protein (protease nexin-II, Alzheimer dise (APP) is a target gene of GAM26, corresponding to GAM26-TARGET GENE of FIG. 26A. APP BINDING SITE is a binding site found in an untranslated region of APP, corresponding to BINDING SITE of FIG. 26A. FIG. 26D illustrates the complementarity of the nucleotide sequence of APP BINDING SITE, designated SEQ ID:62063, to the nucleotide sequence of GAM26 RNA of FIG. 26A, designated SEQ ID:20604.

Another function of GAM26 is therefore inhibition of amyloid beta (A4) precursor protein (protease nexin-II, Alzheimer dise (APP), a gene which encodes a protein that is associated with amyloidosis. Accordingly, utilities of GAM26 include diagnosis and treatment of the abovementioned diseases and clinical conditions.

The function of APP has been established by previous studies. APP, a widely expressed cell surface protein, is cleaved in the transmembrane region by gamma-secretase. Gamma-cleavage of APP produces the extracellular amyloid beta peptide of Alzheimer disease and releases an intracellular tail fragment Cao and Sudhof (2001) demonstrated that the cytoplasmic tail of APP forms a multimeric complex with the nuclear adaptor protein Fe65 (602709) and the histone acetyltransferase TIP60 (601409). This complex potently stimulates transcription via heterologous Gal4 or LexA DNA binding domains, suggesting that release of the cytoplasmic tail of APP by gamma-cleavage may function in gene expression.

Animal model experiments lend further support to the function of APP. Calhoun et al. (1998) studied the pattern of neuron loss in transgenic mice expressing mutant human APP with the 'Swedish mutation' (104760.0008). These mice develop APP-immunoreactive plaques, primarily in neocortex and hippocampus, progressively with age (Sturchler-Pierrat et al., 1997). Calhoun et al. (1998) showed that formation of amyloid plaques can lead to region-specific loss of neurons in the transgenic mouse. Neuron loss was observed primarily in the vicinity of plaques, but intraneuronal amyloidogenic APP processing could not be excluded as an additional cause. The extent of the observed loss was less than that reported in end-stage AD, possibly because overexpression of APP in the transgenic mouse has a neuroprotective effect. It is also likely that neuron loss would increase in these mice with further aging.

It is appreciated that the abovementioned anima model for APP is acknowledged by those skilled in the art as a scientifically valid animal model, as can be further appreciated from the publications sited hereinbelow.

Full details of the abovementioned studies are described in the following publications, the disclosure of which are hereby incorporated by reference:

Calhoun, E.; Wiederhold, K. -H.; Abramowski, D.; Phinney, A. L.; Probst, A.; Sturchler-Pierrat, C.; Staufenbiel, M.; Sommer, B.; Jucker, M.: Neuron loss in APP transgenic mice. Nature 395: 765-766, 1998.

Further studies establishing the function and utilities of APP are found in John Hopkins OMIM database record ID 104760, and in references numbered 50-148 listed hereinbelow.

Reference is now made to ARAF1 BINDING SITE. v-raf murine sarcoma 3611 viral oncogene homolog 1 (ARAF1) is a target gene of GAM26, corresponding to GAM26-TARGET GENE of FIG. 26A. ARAF1 BINDING SITE is a binding site found in an untranslated region of ARAF1, corresponding to BINDING SITE of FIG. 26A. FIG. 26D illustrates the complementarity of the nucleotide sequence of ARAF1 BINDING SITE, designated SEQ ID:63732, to the nucleotide sequence of GAM26 RNA of FIG. 26A, designated SEQ ID:20604.

Yet another function of GAM26 is therefore inhibition of v-raf murine sarcoma 3611 viral oncogene homolog 1 (ARAF1), a gene which encodes an enzyme that may play a critical role in cell growth and development, and is associated with angioimmunoblastic lymphadenopathy. Accordingly, utilities of GAM26 include diagnosis and treatment of the abovementioned diseases and clinical conditions.

The function of ARAF1 has been established by previous studies. By screening a mouse cDNA library with a v-raf oncogene probe, Huebner et al. (1986) also isolated a transforming raf-related cDNA, A-raf, that represented a gene distinct from RAF1. As an initial step in the analysis of this RAF1 related DNA, they isolated a human ARAF cDNA and used it to map the genes in mouse and man. The mouse gene cosegregated with the X chromosome in Chinese hamster-mouse hybrid cells. In humans, 2 independently segregating loci, designated ARAF1 and ARAF2, were mapped to chromosomes X and 7, respectively. (Huebner et al. (1986) had not conclusively shown that the ARAF2 locus on chromosome 7 is transcribed, and indeed the ARAF2 locus, now designated ARAF2P, has been shown to be a pseudogene (Lee et al., 1994).) The single X-linked ARAF locus of the mouse and the ARAF1 locus of man are actively transcribed in several mouse and human cell lines. Because of an 80% homology to RAF1 in its kinase domain, the authors speculated that the ARAF1 gene product may have serine/threonine-specific kinase activity. By in situ hybridization, ARAF1 was mapped to Xp21-q11, probably Xp13-p11. Popescu and Mark (1989) regionalized the gene to Xp11.4-p11.2 by in situ hybridization. Beck et al. (1987) deduced the complete 606-amino acid sequence of the human ARAF1 oncogene from the 2,453-nucleotide sequence of the cDNA. Avner et al (1987) found that in the mouse the A-raf oncogene is on the X chromosome, 10 to 17 cM proximal to the Hprt gene. The localization was considered compatible with the presence of the ARAF oncogene on the short arm of the X chromosome between the centromere and Xp21 in man. The RAF protooncogenes encode cytoplasmic protein serine/threonine kinases that play a critical role in cell growth and development. Araf1 in the mouse is expressed predominantly in urogenital tissues. Lee et al. (1994) demonstrated that the ARAF1 gene in the human comprises 16 exons encoded by a minimum of 10,776 nucleotides.

Full details of the abovementioned studies are described in the following publications, the disclose of which are hereby incorporated by reference:

Beck, T.; Huleihel M.; Gunnell, M.; Bonner, T. I.; Rapp, U. R.: The complete coding sequence of the human A-raf-1 oncogene and transforming activity of a human A-raf carrying retrovirus. Nucleic Acids Res. 15: 595-609, 1987. PubMed ID: 3029685 4. Lee, J. -E.; Beck, T. W.; Brennscheidt, U.; DeGennaro, L. J.; Rapp, U. R.: The complete sequence and promoter activity of the human A-raf-1 gene (ARAF1). Genomics 20: 43-55, 1994.

Further studies establishing the function and utilities of ARAF1 are found in John Hopkins OMIM database record ID 311010, and in numbered 149-154 listed hereinbelow.

Reference is now made to ASC BINDING SITE. Apoptosis-associated speck-like protein containing (ASC) is a target gene of GAM26, corresponding to GAM26-TARGET GENE of FIG. 26A. ASC BINDING SITE is a binding site found in an untranslated region of ASC, corresponding to BINDING SITE of FIG. 26A. FIG. 26D illustrates the complementarity of the nucleotide sequence of ASC BINDING SITE, designated SEQ ID:66821, to the nucleotide sequence of GAM26 RNA of FIG. 26A, designated SEQ ID:20604.

An additional function of GAM26 is therefore inhibition of apoptosis-associated speck-like protein containing (ASC), a gene which encodes a protein that is an adaptor protein with a caspase-associated recruitment domain motif; may act to promote apoptosis induced by etoposide. Accordingly, utilities, of GAM26 include diagnosis and treatment of the abovementioned diseases and clinical conditions.

The function of ASC has been established by previous studies. Western blot analysis by Masumoto et al. (1999) indicated that ASC may have proapoptotic activity by increasing the susceptibility of leukemia cell lines to apoptotic stimuli by anticancer drugs. Methylation-sensitive restriction PCR and methylation-specific PCR (MSP) analyses by Conway et al. (2000) indicated that silencing of TMS1 correlates with hypermethylation of the CpG island surrounding exon 1 and that overexpression of DNMT1 promotes hypermethylation and silencing of TMS1. Breast cancer cell lines, but not normal breast tissue, exhibited complete methylation of TMS1 and expressed no TMS1 message. Express ion of TMS1 in breast cancer cell lines inhibited growth and reduced the number of surviving colonies. Conway et al. (2000) concluded that TMS1 functions in the promotion of caspase-dependent apoptosis and that overexpression of TMS1 inhibits the growth of breast cancer cells. Using bisulfite genomic sequencing, Dnase I-hypersensitive site mapping, and chromatin immunoprecipitation, Stimson and Vertino (2002) showed that in normal fibroblasts, the TMS1 CpG island is composed of an unmethylated domain with distinct 5-prime and 3-prime boundaries. De novo methylation of the CpG island in cells overexpressing DNMT1 was accompanied by a loss of CpG island-specific hypersensitive site formation, localized hypoacetylation of histone H3 (see 601128) and H4 (see 602822), and gene silencing. Stimson and Vertino (2002) proposed the existence of protein-binding sites that demarcate the boundaries of TMS1 CpG islands in normal cells and that the boundaries are overcome by aberrant methylation, resulting in gene silencing.

Full details of the abovementioned studies are described in the following publications, the disclosure of which are hereby incorporated by reference:

Martinon, F.; Hofmann, K.; Tschopp, J.: The pyrin domain: a possible member of the death domain-fold family implicated in apoptosis and inflammation. Curr. Biol. 10: R118-R120, 2001. 3. Masumoto, J.; Taniguchi, S.; Ayukawa, K.; Sarvotham, H.; Kishino, T.; Niikawa, N.; Hidaka, E.; Katsuyama, T.; Higuchi, T.; Sagara, J.: ASC, a novel 22-kDa protein, aggregates during apoptosis of human promyelocytic leukemia HL-60 cells. J. Biol. Chem. 274: 33835-33838, 1999.

Further studies establishing the function and utilities of ASC are found in John Hopkins OMIM database record ID 606838, and in references numbered 155-159 listed hereinbelow.

Reference is now made to ATF4 BINDING SITE. Activating transcription factor 4 (tax-responsive enhancer element B67 (ATF4) is a target gene of GAM26, corresponding to GAM26-TARGET GENE of FIG. 26A. ATF4 BINDING SITE is a binding site found in an untranslated region of ATF4, corresponding to BINDING SITE of FIG. 26A. FIG. 26D illustrates the complementarity of the nucleotide sequence of ATF4 BINDING SITE, designated SEQ ID:67884, to the nucleotide sequence of GAM26 RNA of FIG. 26A, designated SEQ ID:20604.

A further function of GAM26 is therefore inhibition of activating transcription factor 4 (tax-responsive enhancer element B67 (ATF4), a gene which encodes a transcription factor that functions as a specific repressor of CRE-dependent transcription. Accordingly, utilities of GAM26 include diagnosis and treatment of the abovementioned diseases and clinical conditions.

The function of ATF4 has been established by previous studies. The cAMP response element (CRE) is an octanucleotide motif that mediates diverse transcriptional regulatory effects. By screening a Jurkat T-cell line expression library for the ability to bind CRE, Karpinski et al. (1992) isolated and characterized a full-length cDNA corresponding to ATF4, which they called CREB2 (CRE-binding protein-2). The predicted protein contains 351-amino acids. Northern blot analysis revealed that the 1.5-kb CREB2 mRNA was expressed in all human tumor cell lines and mouse organs tested. Unlike CREB (123810), which activates transcription from CRE-containing promoters, CREB2 functions as a specific repressor of CRE-dependent transcription. The transcriptional repressor activity resides within the C-terminal leucine zipper and basic domain region of the CREB2 protein.

Animal model experiments lend further support to the function of ATF4. Tanaka et al. (1998) used gene targeting to generate mice lacking Atf4. They found that Atf4-deficient mice exhibited severe microphthalmia. The Atf4-deficient eyes revealed a normal gross lens structure up to embryonic day 14.5, after which the lens degenerated due to apoptosis without the formation of lens secondary fiber cells. Retinal development was normal in the mutant mice. The lens-specific expression of Atf4 in the mutant mice led not only to the recovery of lens secondary fibers but also to the induction of hyperplasia of these fibers. Tanaka et al. (1998) concluded that ATF4 is essential for the later stages of lens fiber cell differentiation.

It is appreciated that the abovementioned animal model for ATF4 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Karpinski, B. A.; Morle, G. D.; Huggenvik, J.; Uhler, M. D.; Leiden, J. M.: Molecular cloning of human CREB-2: an ATF/CREB transcription factor that can negatively regulate transcription from the cAMP response element Proc. Nat. Acad. Sci. 89: 4820-4824, 1992. PubMed ID: 1534408 3. Tanaka, T.; Tsujimura, T.; Takeda, K.; Sugihara, A.; Maekawa, A.; Terada, N.; Yoshida, N.; Akira, S.: Targeted disruption of ATF4 discloses its essential role in the formation of eye lens fibres. Genes Cells 3; 801-810, 1998.

Further studies establishing the function and utilities of ATF4 are found in John Hopkins OMIM database record ID 604064, and in references numbered 160-163 listed hereinbelow.

Reference is now made to ATP1A1 BINDING SITE. ATPase, Na+/K+transporting, alpha 1 polypeptide (ATP1A1) is a target gene of GAM26, corresponding to GAM26-TARGET GENE of FIG. 26A. ATP1A1 BINDING SITE is a binding site found in an untranslated region of ATP1A1, corresponding to BINDING SITE of FIG. 26A. FIG. 26D illustrates the complementarity of the nucleotide sequence of ATP1A1 BINDING SITE, designated SEQ ID:68935, to the nucleotide sequence of GAM26 RNA of FIG. 26A, designated SEQ ID:20604.

Yet a further function of GAM26 is therefore inhibition of ATPase, Na+/K+ transporting, alpha 1 polypeptide (ATP1A1), a gene which encodes an enzyme that catalyzes the hydrolysis of ATP coupled with the exchange of Na+/K+ ions across the plasma membrane. Accordingly, utilities of GAM26 include diagnosis and treatment of the abovementioned diseases and clinical conditions.

The function of ATP1A1 has been established by previous studies. Na,K-ATPase (Na(+),K(+)-activated ATP phosphohydrolase; EC 3.6.1.3) is an integral membrane protein responsible for establishing and maintaining the electrochemical gradients of Na and K ions across the plasma membrane. As these gradients are essential for osmoregulation, for sodium-coupled transport of a variety of organic and inorganic molecules, and for electrical excitability of nerve and muscle, the enzyme plays an essential role in cellular physiology. It is composed of 2 subunits, a large catalytic subunit (alpha) and a smaller glycoprotein subunit (beta) of unknown function. (See 182330.) Biochemical studies have demonstrated the existence of 2 isoforms of the catalytic subunit, alpha and alpha(+). Kidney contains predominantly the alpha form, whereas both alpha and alpha(+) are found in brain, adipose tissue, and skeletal muscle. A third isoform, alpha-III, has been identified in rat brain. Studies by Shull and Lingrel (1987) demonstrated that the catalytic subunit of Na,K-ATPase is encoded by multiple genes. Shull and Lingrel (1987) identified separate genes encoding the alpha and alpha(+) isoforms. These genes were called alpha-A and alpha-B (ATP1A2; 182340), respectively. In addition, they isolated 2 other genes, termed alpha-C and alpha-D, one of which is physically linked to the alpha(+) gene; these genes showed nucleotide and deduced amino acid homology to the catalytic subunit cDNA sequences but did not correspond to any previously identified isoforms.

Animal model experiments lend further support to the function of ATP1A1. To determine the functional roles of the ATP1A1 and ATP1A2 proteins, James et al. (1999) generated mice with targeted disruption of either the Atp1a1 or Atp1a2 gene. Hearts from heteroygous Atp1a2 mice were hypercontractile as a result of increased calcium transients during the contractile cycle. In contrast, hearts from heterozygous Atp1a1 mice were hypocontractile. The different functional roles of these 2 proteins were further demonstrated since inhibition of the Atp1a2 protein with ouabain increased the contractility of heterozygous Atp1a1 hearts.

These results illustrated specific role for the ATP1A2 protein in calcium signaling during cardiac contraction.

It is appreciated that the abovementioned animal model for ATP1A1 is acknowledged by those skilled in the art as a scientifically valid animal model as can be further appreciated from the publications sited hereinbelow.

Full details of the abovementioned studies are described in the following publications, the disclosure of which are hereby incorporated by reference:

Shull, M. M.; Lingrel, J. B.: Multiple genes encode the human Na+,K+-ATPase catalytic subunit. Proc. Nat. Acad. Sci. 84: 4039-4043, 1987. PubMed ID: 3035563 8.

James, P. F.; Grupp, I. L.; Grupp, G.; Woo, A. L.; Askew, G. R.; Croyle, M. L.; Walsh, R. A.; Lingrel, J. B.: Identification of a specific role for the Na,K-ATPase alpha-2 isoform as a regulator of calcium in the heart Molec. Cell 3: 555-563, 1999.

Further studies establishing the function and utilities of ATP1A1 are found in John Hopkins OMIM database record ID 182310, and in references numbered 164-178 listed hereinbelow.

Referring now to ATP1A1 BINDING SITE. ATPase, Na+/K+ transporting, alpha 1 polypeptide (ATP1A1) is a target gene of GAM26, corresponding to GAM26-TARGET GENE of FIG. 26A. ATP1A1 BINDING SITE is a binding site found in an untranslated region of ATP1A1, corresponding to BINDING SITE of FIG. 26A. FIG. 26D illustrates the complementarity of the nucleotide sequence of ATP1A1 BINDING SITE, designated SEQ ID:68949, to the nucleotide sequence of GAM26 RNA of FIG. 26A, designated SEQ ID:20604.

Another function of GAM26 is therefore inhibition of ATPase, Na+/K+ transporting, alpha 1 polypeptide (ATP1A1), a gene which encodes a Enzyme that catalyzes the hydrolysis of ATP coupled with the exchange of Na+/K+ ions across the plasma membrane. Accordingly, utilities of GAM26 include diagnosis and treatment of the abovementioned diseases and clinical conditions. The function and utilities of ATP1A1 have been established by previous studies, as described hereinabove with reference to FIG. 26D.

Referring now to ATP1A1 BINDING SITE. ATPase, Na+/K+ transporting, alpha 1 polypeptide (ATP1A1) is a target gene of GAM26, corresponding to GAM26-TARGET GENE of FIG. 26A. ATP1A1 BINDING SITE is a binding site found in an untranslated region of ATP1A1, corresponding to BINDING SITE of FIG. 26A. FIG. 26D illustrates the complementarity of the nucleotide sequence of ATP1A1 BINDING SITE, designated SEQ ID:68961, to the nucleotide sequence of GAM26 RNA of FIG. 26A, designated SEQ ID:20604.

Yet another function of GAM26 is therefore inhibition of ATPase, Na+/K+ transporting, alpha 1 polypeptide (ATP1A1), a gene which encodes a Enzyme that catalyzes the hydrolysis of ATP coupled with the exchange of Na+/K+ ions across the plasma membrane. Accordingly, utilities of GAM26 include diagnosis and treatment of the abovementioned diseases and clinical conditions. The function and utilities of ATP1A1 have been established by previous studies, as described hereinabove with reference to FIG. 26D.

Reference is now made to ATP2B2 BINDING SITE. ATPase, Ca++ transporting, plasma membrane 2 (NOTE: redefinition of sy (ATP2B2) is a target gene of GAM26, corresponding to GAM26-TARGET GENE of FIG. 26A. ATP2B2 BINDING SITE is a binding site found in an untranslated region of ATP2B2, corresponding to BINDING SITE of FIG. 26A. FIG. 26D illustrates the complementarity of the nucleotide sequence of ATP2B2 BINDING SITE, designated SEQ ID:69717, to the nucleotide sequence of GAM26 RNA of FIG. 26A, designated SEQ ID:20604.

An additional function of GAM26 is therefore inhibition of ATPase, Ca++ transporting, plasma membrane 2 (NOTE: redefinition of sy (ATP2B2), a gene which encodes an enzyme that catalyzes the hydrolysis of ATP coupled with the transport of calcium out of the cell. Accordingly, utilities of GAM126 include diagnosis and treatment of the abovementioned diseases and clinical conditions.

The function of ATP2B2 has been established by previous studies. The plasma membrane Ca(2+)-transporting ATPase designated as PMCA4 was mapped to 1q25-q32 by Olson et al. (1991) by 3 independent methods: Southern analysis of human-rodent somatic cell hybrids, in situ hybridization of human metaphase spreads, and genetic linkage analysis in the CEPH pedigrees. No evidence was obtained for multiple copies of the gene at this locus; however, a cross-hybridizing sequence was detected on Xq13-qter at low stringency. Further studies were required to determine whether the X-chromosomal sequence represented another member of the PMCA gene family.

Full details of the abovementioned studies are described in the following publications, the disclosure of which are hereby incorporated by reference:

Olson, S.; Wang, M. G.; Carafoli, E.; Strehler, E. E.; McBride, O. W.: Localization of two genes encoding plasma membrane Ca(2+)-transporting ATPases to human chromosomes 1q25-32 and 12q21-23. Genomics 9: 629-641, 1991.

Further studies establishing the function and utilities of ATP2B2 are found in John Hopkins OMIM database record ID 108732, and in references numbered 180 listed hereinbelow.

Reference is now made to DR1 BINDING SITE. Down-regulator of transcription 1, TBP-binding (negative cofactor 2) (DR1) is a target gene of GAM26, corresponding to GAM26-TARGET GENE of FIG. 26A. DR1 BINDING SITE is a binding site found in an untranslated region of DR1, corresponding to BINDING SITE of FIG. 26A. FIG. 26D illustrates the complementarity of the nucleotide sequence of DR1 BINDING SITE, designated SEQ ID:69717, to the nucleotide sequence of GAM26 RNA of FIG. 26A, designated SEQ ID:20604.

A further function of GAM26 is therefore inhibition of down-regulator of transcription 1, TBP-binding (negative cofactor 2) (DR1), a gene which encodes a protein that influences functional repression of both activated and basal transcription of class II genes. Accordingly, utilities of GAM26 include diagnosis and treatment of the abovementioned diseases and clinical conditions.

The function of DR1 has been established by previous studies. Several phosphoproteins are known to interact with TBP, the TATA box-binding protein (600075). Among them, DR1 is a TBP-associated phosphoprotein that represses both basal and activated levels of transcription. Inostroza et al. (1992) biochemically characterized DR1 purified from HeLa cells and cloned the human gene from a HeLa cell cDNA library. The gene encodes a 176-amino acid polypeptide of 19 kD. They showed that DR1 is phosphorylated in vivo and that phosphorylation of DR1 affected its interaction with TBP. The DR1 protein contains 3 domains: a histone fold motif at the N terminus, a TBP-binding domain, and a glutamine- and alanine-rich region. Mermelstein et al. (1996) showed that the histone fold motif of DR1 is required for DR1-DRAP1 interaction. Both the TBP-binding domain and the glutamine- and alanine-rich region are required for DR1-mediated repression of transcription. Yeung et al. (1997) demonstrated that the TBP-binding domain has 2 functions: it tethers the DR1 repressor complex to the promoter by interacting with TBP, and it is required for the coepression activity of DRAP1, although it is nor required for DR1-DRAP1 interaction. Yeung et al. (1997) determined that the glutamine- and alanine-rich region is the repressor domain of DR1 and that this domain interacts with TBP. Goppelt et al. (1996) proposed that binding of DR1 repressor complexes to TBP-promoter complexes establishes a mechanism in which an altered DNA conformation, together with the formation of hi her order complexes, inhibits the assembly or the preinitiation complex and controls the rate of RNA polymerase II transcription.

Full details of the abovementioned studies are described in the following publications, the disclosure of which are hereby incorporated by reference:

Nostroza, nostroza, J. A.; Mermeistein, F. H.; Ha, I.; Lane, W. S.; Reinberg, D.: Dr1, a TATA-binding protein-associated phosphoprotein and inhibitor of class II gene transcription. Cell 70: 477-489, 1992. PubMed ID: 1339312 5. Mermelstein, F.; Yeung, K.; Cao, J.; Inostroza, J. A.; Erdjument-Bromage, H.; Eagelson, K.; Landsman, D.; Levitt, P.; Tempst, P.; Reinberg, D.: Requirement of a corepressor for Dr1-mediated repression of transcription. Genes Dev. 10: 1033-1048, 1996.

Further studies establishing the function and utilities of DR1 are found in John Hopkins OMIM database record ID 601482, and in references numbered 185-193 listed hereinbelow.

Referring now to ATP2B2 BINDING SITE. ATPase, Ca++ transporting, plasma membrane 2. (NOTE: redefinition of sy (ATP2B2) is a target gene of GAM26, corresponding to GAM26-TARGET GENE of FIG. 26A. ATP2B2 BINDING SITE is a binding site found in an untranslated region of ATP2B2, corresponding to BINDING SITE of FIG. 26A. FIG. 26D illustrates the complementarity of the nucleotide sequence of ATP2B2 BINDING SITE, designated SEQ ID:69718, to the nucleotide sequence of GAM26 RNA of FIG. 26A, designated SEQ ID:20604.

Yet a further function of GAM26 is therefore inhibit on of ATPase, Ca++ transporting, plasma membrane 2 (NOTE: redefinition of sy (ATP2B2), a gene which encodes an enzyme that catalyzes the hydrolysis of ATP coupled with the transport of calcium out of the cell. Accordingly, utilities of GAM26 include diagnosis and treatment of the abovementioned diseases and clinical conditions. The function and utilities of ATP2B2 have been established by previous studies, as described hereinabove with reference to FIG. 26D.

Referring now to ATP2B2 BINDING SITE. ATPase, Ca++ transporting, plasma membrane 2 (NOTE: redefinition of sy (ATP2B2) is a target gene of GAM26, corresponding to GAM26-TARGET GENE of FIG. 26A. ATP2B2 BINDING SITE is a binding site found in an untranslated region of ATP2B2, corresponding to BINDING SITE of FIG. 26A. FIG. 26D illustrates the complementarity of the nucleotide sequence of ATP2B2 BINDING SITE, designated SEQ ID:69745, to the nucleotide sequence of GAM26 RNA of FIG. 26A, designated SEQ ID:20604.

Another function of GAM26 is therefore inhibition of ATPase, Ca++ transporting, plasma membrane 2 (NOTE: redefinition of sy (ATP2B2), a gene which encodes an enzyme that catalyzes the hydrolysis of ATP coupled with the transport of calcium out of the cell. Accordingly, utilities of GAM126 include diagnosis and treatment of the abovementioned diseases and clinical conditions. The function and utilities of ATP2B2 have been established by previous studies, as described hereinabove with reference to FIG. 26D.

Referring now to DR1 BINDING SITE. Down-regulator of transcription 1, TBP-binding (negative cofactor 2) (DR1) is a target gene of GAM26, corresponding to GAM26-TARGET GENE of FIG. 26A. DR1 BINDING SITE is a binding site found in an untranslated region of DR1, corresponding to BINDING SITE of FIG. 26A. FIG. 26D illustrates the complementarity of the nucleotide sequence of DR1 BINDING SITE, designated SEQ ID:69745, to the nucleotide sequence of GAM26 RNA of FIG. 26A, designated SEQ ID:20604.

Yet another function of GAM26 is therefore inhibition of down-regulator of transcription 1, TBP-1-binding (negative cofactor 2) (DR1), a gene which encodes a protein that influences functional repression of both activated and basal transcription of class II genes. Accordingly, utilities of GAM26 include diagnosis and treatment of the abovementioned diseases and clinical conditions. The function and utilities of DR1 have been established by previous studies, as described hereinabove with reference to FIG. 26D.

Referring now to ATP2B2 BINDING SITE. ATPase, Ca++ transporting, plasma membrane 2 (NOTE: redefinition of sy (ATP2B2) is a target gene of GAM26, corresponding to GAM26-TARGET GENE of FIG. 26A. ATP2B2 BINDING SITE is a binding site found in an untranslated region of ATP2B2, corresponding to BINDING SITE of FIG. 26A. FIG. 26D illustrates the complementarity of the nucleotide sequence of ATP2B2 BINDING SITE, designated SEQ ID:69749, to the nucleotide sequence of GAM26 RNA of FIG. 26A, designated SEQ ID:20604.

An additional function of GAM26 is therefore inhibition of ATPase, Ca++ transporting, plasma membrane 2 (NOTE: redefinition of sy (ATP2B2), a gene which encodes an enzyme that catalyzes the hydrolysis of ATP coupled with the transport of calcium out of the cell. Accordingly, utilities of GAM26 include diagnosis and treatment of the abovementioned diseases and clinical conditions. The function and utilities of ATP2B2 have been established by previous studies, as described hereinabove with reference to FIG. 26D.

Reference is now made to AUP1 BINDING SITE. Ancient ubiquitous protein 1 (AUP1) is a target gene of GAM26, corresponding to GAM26-TARGET GENE of FIG. 26A. AUP1 BINDING SITE is a binding site found in an untranslated region of AUP1, corresponding to BINDING SITE of FIG. 26A. FIG. 26D illustrates the complementarity of the nucleotide sequence of AUP1 BINDING SITE, designated SEQ ID:72273, to the nucleotide sequence of GAM26 RNA of FIG. 26A, designated SEQ ID:20604.

A further function of GAM26 is therefore inhibition of ancient ubiquitous protein 1 (AUP1), a gene which encodes a protein that is an ubiquitously expressed protein. Accordingly, utilities of GAM26 include diagnosis and treatment of the abovementioned diseases and clinical conditions.

The function of AUP1 has been established by previous studies. While searching for genes on mouse chromosome 6 between microsatellite markers D6Mit5 and D6Mit21, Jang et al. (1996) found a nonrepetitive 0.7-kb fragment that hybridized to human, cat, and dog DNAs on a zoo blot. Using this fragment as a probe, they cloned cDNAs from mouse neonatal brain and adult mouse testis cDNA libraries. Jang et al. (1996) sequenced overlapping cDNAs and found an open reading frame of 410 amino acids with putative secretion signal sequence at the N terminals and a domain with homology to the 'ancient conserved region' of the ARCN1 (600820) gene. They called the new gene AUP1, for ancient ubiquitous protein-1. Northern blot analysis in the mouse revealed a 1.5-kb Aup1 transcript in all adult tissues tested and in fetal samples from days E10 to E14. By database analysis, Jang et al. (1996) revealed the existence of a *Caenorhabditis elegans* homolog, hypothetical protein F44b9, which has 35% amino acid identity to mouse Aup1. With numerous overlapping EST sequences, Jang et al. (1996) identified a human homolog of mouse Aup1.

Full details of the abovementioned studies are described in the following publications, the disclosure of which are hereby incorporated by reference:

Jang, W.; Weber, J. S.; Bashir, R.; Bushby, K.; Meisler, M. H.: Aup1, a novel gene on mouse chromosome 6 and human chromosome 2p13. Genomics 36: 366-368, 1996.

Further studies establishing the function and utilities of AUP1 are found in John Hopkins OMIM database record ID 602434, and in references numbered 194 listed hereinbelow.

Referring now to AUP1 BINDING SITE. Ancient ubiquitous protein 1 (AUP1) is a target gene of GAM26, corresponding to GAM26-TARGET GENE of FIG. 26A. AUP1 BINDING SITE is a binding site found in an untranslated region of AUP1, corresponding to BINDING SITE of FIG. 26A. FIG. 26D illustrates the complementarity of the nucleotide sequence of AUP1 BINDING SITE, designated SEQ ID:72277, to the nucleotide sequence of GAM26 RNA of FIG. 26A, designated SEQ ID:20604.

Yet a further function of GAM26 is therefore inhibition of ancient ubiquitous protein 1 (AUP1), a gene which encodes a protein that is a ubiquitously expressed protein. Accordingly, utilities of GAM26 include diagnosis and treatment of the abovementioned diseases and clinical conditions. The function and utilities of AUP1 have been established by previous studies, as described hereinabove with reference to FIG. 26D.

Reference is now made to BCL11B BINDING SITE. B-cell CLL/lymphoma 11B (zinc finger protein) (BCL11B) is a target gene of GAM26, corresponding to GAM26-TARGET GENE of FIG. 26A. BCL11B BINDING SITE is a binding site found in an untranslated region of BCL11B, corresponding to BINDING SITE of FIG. 26A. FIG. 26D illustrates the complementarity of the nucleotide sequence of BCL11B BINDING SITE, designated SEQ ID:78295, to the nucleotide sequence of GAM26 RNA of FIG. 26, designated SEQ ID:20604.

Another function of GAM26 is therefore inhibition of B-cell CLL/lymphoma 11B (zinc finger protein) (BCL11B), a gene which encodes a protein that is implicated in mouse and human leukemias and is associated with T-cell leukemia/lymphoma. Accordingly, utilities of GAM26 include diagnosis and treatment of the abovementioned diseases and clinical conditions.

The function of BCL11B has been established by previous studies. BCL11A (606558) is a highly conserved gene across a wide range of species and is implicated in mouse and human leukemias. By database analysis, Satterwhite et al. (2001) identified a human homolog of BCL11A, designated BCL11B. The deduced 823-amino acid BCL11B protein is 61% identical to BCL11A overall but 95% identical in the zinc finger domains. It is as 86% identical to mouse Ctip2. Like BCL11A, BCL11B has a large 5-prime CpG island. Northern blot analysis detected expression in malignant T-cell lines derived from patients with adult T-cell leukemia/lymphoma but not in any malignant B-cell lines examined.

Full details of the abovementioned studies are described in the following publications, the disclosure of which are hereby incorporated by reference:

Satterwhite, E.; Sonoki, T.; Willis, T. G.; Harder, L.; Nowak, R.; Arriola, E. L.; Liu, H.; Price, H. P.; Gesk, S.; Steinemann, D.; Schlegelberger, B.; Oscier, D. G.; Siebert, R.; Tucker, P. A.; Dyer, M. J. S.: The BCL11 gene family: involvement of BCL11A in lymphoid malignancies. Blood 98: 3413-3420, 2001.

Further studies establishing the function and utilities of BCL11B are found in John Hopkins OMIM database record ID 606558, and in references numbered 195 listed hereinbelow.

Referring now to BCL11B BINDING SITE. B-cell CLL/lymphoma 11B (zinc finger protein) (BCL11B) is a target gene of GAM26, corresponding to GAM26-TARGET GENE of FIG. 26A. BCL11B BINDING SITE is a binding site found in an untranslated region of BCL11B, corresponding to BINDING SITE of FIG. 26A. FIG. 26D illustrates the complementarity of the nucleotide sequence of BCL11B BINDING SITE, designated SEQ ID:78304, to the nucleotide sequence of GAM26 RNA of FIG. 26A, designated SEQ ID:20604.

Yet another function of GAM26 is therefore inhibition of B-cell CLL/lymphoma 11B (zinc finger protein) (BCL11B), a gene which encodes a protein that is implicated in mouse and human leukemias is associated with T-cell leukemia/lymphoma. Accordingly, utilities of GAM26 include diagnosis and treatment of the abovementioned diseases and clinical conditions. The function and utilities of BCL11B have been established by previous studies, as described hereinabove with reference to FIG. 26D.

Referring now to BCL11B BINDING SITE. B-cell CLL/lymphoma 11B (zinc finger protein) (BCL11B) is a target gene of GAM26, corresponding to GAM26-TARGET GENE of FIG. 26A. BCL11B BINDING SITE is a binding site found in an untranslated region of BCL11B, corresponding to BINDING SITE of FIG. 26A. FIG. 26D illustrates the complementarity of the nucleotide sequence of BCL11B BINDING SITE, designated SEQ ID:78304, to the nucleotide sequence of GAM26 RNA of FIG. 26A, designated SEQ ID:20604.

An additional function of GAM26 is therefore inhibition of B-cell CLL/lymphoma 11B (zinc finger protein) (BCL11B), a gene which encodes a protein that is implicated in mouse and human leukemias and is associated with T-cell leukemia/lymphoma. Accordingly, utilities of GAM26 include diagnosis and treatment of the abovementioned diseases and clinical conditions. The function and utilities of BCL11B have been established by previous studies, as described hereinabove with reference to FIG. 26D.

Referring now to BCL11B BINDING SITE. B-cell CLL/lymphoma 11B (zinc finger protein) (BCL11B) is a target gene of GAM26, corresponding to GAM26-TARGET GENE of FIG. 26A. BCL11B BINDING SITE is a binding site found in an untranslated region of BCL11B, corresponding to BINDING SITE of FIG. 26A. FIG. 26D illustrates the complementarity of the nucleotide sequence of BCL11B BINDING SITE, designated SEQ ID:78310, to the nucleotide sequence of GAM26 RNA of FIG. 26A, designated SEQ ID:20604.

A further function of GAM26 is therefore inhibition of B-cell CLL/lymphoma 11B (zinc finger protein) (BCL11B), a gene which encodes a protein that is implicated in mouse and human leukemias and is associated with T-cell leukemia/lymphoma. Accordingly, utilities of GAM26 include diagnosis and treatment of the abovementioned diseases and clinical conditions. The function and utilities of BCL11B have been established by previous studies, as described hereinabove with reference to FIG. 26D.

Referring now to BCL11B BINDING SITE. B-cell CLL/lymphoma 11B (zinc finger protein) (BCL11B) is a target gene of GAM26, corresponding to GAM26-TARGET GENE of FIG. 26A. BCL11B BINDING SITE is a binding site found in an untranslated region of BCL11B, corresponding to BINDING SITE of FIG. 26A. FIG. 26D illustrates the complementarity of the nucleotide sequence of BCL11B BINDING SITE, designated SEQ ID:78336, to the nucleotide sequence of GAM26 RNA of FIG. 26A, designated SEQ ID:20604.

Yet a further function of GAM26 is therefore inhibition of B-cell CLL/lymphoma 11B (zinc finger protein) (BCL11B), a gene which encodes a protein that is implicated in mouse and human leukemias and is associated with T-cell leukemia/lymphoma. Accordingly, utilities of GAM26 include diagnosis and treatment of the abovementioned diseases and clinical conditions. The function and utilities of BCL11B have been established by previous studies, as described hereinabove with reference to FIG. 26D.

Reference is now made to BCL7B BINDING SITE. B-cell CLL/lymphoma 7B (BCL7B) is a target gene of GAM26, corresponding to GAM26-TARGET GENE of FIG. 26A. BCL7B BINDING SITE is a binding site found in an untranslated region of BCL7B, corresponding to BINDING SITE of FIG. 26A. FIG. 26D illustrates the complementarity of the nucleotide sequence of BCL7B BINDING SITE, designated SEQ ID:79353, to the nucleotide sequence of GAM26 RNA of FIG. 26A, designated SEQ ID:20604.

Another function of GAM26 is therefore inhibition of B-cell CLL/lymphoma 7B (BCL7B), a gene which encodes a protein that is of yet unknown function and is associated with Williams-Beuren syndrome. Accordingly, utilities of GAM26 include diagnosis and treatment of the abovementioned diseases and clinical conditions.

The function of BCL7B has been established by previous studies. Meng et al. (1998) constructed a physical map encompassing the 1.5-Mb region of chromosome 7q11.23 that is commonly deleted in Williams-Beuren syndrome (WBS; 194050). They identified 3 genes in this region, including BCL7B, which contains 6 exons. By EST database searching, screening of a liver cDNA library, and sequencing, they cloned a BCL7B cDNA encoding deduced 202-amino acid protein that shows high homology to the BCL7A gene (601406) which was cloned from a complex chromosomal translocation in Burkitt lymphoma cell lines. BCL7B is highly conserved from C. elegans to human, suggesting that it has been conserved through evolution.

Full detail of the abovementioned studies are described in the following publications, the disclosure of which are hereby incorporated by reference:
Jadayel, D. M.; Osborne, L. R.; Coignet, L. J. A.; Zani, V. J.; Tsui L. -C.; Scherer, S. W.; Dyer, M. J. S.: The BCL7 gene family: deletion of BCL7B in Williams syndrome. Gene 224: 35-44, 1998; PubMed ID: 9931421 2. Meng, X.; Lu, X.; Li, Z.; Green, E. D.; Massa, H.; Trask, B. J.; Morris, C. A.; Keating, M. T.: Complete physical map of the common deletion region in Williams syndrome and identification and characterization of three novel genes. Hum. Genet. 103: 590-599, 1998.

Further studies establishing the function and utilities of BCL7B are found in John Hopkins OMIM database record ID 605846, and in references numbered 196-197 listed hereinbelow.

Reference is now made to BCR BINDING SITE. Breakpoint cluster region (BCR) is a target gene of GAM26, corresponding to GAM26-TARGET GENE of FIG. 26A. BCR BINDING SITE is a binding site found in an untranslated region of BCR, corresponding to BINDING SITE of FIG. 26A. FIG. 26D illustrates the complementarity of the nucleotide sequence of BCR BINDING SITE, designated SEQ ID:79756, to the nucleotide sequence of GAM26 RNA of FIG. 26A, designated SEQ ID:20604.

Yet another function of GAM26 is therefore inhibition of breakpoint cluster region (BCR), a gene which encodes a protein that is a serine/threonine kinase that involves in the t(9;22) translocation (Philadelphia chromosome) and is associated with chronic myeloid leukemia (cml), acute myeloid leukemia (aml), acute lymphoblastic leukemia (all). Accordingly, utilities of GAM26 include diagnosis and treatment of the abovementioned diseases and clinical conditions.

The function of BCR has been established by previous studies. The normal BCR gene occupies a region of about 135 kb on chromosome 22. It is expressed as mRNAs of 4.5- and 6.7-kb, which apparently encode for the same cytoplasmic 160-kD protein, and contains 23 exons as well as an unusual inverted repeat flanking the first exon. The BCR protein reportedly contains a unique serine/threonine kinase activity and at least two SH2 binding sites encoded in its first exon and a C-terminal domain that functions as a GTPase activating protein for p21(rac) (Diekmann et al., 1991); see rac serine/threonine protein kinase (164730). Chissoe et al. (1995) sequenced the complete BCR gene and greater than 80% of the human ABL gene, which are both involved in the t(9;22) translocation (Philadelphia chromosome) associated with more than 90% of chronic myelogenous leukemia, 25 to 30% of adult and 2 to 10% of childhood acute lymphoblastic leukemia, and rare cases of acute myelogenous leukemia. Comparison of the gene with its cDNA sequence revealed the positions of 23 BCR exons and putative alternative BCR first and second exons. From the sequence of 4 newly studied Philadelphia chromosome translocations and a review of several other previously sequenced breakpoints, Chissoe et al. (1995) could discern no consistent breakpoint features. No clear-cut mechanism for Philadelphia chromosome translocation was evident. Because tyrosine kinase activity is essential to the transforming function of BCR-ABL, Druker et al. (2001) reasoned that an inhibitor of the kinase may be an effective treatment for CML. They found that indeed a tyrosine kinase inhibitor (STI571) was well tolerated and had significant antileukemic activity in patients with CML in whom treatment with standard chemotherapy had failed. This experience demonstrated the potential for the development of anticancer drugs based on the specific molecular abnormality present in a human cancer.

Animal model experiments lend further support to the function of BCR. Cancer is thought to arise from multiple genetic events that establish irreversible malignancy. A different mechanism might be present in certain leukemias initiated by a chromosomal translocation. Huettner et al. (2000) adopted a new approach to determine if ablation of the genetic abnormality is sufficient for reversion. They generated a conditional transgenic model of BCR-ABL-induced leukemia. The most common form of the product of the fusion gene, p210 BCR-ABL1, is found in more than 90% of patients with chronic myelogenous leukemia and in up to 15% of adult patients with de novo acute lymphoblastic leukemia. Efforts to establish a useful transgenic model had been hampered by embryonic lethality when the oncogene is expressed during embryogenesis, by reduced penetrance, or by extremely long latency. Huettner et al. (2000) used the 'knock-in' approach to induce leukemia by p190 BCR-ABL1 (Castellanos et al., 1997). Lethal leukemia developed within an acceptable time frame in all animals, and complete remission was achieved by suppression of BCR-ABL1 expression, even after multiple rounds of induction and reversion. The results demonstrated that BCR-ABL1 is required for both induction and maintenance of leukemia. The findings suggested that complete and lasting remissions can be achieved if the genetic abnormality is abolished or silenced before secondary mutations are acquired. The results have implications for therapies that directly target leukemia oncogenes, with a relevant example being the use of BCR-ABL1-specific tyrosine kinase inhibitors.

It is appreciated that the abovementioned animal model for BCR is acknowledged by those skilled in the art as a scientifically valid animal model, as can be further appreciated from the publications sited hereinbelow.

Full details of the abovementioned studies are described in the following publications, the disclosure of which are hereby incorporated by reference:

Chissoe, S. L.; Bodenteich, A.; Wang, Y. -F.; Wang, Y. -P.; Burian, D.; Clifton, S. W.; Crabtree, J.; Freeman, A.; Iyer, K.; Jian, L.; Ma, Y.; McLaury, H. -J.; Pan, H. -Q.; Sarhan, O. H.; Toth, S.; Wang, Z.; Zhang, G.; Heisterkamp, N.; Groffen, J.; Roe, B. A.: Sequence and analysis of the human ABL gene, the BCR gene, and regions involved in the Philadelphia chromosomal translocation. Genomics 27: 67-82, 1995. PubMed ID: 7665185 31. Huettner, C. S.; Zhang, P.; Van Etten, R. A.; Tenen, D. G.: Reversibility of acute B-c ell leukaemia induced by BCR-ABL1. Nature Genet. 24: 57-60, 2000.

Further studies establishing the function and utilities of BCR are found in John Hopkins OMIM database record ID 151410, and in references numbered 198-267 listed hereinbelow.

Referring now to BCR BINDING SITE. Breakpoint cluster region (BCR) is a target gene of GAM26, corresponding to GAM26-TARGET GENE of FIG. 26A. BCR BINDING SITE is a binding site found in an untranslated region of BCR, corresponding to BINDING SITE of FIG. 26A. FIG. 26D illustrates the complementarity of the nucleotide sequence of BCR BINDING SITE, designated SEQ ID:79756, to the nucleotide sequence of GAM26 RNA of FIG. 26A, designated SEQ ID:20604.

An additional function of GAM26 is therefore inhibition of breakpoint cluster region (BCR), a gene which encodes a protein that is a serine/threonine kinase that involves in the t(9;22) translocation (Philadelphia chromosome) and is associated with chronic myeloid leukemia (cml), acute myeloid leukemia (aml), acute lymphoblastic leukemia (all). Accordingly, utilities of GAM26 include diagnosis and treatment of the abovementioned diseases and clinical conditions. The function and utilities of BCR have been established by previous studies, as described hereinabove with reference to FIG. 26D.

Referring now to BCR BINDING SITE. Breakpoint cluster region (BCR) is a target gene of GAM26, corresponding to GAM26-TARGET GENE of FIG. 26A. BCR BINDING SITE is a binding site found in an untranslated region of BCR, corresponding to BINDING SITE of FIG. 26A. FIG. 26D illustrates the complementarity of the nucleotide sequence of BCR BINDING SITE, designated SEQ ID:79759, to the nucleotide sequence of GAM26 RNA of FIG. 26A, designated SEQ ID:20604.

A further function of GAM26 is therefore inhibition of breakpoint cluster region (BCR), a gene which encodes a protein that is a serine/threonine kinase that involves in the t(9;22) translocation (Philadelphia chromosome) and is associated with chronic myeloid leukemia (cml), acute myeloid leukemia (aml), acute lymphoblastic leukemia (all). Accordingly, utilities of GAM26 include diagnosis and treatment of the abovementioned disease and clinical conditions. The function and utilities of BCR have been established by previous studies, as described hereinabove with reference to FIG. 26D.

Referring now to BCR BINDING SITE. Breakpoint cluster region (BCR) is a target gene of GAM26, corresponding to GAM26-TARGET GENE of FIG. 26A. BCR BINDING SITE is a binding site found in an untranslated region of BCR, corresponding to BINDING SITE of FIG. 26A. FIG. 26D illustrates the complementarity of the nucleotide sequence of BCR BINDING SITE, designated SEQ ID:79761, to the nucleotide sequence of GAM26 RNA of FIG. 26A, designated SEQ ID:20604.

Yet a further function of GAM26 is therefore inhibition of breakpoint cluster region (BCR), a gene which encodes a protein that is a serine/threonine kinase that involves in the t(9;22) translocation (Philadelphia chromosome) and is associated with chronic myeloid leukemia (cml), acute myeloid leukemia (aml), acute lymphoblastic leukemia (all). Accordingly, utilities of GAM26 include diagnosis and treatment of the abovementioned diseases and clinical conditions. The function and utilities of BCR have been established by previous studies, as described hereinabove with reference to FIG. 26D.

Referring now to BCR BINDING SITE. Breakpoint cluster region (BCR) is a target gene of GAM26, corresponding to GAM26-TARGET GENE of FIG. 26A. BCR BINDING SITE is a binding site found in an untranslated region of BCR, corresponding to BINDING SITE of FIG. 26A. FIG. 26D illustrates the complementarity of the nucleotide sequence of BCR BINDING SITE, designated SEQ ID:79761, to the nucleotide sequence of GAM26 RNA of FIG. 26A, designated SEQ ID:20604.

Another function of GAM26 is therefore inhibition of breakpoint cluster region (BCR), a gene which encodes a protein that is a serine/threonine kinase that involves in the t(9;22) translocation (Philadelphia chromosome) and is associated with chronic myeloid (cml), acute myeloid leukemia (aml) acute lymphoblastic leukemia (all). Accordingly, utilities of GAM26 include diagnosis and treatment of the abovementioned diseases and clinical conditions. The function ant utilities of BCR have been established by previous studies, as described hereinabove with reference to FIG. 26D.

Referring now to BCR BINDING SITE. Breakpoint cluster region (BCR) is a target gene of GAM26, corresponding to GAM26-TARGET GENE of FIG. 26A. BCR BINDING SITE is a binding site found in an untranslated region of BCR, corresponding to BINDING SITE of FIG. 26A. FIG. 26D illustrates the complementarity of the nucleotide sequence of BCR BINDING SITE, designated SEQ ID:79762, to the nucleotide sequence of GAM26 RNA of FIG. 26A, designated SEQ ID:20604.

Yet another function of GAM26 is therefore inhibition of breakpoint cluster region (BCR), a gene which encodes a protein that is a serine/threonine kinase that involves in the t(9;22) translocation (Philadelphia chromosome) and is associated with chronic myeloid leukemia (cml), acute myeloid leukemia (aml), acute lymphoblastic leukemia (all). Accordingly, utilities of GAM26 include diagnosis and treatment of the abovementioned disease and clinical conditions. The function and utilities of BCR have been established by previous studies, as described hereinabove with reference to FIG. 26D.

Referring now to BCR BINDING SITE. Breakpoint cluster region (BCR) is a target gene of GAM26, corresponding to GAM26-TARGET GENE of FIG. 26A. BCR BINDING SITE is a binding site found in an untranslated region of BCR, corresponding to BINDING SITE of FIG. 26A. FIG. 26D illustrates the complementarity of the nucleotide sequence of BCR BINDING SITE, designated SEQ ID:79766, to the nucleotide sequence of GAM26 RNA of FIG. 26A, designated SEQ ID:20604.

An additional function of GAM26 is therefore inhibition of breakpoint cluster region (BCR), a gene which encodes a protein that is a serine/threonine kinase that involves in the t(9;22) translocation (Philadelphia chromosome) and is associated with chronic myeloid leukemia (cml), acute myeloid leukemia (aml), acute lymphoblastic leukemia (all). Accordingly, utilities of GAM26 include diagnosis and treatment of the abovementioned diseases and clinical conditions. The function and utilities of BCR have been established by previous studies, as described hereinabove with reference to FIG. 26D.

Referring now to BCR BINDING SITE. Breakpoint cluster region (BCR) is a target gene of GAM26, corresponding to GAM26-TARGET GENE of FIG. 26A. BCR BINDING SITE is a binding site found in an untranslated region of BCR, corresponding to BINDING SITE of FIG. 26A. FIG. 26D illustrate the complementarity of the nucleotide sequence of BCR BINDING SITE, designated SEQ ID:79766, to the nucleotide sequence of GAM26 RNA of FIG. 26A, designated SEQ ID:20604.

A further function of GAM26 is therefore inhibition breakpoint cluster region (BCR), a gene which encodes a protein that is a serine/threonine kinase that involves in the t(9;22) translocation (Philadelphia chromosome) and is associated with chronic myeloid leukemia (cml), acute myeloid leukemia (aml), acute lymphoblastic leukemia (all). Accordingly, utilities of GAM26 include diagnosis and treatment of the abovementioned diseases and clinical conditions. The function and utilities of BCR have been established by previous studies, as described hereinabove with reference to FIG. 26D.

Reference is now made to ZNF6 BINDING SITE. Zinc finger protein 6 (CMPX1) (ZNF6) is a target gene of GAM26, corresponding GAM26-TARGET GENE of FIG. 26A. ZNF6 BINDING SITE is a binding site found in an untranslated region of ZNF6, corresponding to BINDING SITE of FIG. 26A. FIG. 26D illustrates the complementarity of the nucleotide sequence of ZNF6 BINDING SITE, designated SEQ ID:79766, to the nucleotide sequence of GAM26 RNA of FIG. 26A, designated SEQ ID:20604.

Yet a further function of GAM26 is therefore inhibition of zinc finger protein 6 (CMPX1) (ZNF6), a gene which encodes a protein that is probably a transcriptional activator. Accordingly, utilities of GAM26 include diagnosis and treatment of the abovementioned diseases and clinical conditions.

The function of ZNF6 has been established by previous studies. See 194520. This gene was originally called CMPX1 and later ZNF6 by the Human Gene Mapping Workshop nomenclature committee. Lloyd et al. (1991) mapped the ZNF6 gene to the region in the proximal long arm of the X chromosome that shows homology to a region of the Y chromosome. It was mapped to Xq21.1-q21.3 by in situ hybridization, analysis of somatic cell hybrids, and study of males carrying deleted X chromosomes. The ZNF6 gene is highly conserved across species. Dosage in male mice indicated that it is also X linked in that species. ZFX (314980), ZFY, and ZNF6 may be derived from a common ancestral gene.

Full details of the abovementioned studies are described in the following publications, the disclosure of which are hereby incorporated by reference:

Lloyd, S. L.; Sargent, C. A.; Chalmers, J.; Lim, E.; Habeebu, S. S. M.; Affara, N. A.: An X-linked zinc finger gene mapping to Xq21.1-21.3 closely related to ZFX and ZFY: possible origins from a common ancestral gene. Nucleic Acids Res. 19: 4835-4841, 1991.

Further studies establishing the function and utilities of ZNF6 are found in John Hopkins OMIM database record ID 314990, and in references numbered 268 listed hereinbelow.

Reference is now made to BCRP2 BINDING SITE. Breakpoint cluster region protein, uterine leiomyo (BCRP2) is a target gene of GAM26, corresponding to GAM26-TARGET GENE of FIG. 26A. BCRP2 BINDING SITE is a binding site found in an untranslated region of BCRP2, corresponding to BINDING SITE of FIG. 26A. FIG. 26D illustrates the complementarity of the nucleotide sequence of BCRP2 BINDING SITE, designated SEQ ID:79919, to the nucleotide sequence of GAM26 RNA of FIG. 26A, designated SEQ ID:20604.

Another function of GAM26 is therefore inhibition of Breakpoint cluster region protein, uterine leiomyo (BCRP2), a gene which encodes a protein that accelerates osteoblast differentiation. Accordingly, utilities of GAM26 include diagnosis and treatment of the abovementioned diseases and clinical conditions.

The function of BCRP2 has been established by previous studies. In a t(12;14) breakpoint cluster region, Lynch et al. (1998) identified 4 expressed genes: REC2 (602948), cytoskeletal alpha-actinin (102575), D14S1460E (BCRP1), and D14S1461E (BCRP2). All map to the 14q24.1-q24.2 region. Northern blot analysis revealed BCRP2 expression in all human tissues tested.

Full details of the abovementioned studies are described in the following publications, the disclosure of which are hereby incorporated by reference:

Lynch, R. A.; Piper, M.; Bankier, A.; Bhugra, B.; Surti, U.; Liu, J.; Buckler, A.; Dear, P. H.; Menon, A. G.: Genomic and functional map of the chromosome 14 t(12;14) breakpoint cluster region in uterine leiomyoma. Genomics 52: 17-26, 1998.

Further studies establishing the function and utilities of BCRP2 are found in John Hopkins OMIM database record ID 603812, and in references numbered 269 listed hereinbelow.

Referring now to BCRP2 BINDING SITE. Breakpoint cluster region protein, uterine leiomyo (BCRP2) is a target gene of GAM26, corresponding to GAM26-TARGET GENE of FIG. 26A. BCRP2 BINDING SITE is a binding site found in an untranslated region of BCRP2, corresponding to BINDING SITE of FIG. 26A. FIG. 26D illustrates the complementarity of the nucleotide sequence of BCRP2 BINDING SITE, designated SEQ ID:79941, to the nucleotide sequence of GAM26 RNA of FIG. 26A, designated SEQ ID:20604.

Yet another function of GAM26 is therefore inhibition of Breakpoint cluster region protein, uterine leiomyo (BCRP2), a gene which encodes a protein that accelerates osteoblast differentiation. Accordingly, utilities of GAM26 include diagnosis and treatment of the abovementioned diseases and clinical conditions. The function and utilities of BCRP2 have been established by previous studies, as described hereinabove with reference to FIG. 26D.

Reference is now made to BSG BINDING SITE. Basigin (OK blood group) (BSG) is a target gene of GAM26, corresponding GAM26-TARGET GENE of FIG. 26A. BSG BINDING SITE is a binding site found in an untranslated region of BSG, corresponding to BINDING SITE of FIG. 26A. FIG. 26D illustrates the complementarity of the nucleotide sequence of BSG BINDING SITE, designated SEQ ID:83983, to the nucleotide sequence of GAM26 RNA of FIG. 26A, designated SEQ ID:20604.

An additional function of GAM26 is therefore inhibition of basigin (OK blood group) (BSG), a gene which encodes a protein that is a LEUKOCYTE ACTIVATION ANTIGEN and a member of the immunoglobulin superfamily. Accordingly, utilities of GAM26 include diagnosis and treatment of the abovementioned diseases and clinical conditions.

The function of BSG has been established by previous studies. Basigin is a member of the immunoglobulin superfamily, with a structure related to the putative primordial form of the family. It was cloned as a carrier of an oncodevelopmental carbohydrate marker expressed in teratocarcinoma stem cells. It is expressed broadly in both embryos and adults (4,5:Miyauchi et al., 1990, 1991; Kanekura et al., 1991). As members of the immunoglobulin superfamily play fundamental roles in intercellular recognition involved in various immunologic phenomena, differentiation, and development, basigin is thought also to play a role in intercellular recognition.

Animal model experiments lend further support to the function of BSG. Naruhashi et al. (1997) generated mice deficient in basigin by targeted disruption. Bsg −/− mice showed worse performance than their wildtype and heterozygous littermates in the Y-maze task, which assesses short-term memory, and in the water-finding task, which examines latent learning, without any motor dysfunction. Moreover, the mutant mice showed less acclimation in the habituation task compared with the wildtype mice. The mutant mice were also more sensitive to electric foot shock. Naruhashi et al. (1997) found these findings consistent with the expression profile of basigin in the central nervous system and suggested that basigin may play an important role in learning and memory as well as in sensory functions.

It is appreciated that the abovementioned anima model for BSG is acknowledged by those skilled in the art as a scientifically valid animal model, as can be further appreciated from the publications sited hereinbelow.

Full details of the abovementioned studies are described in the following publications, the disclosure of which are hereby incorporated by reference:

Kanekura, T.; Miyauchi, T.; Tashiro, M.; Muramatsu, T.: Basigin, a new member of the immunoglobulin superfamily: genes in different mammalian species, glycosylation changes in the molecule from adult organs and possible variation in the N-terminal sequences. Cell Struct. Funct. 16: 23-30, 1991. PubMed ID: 2032306 6.

Naruhashi, K.; Kadomatsu, K.; Igakura, T.; Fan, Q. -W.; Kuno, N.; Muramatsu, H.; Miyauchi, T.; Hasegawa, T.; Itoh, A.; Muramatsu, T.; Nabeshima T.: Abnormalities of sensory and memory functions in mice lacking Bsg gene. Biochem. Biophys. Res. Commun. 236: 733-737, 1997.

Further studies establishing the function and utilities of BSG are found in John Hopkins OMIM database record ID 109480, and in references numbered 270-277 listed hereinbelow.

Reference is now made to BSN BINDING SITE. Bassoon (presynaptic cytomatrix protein) (BSN) is a target gene of GAM26, corresponding to GAM26-TARGET GENE of FIG. 26A. BSN BINDING SITE is a binding site found in an untranslated region of BSN, corresponding to BINDING SITE of FIG. 26A. FIG. 26D illustrates the complementarity of the nucleotide sequence of BSN BINDING SITE, designated SEQ ID:84199, to the nucleotide sequence of GAM26 RNA of FIG. 26A, designated SEQ ID:20604.

A further function of GAM26 is therefore inhibition of bassoon (presynaptic cytomatrix protein) (BSN), a gene which encodes a protein that may be involved in cytomatrix organization at the site of neurotransmitter release and is associated with Multiple system atrophy (MSA). Accordingly, utilities of GAM26 include diagnosis and treatment of the abovementioned diseases and clinical conditions.

The function of BSN has been established by previous studies. Both the presynaptic terminal and the postsynaptic compartment of neuronal synapses comprise a highly specialized cytoskeleton underlying the synaptic membranes. The presynaptic nerve terminal is the principal site of regulated neurotransmitter release. The active zone is the region of the presynaptic plasmalemma over which synaptic vesicles dock, fuse, and release neurotransmitter. Piccolo (PCLO; 604918), a 420-kD protein, is 1 component of the presynaptic cytomatrix. Tom Dieck et al. (1998) isolated a large (greater than 400 kD) protein in mouse that is also found in the presynaptic compartments of rat brain synapses. They designated the protein Bassoon because it, along with Piccolo, is part of the ensemble of presynaptic proteins that are involved in orchestrating events at the nerve terminal. Bassoon is found in axon terminals of hippocampal neurons where it is highly concentrated in the vicinity of the active zone. Piccolo has a similar distribution and colocalizes with Bassoon in cultured hippocampal cells. Tom Dieck et al. (1998) suggested that Bassoon may be involved in cytomatrix organization at the site of neurotransmitter release multiple system atrophy (MSA) is a sporadic progressive neurodegenerative disease. By differential hybridization to high-density cDNA filters, Hashida et al. (1998) identified human frontal lob with altered expression patterns in patients. One partial cDNA whose expression was elevated 2-fold in MSA cerebella encoded a protein that the authors designated ZNF231 (zinc finger protein-231). By screening additional libraries with the partial cDNA, they assembled a full-length ZNF231 cDNA. The predicted 3,926-amino acid protein contains 2 glycine-proline dipeptide repeats, a pair of homologous C8 double zinc finger motifs, a leucine zipper motif, an SH3 domain-binding motif, 2 nuclear targeting sequences, 2 glutamine-rich domains, and a histidine-rich domain. Northern blot analysis of rat tissues indicated that the ZNF231 gene was expressed as a 16-kb mRNA specifically in brain. By RT-PCR of human brain cell lines and tissue, Hashida et al. (1998) determined that ZNF231 was expressed in the cerebellum and in a neuroblastoma cell line, but not in the white matter. Ishikawa et al. (1997) recovered a ZNF231 cDNA, designated KIAA0434, as 1 of 78 brain cDNAs that may encode large proteins. Gundelfinger 1999) stated that ZNF231 is the human homolog of Bassoon.

Full details of the abovementioned studies are described in the following publications, the disclosure of which are hereby incorporated by reference:

Tom Dieck, S.; Sanmarti-Vila, L.; Langnaese, K.; Richter, K.; Kindler, S.; Soyke, A.; Wex, H.; Smalla, K. -H.; Kampf, U.; Franzer, J. -T.; Stumm, M.; Garner, C. C.; Gundelfinger, E. D.: Bassoon, a novel zinc-finger CAG/glutamine-repeat protein selectively localized at the active zone of presynaptic nerve terminals. J. Cell Biol.

142: 499-509, 1998. PubMed ID: 9679147 2. Hashida, H.; Goto, J.; Zhao, N.; Takahashi, N.; Hirai, M.; Kanazawa, I.; Sakaki, Y.: Cloning and mapping of ZNF231, a novel brain-specific gene encoding neuronal double zinc finger protein whose expression is enhanced in a neurodegenerative disorder, multiple system atrophy (MSA). Genomics 54: 50-58, 1998.

Further studies establishing the function and utilities of BSN are found in John Hopkins OMIM database record ID 604020, and in references numbered 278-282 listed hereinbelow.

Reference is now made to BTG3 BINDING SITE. BTG family, member 3 (BTG3) is a target gene of GAM26, corresponding to GAM26-TARGET GENE of FIG. 26A. BTG3 BINDING SITE is a binding site found in an untranslated region of BTG3, corresponding to BINDING SITE of FIG. 26A. FIG. 26D illustrate complementarity of the nucleotide sequence of BTG3 BINDING SITE, designated SEQ ID:84854, to the nucleotide sequence of GAM26 RNA of FIG. 26A, designated SEQ ID:20604.

Yet a further function of GAM26 is therefore inhibition of BTG family, member 3 (BTG3), a gene which encodes a protein that may inhibit cell cycle progression from the g0/g1 to s phase. Accordingly, utilities of GAM26 include diagnosis and treatment of the abovementioned diseases and clinical conditions.

The function of BTG3 has been established by previous studies. Using the RT-PCR-mediated cloning procedure, Yoshida et al. (1998) identified BTG3, a novel member of the PC3/BTG/TOB family of growth inhibitory genes. They obtained full-length sequences of the human and mouse cDNAs by screening a Daudi cell cDNA library and a testis cDNA library, respectively. The human BTG3 cDNA, which the authors called ANA, encodes a deduced 252-amino acid protein that shares 93% sequence identity with the mouse protein. Northern blot analysis detected a 1.5-kb transcript in various human tissues, with relatively high expression in testis, prostate, ovary, thymus, and lung, and low expression in skeletal muscle and spleen. Further analysis in mouse revealed that BTG3 expression was high in the ventricular zone of the developing central nervous system. Overexpression of BTG3 impaired serum-induced cell cycle progression from the G0/G1 to S phase.

Full details of the abovementioned studies are described in the following publications, the disclose of which are hereby incorporated by reference:

Yoshida, Y.; Matsuda, S.; Ikematsu, N.; Kawamura-Tsuzuku, J.; Inazawa, J.; Umemori, H.; Yamamoto, T.: ANA, a novel member of Tob/BTG1 family, is expressed in the ventricular zone of the developing central nervous system. Oncogene 16: 2687-2693, 1998.

Further studies establishing the function and utilities of BTG3 are found in John Hopkins OMIM database record ID 605674, and in references numbered 283 listed hereinbelow.

Reference is now made to CHS1 BINDING SITE. Chediak-Higashi syndrome 1 (CHS1) is target gene of GAM26, corresponding to GAM26-TARGET GENE of FIG. 26A. CHS1 BINDING SITE is a binding site found in an untranslated region of CHS1, corresponding to BINDING SITE of FIG. 26A. FIG. 26D illustrates the complementarity of the nucleotide sequence of CHS1 BINDING SITE, designated SEQ ID:84854, to the nucleotide sequence of GAM26 RNA of FIG. 26A, designated SEQ ID:20604.

Another function of GAM26 is therefore inhibition of Chediak-Higashi syndrome 1 (CHS1), a gene which encodes a protein that is associated with chediak-Higashi syndrome. Accordingly, utilities of GAM26 include diagnosis and treatment of the abovementioned diseases and clinical conditions.

The function of CHS1 has been established by previous studies. Barbosa et al. (1997) identified novel mutations within the region of the coding domain common to both CHS1 isoforms in 3 CHS patients: C-to-T transitions that generated stop codons (R50X; 606897.0006 and Q1029X; 606897.0007) were found in 2 patients, and a novel frameshift mutation (deletion of nucleotides 3073 and 3074 of the coding domain) was found in a third. Northern blots of lymphoblastoid mRNA from HS patients revealed loss of the largest transcript (approximately 13.5 kb) in 2 of 7 CHS patients, while the small mRNA was undiminished in abundance. These results suggested that the small isoform alone cannot complement Chediak-Higashi syndrome. All beige and CHS1 mutations that had been identified were predicted to result in either truncated or absent proteins. Although Perou et al. (1996) and Barbosa et al. (1996) reported identification of the 'beige' gene, the 2 cDNAs were quite different. Nagle et al. (1996) described the sequence of a human cDNA homologous to mouse 'beige,' identified pathologic mutations in patients with Chediak-Higashi syndrome, and clarified the discrepancies of the previous reports of sequence. Analysis of the CHS1 polypeptide demonstrated that its modular architecture is similar to that of the yeast vacuolar sorting VPS15. Nagle et al. (1996) screened human cDNA libraries with mouse 'beige' probes to yield the human 'beige' cDNA homolog, and found 87.9% amino acid identity between the 2 sequences. The predicted human protein comprises 3,801 amino acids, with a molecular mass of approximately 43 kD. Barbosa et al. (1997) reported the sequences of 2 major mRNA isoforms of the CHS1 gene in human and mouse. These isoforms differ both in size and in sequence at the 3-prime end of their coding domains, with a small isoform (approximately 5.8 kb) arising from incomplete splicing and reading through an intron. These mRNAs also differ in tissue distribution of transcription and in predicted biologic properties.

Full details of the abovementioned studies are described in the following publications, the disclosure of which are hereby incorporated by reference:

Karim, M. A.; Nagle, D. L.; Kandil, H. H.; Burger, J.; Moore, K. J.; Spritz, R. A.: Mutations in the Chediak-Higashi syndrome gene (CHS1) indicate requirement for the complete 3801 amino acid CHS protein. Hum. Molec. Genet. 6: 1087-1089, 1997. PubMed ID: 9215679 1. Barbosa, M. D. F. S.; Barrat, F. J.; Tchernev, V. T.; Nguyen, Q. A.; Mishra, V. S.; Colman, S. D.; Pastural, E.; Dufourcq-Lagelouse, R.; Fischer, A.; Holcombe, R. F.; Wallace, M. R.; Brandt, S. J.; de Saint Basile, G.; Kingsmore S. F.: Identification of mutations in two major mRNA isoforms of the Chediak-Higashi syndrome gene in human and mouse. Hum. Molec. Genet. 6: 1091-1098, 1997.

Further studies establishing the function and utilities of CHS1 are found in John Hopkins OMIM database record ID 606897, and in references numbered 284-296 listed hereinbelow.

Referring now to BTG3 BINDING SITE. BTG family, member 3 (BTG3) is a target gene of GAM26, corresponding to GAM26-TARGET GENE of FIG. 26A. BTG3 BINDING SITE is a binding site found in an untranslated region of BTG3, corresponding to BINDING SITE of FIG. 26A. FIG. 26D illustrates the complementarity of the nucleotide sequence of BTG3 BINDING SITE, designated SEQ ID:84863, to the nucleotide sequence of GAM26 RNA of FIG. 26A, designated SEQ ID:20604.

Yet another function of GAM26 is therefore inhibition of BTG family, member 3 (BTG3), a gene which encodes a protein that may inhibit cell cycle progression from the g0/g1 to s phase. Accordingly, utilities of GAM26 include diagnosis and treatment of the abovementioned diseases and clinical conditions. The function and utilities of BTG3 have been established by previous studies, as described hereinabove with reference to FIG. 26D.

Reference is now made to HIRA BINDING SITE. HIR (histone cell cycle regulation defective, *S. cerevisiae*) homolog A (HIRA) is a target gene of GAM26, corresponding to GAM26-TARGET GENE of FIG. 26A. HIRA BINDING SITE is a binding site found in an untranslated region of HIRA, corresponding to BINDING SITE of FIG. 26A. FIG. 26D illustrates the complementarity of the nucleotide sequence of HIRA BINDING SITE, designated SEQ ID:85041, to the nucleotide sequence of GAM26 RNA of FIG. 26A, designated SEQ ID:20604.

An additional function of GAM26 is therefore inhibition of HIR (histone cell cycle regulation defective, *S. cerevisiae*) homolog A (HIRA), a gene which encodes a transcription factor that have a part in mechanisms of transcriptional regulation similar to that played by yeast hir1 and hir2 together and is associated with DiGeorge syndrome. Accordingly, utilities of GAM26 include diagnosis and treatment of the abovementioned diseases and clinical conditions.

The function of HIRA has been established by previous studies. The human TUPLE1 gene encodes a putative transcription regulator with a sequence similar to that of the yeast TUP1 gene (Halford et al., 1993). The protein product of the TUPLE1 gene contains WD40 domain, motifs thought to be involved in protein-protein interactions. Halford et al. (1993) demonstrated that the TUPLE1 gene maps to chromosome 22 and to the shortest region of deletion overlap in a series of over 100 patients with the DiGeorge syndrome (DGS; 188400), velocardiofacial syndrome (VCFS; 92430), or a related disorder. It is expressed in a range of fetal tissues. Halford et al. (1993) cloned the murine Tuple1 gene and showed that it has strong sequence similarity to the human gene. Since TUPLE1 is a candidate gene for DGS through the mechanism of haploinsufficiency and it might be possible to produce models of this disorder by creating mutations in the mouse gene, Mattei et al. (1994) mapped the gene to mouse chromosome 16 by isotopic in situ hybridization. The experiments were carried out using metaphase spreads from a WMP male mouse in which all of the autosomes, except 19, were the form of metacentric Robertsonian translocations. In the human, TUPLE1 is centromeric to COMT (116790), which in turn is centromeric to IGLC1 (147220); all of these expressed sequences map to mouse chromosome 16. Magnaghi et al. (1998) reported an interaction between HIRA and the transcription factor PAX3 (606597). PAX3 haploinsufficiency results in the mouse 'splotch' and human Waardenburg syndrome (see 193500) phenotypes. Mice homozygous for PAX3 mutations die in utero with a phenocopy of DiGeorge syndrome, or neonatally with neural tube defects. HIRA was also found to interact with core histones. Thus, altered stoichiometry of complexes containing HIRA may be important for the development of structures affected in Waardenburg syndrome and DiGeorge syndrome.

Full details of the abovementioned studies are described in the following publications, the disclosure of which are hereby incorporated by reference:

Halford, S.; Wilson, D. I.; Daw, S. C. M.; Roberts, C.; Wadey, R.; Kamath, S.; Wickremasinghe, A.; Burn, J.; Goodship, J.; Mattei, M. -G.; Moorman, A. F. M.; Scambler, P. J.: Isolation of a gene expressed during early embryogenesis from the region of 22q11 commonly deleted in DiGeorge syndrome. Hum. Molec. Genet 2: 1577-1582, 1993. PubMed ID: 8268909 5. Magnaghi, P.; Roberts, C.; Lorain, S.; Lipinski, M.; Scambler, P. J.: HIRA, a mammalian homologue of *Saccharomyces cerevisiae* transcriptional co-repressors, interacts with Pax3. Nature Genet. 20: 74-77, 1998.

Further studies establishing the function and utilities HIRA are found in John Hopkins OMIM database record ID 600237, and in references numbered 297-304 listed hereinbelow.

Reference is now made to CACNA1A BINDING SITE. Calcium channel, voltage-dependent, P/Q type, alpha 1A subunit (CACNA11) is a target gene of GAM26, corresponding to GAM26-TARGET GENE of FIG. 26A. CACNA1A BINDING SITE is a binding site found in an untranslated region of CACNA1A, corresponding to BINDING SITE of FIG. 26D illustrates the complementarity of the nucleotide sequence of CACNA1A BINDING SITE, designated SEQ ID:87774, to the nucleotide sequence of GAM26 RNA of FIG. 26A, designated SEQ ID:20604.

A further function of GAM26 is therefore inhibition of calcium channel, voltage-dependent, P/Q type, alpha 1A subunit (CACNA1A), a gene which encodes a protein that is associated with episodic ataxia type 2, familial hemiplegic migraine, spinocerebellar ataxia type 6, and idiopathic generalized epilepsy. Accordingly, utilities of GAM26 include diagnosis and treatment of the abovementioned diseases and clinical conditions.

The function of CACNA1A has been established by previous studies. Ca(2+) currents have been described on the basis of their biophysical and pharmacologic properties and include L-, N-, T-, P-, Q-, and R-types. The distinctive properties of these Ca(2+) channel types are related primarily to the expression of a variety of alpha-1 isoforms (Dunlap et al., 1995). The alpha-1A isoform is abundantly expressed in neuronal tissue and corresponds to the P/Q Ca(2+) channel type. The B and E isoforms are also expressed in neuronal tissue and correspond to the N-type and R-type of Ca(2+) channels, respectively (Lehmann-Horn and Jurkat-Rott, 1999). The genes encoding the alpha-1A, B, and E isoforms are symbolized CACNL1A4 or CACNA1A, CACNL1A5 (601012), and CACNL1A6 (601013) and are located on 19p13, 9q34 and 1q25-q31, respectively (Diriong et al., 1995).

Animal model experiments lend further support to the function of CACNA1A. By a position al cloning approach, Fletcher et al. (1996) identified an alpha-1 voltage-sensitive Ca(2+) channel gene that is mutated in the 'tottering' mutations in tg and tg(1a) mice. The tg mutation is a well-studied mutation that gives rise to behavioral arrest seizures, which may be compared to human absence (or petit mal) epilepsy (600131) and cerebellar ataxia. The tottering phenotype also includes motor seizures. Fletcher et al. (1996) noted that the tg leaner mice, tg(1a), suffer from absence seizures but do not have motor seizures. These mice are severely ataxic. Fletcher et al. (1996) mapped the tg phenotype to mouse chromosome 8 in the vicinity of the Junb gene (165161). Fletcher et al. (1996) evaluated the C (2+) channel gene as a candidate for the tg locus using RT-PCR and sequencing.

In the tg(1a) mice they demonstrated a single G-to-A change in a splice donor site in the portion of the mouse gene encoding the putative regulatory C-terminal domain of the channel. This mutation resulted in several aberrant mRNA species, including insertion of 98 nucleotides at position 5901/2 and deletion of nucleotides 5763-5901, either of which altered the reading frame 3-prime to the mutations. The tg transcript contained a C-to-A change at position 1802 relative to the control sequence. Fletcher et al. (1996) reported that this alteration leads to a nonconservative proline-to-leucine amino acid substitution that may affect the pore function of the Ca(2+) channel. Fletcher et al. (1996) noted that this is the first gene identified as being involved in absence epilepsy.

It is appreciated that the abovementioned animal model for CACNA1A is acknowledged by those skilled in the art as a scientifically valid animal model, as can be further appreciated from the publications sited hereinbelow.

Full details of the abovementioned studies are described in the following publications, the disclosure of which are hereby incorporated by reference:

Dunlap, K.; Luebke, J. I.; Turner, T. J.: Exocytotic Ca(2+) channels in mammalian central neurons. Trends Neurosci. 18: 89-98, 1995. PubMed ID: 7537420 8. Fletcher, C. F.; Lutz, C. M.; O'Sullivan, T. N.; Shaughnessy, J. D, Jr.; Hawkes, R.; Frankel, W. N.; Copeland, N. G.; Jenkins, N. A.: Absence epilepsy in tottering mutant mice is associated with calcium channel defects. Cell 87: 607-617, 1996.

Further studies establishing the function and utilities of CACNA1A are found in John Hopkins OMIM database record ID 601011, and in numbered 305-335 listed hereinbelow.

Reference is now made to CALM1 BINDING SITE. Calmodulin 1 (phosphorylase kinase, delta) (CALM1 is a target gene of GAM26, corresponding to GAM26-TARGET GENE of FIG. 26A. CALM1 BINDING SITE is a binding site found in an untranslated region of CALM1, corresponding to BINDING SITE of FIG. 26A. FIG. 26D illustrates the complementarity of the nucleotide sequence of CALM1 BINDING SITE, designated SEQ ID:89443, to the nucleotide sequence of GAM26 RNA of FIG. 26A, designated SEQ ID:20604.

Yet a further function of GAM26 is therefore inhibition of calmodulin 1 (phosphorylase kinase, delta) (CALM1), a gene which encodes a protein that plays roles in growth and the cell cycle as well as in signal transduction and the synthesis and release of neurotransmitters. Accordingly, utilities of GAM26 include diagnosis and treatment of the abovementioned diseases and clinical conditions.

The function of CALM1 has been established by previous studies. Calmodulin is the archetype of the family of calcium-modulated proteins of which nearly 20 members have been found. They are identified by their occurrence in the cytosol or on membranes facing the cytosol and by a high affinity for calcium. Calmodulin contains 149 amino acids and has 4 calcium-binding domains. Its functions include roles in growth and the cell cycle as well as in signal transduction and the synthesis and release of neurotransmitters. To determine how calcium/calmodulin activate calcium/calmodulin-dependent protein kinase I (CAMK1; 604998), Chin et al. (1997) characterized CAMK1 activation by calmodulin mutants with substitutions at hydrophobic residues. They found that CAMK1 activity is dependent on met124 within the C-terminal domain of calmodulin as well as on N-terminal hydrophobic residues of calmodulin.

Full details of the abovementioned studies are described in the following publications, the disclosure of which are hereby incorporated by reference:

Rhyner, J. A.; Ottiger, M.; Wicki, R.; Greenwood, T. M.; Strehler, E. E.: Structure of the human CALM1 calmodulin gene and identification of two CALM1-related pseudogenes CALM1P1 and CALM1P2. Europ. J. Biochem. 225: 71-82, 1994. PubMed ID: 7925473 2. Chin, D.; Winkler, K. E.; Means, A. R.: Characterization of substrate phosphorylation and use of calmodulin mutants to address implications from the enzyme crystal structure of calmodulin-dependent protein kinase I. J. Biol. Chem. 272: 31235-31240, 1997.

Further studies establishing the function and utilities of CALM1 are found in John Hopkins OMIM database record ID 114180, and in references numbered 336-347 listed hereinbelow.

Referring now to CALM1 BINDING SITE. Calmodulin 1 (phosphorylase kinase, delta) (CALM1) is a target gene of GAM26, corresponding to GAM26-TARGET GENE of FIG. 26A. CALM1 BINDING SITE is a binding site found in an untranslated region of CALM1, corresponding to BINDING SITE of FIG. 26A. FIG. 26D illustrates the complementarity of the nucleotide sequence CALM1 BINDING SITE, designated SEQ ID:89450, to the nucleotide sequence of GAM26 RNA of FIG. 26A, designated SEQ ID:20604.

Another function of GAM26 is therefore inhibition of calmodulin 1 (phosphorylase kinase, delta) (CALM1), a gene which encodes a protein that plays roles in growth and the cell cycle as well as in signal transduction and the synthesis and release of neurotransmitters. Accordingly, utilities of GAM26 include diagnosis and treatment of the abovementioned diseases and clinical conditions. The function and utilities of CALM1 have been established by previous studies, as described hereinabove with reference to FIG. 26D.

Referring now to CACNA1A BINDING SITE. Calcium channel, voltage-dependent, P/Q type, alpha 1A subunit (CACNA1A) is a target gene of GAM26, corresponding to GAM26-TARGET GENE of FIG. 26A. CACNA1A BINDING SITE is a binding site found in an untranslated region of CACNA1A, corresponding to BINDING SITE of FIG. 26A. FIG. 26D illustrates the complementarity of the nucleotide sequence of CACNA1A BINDING SITE, designated SEQ ID:94853, to the nucleotide sequence of GAM26 RNA of FIG. 26A, designated SEQ ID:20604.

Yet another function of GAM26 is therefore calcium channel, voltage-dependent, P/Q type, alpha 1A subunit (CACNA1A), a gene which encodes a protein that is associated with episodic ataxia type 2, familial hemiplegic migraine, spinocerebellar ataxia type 6, and idiopathic generalized epilepsy. Accordingly, utilities of GAM26 include diagnosis and treatment of the abovementioned diseases and clinical conditions. The function and utilities of CACNA1A have been established by previous studies, as described hereinabove with reference to FIG. 26D.

Reference is now made to CBL BINDING SITE. Cas-Br-M (murine) ecotropic retroviral transforming sequence (CBL) is a target gene of GAM26, corresponding to GAM26-TARGET GENE of FIG. 26A. CBL BINDING SITE is a binding site found in an untranslated region of CBL, corresponding to BINDING SITE of FIG. 26A. FIG. 26D illustrates the complementarity of the nucleotide sequence of CBL BINDING SITE, designated SEQ ID:94853, to the nucleotide sequence of GAM26 RNA of FIG. 26A, designated SEQ ID:20604.

An additional function of GAM26 is therefore inhibition of Cas-Br-M (murine) ecotropic retroviral transforming sequence (CBL), a gene which encodes a protein that may modify receptor tyrosine kinase-mediated signal transduction and is associated with B-lineage lymphomas. Accordingly, utilities of GAM26 include diagnosis and treatment of the abovementioned diseases and clinical conditions.

The function of CBL has been established by previous studies. Cas NS-1 is an acutely transforming murine retrovirus that induces pre-B and pro-B cell lymphomas. Molecular cloning showed that it was generated from the ecotropic Cas-Br-M virus by sequential recombinations with endogenous retroviral sequences and a cellular oncogene. Langdon et al. (1989) found that the oncogene sequence shows no homology with known oncogenes, but some similarity to the yeast transcriptional activator GCN4. A 100-kD gag-cbl fusion protein, with no detectable kinase activity, is responsible for the cellular transformation. The cellular homolog of v-cbl, present in mouse and human DNA, is expressed in a range of homopoietic lineages. Wei et al. (1990) mapped the CBL2 gene to 11q23.3-qter by molecular characterization of the breakpoints in 2 somatic cell hybrids. Savage et al. (1991) studied the relation of CBL2 to the breakpoints in malignancies with translocations involving chromosome 11. CBL2 was translocated from chromosome 11 to 4 in an acute leukemia cell line possessing a t(4;11)(q21;q23) and from chromosome 11 to 14 in a B-cell lymphoma with a t(11;14)(q23;q32). CBL2 remained on chromosome 11 in a Ewing sarcoma cell line (133450) with a t(11;22)(q23;q12). Other studies indicated that NCAM (116930) and the genes for the 3 subunits of CD3 were all proximal to the tightly clustered THY1 (188230), ETS1 (164720), and CBL2 in 11q23. Vulval induction during development of *Caenorhabditis elegans* is mediated by LET-23, a homolog of the mammalian epidermal growth factor receptor tyrosine kinase (131550). The sli-1 gene is a negative regulator of LET-23 and was shown by Yoon et al. (1995) to encode a protein similar to the mammalian protooncoprotein CBL2. The sli-1 and CBL2 proteins share approximately 55% amino acid identity over a stretch of 390 residues, which includes a C(3)HC(4) zinc-binding motif known as the RING finger, and multiple consensus binding sites for SRC homology 3 (SH3) domains. The authors stated that sli-1 and CBL2 may define a new class of proteins that modify receptor tyrosine kinase-mediated signal transduction.

Full details of the abovementioned studies are described in the following publications, the disclosure of which are hereby incorporated by reference:

Savage, P. D.; Shapiro, M.; Langdon, W. Y.; Geurts van Kessel, A. D.; Seuanez, H. N.; Akao, Y.; Croce, C.; Morse, H. C., III; Kersey, J. H.: Relationship of the human protooncogene CBL2 on 11q23 to the t(4;11), t(11;22), and t(11;4) breakpoints. Cytogenet Cell Genet 56: 112-115, 1991. PubMed ID: 2013228 12. Yoon, C. H.; Lee, J.; Jongeward, G. D.; Sternberg, P. W.: Similarity of sli-1, a regulator of vulval development in *C. elegans*, to the mammalian proto-oncogene c-cbl. Science 269: 1102-1105, 1995.

Further studies establishing the function and utilities of CBL are found in John Hopkins OMIM database record ID 165360, and in references numbered 348-359 listed hereinbelow.

Referring now to CBL BINDING SITE. Cas-Br-M (murine) ecotropic retroviral transforming sequence (CBL) is a target gene of GAM26, corresponding to GAM26-TARGET GENE of FIG. 26A. CBL BINDING SITE is a binding site found in an untranslated region of CBL, corresponding to BINDING SITE of FIG. 26A. FIG. 26D illustrates the complementarity of the nucleotide sequence of CBL BINDING SITE, designated SEQ ID:94853, to the nucleotide sequence of GAM26 RNA of FIG. 26A, designated SEQ ID: 20604.

A further function of GAM26 is therefore inhibition of Cas-Br-M (murine) ecotropic retroviral transforming sequence (CBL), a gene which encodes a protein that may modify receptor tyrosine kinase-mediated signal transduction, and is associated with B-lineage lymphomas. Accordingly, utilities of GAM26 include diagnosis and treatment of the abovementioned diseases and clinical conditions. The function and utilities of CBL have been established by previous studies, as described hereinabove with reference to FIG. 26D.

Referring now to CBL BINDING SITE. Cas-Br-M (murine) ecotropic retroviral transforming sequence (CBL) is a target gene of GAM26, corresponding to GAM26-TARGET GENE of FIG. 26A. CBL BINDING SITE is a binding site found in an untranslated region of CBL, corresponding to BINDING SITE FIG. 26A. FIG. 26D illustrates the complementarity of the nucleotide sequence of CBL BINDING SITE, designated SEQ ID:94853, to the nucleotide sequence of GAM26 RNA of FIG. 26A, designated SEQ ID:20604.

Yet a further function of GAM26 is therefore inhibition of Cas-Br-M (murine) ecotropic retroviral transforming sequence (CBL), a gene which encodes a protein that may modify receptor tyrosine kinase-mediated signal transduction and is associated with B lineage lymphomas. Accordingly, utilities of GAM26 include diagnosis and treatment of the abovementioned diseases and clinical conditions. The function and utilities of CBL have been established by previous studies, as described hereinabove with reference to FIG. 26D.

Referring now to CBL BINDING SITE. Cas-Br-M (murine) ecotropic retroviral transforming sequence (CBL) is a target gene of GAM26, corresponding to GAM26-TARGET GENE of FIG. 26A. CBL BINDING SITE is a binding site found in an untranslated region of CBL, corresponding to BINDING SITE of FIG. 26A. FIG. 26D illustrates the complementarity of the nucleotide sequence of CBL BINDING SITE, designated SEQ ID:94853, to the nucleotide sequence of GAM26 RNA of FIG. 26A, designated SEQ ID:20604.

Another function of GAM26 is therefore inhibition of Cas-Br-M (murine) ecotropic retroviral transforming sequence (CBL), a gene which encodes a protein that may modify receptor tyrosine kinase-mediated signal transduction and is associated with B-lineage lymphomas. Accordingly, utilities of GAM26 include diagnosis and treatment of the abovementioned diseases and clinical conditions. The function and utilities of CBL have been established by previous studies, as described hereinabove with reference to FIG. 26D.

Reference is now made to FGF18 BINDING SITE. Fibroblast growth factor 18 (FGF18) is a target gene of GAM26, corresponding to GAM26-TARGET GENE of FIG. 26A. FGF18 BINDING SITE is a binding site found in an untranslated region of FGF18, corresponding to BINDING SITE of FIG. 26A. FIG. 26D illustrates the complementarity of the nucleotide sequence of FGF18 BINDING SITE, designated SEQ ID:94853, to the nucleotide sequence of GAM26 RNA of FIG. 26A, designated SEQ ID:20604.

Yet another function of GAM26 is therefore inhibition of fibroblast growth factor 18 (FGF18), a gene which encodes a protein that stimulates hepatic and intestinal proliferation.

Accordingly, utilities of GAM26 include diagnosis and treatment of the abovementioned diseases and clinical conditions.

The function of FGF18 has been established by previous studies. The fibroblast growth factors (FGFs; e.g., FGF2; 134920) are a family of growth factors and oncogenes that contain a conserved, approximately 120-amino acid core. Individual FGFs play important roles in embryonic development, cell growth, morphogenesis, tissue repair, inflammation, angiogenesis, and tumor growth and invasion. Ohbayashi et al. (1998) isolated human, mouse, and rat cDNAs encoding a novel member of the FGF family, FGF18. The deduced 207-amino acid human and rat FGF18 proteins are 99% identical. FGF18 contains a typical hydrophobic signal sequence at its N terminus, and the authors demonstrated that recombinant rat Fgf18 can be efficiently secreted by High Five insect cells. Recombinant rat Fgf18 induced neurite outgrowth in PC12 cells. Northern blot analysis of rat adult tissues showed abundant expression of Fgf18 in lung but did not detect Fgf18 expression in other tissues. In rat 14.5- and 19.5-day embryos, in situ hybridization showed Fgf18 expression in several discrete regions. Independently, Hu et al. (1998) isolated human and mouse FGF18 cDNAs. Among known FGF family members, the FGF18 protein is most similar to FGF8 (600483) and FGF17 (603725), with human FGF18 showing 60% and 58% identity with human FGF8 and FGF17, respectively. The authors demonstrated that recombinant mouse Fgf18 is glycosylated and can stimulate proliferation of NIH 3T3 cells in vitro in a heparan sulfate-dependent manner. Northern blot analysis of mouse adult tissues showed highest Fgf18 expression in the lung and kidney, and in situ hybridization of mouse 15.5-day embryos detected Fgf18 transcripts primarily in the lung. However, injection of recombinant mouse Fgf18 into normal mice induced proliferation in a wide variety of tissues, with the liver and small intestine appearing to be the primary targets. Hu et al. (1998) showed that transgenic mice overexpressing Fgf18 in the liver exhibited an increase in liver weight and hepatocellular proliferation. By radiation hybrid analysis and FISH, Whitmore et al. (2000) mapped the FGF18 gene to chromosome 5q34.

Full details of the abovementioned studies are described in the following publications, the disclosure of which are hereby incorporated by reference:

Ohbayashi, N.; Hoshikawa, M.; Kimura, S.; Yamasaki, M.; Fukui, S.; Itoh, N.: Structure and expression of the mRNA encoding a novel fibroblast growth factor, FGF-18. J. Biol. Chem. 273: 18161-18164, 1998. PubMed ID: 9660775 3. Whitmore, T. E.; Maurer, M. F.; Sexson, S.; Raymond, F.; Conklin, D.; Deisher, T. A.: Assignment of fibroblast growth factor 18 (FGF18) to human chromosome 5q34 by use of radiation hybrid mapping and fluorescence in situ hybridization. Cytogenet. Cell Genet 90: 231-233, 2000.

Further studies establishing the function and utilities of FGF18 are found in John Hopkins OMIM database record ID 603726, and in references numbered 360-362 listed hereinbelow.

Referring now to FGF18 BINDING SITE. Fibroblast growth factor 18 (FGF18) is a target gene of GAM26, corresponding to GAM26-TARGET GENE of FIG. 26A. FGF18 BINDING SITE is a binding site found in an untranslated region of FGF18, corresponding to BINDING SITE of FIG. 26A. FIG. 26D illustrates the complementarity of the nucleotide sequence of FGF18 BINDING SITE, designated SEQ ID:94853, to the nucleotide sequence of GAM26 RNA of FIG. 26A, designated SEQ ID:20604.

An additional function of GAM26 is therefore inhibition of fibroblast growth factor 18 (FGF18) a gene which encodes a protein that stimulates hepatic and intestinal proliferation. Accordingly, utilities of GAM26 include diagnosis and treatment of the abovementioned diseases and clinical condition. The function and utilities of FGF18 have been established by previous studies, as described hereinabove with reference to FIG. 26D.

Reference is now made to FMR1 BINDING SITE. Fragile X mental retardation 1 (FMR1) is a target gene of GAM26, corresponding to GAM26-TARGET GENE of FIG. 26A. FMR1 BINDING SITE is a binding site found in an untranslated region of FMR1, corresponding to BINDING SITE of FIG. 26A. FIG. 26D illustrates the complementarity of the nucleotide sequence of FMR1 BINDING SITE, designated SEQ ID:94853, to the nucleotide sequence of GAM26 RNA of FIG. 26A, designated SEQ ID:20604.

A further function of GAM26 is therefore inhibition of fragile X mental retardation 1 (FMR1), a gene which encodes a protein that is associated with fragile x syndrome. Accordingly, utilities of GAM26 include diagnosis and treatment of the abovementioned diseases and clinical conditions.

The function of FMR1 has been established by previous studies. X-linked mental retardation associated with marXq28, or fragile X syndrome, is characterized by moderate to severe mental retardation, macroorchidism, large ears, prominent jaw, and high-pitched jocular speech. Expression is variable, with mental retardation being the most common feature. This phenotype is associated with mutations in the FMR1 gene. McCabe et al. (1999) summarized the proceedings of a workshop on the fragile X syndrome held in December 1998. Filippi et al. (1983) studied linkage with G6PD and colorblindness in 18 Sardinian pedigrees. In 6 informative pedigrees the fragile X syndrome showed close linkage with G6PD deficiency and deutan colorblindness. The maximum likelihood estimate of recombination was 6% with 90% fiducial limits between 2.5 and 19.5% and odds favoring linkage of 428:1. No hint of linkage of G6PD and the Renpenning form of X-linked mental retardation (309500) or other unspecified type of X-linked mental retardation was found. Patients with the Renpenning form not only lack the facial features and macroorchidism typical of the fragile X syndrome but also have microcephaly. Brown et al. (1988) performed a multilocus linkage analysis of the fragile X syndrome in 147 families using 4 flanking markers. As previously observed by Giannelli et al. (1987), significant variation in the recombination distance between F9 and FRAXA was found also in this group of families. Heterogeneity testing showed that 20% of the families had tight F9-FRAXA linkage, whereas 80% demonstrated loose linkage, with an average recombination distance of 0.35. On average, the multipoint distances found were DXS51-F9, 6.9%; F9-FRAXA, 22.4%; FRAXA-DXS52, 12.7%; and DXS52-DXS15, 2.2%. Thibodeau et al. (1988) also reported on linkage data between the fragile X locus and 4 polymorphic markers: DXS51, F9, DXS98, and DXS52. The markers were studied in 14 families with fragile X and 9 normal pedigrees from the CEPH collection. In this set of families, as has been previously observed, there was evidence for genetic heterogeneity between the fragile X locus and the F9 site. The observed recombination frequencies were as follows: DXS51-F9, 0%; F9-DXS52, 45%; DXS51-FRAXA, 15%; F9-FRAXA, 18%; DXS8-FRAXA, 36%; and DXS52-FRAXA, 15%. The authors proposed the following relative order for the 5 loci, based on multipoint linkage analysis: (DXS51, F9, DXS98)--FRAXA--DXS52. Laggerbauer et al. (2001) showed that FMR1 strongly inhibited translation of various mRNAs at nanomolar in both rabbit reticulocyte lysate and microinjected *Xenopus laevis* oocytes. The effect was specific for FMR1, since other proteins with similar RNA-binding domains, including the autosomal homologs of FMR1, FXR1 and FXR2, failed to suppress translation in the same concentration range. Initial studies addressing the underlying mechanism of inhibition suggested that FMR1 may inhibit the assembly of 80S ribosomes on the target mRNAs. A disease-causing substitution, ile304 to asn (I304N; 309550.0001), rendered FMR1 incapable of interfering with translation in both test systems, and severely impaired homooligomerization of FMR1. The failure of FMR1 I304N to suppress translation was not due to its reduced affinity for mRNA or its interacting proteins FXR1 and FXR2. The authors hypothesized that inhibition of translation may be a function of FMR1 in vivo, and that failure of mutant FMR1 protein to oligomerize may contribute to the pathophysiologic events leading to fragile X syndrome.

Animal model experiments lend further support to the function of FMR1. Zhang et al. (2001) developed a *Drosophila* model of fragile X syndrome using loss-of-function mutants and overexpression of the FMR1 homolog, Dfxr (*Drosophila* fragile X-related gene). Dfxr nulls displayed enlarged synaptic terminals, whereas neuronal overexpression resulted in fewer and larger synaptic boutons. Synaptic structural defects were accompanied by altered neurotransmission, with synapse type-specific regulation in central and peripheral synapses.

It is appreciated that the abovementioned animal model for FMR1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Zhang Y. Q.; Bailey, A. M.; Matthies, H. J. G.; Renden, R. B.; Smith, M. A.; Speese, S. D.; Rubin, G. M.; Broadie, K.: Drosophila fragile X-related gene regulates the MAP1B homolog Futsch to control synaptic structure and function. Cell 107: 591-603, 2001. PubMed ID: 11733059

139. McCabe, E. R. B.; de la Cruz, F.; Clapp, K.: Workshop on Fragile X: future research directions. Am. J. Med. Genet 85: 317-322, 1999.

Further studies establishing the function and utilities of FMR1 are found in John Hopkins OMIM database record ID 309550, and in references numbered 363-461 listed hereinbelow.

Referring now to FMR1 BINDING SITE. Fragile X mental retardation 1 (FMR1) is a target gene of GAM26, corresponding to GAM26-TARGET GENE of FIG. 26A. FMR1 BINDING SITE is a binding site found in an untranslated region of FMR1, corresponding to BINDING SITE of FIG. 26A. FIG. 26D illustrates the complementarity of the nucleotide sequence of FMR1 BINDING SITE, designated SEQ ID:94853, to the nucleotide sequence of GAM26 RNA of FIG. 26A, designated SEQ ID:20604.

Yet a further function of GAM26 is therefore inhibition of fragile X mental retardation 1 (FMR1), a gene which encodes a protein that is associated with fragile x syndrome. Accordingly, utilities of GAM26 include-diagnosis and treatment of the abovementioned diseases and clinical conditions. The function and utilities of FMR1 have been established by previous studies, as described hereinabove with reference to FIG. 26D.

Referring now to FMR1 BINDING SITE. Fragile X mental retardation 1 (FMR1) is a target gene of GAM26, corresponding to GAM26-TARGET GENE of FIG. 26A. FMR1 BINDING SITE is a binding site found in an untranslated region of FMR1, corresponding to BINDING SITE of FIG. 26A. FIG. 26D illustrates the complementarity of the nucleotide sequence of FMR1 BINDING SITE, designated SEQ ID:94853, to the nucleotide sequence of GAM26 RNA of FIG. 26A, designated SEQ ID:20604.

Another function of GAM26 is therefore inhibition of fragile X mental retardation 1 (FMR1), a gene which encodes a protein that is associated with fragile x syndrome. Accordingly, utilities of GAM26 include diagnosis and treatment of the abovementioned diseases and clinical conditions. The function and utilities of FMR1 have been established by previous studies, as described hereinabove with reference to FIG. 26D.

Referring now to FMR1 BINDING SITE. Fragile X mental retardation 1 (FMR1) is a target gene of GAM26, corresponding to GAM26-TARGET GENE of FIG. 26A. FMR1 BINDING SITE is a binding site found in an untranslated region of FMR1, corresponding to BINDING SITE of FIG. 26A. FIG. 26D illustrates the complementarity of the nucleotide sequence of FMR1 BINDING SITE, designated SEQ ID:94853, to the nucleotide sequence of GAM26 RNA of FIG. 26A, designated SEQ ID:20604.

Yet another function of GAM26 is therefore inhibition of fragile X mental retardation 1 (FMR1), a gene which encodes a protein that is associated with fragile x syndrome. Accordingly, utilities of GAM26 include diagnosis and treatment of the abovementioned diseases and clinical conditions. The function and utilities of FMR1 have been established by previous studies, as described hereinabove with reference to FIG. 26D.

Referring now to FMR1 BINDING SITE. Fragile X mental retardation 1 (FMR1) is a target gene of GAM26, corresponding to GAM26-TARGET GENE of FIG. 26A. FMR1 BINDING SITE is a binding site found in an untranslated region of FMR1, corresponding to BINDING SITE of FIG. 26A. FIG. 26D illustrates the complementarity of the nucleotide sequence of FMR1 BINDING SITE, designated SEQ ID:94853, to the nucleotide sequence of GAM26 RNA of FIG. 26A, designated SEQ ID:20604.

An additional function of GAM26 is therefore inhibition of fragile X mental retardation 1 (FMR1), a gene which encodes a protein that is associated with fragile x syndrome. Accordingly, utilities of GAM26 include diagnosis and treatment of the abovementioned diseases and clinical conditions. The function and utilities of FMR1 have been established by previous studies, as described hereinabove with reference to FIG. 26D.

Referring now to FMR1 BINDING SITE. Fragile X mental retardation 1 (FMR1) is a target gene of GAM26, corresponding GAM26-TARGET GENE of FIG. 26A. FMR1 BINDING SITE is a binding site found in an untranslated region of FMR1, corresponding to BINDING SITE of FIG. 26A. FIG. 26D illustrates the complementarity of the nucleotide sequence of FMR1 BINDING SITE, designated SEQ ID:94853, to the nucleotide sequence of GAM26 RNA of FIG. 26A, designated SEQ ID:20604.

A further function of GAM26 is therefore inhibition of fragile X mental retardation 1 (FMR1), a gene which encodes a protein that is associated with fragile x syndrome. Accordingly utilities of GAM26 include diagnosis and treatment of the abovementioned diseases and clinical conditions. The function and utilities of FMR1 have been established by previous studies, as described hereinabove with reference to FIG. 26D.

Referring now to FMR1 BINDING SITE. Fragile X mental retardation 1 (FMR1) is a target gene of GAM26, corresponding to GAM26-TARGET GENE of FIG. 26A. FMR1 BINDING SITE is a binding site found in an untranslated region of FMR1, corresponding to BINDING SITE of FIG. 26A. FIG. 26D illustrates the complementarity of the nucleotide sequence of FMR1 BINDING SITE, designated SEQ ID:94853, to the nucleotide sequence of GAM26 RNA of FIG. 26A, designated SEQ ID:20604.

Yet a further function of GAM26 is therefore inhibition of fragile X mental retardation 1 (FMR1), a gene which encodes a protein that is associated with fragile x syndrome. Accordingly, utilities of GAM26 include diagnosis and treatment of the abovementioned diseases and clinical conditions. The function and utilities of FMR1 have been established by previous studies, as described hereinabove with reference to FIG. 26D.

Reference is now made to GSPT1 BINDING SITE. G1 to S phase transition 1 (GSPT1) is a target gene of GAM26, corresponding to GAM26-TARGET GENE of FIG. 26A. GSPT1 BINDING SITE is a binding site found in an untranslated region of GSPT1, corresponding to BINDING SITE of FIG. 26A. FIG. 26D illustrates the complementarity of the nucleotide sequence of GSPT1 BINDING SITE, designated SEQ ID:94853, to the nucleotide sequence of GAM26 RNA of FIG. 26A, designated SEQ ID:20604.

Another function of GAM26 is therefore inhibition of G1 to S phase transition 1 (GSPT1), a gene which encodes a protein that involves in regulation of mammalian cell growth. Accordingly, utilities of GAM26 include diagnosis and treatment of the abovementioned diseases and clinical conditions.

The function of GSPT1 has been established by previous studies. Kikuchi et al. (1988) isolated a gene from a yeast genomic library that could complement a temperature-sensitive mutant of Saccharomyces cerevisiae. The gene, termed GST1, seemed to be essential for the G1-to-S phase transition in the yeast cell cycle. The gene product appeared to be a GTP-binding protein of molecular mass 76,565 Da, with 38% identity in amino acid sequence with the alpha subunit of elongation factor-1 (130590). Hoshino et al. (1989) cloned the human equivalent from a cDNA library. By nonradioactive in situ hybridization, Ozawa et al. (1992) mapped the GSPT1 gene, the human homolog of the yeast gene GST1-Hs, to human chromosome 16p13.1. Southern blot hybridization with a panel of human-rodent somatic cells confirmed the localization of the GSPT1 gene on chromosome 16 and also showed the existence of a homologous gene on the X chromosome. They pointed out that a breakpoint for nonrandom chromosome rearrangements has been found in the region of GSPT1 in patients with acute nonlymphocytic leukemia.

Full details of the abovementioned studies are described in the following publications, the disclosure of which are hereby incorporated by reference:

Ozawa, K.; Murakami, Y.; Eki, T.; Yokoyama, K.; Soeda, E.; Hoshino, S.; Ui, M.; Hanaoka, F.: Mapping of the human GSPT1 gene, a human homolog of the yeast GST1 gene, to chromosomal band 16p13.1. Somat. Cell Molec. Gene 18: 189-194, 1992. PubMed ID: 1574740 1. Hoshino, S.; Miyazawa, H.; Enomoto, T.; Hanaoka, F.; Kikuchi, Y.; Kikuchi, A.; Ui, M.: A human homologue of the yeast GST1 gene codes for a GTP-binding protein and is expressed in a proliferation-dependent manner in mammalian cells. EMBO J. 8: 3807-3814, 1989.

Further studies establishing the function and utilities of GSPT1 are found in John Hopkins OMIM database record ID 139259, and in references numbered 462-464 listed hereinbelow.

Referring now to GSPT1 BINDING SITE. G1 to S phase transition 1 (GSPT1) is a target gene of GAM26, corresponding to GAM26-TARGET GENE of FIG. 26A. GSPT1 BINDING SITE is a binding site found in an untranslated region of GSPT1, corresponding to BINDING SITE of FIG. 26A. FIG. 26D illustrates the complementarity of the nucleotide sequence of GSPT1 BINDING SITE, designated SEQ ID:94853, to the nucleotide sequence of GAM26 RNA of FIG. 26A, designated SEQ ID:20604.

Yet another function of GAM26 is therefore inhibition of G1 to S phase transition 1 (GSPT1), a gene which encodes a protein that involves in regulation of mammalian cell growth. Accordingly, utilities of GAM26 include diagnosis and treatment of the abovementioned diseases and clinical conditions. The function and utilities of GSPT1 have been established by previous studies, as described hereinabove with reference to FIG. 26D.

Referring now to GSPT1 BINDING SITE. G1 to S phase transition 1 (GSPT1) is a target gene of GAM26, corresponding to GAM26-TARGET GENE of FIG. 26A. GSPT1 BINDING SITE is a binding site found in an untranslated region of GSPT1, corresponding to BINDING SITE of FIG. 26A. FIG. 26D illustrates the complementarity of the nucleotide sequence of GSPT1 BINDING SITE, designated SEQ ID:94853, to the nucleotide sequence of GAM26 RNA of FIG. 26A, designated SEQ ID:20604.

An additional function of GAM26 is therefore inhibition of G1 to S phase transition 1 (GSPT1), a gene which encodes a protein that involves in regulation of mammalian cell growth. Accordingly, utilities of GAM26 include diagnosis and treatment of the abovementioned diseases and clinical conditions. The function and utilities of GSPT1 have been established by previous studies, as described hereinabove with reference to FIG. 26D.

Reference is now made to MLLT1 BINDING SITE. Myeloid/lymphoid or mixed-lineage leukemia (trithorax (Drosophila) hom (MLLT1) is a target gene of GAM26, corresponding to GAM26-TARGET GENE of FIG. 26A. MLLT1 BINDING SITE is a binding site found in an untranslated region of MLLT1, corresponding to BINDING SITE of FIG. 26A. FIG. 26D illustrates the complementarity of the nucleotide sequence of MLLT1 BINDING SITE, designated SEQ ID:94853, to the nucleotide sequence of GAM26 RNA of FIG. 26A, designated SEQ ID:20604.

A further function of GAM26 is therefore inhibition of myeloid/lymphoid or mixed-lineage leukemia (trithorax (Drosophila) hom (MLLT1), a gene which encodes a protein that is associated with acute leukemias. Accordingly, utilities of GAM26 include diagnosis and treatment of the abovementioned diseases and clinical conditions.

The function of MLLT1 has been established by previous studies. Tkachuk et al. (1992) showed that the gene involved in recurring 11q23 leukemogenic translocations codes for an unusually large protein that is a homolog of Drosophila 'trithorax' and is involved in homeotic gene regulation (MLL; 159555). In studies of a t(11;19) translocation, they identified a chimeric protein containing the amino-terminal 'AT-hook' motifs of the MLL gene on chromosome 11 fused to a previously undescribed protein from chromosome 19. The nucleotide sequence determinations demonstrated an open reading frame that coded for a predicted 62-kD protein, which Tkachuk et al. (1992) named ENL for 'eleven-nineteen leukemia.' Nakamura et al. (1993) showed that the gene on chromosome 19 that is fused to the MLL gene (also known as ALL1 gene) in patients with leukemia and translocation t(11;19)(q23;p13) shows high sequence homology to the genes on chromosome 4 (159557) and chromosome 9 (159558) that are fused with the ALL1 gene in patient with translocation t(4;11)(q21;q23) and t(9;11)(p22;q23), respectively. The 3 protein gene products contained nuclear targeting sequences as well as serine-rich and proline-rich regions. The results suggested that the different proteins fused to ALL1 polypeptides. These leukemias provide similar functional domains. Thirman et al. (1994) pointed out that the breakpoint that results in the fusion of MLL to the ENL gene is located at 19p13.3. Another translocation t(11;19)(q23;p13.1) results in fusion of the MLL gene with the ELL gene (600284) in acute myeloid leukemia. This gene is also symbolized MLLT1.

Full details of the abovementioned studies are described in the following publications, the disclosure of which are hereby incorporated by reference:

Takamura, T.; Alder, H.; Gu, Y.; Prasad, R.; Canaani, O.; Kamada, N.; Gale, R. P.; Lange, B.; Crist, W. M.; Nowell, P. C.; Croce, C. M.; Canaani, E.: Genes on chromosomes 4, 9, and 19 involved in 11q23 abnormalities in acute leukemia share sequence homology and/or common motifs. Proc. Nat. Acad. Sci. 90: 4631-4635, 1993. PubMed ID: 8506309 3. Thirman, M. J.; Levitan, D. A.; Kobayashi, H.; Simon, M. C.; Rowley, J. D.: Cloning of ELL, a gene that fuses to MLL in a t(11;19)(q23;p13.1) in acute myeloid leukemia. Proc. Nat. Acad. Sci. 91: 12110-12114, 1994.

Further studies establishing the function and utilities of MLLT1 are found in John Hopkins OMIM database record ID 159556, and in references numbered 465-468 listed hereinbelow.

Referring now to MLLT1 BINDING SITE. Myeloid/lymphoid or mixed-lineage leukemia (trithorax (*Drosophila*) hom (MLLT1) is a target gene of GAM26, corresponding to GAM26-TARGET GENE of FIG. 26A. MLLT1 BINDING SITE is a binding site found in an untranslated region of MLLT1, corresponding BINDING SITE of FIG. 26A. FIG. 26D illustrates the complementarity of the nucleotide sequence of MLLT1 BINDING SITE, designated SEQ ID:94853, to the nucleotide sequence of GAM26 RNA of FIG. 26A, designated SEQ ID:20604.

Yet a further function of GAM26 is therefore inhibition of myeloid/lymphoid or mixed-lineage leukemia (trithorax (*Drosophila*) hom (MLLT1), a gene which encodes a protein that is associated with acute leukemias. Accordingly, utilities of GAM26 include diagnosis and treatment of the abovementioned diseases and clinical conditions. The function and utilities of MLLT1 have been established by previous studies, as described hereinabove with reference to FIG. 26D.

Reference is now made to NTRK3 BINDING SITE. Neurotrophic tyrosine kinase, receptor, type 3 (NTRK3) is a target gene of GAM26, corresponding to GAM26-TARGET GENE of FIG. 26A. NTRK3 BINDING SITE is a binding site found in an untranslated region of NTRK3, corresponding to BINDING SITE of FIG. 26A. FIG. 26D illustrates the complementarity of the nucleotide sequence of NTRK3 BINDING SITE, designated SEQ ID:94853, to the nucleotide sequence of GAM26 RNA of FIG. 26A, designated SEQ ID:20604.

Another function of GAM26 is therefore inhibition of neurotrophic tyrosine kinase, receptor, type 3 (NTRK3), a gene which encodes a protein that is a tyrosine-protein kinase receptor. Accordingly, utilities of GAM26 include diagnosis and treatment of the abovementioned diseases and clinical conditions.

The function of NTRK3 has been established by previous studies. Bothwell (1996), Carter and Lewin (1997), and Bibel and Barde (2000) reviewed neurotrophins and their receptors. Nerve growth factor receptor (NGFR; 162010) is also referred to as p75(NTR) due to its molecular mass and its ability to bind at low affinity not only NGF (see 162030), but also other neurotrophins, including brain-derived neurotrophic factor (BDNF; 113505), neurotrophin-3 (NTF3; 162660), and neurotrophin-4/5 (NTF5; 162662). As a monomer, NGFR binds NGF with low affinity. Higher affinity binding is achieved by association with higher molecular mass, low-affinity neurotrophin receptors, namely the tropomyosin receptor kinases, TRKA (NTRK1; 191315), TRKB (NTRK2; 600456), and TRKC (NTRK3). TRKA, TRKB, and TRKC are specific for or 'preferred by' NGF, NTF5 and BDNF, and NTF3, respectively (Ip et al., 1993). NTF3 also binds to TRKA and TRKB, but with significantly lower affinity. Lamballe et al. (1991) isolated and characterized TRKC, a member of the TRK family of tyrosine protein kinase genes. They found that TRKC is preferentially expressed in the brain; in situ hybridization studies showed transcripts in the hippocampus, cerebral cortex, and the granular cell layer of the cerebellum. The product of the TRKC gene is a glycoprotein of 145 kD, gp145(trkC), which is equally related to the previously characterize gp140(trk) (TRKA) and gp145(trkB) (TRKB) tyrosine kinases. Lamballe et al. (1991) demonstrated that gp145(trkC) is a receptor for NTF3, a factor important in the development of certain areas of the central nervous system, but does not bind NGF or BDNF.

Full details of the abovementioned studies are described in the following publications, the disclosure of which are hereby incorporated by reference:

Bibel, M.; Barde, Y. A.: Neurotrophins: key regulators of cell fate and cell shape in the vertebrate nervous system. Genes Dev. 14: 2919-2937, 2000. PubMed ID: 11114882 6. Lamballe, F.; Klein, R.; Barbacid, M.: TRKC, a new member of the TRK family of tyrosine protein kinases, is a receptor for neurotrophin-3. Cell 66: 967-979, 1991.

Further studies establishing the function and utilities of NTRK3 are found in John Hopkins OMIM database record ID 191316, and in references numbered 469-477 listed hereinbelow.

Reference is now made to PPP3CA BINDING SITE. Protein phosphatase 3 (formerly 2B), catalytic subunit, alpha isoform (PPP3CA) is a target gene of GAM26, corresponding to GAM26-TARGET GENE of FIG. 26. PPP3CA BINDING SITE is a binding site found in an untranslated region of PPP3CA, corresponding to BINDING SITE of FIG. 26A. FIG. 26D illustrates the complementarity of the nucleotide sequence of PPP3CA BINDING SITE, designated SEQ ID:94853, to the nucleotide sequence of GAM26 of FIG. 26A, designated SEQ ID:20604.

Yet another function of GAM26 is therefore inhibition of protein phosphatase 3 (formerly 2B), catalytic subunit, alpha isoform (PPP3CA), a gene which encodes enzyme that is the catalytic subunit of calcium-dependent, calmodulin-stimulated protein phosphatase. Accordingly, utilities of GAM26 include diagnosis and treatment of the abovementioned diseases and clinical conditions.

The function of PPP3CA has been established previous studies. Semsarian et al. (1999) and Musaro et al. (1999) independently showed that IGF1 (147440) stimulates skeletal muscle hypertrophy and a switch to glycolytic metabolism by activating calcineurin A and inducing the nuclear translocation of transcription factor NFATC1 (600489). Semsarian et al. (1999) found that hypertrophy was suppressed by the calcineurin inhibitors cyclosporin A or FK506, but not by inhibitors of the MAP kinase or phosphatidylinositol-3-OH kinase pathways. Musaro et al. (1999) showed that expression of a dominant-negative calcineurin mutant also repressed myocyte differentiation and hypertrophy. Musaro et al. (1999) demonstrated that either IGF1 or activated calcineurin induces expression of transcription factor GATA2 (137295), which accumulates in a subset of myocyte nuclei, where it associates with calcineurin and a specific dephosphorylated isoform of NFATC1.

Animal model experiments lend further support to the function of PPP3CA. Winder et al. (1998) generated transgenic mice that overexpressed a truncated form of the murine calcineurin A-alpha catalytic subunit under the control of the CaMKII-alpha promoter. Mice expressing this transgene show increased calcium-dependent phosphatase activity in the hippocampus. Physiologic studies and pharmacologic experiments revealed a novel, intermediate phase of long-term potentiation (I-LTP) in the CA1 region of the hippocampus. This I-LTP differs from the E-LTP (early component of LTP) by requiring multiple trains for induction and in being dependent on PKA (cAMP-dependent protein kinase). It also differs from the L-LTP (late component of LTP) in not requiring new protein synthesis. These data suggested to Winder et al. (1998) that calcineurin acts as an inhibitory constraint on I-LTP that is relieved by PKA, and that this inhibitory constraint acts as a gate to regulate the synaptic induction of L-LTP.

It is appreciated that the abovementioned animal model for PPP3CA is acknowledged by those skilled in the art as a scientifically valid animal model, as can be further appreciated from the publications sited hereinbelow.

Full details of the abovementioned studies are described in the following publications, the disclosure, of which are hereby incorporated by reference:
Winder, D. G.; Mansuy, I. M.; Osman, M.; Moallem, T. M.; Kandel, E. R.: Genetic and pharmacological evidence for a novel, intermediate phase of long-term potentiation suppressed by calcineurin. Cell 92: 25-37, 1998. PubMed ID:9489697 2. Fuentes, J. J.; Genesca, L.; Kingsbury, T. J.; Cunningham, K. W.; Perez-Riba, M.; Estivill, X.; de la Luna, S.: DSCR1, overexpressed in Down syndrome, is an inhibitor of calcineurin-mediated signaling pathways. Hum. Molec. Genet 9: 681-1690, 2000.

Further studies establishing the function and utilities of PPP3CA are found in John Hopkins OMIM database record ID 114105, and in references numbered 478-490 listed hereinbelow.

Referring now to PPP3CA BINDING SITE. Protein phosphatase 3 (formerly 2B), catalytic subunit, alpha isoform (PPP3CA) is a target gene of GAM26, corresponding to GAM26-TARGET GENE of FIG. 26A. PPP3CA BINDING SITE is a binding site found in an untranslated region of PPP3CA, corresponding to BINDING SITE of FIG. 26A. FIG. 26D illustrates the complementarity of the nucleotide sequence of PPP3CA BINDING SITE, designated SEQ ID:94853, to the nucleotide sequence of GAM26 RNA of FIG. 26A, designated SEQ ID:20604.

An additional function of GAM26 is therefore inhibition of protein phosphatase 3 (formerly 2B), catalytic subunit, alpha isoform (PPP3CA), a gene which encodes enzyme that is the catalytic subunit of calcium-dependent, calmodulin-stimulated protein phosphatase. Accordingly, utilities of GAM26 include diagnosis and treatment of the abovementioned diseases and clinical conditions. The function and utilities of PPP3CA have been established by previous studies, as described hereinabove with reference to FIG. 26D.

Referring now to PPP3CA BINDING SITE. Protein phosphatase 3 (formerly 2B), catalytic subunit, alpha isoform (PPP3CA) is a target gene of GAM26, corresponding to GAM26-TARGET GENE of FIG. 26A. PPP3CA BINDING SITE is a binding site found in an untranslated region of PPP3CA, corresponding to BINDING SITE of FIG. 26A. FIG. 26D illustrates the complementarity of the nucleotide sequence of PPP3CA BINDING SITE designated SEQ ID:94853, to the nucleotide sequence of GAM26 RNA of FIG. 26A, designated SEQ ID:20604.

A further function of GAM26 is therefore inhibition of protein phosphatase 3 (formerly 2B), catalytic subunit, alpha isoform (PPP3CA), a gene which encodes enzyme that is the catalytic subunit of calcium-dependent, calmodulin-stimulated protein phosphatase. Accordingly, utilities of GAM26 include diagnosis and treatment of the abovementioned diseases and clinical conditions. The function and utilities of PPP3CA have been established by previous studies, as described hereinabove with reference to FIG. 26D.

Reference is now made to RELN BINDING SITE. Reelin (RELN) is a target gene of GAM26, corresponding to GAM26-TARGET GENE of FIG. 26A. RELN BINDING SITE is a binding site found in an untranslated region of RELN, corresponding to BINDING SITE of FIG. 26A. FIG. 26D illustrates the complementarity of the nucleotide sequence of RELN BINDING SITE, designated SEQ ID:94853, to the nucleotide sequence of GAM26 RNA of FIG. 26A, designated SEQ ID:20604.

Yet a further function of GAM26 is therefore inhibition of reelin (RELN), a gene which encodes transcription factor that is associated with Norman-Roberts syndrome. Accordingly, utilities of GAM26 include diagnosis and treatment of the abovementioned diseases and clinical conditions.

The function of RELN has been established by previous studies. Normal development of the cerebral cortex requires long-range migration of cortical neurons from proliferative regions deep in the brain. Lissencephaly ('smooth brain,' from 'lissos,' meaning 'smooth,' and 'encephalos,' meaning 'brain') is a severe developmental disorder in which neuronal migration is impaired, leading to a thickened cerebral cortex whose normally folded contour is simplified and smooth. X-linked lissencephaly (300067) is caused by mutation in the gene encoding doublecortin (DCX; 300121). Deletion of or mutation in the LIS1 gene (601545), located on 17p, causes isolated lissencephaly sequence (ILS), and haploinsufficiency of this and other neighboring genes is responsible for the Miller-Dieker lissencephaly syndrome (247200), a contiguous gene deletion syndrome. Lissencephaly is a feature of a number of syndromes, such as the Walker-Warburg syndrome (236670). Hong et al. (2000) studied an autosomal recessive form of lissencephaly associated with severe abnormalities of the cerebellum, hippocampus, and brainstem; see lissencephaly syndrome, Norman-Roberts type (257320). They tested for linkage to markers near RELN on chromosome 7 and DAB1 on 1p32-p31, because mutations in the mouse homologs of these 2 genes cause brain defects in mice that resemble lissencephaly, including hypoplasia of the cerebellum, brainstem abnormalities, and a neuronal migration disorder of the neocortex and hippocampus. In 2 unrelated pedigrees, they found substantial regions of homozygosity in affected children near the RELN locus on 7q22. In these 2 families, they demonstrated different splice site mutations in the RELN gene. The study of these human patients pointed to several previously unsuspected functions of reelin in and outside of the brain. Although abnormalities of RELN mRNA had been reported in postmortem rains of schizophrenic humans (Impagnatiello et al., 1998), no evidence of schizophrenia was found in individuals with heterozygous or homozygous RELN mutations. On the other hand, one of the lissencephaly patients studied with a muscle biopsy showed evidence of abnormal neuromuscular connectivity (Hourihane et al., 1993). Moreover, at least 3 patients had persistent lymphedema neonatally, and one showed accumulation of chlyous (i.e., fatty) ascites fluid that required peritoneal shunting (Hourihane et al., 1993). The apparent role for reelin in serum homeostasis may reflect reelin interactions with LDL superfamily receptors outside the brain, as well as in the brain.

Animal model experiments lend further support to the function of RELN. To investigate Reln function, Magdaleno et al. (2002) generated transgenic mice using the nestin (NES; 600915) promoter to drive ectopic expression of Reln in the ventricular zone during early brain development. Ectopic Reln expression in transgenic reelin mice, which lack endogenous Reln expression, induced tryosine phosphorylation of Dab1 in the ventricular zone. The transgene also rescued some, but not all, of the neuroanatomic and behavioral abnormalities characteristic of the reeler phenotype, including ataxia and the migration of Purkinje cells. Magdaleno et al. (2002) hypothesized that Reln functions in concert with other positional cues to promote cell-cell interactions that are required for layer formation during development.

It is appreciated that the abovementioned animal model for RELN is acknowledged by those skilled in the art as a scientifically valid animal model, as can be further appreciated from the publications sited hereinbelow.

Full details of the abovementioned studies are described in the following publications, the disclosure of which are hereby incorporated by reference:

Hong, S. E.; Shugart, Y. Y.; Huang, D. T.; Al Shahwan, S.; Grant, P. E.; Hourihane, J. O.; Martin, N. D. T.; Walsh, C. A.: Autosomal recessive lissencephaly with cerebellar hypoplasia is associated with human RELN mutations. Nature Genet. 26: 93-96, 2000. Note: Erratum: Nature Genet. 27: 225 only, 2001. PubMed ID:10973257 12. Magdaleno, S.; Keshvara, L.; Curran, T.: Rescue of ataxia and preplate splitting by ectopic expression of reelin in reeler mice. Neuron 33: 573-586, 2002.

Further studies establishing the function and utilities of RELN are found in John Hopkins OMIM data base record ID 600514, and in references numbered 491-505 listed hereinbelow.

Reference is now made to RGS19IP1 BINDING SITE. (RGS19IP1) is a target gene of GAM26, corresponding to GAM26-TARGET GENE of FIG. 26A. RGS19IP1 BINDING SITE is a binding site found in an untranslated region of RGS19IP1, corresponding to BINDING SITE of FIG. 26A. FIG. 26D illustrates the complementarity of the nucleotide sequence of RGS19IP1 BINDING SITE, designated SEQ ID:94853, to the nucleotide sequence of GAM26 RNA of FIG. 26A, designated SEQ ID:20604.

Another function of GAM26 is therefore inhibition of (RGS19IP1), a gene which encodes a protein that is involved in g protein-linked signaling. Accordingly, utilities of GAM26 include diagnosis and treatment the abovementioned diseases and clinical conditions.

The function of RGS19IP1 has been established by previous studies. Northern blot analysis detected a 1.8-kb C19ORF3 transcript in all tissues tested, with strongest expression in pancreas, followed by skeletal muscle, brain, kidney, placenta, lung, liver, and lowest expression in heart. Expression levels did not correlate with those of GAIP. Immunoblot analysis demonstrated the presence of C19ORF3 primarily in cytosolic fractions but also in membrane fractions. Immunofluorescence analysis showed expression of endogenous C19ORF3 in both a diffuse and a punctate staining pattern throughout the cytoplasm. Using a yeast 2-hybrid system, Bunn et al. (1999) isolated a cDNA encoding C19ORF3, which they called GLUT1CBP (GLUT1 (SLC2A1; 138140) C-terminus-binding protein). SDS-PAGE and Western blot analyses determined that C19ORF3 is expressed as a 39-kD protein in all tissues tested except small intestine. Yeast 2-hybrid analysis showed that C19ORF3 binds SLC2A1 through its PDZ domain. Northern blot analysis revealed similar expression patterns for C19ORF3 and SLC2A1, with both being expressed most strongly in brain. Using a yeast 2-hybrid screen for brain-interacting proteins, the authors determined that only SLC2A1, KIF1B, and alpha actinin-1 (ACTN1; 102575) bind C19ORF3 through its PDZ domain; myosin VI (MYO6; 600970) was shown to interact with C19ORF3 but not via the PDZ domain.

Full details of the abovementioned studies are described in the following publications, the disclosure of which are hereby incorporated by reference.

Bunn, R. C.; Jensen, M. A.; Reed, B. C.: Protein interactions with the glucose transporter binding protein GLUT1CBP that provides a link between GLUT1 and the cytoskeleton. Molec. Biol. Cell 10: 819-832, 1999. PubMed ID: 10198040 Von Kap-Herr, C.; Kandala, G.; Mann, S. S.; Hart, T. C.; Pettenati, M. J.; Setaluri, V.: Assignment of PDZ domain-containing protein GIPC gene (C19orf3) to human chromosome band 19p13.1 by in situ hybridization and radiation hybrid mapping. Cytogenet Cell Genet. 89: 234-235, 2000.

Further studies establishing the function and utilities of RGS19IP1 are found in John Hopkins OMIM database record ID 605072, and in references numbered 506-508 listed hereinbelow.

Referring now to RGS19IP1 BINDING SITE. (RGS19IP1) is a target gene of GAM26, corresponding to GAM26-TARGET GENE of FIG. 26A. RGS19IP1 BINDING SITE is a binding site found in an untranslated region of RGS19IP1, corresponding to BINDING SITE of FIG. 26A. FIG. 26D illustrates the complementarity of the nucleotide sequence of RGS19IP1 BINDING SITE, designated SEQ ID:94853, to the nucleotide sequence of GAM26 RNA of FIG. 26A, designated ID:20604.

Yet another function of GAM26 is therefore inhibition of (RGS19IP1), a gene which encodes a protein that is involved in g protein-linked signaling. Accordingly, utilities of GAM26 include diagnosis and treatment the abovementioned diseases and clinical conditions. The function and utilities of RGS19IP1 have been established by previous studies, as described hereinabove with reference to FIG. 26D.

Referring now to RGS19IP1 BINDING SITE. RGS19IP1) is a target gene of GAM26, corresponding to GAM26-TARGET GENE of FIG. 26A. RGS19IP1 BINDING SITE is a binding site found in an untranslated region of RGS19IP1, corresponding to BINDING SITE of FIG. 26A. FIG. 26D illustrates the complementarity of the nucleotide sequence of RGS19IP1 BINDING SITE, designated SEQ ID:94853, to the nucleotide sequence of GAM26 RNA of FIG. 26A, designated SEQ ID:20604.

An additional function of GAM26 is therefore inhibition of (RGS19IP1), a gene which encodes a protein that is involved in g protein-linked signaling. Accordingly, utilities of GAM26 include diagnosis and treatment of the abovementioned diseases and clinical conditions. The function and utilities of RGS19IP1 have been established by previous studies, as described hereinabove with reference to FIG. 26D.

Referring now to RGS19IP1 BINDING SITE. (RGS19IP1) is a target gene of GAM26, corresponding to GAM26-TARGET GENE of FIG. 26A. RGS19IP1 BINDING SITE is a binding site found in an untranslated region of RGS19IP1, corresponding to BIND NG SITE of FIG. 26A. FIG. 26D illustrates the complementarity of the nucleotide sequence of RGS19IP1 BINDING SITE, designated SEQ ID:94853, to the nucleotide sequence of GAM26 RNA of FIG. 26A, designated SEQ ID:20604.

A further function of GAM26 is therefore inhibition of (RGS19IP1), a gene which encodes a protein that is involved in g protein-linked signaling. Accordingly, utilities of GAM26 include diagnosis and treatment of the abovementioned diseases and clinical conditions. The function and utilities of RGS19IP1 have been established by previous studies, as described hereinabove with reference to FIG. 26D.

Reference is now made to UBE2B BINDING SITE. Ubiquitin-conjugating enzyme E2B (RAD6 homolog) (UBE2B) is a target gene of GAM26, corresponding to GAM26-TARGET GENE of FIG. 26A. UBE2B BINDING SITE is a binding site found in an untranslated region of UBE2B, corresponding to BINDING SITE of FIG. 26A. FIG. 26D illustrates the complementarity of the nucleotide sequence of UBE2B BINDING SITE, designated SEQ ID:94853, to the nucleotide sequence of GAM26 RNA of FIG. 26A, designated SEQ ID:20604.

Yet a further function of GAM26 is therefore inhibition of ubiquitin-conjugating enzyme E2B (RAD6 homolog) (UBE2B), a gene which encodes an enzyme that catalyzes the covalent attachment of ubiquitin to other proteins and is required for postreplication repair of uv-damaged DNA. Accordingly, utilities of GAM26 include diagnosis and treatment of the abovementioned diseases and clinical conditions.

The function of UBE2B has been established by previous studies. The RAD6 pathway is central to postreplicative DNA repair in eukaryotic cells. Two principal elements of this pathway are the ubiquitin-conjugating enzymes RAD6 and the MMS2 (603001)-UBC13 (603679) heterodimer, which are recruited to chromatin by the RING-finger proteins RAD18 (6015256) and RAD5 (607266), respectively. Hoege et al. (2002) showed that UBC9 (601661), a small ubiquitin-related modifier (SUMO)-conjugating enzyme, is also affiliated with this pathway and that proliferating cell nuclear antigen (PCNA; 176740), a DNA polymerase sliding clamp involved in DNA synthesis and repair, is a substrate. PCNA is monoubiquitinated through RAD6 and RAD18, modified by lys63-linked multiubiquitination, which additionally requires MMS2, UBC13, and RAD5, and is conjugated to SUMO by UBC9. All 3 modifications affect the same lysine residue of PCNA, K164, suggesting that they label PCNA for alternative functions. Hoege et al. (2002) demonstrated that these modifications differentially affect resistance to DNA damage, and that damage-induced PCNA ubiquitination is elementary for DNA repair and occurs at the same conserved residue in yeast and humans.

Animal model experiments lend further support to the function of UBE2B. Roest et al. (1996) reported the phenotype of the first animal mutant in the ubiquitin pathway. Experimental inactivation of the RAD6B gene in mice caused male infertility. Derailment of spermatogenesis became overt during the postmeiotic condensation of chromatin in spermatids. In yeast the gene is not only implicated in postreplication repair and damage-induced mutagenesis but is also required for sporulation and may modulate chromatin structure via histone ubiquitination. The authors stated that the findings in the 'knock-out' mice provided a parallel between yeast sporulation and mammalian spermatogenesis and strongly implicated RAD6-dependent ubiquitination in chromatin remodeling in the human. Since heterozygous male mice and even knockout female mice are completely normal and fertile and thus able to transmit the defect, similar RAD6B mutations may cause male infertility in man. The fact that the RAD6B mice are viable and phenotypically normal is presumably due to functional redundancy with RAD6A (312180).

It is appreciated that the abovementioned animal model for UBE2B is acknowledged by those skilled in the art as a scientifically valid animal model, as can be further appreciated from the publications sited hereinbelow.

Full details of the abovementioned studies are described in the following publications, the disclosure of which are hereby incorporated by reference:

Hoege, C.; Pfander, B.; Moldovan, G. -L.; Pyrowolakis, G.; Jentsch, S.: RAD6-dependent DNA repair is linked to modification of PCNA by ubiquitin and SUMO. Nature 419: 135-141, 2002. PubMed ID: 12226657 Roest, H. P.; van Klaveren, J.; de Wit, J.; van Gurp, C. G.; Koken, M. H. M.; Vermey, M.; van Roijen, J. H.; Hoogerbrugge, J. W.; Vreeburg, J. T. M.; Baarends, W. M.; Bootsma, D.; Grootegoed, J. A.; Hoeijmakers, J. H. J.: Inactivation of the HR6B ubiquitin-conjugating DNA repair enzyme in mice causes male sterility associated with chromatin modification. Cell 86: 799-810, 1996.

Further studies establishing the function and utilities of UBE2B are found in John Hopkins OMIM database record ID 179095, and in references numbered 509-513 listed hereinbelow.

Referring now to UBE2B BINDING SITE. Ubiquitin-conjugating enzyme E2B (RAD6 homolog) (UBE2B) is a target gene of GAM26, corresponding to GAM26-TARGET GENE of FIG. 26A. UBE2B BINDING SITE is a binding site found in an untranslated region of UBE2B, corresponding to BINDING SITE of FIG. 26A. FIG. 26D illustrates the complementarity of the nucleotide sequence of UBE2B BINDING SITE, designated SEQ ID:94853, to the nucleotide sequence of GAM26 RNA of FIG. 26A, designated SEQ ID:20604.

Another function of GAM26 is therefore inhibition of ubiquitin-conjugating enzyme E2B (RAD6 homolog) (UBE2B), a gene which encodes an enzyme that catalyzes the covalent attachment of ubiquitin to other proteins and is required for postreplication repair of uv-damaged DNA. Accordingly, utilities of GAM26 include diagnosis and treatment of the abovementioned diseases and clinical conditions. The function and utilities of UBE2B have been established by previous studies, as described hereinabove with reference to FIG. 26D.

Referring now to UBE2B BINDING SITE. Ubiquitin-conjugating enzyme E2B (RAD6 homolog) (UBE2B) is a target gene of GAM26, corresponding to GAM26-TARGET GENE of FIG. 26A. UBE2B BINDING SITE is a binding site found in an untranslated region of UBE2B, corresponding to BINDING SITE of FIG. 26A. FIG. 26D illustrates the complementarity of the nucleotide sequence of UBE2B BINDING SITE, designated SEQ ID:94853, to the nucleotide sequence of GAM26 RNA of FIG. 26A, designated SEQ ID:20604.

Yet another function of GAM26 is therefore inhibition of ubiquitin-conjugating enzyme (RAD6 homolog) (UBE2B), a gene which encodes an enzyme that catalyzes the covalent attachment of ubiquitin to other proteins and is required for postreplication repair of uv-damaged DNA. Accordingly, utilities of GAM26 include diagnosis and treatment of the abovementioned diseases and clinical conditions. The function and utilities of UBE2B have been established by previous studies, as described hereinabove with reference to FIG. 26D.

Referring now to UBE2B BINDING SITE. Ubiquitin-conjugating enzyme E2B (RAD6 homolog) (UBE2B) is a target gene of GAM26, corresponding to GAM26-TARGET GENE of FIG. 26A. UBE2B BINDING SITE is a binding site found in an untranslated region of UBE2B, corresponding to BINDING SITE of FIG. 26A. FIG. 26D illustrates the complementarity of the nucleotide sequence of UBE2B BINDING SITE, designated SEQ ID:94853, to the nucleotide sequence of GAM26 RNA of FIG. 26A, designated SEQ ID:20604.

An additional function of GAM26 is therefore inhibition of ubiquitin-conjugating enzyme E2B (RAD6 homolog) (UBE2B), a gene which encodes an enzyme that catalyzes the covalent attachment of ubiquitin to other proteins and is required for postreplication repair of uv-damaged DNA. Accordingly, utilities of GAM26 include diagnosis and treatment of the abovementioned diseases and clinical conditions. The function and utilities of UBE2B have been established by previous studies, as described hereinabove with reference to FIG. 26D.

Reference is now made to CAMK4 BINDING SITE calcium/calmodulin-dependent protein kinase IV (CAMK4) is a target gene of GAM26, corresponding to GAM26-TARGET GENE of FIG. 26A. CAMK4 BINDING SITE is a binding site found in an untranslated region of CAMK4, corresponding to BINDING SITE of FIG. 26A. FIG. 26D illustrates the complementarity of the nucleotide sequence of CAMK4 BINDING SITE, designated SEQ ID:94860; to the nucleotide sequence of GAM26 RNA of FIG. 26A, designated SEQ ID 20604.

A further function of GAM26 is therefore inhibition of calcium/calmodulin-dependent protein kinase IV (CAMK4), a gene which encodes an enzyme that is a heat-stable, acidic, calmodulin-binding protein. Accordingly, utilities of GAM26 include diagnosis and treatment of the abovementioned diseases and clinical conditions.

The function of CAMK4 has been established by previous studies. Protein phosphorylation, a prominent activity in the brain, apparently plays an important role in several neural functions such as neural transmitter release, ion channel modulation, and axoplasmic transport. Sikela et al. (1989) identified cDNA clones corresponding to a brain Ca(2+)/calmodulin-dependent protein kinase, which they referred to as brain CaM kinase IV (CAMK4). On the basis of Western blot analysis, this kinase appeared to be restricted to brain in the rat; interestingly, it was not detected in the brain of the newborn, but became detectable within a few days after birth.

Animal model experiments lend further support to the function of CAMK4. Camk4 is a multifunctional serine/threonine protein kinase with limited tissue distribution that has been implicated in transcriptional regulation in lymphocytes, neurons, and male germ cells. In the mouse testis, however, Camk4 is expressed in spermatids and associated with chromatin and nuclear matrix. Elongating spermatids are not transcriptionally active, rising the possibility that Camk4 has a novel function in male germ cells. To investigate the role of Camk4 in spermatogenesis, Wu et al. (2000) generated mice with a targeted deletion of the Camk4 gene. Male Camk4 −/− mice were infertile with impairment of spermiogenesis in late elongating spermatids. The sequential deposition of sperm basic nuclear proteins on chromatin was disrupted, with a specific loss of protamine-2 (182890) and prolonged retention of transition protein-2 (190232) in step-15 spermatids. Protamine-2 is phosphorylated by Camk4 in vitro implicating a connection between Camk4 signaling and the exchange of basic nuclear proteins in mammalian male germ cells. Defects in protamine-2 have been identified in sperm of infertile men, suggesting that the results of Wu et al. (2000) may have clinical implications for the understanding of human male infertility.

It is appreciated that the abovementioned animal model for CAMK4 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Sikela, J. L.; Law, M. L.; Kao, F. -T.; Hartz, J. A.; Wei, Q.; Han, W. E.: Chromosomal localization of the human gene for brain Ca(2+)/calmodulin-dependent protein kinase type IV. Genomics 4: 21-27, 1989. PubMed ID: 6634 7.

Wu, J. Y.; Ribar, T. J.; Cummings D. E.; Burton, K. A.; McKnight, G. S.; Means, A. R.: Spermiogenesis and exchange of basic nuclear proteins are impaired in male germ cells lacking Camk4 Nature Genet. 25: 448-452, 2000.

Further studies establishing the function and utilities of CAMK4 are found in John Hopkins OMIM database record ID 114080, and in references numbered 514-520 listed hereinbelow.

Referring now to CBL BINDING SITE. Cas-B-M (murine) ecotropic retroviral transforming sequence (CBL) is a target gene of GAM26, corresponding to GAM26-TARGET GENE of FIG. 26A. CBL BINDING SITE is a binding site found in an untranslated region of CBL, corresponding to BINDING SITE of FIG. 26A. FIG. 26D illustrates the complementarity of the nucleotide sequence of CBL BINDING SITE, designated SEQ ID:94860, to the nucleotide sequence of GAM26 RNA of FIG. 26A, designated SEQ ID:20604.

Yet a further function of GAM26 is therefore inhibition of Cas-Br-M (murine) ecotropic retroviral transforming sequence (CBL), a gene which encodes a protein that may modify receptor tyrosine kinase-mediated signal transduction, and is associated with B-lineage lymphomas. Accordingly, utilities of GAM26 include diagnosis and treatment of the abovementioned diseases and clinical conditions. The function and utilities of CBL have been established by previous studies, as described hereinabove with reference to FIG. 26D.

Reference is now made to CD47 BINDING SITE. CD47 antigen (Rh-related antigen, integrin-associated signal transduce (CD47) is a target gene of GAM26, corresponding to GAM26-TARGET GENE of FIG. 26A. CD47 BINDING SITE is a binding site found in an untranslated region of CD47, corresponding to BINDING SITE of FIG. 26A. FIG. 26D illustrates the complementarity of the nucleotide sequence of CD47 BINDING SITE, designated SEQ ID:97660, to the nucleotide sequence of GAM26 RNA of FIG. 26A, designated SEQ ID:20604.

Another function of GAM26 is therefore inhibition of CD47 antigen (Rh-related antigen, integrin-associated signal transduce (CD47), a gene which encodes a protein that may be involved in membrane permeability changes induced following virus infection. Accordingly, utilities of GAM26 include diagnosis and treatment of the abovementioned diseases and clinical conditions.

The function of CD47 has been established by previous studies. By testing hybrids containing various deletions of chromosome 3, Miller et al (1987) described an IgM monoclonal antibody, 1D8, that recognized an antigen coded by a gene located in the region 3cen-q22. The monoclonal antibody was designated MER6. The antigen was absent in the Rh deficiency syndrome, Rh-null hemolytic anemia (268150). This antigen probably had no pathogenetic role in the Rh deficiency, which was shown by Cherif-Zahar et al. (1996) to be due to mutation in the Rh50 gene (190297) on chromosome 6. They noted that many cell Animal model experiments lend further support to the function of CD47. By testing hybrids containing various deletions of chromosome 3, Miller et al. (1987) described an IgM monoclonal antibody, 1D8, that recognized an antigen coded by a gene located in the region 3cen-q22. The monoclonal antibody was designated MER6. The antigen was absent in the Rh deficiency syndrome, Rh-null hemolytic anemia (268150). This antigen probably had no pathogenetic role in the Rh deficiency, which was shown by Cherif-Zahar et al. (1996) to be due to mutation in the Rh50 gene (180297) on chromosome 6. They noted that many cell It is appreciated that the abovementioned animal model for CD47 is acknowledged by those skilled in the art as a scientifically valid animal model, as can be further appreciated from the publications sited hereinbelow.

Full details of the abovementioned studies are described in the following publications, the disclosure of which are hereby incorporated by reference:

By testing hybrids containing various deletions of chromosome 3, Miller et al. (1987) described an IgM monoclonal antibody, 1D8, that recognized an antigen coded by a gene located in the region 3cen-q22. The monoclonal antibody was designated MER6. The antigen was absent in the Rh deficiency syndrome, Rh-null hemolytic anemia (268150). This antigen probably had no pathogenetic role in the Rh deficiency, which was shown by Cherif-Zahar et al. (1996) to be due to mutation in the Rh50 gene (180297) on chromosome 6. They noted that many cell.

Further studies establishing the function and utilities of CD47 are found in John Hopkins OMIM database record ID 601028, and in references numbered 521-527 listed hereinbelow.

Reference is now made to CDC2L1 BINDING SITE. cell division cycle 2-like 1 (PITSLRE proteins) (CDC2L1) is a target gene of GAM26, corresponding to GAM26-TARGET GENE of FIG. 26A. CDC2L1 BINDING SITE is a binding site found in an untranslated region of CDC2L1, corresponding to BINDING SITE of FIG. 26A. FIG. 26D illustrates the complementarity of the nucleotide sequence of CDC2L1 BINDING SITE, designated SEQ ID:99045, to the nucleotide sequence of GAM26 RNA of FIG. 26A, designated SEQ ID:20604.

Yet another function of GAM26 is therefore inhibition of cell division cycle 2-like 1 (PITSLRE proteins) (CDC2L1), a gene which encodes a protein that is a negative regulator of normal cell cycle progression. Accordingly, utilities of GAM26 include diagnosis and treatment of the abovementioned diseases and clinical conditions.

The function of CDC2L1 has been established by previous studies. Bunnell et al. (1990) identified a human cell division control (CDC)-related protein kinase, p58, that is structurally and functionally related to p34(cdc2) (CDC2; 116940). Abnormal expression of the p58 protein kinase in eukaryotic cells had effects suggesting that it is a negative regulator of normal cell cycle progression. The gene is well conserved evolutionarily. Its expression is regulated during murine embryogenesis, and its activity is coordinately regulated with that of p34(cdc2) during the cell cycle. Eipers et al. (1991) assigned the expressed p58 gene to 1p36 by somatic cell hybrid analysis, in situ hybridization, and nested PCR amplification of microdissected chromosomes. The authors stated that this gene, tentatively symbolized PK58, may be implicated in the pathogenesis of tumors that have deletion in the region of 1p36. Eipers et al. (1992) detailed the complete structure of the CDC2L1 gene including its putative promoter region, transcriptional start sites, exonic sequences, and intron/exon boundary sequences. The gene is 10 kb in size and contains 12 exons and 11 introns.

Full details of the abovementioned studies are described in the following publications, the disclosure of which are hereby incorporated by reference:

Bunnell, B.; Heath, L. S.; Adams, D. E.; Lahti, J. M.; Kidd, V. J.: Elevated expression of a p58 protein kinase leads to changes in the CHO cell cycle. Proc. Nat. Acad. Sci. 87: 7467-747, 1990. PubMed ID: 2217177 2. Cornelis, S.; Bruynooghe, Y.; Denecker, G.; Van Huffel, S.; Tinton, S.; Beyaert, R.: Identification and characterization of a novel cell cycle-regulated internal ribosome entry site. Molec. Cell 5: 597-605, 2000.

Further studies establishing the function and utilities of CDC2L1 are found in John Hopkins OMIM database record ID 176873, and in references numbered 528-535 listed hereinbelow.

Referring now to CDC2L1 BINDING SITE. Cell division cycle 2-like 1 (PITSLRE proteins) (CDC2L1) is a target gene of GAM26, corresponding to GAM26-TARGET GENE of FIG. 26A. CDC2L1 BINDING SITE is a binding site found in an untranslated region of CDC2L1, corresponding to BINDING SITE of FIG. 26A. FIG. 26D illustrates the complementarity of the nucleotide sequence of CDC2L1 BINDING SITE, designated SEQ ID:99046, to the nucleotide sequence of GAM26 RNA of FIG. 26A, designated SEQ ID:20604.

An additional function of GAM26 is therefore inhibition of cell division cycle 2-like 1 (PITSLRE proteins) (CDC2L1), a gene which encode a protein that is a negative regulator of normal cell cycle progression. Accordingly, utilities of GAM26 include diagnosis and treatment of the abovementioned diseases ad clinical conditions. The function and utilities of CDC2L1 have been established by previous studies, as described hereinabove with reference to FIG. 26D.

Reference is now made to CDC34 BINDING SITE. Cell division cycle 34 (CDC34) is a target gene of GAM26, corresponding to GAM26-TARGET GENE of FIG. 26A. CDC34 BINDING SITE is a binding site found in an untranslated region of CDC34, corresponding to BINDING SITE of FIG. 26A. FIG. 26D illustrates the complementarity of the nucleotide sequence of CDC34 BINDING SITE, designated SEQ ID:99180, to the nucleotide sequence of GAM26 RNA of FIG. 26A, designated SEQ ID:20604.

A further function of GAM26 is therefore inhibition of cell division cycle 34 (CDC34), a gene which encodes a protein that catalyzes the covalent attachment of ubiquitin to other proteins. Accordingly, utilities of GAM26 include diagnosis and treatment of the abovementioned diseases and clinical conditions.

The function of CDC34 has been established by previous studies. Genomic instability with aneuploidy and chromosomal rearrangement is a hallmark of human malignancies. Normal eukaryotes from yeasts to humans have a conserved checkpoint mechanism in cell division for maintenance of genomic stability. After DNA strand breaks, checkpoint genes induce rest in the G1 and G2 phases of the cell cycle until the damage is repaired. The tumor suppressor gene p53 (191170) is a checkpoint gene required for the G1 arrest after DNA damage. Plon et al. (1993) isolated a putative human G2 checkpoint gene, a homolog of the CDC34 gene of *Saccharomyces cerevisiae*. Human CDC34 could substitute efficiently for yeast CDC34. Plon et al. (1993) demonstrated by in situ hybridization that the CDC34 gene is located in the far telomeric region of 19p13.3, in a region of homology between human 19p and mouse 11.

Full details of the abovementioned studies are described in the following publications, the disclosure of which are hereby incorporated by reference:

Plon, S. E.; Leppig, K. A.; Do, H. -N.; Groudine, M.: Cloning of the human homolog of the CDC34 cell cycle gene by complementation in yeast. Proc. Nat. Acad. Sci. 90: 10484-10488, 1993.

Further studies establishing the function and utilities of CDC34 are found in John Hopkins OMIM database record ID 116948, and in references numbered 536 listed hereinbelow.

Reference is now made to CDH23 BINDING SITE. Cadherin related 23 (CDH23) is a target gene of GAM26, corresponding to GAM26-TARGET GENE of FIG. 26A. CDH23 BINDING SITE is a binding site found in an untranslated region of CDH23, corresponding to BINDING SITE of FIG. 26A. FIG. 26D illustrates the complementarity of the nucleotide sequence of CDH23 BINDING SITE, designated SEQ ID:100443, to the nucleotide sequence of GAM26 RNA of FIG. 26A, designated SEQ ID:20604.

Yet a further function of GAM26 is therefore inhibition of cadherin related 23 (CDH23), a gene which encodes a protein that is associated with usher syndrome type 1d (ush1d). Accordingly, utilities of GAM26 include diagnosis and treatment of the abovementioned diseases and clinical conditions.

The function of CDH23 has been established by previous studies. Bolz et al. (2001) identified a Cuban pedigree in which type I Usher syndrome was linked to the USH1D locus on chromosome 10. Affected individuals presented with congenital deafness and a highly variable degree of retinal degeneration as an autosomal recessive trait. Using a positional candidate approach, Bolz et al. (2001) identified CDH23 as the gene responsible for USH1D in these individuals. CDH23 encodes a predicted protein of 3,354 amino acids with a single transmembrane domain and 27 cadherin repeats. In the Cuban family, the authors detected 2 different CDH23 mutations. A severe course of the retinal disease was observed in individuals homozygous for a presumed truncating splice-site mutation (605516.0001), whereas mild retinitis pigmentosa was present in individuals carrying a homozygous missense mutation (605516.0002). Variable expression of the retinal phenotype was seen in patients with a combination of the 2 mutations. Bolz et al. (2001) also identified 2 mutations in the CDH23 gene in a German patient with Usher syndrome (see 605516.0003). Only missense mutations of CDH23 have been observed in families with nonsyndromic deafness, whereas nonsense, frameshift, splice-site, and missense mutations have been identified in families with Usher syndrome. Astuto et al. (2002) screened a panel of 69 probands with Usher syndrome and 38 probands with recessive nonsyndromic deafness for the presence of mutations in the entire coding region of CDH23, by heteroduplex, SSCP, and direct sequence analyses. Thirty-six different CDH23 mutations were detected in 45 families; 33 of these mutations were novel, including 18 missense, 3 nonsense, 5 splicing defects, 5 microdeletions, and 2 insertions. Seven mutations were common to more than 1 family. Ophthalmologic examination of patients with nonsyndromic deafness revealed asymptomatic manifestations similar to retinitis pigmentosa (RP; 268000), which indicated that missense mutations may have a subtle effect in the retina. Furthermore, patients with mutations in CDH23 displayed a wide range of hearing loss and RP phenotypes, differing in severity, age at onset, type, and the presence or absence of vestibular areflexia. Astuto et al. (2002) also presented a comprehensive catalog of CDH23 mutations identified both in their study and in patients reported elsewhere with either recessive nonsyndromic deafness or Usher syndrome type I.

Full details of the abovementioned studies are described in the following publications, the disclosure of which are hereby incorporated by reference:

Bolz, H.; von Brederlow, B.; Ramirez, A.; Bryda, E. C.; Kutsche, K.; Nothwang, H. G.; Seeliger, M.; Cabrera, M. C. -S.; Vila, M. C.; Molina, O. P.; Gal, A.; Kubisch, C.: Mutation of CDH23, encoding a new member of the cadherin gene family, causes Usher syndrome type 1D. Nature Genet. 27: 108-112, 2001. PubMed ID: 11138009

1. Astuto, L. M.; Bork, J. M.; Weston, M. D.; Askew, J. W.; Fields, R. R.; Orten, D. J.; Ohliger, S. J.; Riazuddin, S.; Morell, R. J.; Khan, S.; Riazuddin, S.; Kremer, H.; and 15 others: CDH23 mutation and phenotype heterogeneity: a profile of 107 diverse families with Usher syndrome and nonsyndromic deafness. Am. J. Hum. Genet. 71: 262-275, 2002.

Further studies establishing the function and utilities of CDH23 are found in John Hopkins OMIM database record ID 605516, and in references numbered 537-541 listed hereinbelow.

Reference is now made to CDH6 BINDING SITE. Cadherin 6, type 2, K-cadherin (fetal kidney) (CDH6) is a target gene of GAM26, corresponding to GAM26-TARGET GENE of FIG. 26A. CDH6 BINDING SITE is a binding site found in an untranslated region of CDH6, corresponding to BINDING SITE of FIG. 26A. FIG. 26D illustrates the complementarity of the nucleotide sequence of CDH6 BINDING SITE, designated SEQ ID:100628, to the nucleotide sequence of GAM26 RNA of FIG. 26A, designated SEQ ID:20604.

Another function of GAM26 is therefore inhibition of cadherin 6, type 2, K-cadherin (fetal kidney) (CDH6), a gene which encodes a protein that is a calcium dependent cell adhesion protein. Accordingly, utilities of GAM26 include diagnosis and treatment of the abovementioned diseases and clinical conditions.

The function of CDH6 has been established by previous studies. Cadherins are calcium-dependent cell-cell adhesion molecules that mediate cell-cell binding in a homophilic manner. They play key roles in morphogenesis and in the maintenance of orderly structures such as epithelium, and may be involved in the metastasis and invasion of cancer. Mature cadherin proteins are composed of a large N-terminal extracellular domain, a single membrane-spanning domain, and a small C-terminal cytoplasmic domain. The extracellular domain consists of 5 subdomains, each containing a cadherin motif, and appears to determine the specificity of the homophilic cell adhesion activity of the cadherin; the amino acid sequence of the cytoplasmic domain is highly conserved among cadherins. CLONING By PCR using degenerate oligonucleotides based on highly conserved sequences of the cadherin cytoplasmic domain, followed by screening of a human fetal brain cDNA library, Suzuki et al. (1991) isolated a partial cDNA encoding CDH6. Using this partial CDH6 cDNA to screen a human hepatocellular carcinoma cell cDNA library, Shimoyama et al. (1995) cloned a full-length CDH6 cDNA. The deduced 790-amino acid CDH6 protein contains a signal sequence, prosequence, extracellular domain, transmembrane sequence, and cytoplasmic domain. The predicted 737-amino acid mature CDH6 protein has 97% amino acid similarity with rat K-cadherin, 64% with human CDH12 (600562), and 60% with human CDH8 (603008) and CDH11 (600023). Northern blot analysis detected multiple CDH6 transcripts in a variety of normal human tissues, with highest levels in kidney, brain, and cerebellum; no expression was found in liver, heart or colonic mucosa. Four of 6 hepatocellular carcinoma cell lines and 3 of 4 renal carcinoma cell lines showed strong expression of CDH6 transcripts. Among small cell lung carcinoma lines, all 11 CDH6-positive lines were of the classic type, whereas all 4 CDH6-negative lines were of the variant type.

Full details of the abovementioned studies are described in the following publications, the disclosure of which are hereby incorporated by reference:

Shimoyama, Y.; Gotoh, M.; Terasaki, T.; Kitajima, M.; Hirohashi, S.: Isolation and sequence analysis of human cadherin-6 complementary DNA for the full coding sequence and its expression in human carcinoma cells. Cancer Res. 55: 2206-2211, 1995. PubMed ID: 7743525 3. Suzuki, S.; Sano, K.; Tanihara, H.: Diversity of the cadherin family: evidence for eight new cadherins in nervous tissue. Cell Regul. 2: 261-270, 1991.

Further studies establishing the function and utilities of CDH6 are found in John Hopkins OMIM database record ID 603007, and in references numbered 542-544 listed hereinbelow.

Referring now to CDH6 BINDING SITE. Cadherin 6, type 2, K-cadherin (fetal kidney) (CDH6) is a target gene of GAM26, corresponding to GAM26-TARGET GENE of FIG. 26A. CDH6 BINDING SITE is a binding site found in an untranslated region of CDH6, corresponding to BINDING SITE FIG. 26A. FIG. 26D illustrates the complementarity of the nucleotide sequence of CDH6 BINDING SITE, designated SEQ ID:100637, to the nucleotide sequence of GAM26 RNA of FIG. 26A, designated SEQ ID:20604.

Yet another function of GAM26 is therefore inhibition of cadherin 6, type 2, K-cadherin (fetal kidney) (CDH6), a gene which encodes a protein that is a calcium dependent cell adhesion protein. Accordingly, utilities of GAM26 include diagnosis and treatment of the abovementioned diseases and clinical conditions. The function and utilities of CDH6 have been established by previous studies, as described hereinabove with reference to FIG. 26D.

Reference is now made to PEA15 BINDING SITE. Phosphoprotein enriched in astrocytes 15 (PEA15) is a target gene of GAM26, corresponding to GAM26-TARGET GENE of FIG. 26. PEA15 BINDING SITE is a binding site found in an untranslated region of PEA15, corresponding to BINDING SITE of FIG. 26A. FIG. 26D illustrates the complementarity of the nucleotide sequence of PEA15 BINDING SITE, designated SEQ ID:100637, to the nucleotide sequence of GAM26 RNA of FIG. 26A, designated SEQ ID:20604.

An additional function of GAM26 is therefore inhibition of phosphoprotein enriched in astrocytes 15 (PEA15), a gene which encodes a protein that is a phosphoprotein and involved in glucose uptake. Accordingly, utilities of GAM26 include diagnosis and treatment of the abovementioned diseases and clinical conditions.

The function of PEA15 has been established by previous studies. Astrocytes are involved in a variety of functions, including storage of glycogen and support for the migration and differentiation of neurons. They express membrane receptors which allow them to respond to extracellular signals. Activation of the receptors induces a cascade of events, such as the stimulation of protein kinases and the subsequent phosphorylation of target proteins. Araujo et al. (1993) identified a unique 15-kD protein in astrocytes that exists as a nonphosphorylated form and as 2 increasingly phosphorylated varieties. This protein, which they called PEA15, contains a consensus site for protein kinase C (PKC; e.g., 176960) and is an endogenous substrate for PKC. Using differential display to identify genes whose expressions are altered in tissues derived from type II diabetes mellitus (125853) patients compared with nondiabetic individuals, Condorelli et al. (1998) cloned cDNAs encoding PEA15, which they named PED for 'phosphoprotein enriched in diabetes'. The ubiquitously expressed 2.8-kb PED mRNA was overexpressed in fibroblasts, skeletal muscle, and adipose tissue from type II diabetics. Levels of the 15-kD PED phosphoprotein were also elevated in type II diabetic tissues. The authors demonstrated that transfection of a PED cDNA into differentiating L6 skeletal muscle cells increases the content of glucose transporter-1 (GLUT1; 138140) on the plasma membrane and inhibits insulin-stimulated glucose transport and cell surface recruitment of glucose transporter-4 (GLUT4; 138190). These effects were reversed by blocking PKC activity.

Full details, of the abovementioned studies are described in the following publications, the disclosure of which are hereby incorporated by reference:

Araujo, H.; Danziger, N.; Cordier, J.; Glowinski, J.; Chneiweiss, H.: Characterization of PEA-15, a major substrate for protein kinase C in astrocytes. J. Biol. Chem. 268: 5911-5920, 1993. PubMed ID: 8449955 3. Condorelli, G.; Vigliotta, G.; Iavarone, C.; Caruso, M.; Tocchetti, C. G.; Andreozzi, F.; Cafieri, A.; Tecce, M. F.; Formisano, P.; Beguinot, L.; Beguinot, F.: PED/PEA-15 gene controls glucose transport and is overexpressed in type 2 diabetes mellitus. EMBO J. 17: 3858-3866, 1998.

Further studies establishing the function and utilities of PEA15 are found in John Hopkins OMIM database record ID 603434, and in references numbered 545-551 listed hereinbelow.

Referring now to CDH6 BINDING SITE. Cadherin 6, type 2, K-cadherin (fetal kidney) (CDH6) is a target gene of GAM26, corresponding to GAM26-TARGET GENE of FIG. 26A. CDH6 BINDING SITE is a binding site found in an untranslated region of CDH6, corresponding to BINDING SITE of FIG. 26A. FIG. 26D illustrates the complementarity of the nucleotide sequence of CDH6 BINDING SITE, designated SEQ ID:100646, to the nucleotide sequence of GAM26 RNA of FIG. 26A, designated SEQ ID:20604.

A further function of GAM26 is therefore inhibition of cadherin 6, type 2, K-cadherin (fetal kidney) (CDH6), a gene which encodes a protein that is a calcium dependent cell adhesion protein. Accordingly, utilities of GAM26 include diagnosis and treatment of the abovementioned diseases and clinical conditions. The function and utilities of CDH6 have been established by previous studies, as described hereinabove with reference to FIG. 26D.

Reference is now made to CDK9 BINDING SITE. Cyclin-dependent kinase 9 (CDC2-related kinase) (CDK9) is a target gene of GAM26, corresponding to GAM26-TARGET GENE of FIG. 26A. CDK9 BINDING SITE is a binding site found in an untranslated region of CDK9, corresponding to BINDING SITE of FIG. 26A. FIG. 26D illustrates the complementarity of the nucleotide sequence of CDK9 BINDING SITE, designated SEQ ID:101419, to the nucleotide sequence of GAM26 RNA of FIG. 26A, designated SEQ ID:20604.

Yet a further function of GAM26 is therefore inhibition of cyclin-dependent kinase 9 (CDC2-related kinase) (CDK9), a gene which encodes a protein that is a positive transcription elongation factor band. Accordingly, utilities of GAM26 include diagnosis and treatment of the abovementioned diseases and clinical conditions.

The function of CDK9 has been established by previous studies. Cyclin-dependent kinases (CDKs) are CDC2 (116940)-related kinases that bind to cyclin to form active holoenzymes that play a pivotal role in the regulation of the eukaryotic cell cycle. To identify additional CDC2 family members, Grana et al. (1994) performed PCR on a mouse embryonic cDNA library using degenerate oligonucleotides based on regions conserved among CDC2-related proteins. They used a resulting PCR product to screen a human cDNA library and isolated a CDK9 cDNA. The predicted 372-amino acid protein contains the 11 conserved regions characteristic of the protein kinase catalytic domain, a putative nuclear localization signal, and a putative ATP-binding site. The authors called the protein PITALRE because it contains a pro-ile-thr-ala-leu-arg-glu motif that is similar to the PSTAIRE motif found in prototypic CDC2 kinases. CDK9 shares 41 to 43% amino acid sequence identity with CDC2, CDK2 (116953), CDK3 (123828), and CDK5 (123831). Subcellular fractionation and Western blot analyses demonstrated that CDK9 has a molecular mass of 43 kD and is located primarily in the nucleus. Three cellular proteins coimmunoprecipitated with CDK9, and CDK9 immunocomplexes had an RB1 (180200) kinase activity. Northern blot analysis indicated that CDK9 was expressed as 2.8- and 3.2-kb mRNAs in all tissues tested, with the highest levels in liver and placenta. Yang et al. (2001) identified 7SK snRNA (606515) as a specific P-TEFb-associated factor. 7SK inhibits general and HIV-1 Tat-specific transcriptional activities of P-TEFb in vivo and in vitro by inhibiting the kinase activity of CDK9 and preventing recruitment of P-TEFb to the HIV-1 promoter. 7SK is efficiently dissociated from P-TEFb (the CDK9/cyclin T1 heterodimer) by treatment of cells with ultraviolet irradiation and actinomycin D. As these 2 agents have been shown to enhance significantly HIV-1 transcription and phosphorylation of Pol-II, Yang et al. (2001) concluded that their data provide a mechanistic explanation for this stimulatory effect. Yang et al. (2001) further suggested that the 7SK/P TEFb interaction may serve as a principal control point for the induction of cellular and HIV-1 viral gene expression during stress-related responses. The study demonstrated the involvement of a snRNA in controlling the activity of CDK/cyclin kinase.

Full details of the abovementioned studies are described in the following publications, the disclosure of which are hereby incorporated by reference:

Yang, Z.; Zhu, Q.; Luo, K.; Zhou, Q.: The 7SK small nuclear RNA inhibits the CDK9/cyclin T1 kinase to control transcription. Nature 414: 317-322, 2001. PubMed ID: 11713532 5. Grana, X.; De Luca, A.; Sang, N.; Fu, Y.; Claudio, P. P.; Rosenblatt, J.; Morgan, D. O.; Giordano, A.: PITALRE, a nuclear CDC2-related protein kinase that phosphorylates the retinoblastoma protein in vitro. Proc. Nat. Acad. Sci. 91: 3834-3838, 1994.

Further studies establishing the function and utilities of CDK9 are found in John Hopkins OMIM database record ID 603251, and in references numbered 552-559 listed hereinbelow.

Referring now to CDK9 BINDING SITE. Cyclin-dependent kinase 9 (CDC2-related kinase) (CDK9) is a target gene of GAM26, corresponding to GAM25-TARGET GENE of FIG. 26A. CDK9 BINDING SITE is a binding site found in an untranslated region of CDK9, corresponding to BINDING SITE of FIG. 26A. FIG. 26D illustrates the complementarity of the nucleotide sequence of CDK9 BINDING SITE, designated SEQ ID:101421, to the nucleotide sequence of GAM26 RNA of FIG. 26A, designated SEQ ID:20604.

Another function of GAM26 is therefore inhibition of cyclin-dependent kinase 9 (CDC2-related kinase) (CDK9), a gene which encodes a protein that is a positive transcription elongation factor band. Accordingly, utilities of GAM26 include diagnosis and treatment of the abovementioned diseases and clinical conditions. The function and utilities of CDK9 have been established by previous studies, as described hereinabove with reference to FIG. 26D.

Referring now to CDK9 BINDING SITE. Cyclin-dependent kinase 9 (CDC2-related kinase) (CDK9) is a target gene of GAM26, corresponding to GAM26-TARGET GENE of FIG. 26A. CDK9 BINDING SITE is a binding site found in an untranslated region of CDK9, corresponding to BINDING SITE of FIG. 26A. FIG. 26D illustrates the complementarity of the nucleotide sequence of CDK9 BINDING SITE, designated SEQ ID:101424, to the nucleotide sequence of GAM26 RNA of FIG. 26A, designated SEQ ID:20604.

Yet another function of GAM26 is therefore inhibition of cyclin-dependent kinase 9 (CDC2-related kinase) (CDK9), a gene which encodes a protein that is a positive transcription elongation factor band. Accordingly, utilities of GAM26 include diagnosis and treatment of the abovementioned diseases and clinical conditions. The function and utilities of CDK9 have been established by previous studies, as described hereinabove with reference to FIG. 26D.

Referring now to CDK9 BINDING SITE. Cyclin-dependent kinase 9 (CDC2-related kinase) (CDK9) is a target gene of GAM26, corresponding to GAM26-TARGET GENE of FIG. 26A. CDK9 BINDING SITE is a binding site found in an untranslated region of CDK9, corresponding to BINDING SITE of FIG. 26A. FIG. 26D illustrates the complementarity of the nucleotide sequence of CDK9 BINDING SITE, designated SEQ ID:101437, to the nucleotide sequence of GAM26 RNA of FIG. 26A, designated SEQ ID:20604.

An additional function of GAM26 is therefore inhibition of cyclin-dependent kinase 9 (CDC2-related kinase) (CDK9), a gene which encodes a protein that is a positive transcription elongation factor band. Accordingly, utilities of GAM26 include diagnosis and treatment of the abovementioned diseases and clinical conditions. The function and utilities of CDK9 have been established by previous studies, as described hereinabove with reference to FIG. 26D.

Reference is now made to CDKN2D BINDING SITE. Cyclin-dependent kinase inhibitor 2D (p19, inhibits CDK4) (CDKN2D) is a target gene of GAM26, corresponding to GAM26-TARGET GENE of FIG. 26A. CDKN2D BINDING SITE is a binding site found in an untranslated region of CDKN2D, corresponding to BINDING SITE of FIG. 26A. FIG. 26D illustrates the complementarity of the nucleotide sequence of CDKN2D BINDING SITE, designated SEQ ID:102195, to the nucleotide sequence of GAM26 RNA of FIG. 26A, designated SEQ ID:20604.

A further function of GAM26 is therefore inhibition of cyclin-dependent kinase inhibitor 2D (p19, inhibits CDK4) (CDKN2D), a gene which encodes a protein that interacts strongly with cdk4 and cdk6. Accordingly, utilities of GAM26 include diagnosis and treatment of the abovementioned diseases and clinical conditions.

The function of CDKN2D has been established by previous studies. Cyclins are important in regulating the cell cycle through their formation of enzymatic complexes with various cyclin-dependent kinases. The D type cyclins complex with CDK4 (123829) and CDK6 to govern progression through the G1 phase of the cell cycle and later are involved with inactivating phosphorylation of the RB protein (180200) which results in release of RB-associated transcription factors that are needed for entry into S phase (Okuda et al., 1995). The activity of the cyclin D-dependent kinases is, in part, controlled by inhibitors such as the INK4 family (which includes INK4a (CDKN2A; 600160), 4b (CDKN2B; 600431), 4c (CDKN2C), and 4d (CDKN2D)). INK4a has been shown to act by competing with CDK4 and CDK6 and functions as a tumor suppressor in a variety of cancers. The INK4d protein was first identified in a yeast 2 hybrid system screened for CDK4 binding proteins (Hirai et al., 1995). The mouse INK4d protein interacts with cdk6 as well. In fibroblasts and macrophages it is rapidly induced at the G1-to-S transition. Overexpression of INK4d caused NIH 3T3 cells to arrest in G1 phase and inhibited cyclin D1-CDK4 kinase activity (Hirai et al., 1995 Okuda et al. (1995) described the cloning and mapping of the human INK4d gene (CDKN2D). The predicted 166-amino acid protein is 86% identical to the mouse protein and about 45% identical to other human INK4 family members. Northern blots showed that the 1.4-kb transcript is ubiquitously expressed with the highest levels in tissues with the most rapidly dividing cells. Lowest expression occurs at mid G1 phase and is highest during S phase. Okuda et al. (1995) obtained a P1-phage genomic clone including the gene and mapped it by fluorescence in situ hybridization to 19p13

Full details of the abovementioned studies are described in the following publications, the disclosure of which are hereby incorporated by reference:

Hirai, H.; Roussel, M. F.; Kato, J. -Y.; Ashmun, R. A.; Sherr, C. J.: Novel INK4 proteins, p19 and p18, are specific inhibitors of cyclin D-dependent kinases CDK4 and CDK6. Molec. Cell. Biol. 15: 2672-2681, 1995. PubMed ID:7739547 2. Okuda, T.; Hirai, H.; Valentine, V. A.; Shurtleff, S. A.; Kidd, V. J.; Lahti, J. M.; Sherr, C. J.; Downing, J. R.: Molecular cloning, expression pattern, and chromosomal localization of human CDKN2D/INK4d, an inhibitor of cyclin D-dependent kinases. Genomics 29: 623-630, 1995.

Further studies establishing the function and utilities of CDKN2D are found in John Hopkins OMIM database record ID 600927, and in references numbered 560-561 listed hereinbelow.

Referring now to CDKN2D BINDING SITE. Cyclin-dependent kinase inhibitor 2D (p19, inhibits CDK4) (CDKN2D) is a target gene of GAM26, corresponding to GAM26-TARGET GENE of FIG. 26A. CDKN2D BINDING SITE is a binding site found in an untranslated region of CDKN2D, corresponding to BINDING SITE of FIG. 26A. FIG. 26D illustrates the complementarity of the nucleotide sequence of CDKN2D BINDING SITE, designated SEQ ID 102235, to the nucleotide sequence of GAM26 RNA of FIG. 26A, designated SEQ ID:20604.

Yet a further function of GAM26 is therefore inhibition of cyclin-dependent kinase inhibitor 2D (p19, inhibits CDK4) (CDKN2D), gene which encodes a protein that strongly with cdk4 and cdk6. Accordingly, utilities of GAM26 include diagnosis and treatment of the abovementioned diseases and clinical conditions. The function and utilities of CDKN2D have been established by previous studies, as described hereinabove with reference to FIG. 26D.

Reference is now made to CHN2 BINDING SITE. Chimerin (chimaerin) 2 (CHN2) is a target gene of GAM26, corresponding to GAM26-TARGET GENE of FIG. 26A. CHN2BINDING SITE is a binding site found in an untranslated region of CHN2, corresponding to BINDING SITE of FIG. 26A. FIG. 26D illustrates the complementarity of the nucleotide sequence of CHN2 BINDING SITE, designated SEQ ID:105797, to the nucleotide sequence of GAM26 RNA of FIG. 26A, designated SEQ ID:20604.

Another function of GAM26 is therefore inhibition of chimerin (chimaerin) 2 (CHN2), a gene which encodes a receptor that plays a role in the progression from low-grade to high-grade tumors. Accordingly, utilities of GAM26 include diagnosis and treatment of the abovementioned diseases and clinical conditions.

The function of CHN2 has been established by previous studies. The Rho family of GTP-binding proteins is believed to play a role in membrane/cytoskeletal reorganization events. These proteins cycle between active GTP-bound and inactive GDP-bound forms. Activation to the GTP-bound state is mediated by specific guanine nucleotide dissociation stimulators, whereas acceleration of GTP hydrolysis can be accomplished by GTPase-activating proteins (GAPs). Leung et al., (1993) isolated a rat testis cDNA that encodes a 30-kD GAP, which they named beta-chimerin, or beta-1-chimerin. The 1.35-kb beta-1 chimerin transcript is present exclusively in testicular germ cells. The beta-1-chimerin protein contains a phorbol ester-binding region and a GAP domain, and is selective for Rac (see RAC1; 602048). Leung et al. (1994) detected a 46-kD RacGAP in soluble rat cerebellar extracts, using antibodies against beta-1 chimerin. By screening a human cerebellar cDNA library with a rat beta-1-chimerin cDNA, they cloned a 2.45-kb cDNA corresponding to the cerebellar chimerin, which they named beta-2 chimerin. The encoded 466-amino acid beta-2-chimerin protein is identical to beta-1-chimerin, in both the phorbol ester binding and GAP domains, but it contains an additional N-terminal SH2 domain which is strikingly similar to that of alpha-2-chimerin (CHN1; 118423). Based on Southern blot and cDNA analyses, the authors concluded that beta-1- and beta-2-chimerin are derived from the same gene by alternative splicing. In situ hybridization of rat, brain showed that beta-2-chimerin mRNA is expressed only in the cerebellum, mainly in granule cells. Beta-2-chimerin protein is enriched in the particulate/synaptosomal fractions of rat cerebellum. Signaling in response to the second messenger diacylglycerol (DAG) is thought to proceed through the activation of protein kinase C (PKC) isozymes. Binding of this lipid second messenger and its related analogs, the phorbol esters, occurs at the C1 domain (also called cysteine-rich regions or zinc fingers) present in PKCs. The phorbol ester receptor family was expanded with the discovery of the chimerins. The several chimerin isoforms each possess a single C1 domain with approximately 40% homology to those present in PKCs. Having previously demonstrated that beta-2-chimerin binds phorbol esters with high affinity, Caloca et al. (1999) analyzed its properties as a DAG receptor by using a series of conformationally constrained cyclic DAG analogs (DAG lactones) as probes. They identified analogs that bind to beta-2-chimerin with high affinity. Cellular studies revealed that these DAG analogs induced translocation of beta-2-chimerin from cytosolic (soluble) to particulate fractions, and specifically to the perinuclear region. Binding and translocation were prevented by mutation of the conserved cys246 in the C1 domain. The results demonstrated that beta-2-chimerin is indeed a high affinity receptor for DAG through binding to its C1 domain and supported the concept that multiple pathways transduce signaling through DAG and the phorbol esters Full details of the abovementioned studies are described in the following publications, the disclosure of which are hereby incorporated by reference:

Leung, T.; How, B. -E.; Manser, E.; Lim, L.: Cerebellar beta-2-chimaerin, a GTPase-activating protein for p21 Ras-related Rac is specifically expressed in granule cells and has a unique N-terminal SH2 domain J. Biol. Chem. 269: 12888-12892, 1994. PubMed ID: 8175705 1. Caloca, M. J.; Garcia Bermejo, M. L.; Blumberg, P. M.; Lewin, N. E.; Kremmer, E.; Mischak, H.; Wang, S.; Nacro, K.; Bienfait, B.; Marquez, V. E.; Kazanietz, M. G.: Beta-2-chimaerin is a novel target for diacylglycerol: binding properties and changes in subcellular localization mediated by ligand binding to its C1 domain. Proc. Nat. Acad. Sci. 96: 11854-11859, 1999.

Further studies establishing the function and utilities of CHN2 are found in John Hopkins OMIM database record ID 602857, and in references numbered 562-565 listed hereinbelow.

Reference is now made to CHRNA3 BINDING SITE. Cholinergic receptor, nicotinic, alpha polypeptide 3 (CHRNA3) is a target gene of GAM26, corresponding to GAM26-TARGET GENE of FIG. 26A. CHRNA3 BINDING SITE is a binding site found in an untranslated region of CHRNA3, corresponding to BINDING SITE of FIG. 26A. FIG. 26D illustrates the complementarity of the nucleotide sequence of CHRNA3 BINDING SITE, designated SEQ ID:106136, to the nucleotide sequence of GAM26 RNA of FIG. 26A, designated SEQ ID:20604.

Yet another function of GAM26 is therefore inhibition of cholinergic receptor, nicotinic, alpha polypeptide 3 (CHRNA3), a gene which encodes a protein that binds acetylcholine and opens an ion-conducting channel across the plasma membrane and is associated with myasthenia gravis. Accordingly, utilities of GAM26 include diagnosis and treatment of the abovementioned diseases and clinical conditions.

The function of CHRNA3 has been established by previous studies. To examine the role of thymic AChRs in the anti-AChR response seen in myasthenia gravis (254200), Mihovilovic and Roses (1991) independently isolated the human alpha-3 subunit from a thymus cDNA library. The open reading frame coded for a 503-amino acid protein with a 29-amino acid putative signal peptide. On Northern blots, alpha-3 was transcribed as a major 3.0-kb mRNA with other minor bands in thymus but not in muscle or liver. Groot Kormelink and Luyten (1997) reported that alpha-3 was transcribed as a 3.0-kb mRNA on Northern blots of a neuroblastoma cell line. Prompted by the finding that mutations in the CHRNA4 gene (118504) are responsible for some cases of autosomal dominant nocturnal frontal lobe epilepsy (600513), Rempel et al. (1998) determined the genomic structure of the CHRNA3 gene necessary or mutational analysis of this gene as a candidate in families with epilepsy unlinked to CHRNA4.

Animal model experiments lend further support to the function of CHRNA3. The alpha-3 subunit of the neuronal nicotinic acetylcholine receptor is widely expressed in autonomic ganglia and in some parts of the brain. The alpha-3 subunit can form heteromultimeric ion channels with other alpha subunits and with beta-2 and beta-4 subunits. To understand better the function of CHRNA3 in vivo, Xu et al. (1999) prepared a null mutation the alpha-3 gene by the deletion of exon 5 and found that homozygous –/– mice lacked detectable mRNA on Northern blotting. The null mice survived to birth but had impaired growth and increased mortality before and after weaning. The null mice had extreme bladder enlargement, dribbling urination, bladder infection, urinary stones, and widely dilated ocular pupils that did not contract in response to light. Detailed histologic studies of null mice showed no significant abnormalities in brain or peripheral tissues except urinary bladder, where inflammation was prominent. Ganglion cells and axons were present in bladder and bowel. Bladder strips from null mice failed to contract in response to 0.1 mM nicotine, but did contract in response to electrical field stimulation or carbamoylcholine. The number of acetylcholine-activated single-channel currents was severely reduced in the neurons of superior cervical ganglia in null mice with 5 physiologically distinguishable nicotinic acetylcholine receptor subtypes with different conductance and kinetic properties in wildtype mice, all of which were reduced in null mice. The findings in the alpha-3-null mice suggested that this subunit is an essential component of the nicotinic receptors mediating normal function of the autonomic nervous system. Xu et al. (1999) suggested that the phenotype in null mice may be similar to that of the rare megacystis-microcolon-intestinal hypoperistalsis syndrome (MMIH; 249210).

It is appreciated that the abovementioned animal model for CHRNA3 is acknowledged by those skilled in the art as a scientifically valid animal model, as can be further appreciated from the publications sited hereinbelow.

Full details of the abovementioned studies are described in the following publications, the disclose of which are hereby incorporated by reference:

Groot Kormelink, P. J.; Luyten, W. H. M. L.: Cloning and sequence of full-length cDNAs encoding the human neuronal nicotinic acetylcholine receptor (nAChR) subunits beta-3 and beta-4 and expression of seven nAChR subunits in the human neuroblastoma cell line SH-SY5Y and/or IMR-32. FEBS Lett. 400: 309-314, 1997. PubMed ID: 9009220 12. Rempel, N.; Heyers, S.; Engels, H.; Sleegers, E.; Steinlein, O. K.: The structures of the human neuronal nicotinic acetylcholine receptor beta-2- and alpha-3-subunit genes (CHRNB2 and CHRNA3). Hum. Genet. 103: 645-653, 1998.

Further studies establishing the function and utilities of CHRNA3 are found in John Hopkins OMIM database record ID 118503, and in references numbered 566-578 listed hereinbelow.

Referring now to CHS1 BINDING SITE. Chediak-Higashi syndrome 1 (CHS1) is a target gene of GAM26, corresponding to GAM26-TARGET GENE of FIG. 26A. CHS1 BINDING SITE is a binding site found in an untranslated region of CHS1, corresponding to BINDING SITE of FIG. 26A. FIG. 26D illustrates the complementarity of the nucleotide sequence of CHS1 BINDING SITE, designated SEQ ID:106651, to the nucleotide sequence of GAM26 RNA of FIG. 26A, designated SEQ ID:20604.

An additional function of GAM26 is therefore inhibition of Chediak-Higashi syndrome 1 (CHS1), a gene which encodes a protein that is associated with chediak-Higashi syndrome. Accordingly, utilities of GAM26 include diagnosis and treatment of the abovementioned diseases and clinical conditions. The function and utilities of CHS1 have been established by previous studies, as described hereinabove with reference to FIG. 26D.

Reference is now made to CKAP1 BINDING SITE. Cytoskeleton-associated protein 1 (CKAP1) is a tar et gene of GAM26, corresponding to GAM26-TARGET GENE of FIG. 26A. CKAP1 BINDING SITE is a binding site found in an untranslated region of CKAP1, corresponding to BINDING SITE of FIG. 26A. FIG. 26D illustrates the complementarity of the nucleotide sequence of CKAP1 BINDING SITE, designated SEQ ID:107655, to the nucleotide sequence of GAM26 RNA of FIG. 26A, designated SEQ ID:20604.

A further function of GAM26 is therefore inhibition of cytoskeleton-associated protein 1 (CKAP1), a gene which encodes a protein that binds to alpha-tubulin folding intermediates. Accordingly, utilities of GAM26 include diagnosis and treatment of the abovementioned diseases and clinical conditions.

The function of CKAP1 has been established by previous studies. The cytoskeleton is composed of 3 structural elements: actin filaments, microtubules, and intermediate filaments. Cytoskeletal activity is modulated by many cytoskeleton-associated proteins (CAPs). One group of CAPs is characterized by a highly conserved glycine motif, the CAP-GLY domain, which may contribute to its association with microtubules. Members of the group of CAPs include dynactin (601143), the dynein-associated protein. Watanabe et al. (1996) isolated a novel member of this family, which they called CKAPI (for cytoskeleton-associated protein I, glycine motif). The cDNA was isolated from a human fetal-brain cDNA library and found to contain an open reading frame of 579 nucleotides encoding a 193-amino acid polypeptide. Three transcripts of different sizes were expressed in all tissues examined. By fluorescence in situ hybridization, Watanabe et al. (1996) assigned the gene to 19q13.11-q13.12.

Full details of the abovementioned studies are described in the following publications, the disclosure of which are hereby incorporated by reference:

Watanabe, T. K.; Shimizu, F.; Nagata, M.; Kawai, A.; Fujiwara, T.; Nakamura, Y.; Takahashi, E.; Hirai, Y.: Cloning, expression, and mapping of CKAP1, which encodes a putative cytoskeleton-associated protein containing a CAP-GLY domain. Cytogenet. Cell Genet. 72: 208-211, 1996.

Further studies establishing the function and utilities of CKAP1 are found in John Hopkins OMIM database record ID 601303, and in references numbered 579 listed hereinbelow.

Referring now to CKAP1 BINDING SITE. Cytoskeleton-associated protein 1 (CKAP1) is a target gene of GAM26, corresponding to GAM26-TARGET GENE of FIG. 26A. CKAP1 BINDING SITE is a binding site found in an untranslated region of CKAP1, corresponding to BINDING SITE of FIG. 26A. FIG. 26D illustrates the complementarity of the nucleotide sequence of CKAP1 BINDING SITE, designated SEQ ID:107655, to the nucleotide sequence of GAM26 RNA of FIG. 26A, designated SEQ ID:20604.

Yet a further function of GAM26 is therefore inhibition of cytoskeleton-associated protein 1 (CKAP1), a gene which encodes a protein that binds to alpha-tubulin folding intermediates. Accordingly, utilities of GAM26 include diagnosis and treatment of the abovementioned diseases and clinical conditions. The function and utilities of CKAP1 have been established by previous studies, as described hereinabove with reference to FIG. 26D.

Referring now to CKAP1 BINDING SITE. Cytoskeleton-associated protein 1 (CKAP1) is a target gene of GAM26, corresponding to GAM26-TARGET GENE of FIG. 26A. CKAP1 BINDING SITE is a binding site found in an untranslated region of CKAP1, corresponding to BINDING SITE of FIG. 26A. FIG. 26D illustrates the complementarity of the nucleotide sequence of CKAP1 BINDING SITE, designated SEQ ID:107659, to the nucleotide sequence of GAM26 RNA of FIG. 26A, designated SEQ ID:20604.

Another function of GAM26 is therefore inhibition of cytoskeleton-associated protein 1 (CKAP1), a gene which encodes a protein that binds to alpha-tubulin folding intermediates. Accordingly, utilities of GAM26 include diagnosis and treatment of the abovementioned diseases and clinical conditions. The function and utilities of CKAP1 have been established by previous studies, as described hereinabove with reference to FIG. 26D.

Reference is now made to COL5A1 BINDING SITE. Collagen type V, alpha 1 (COL5A1) is a target gene of GAM26, corresponding to GAM26-TARGET GENE of FIG. 26A. COL5A1 BINDING SITE is a bi ding site found in an untranslated region of COL5A1, corresponding to BINDING SITE of FIG. 26A. FIG. 26D illustrates the complementarity of the nucleotide sequence of COL5A1 BINDING SITE, designated SEQ ID:114312, to the nucleotide sequence of GAM26 RNA of FIG. 26A, designated SEQ ID:20604.

Yet another function of GAM26 is therefore inhibition of collagen, type V, alpha 1 (COL5A1), a gene which encodes a protein that is associated with EHLERS-DANLOS SYNDROME. Accordingly, utilities of GAM26 include diagnosis and treatment of the above mentioned diseases and clinical conditions.

The function of COL5A1 has been established by previous studies. Type V collagen was first identified in human placenta and adult skin, but later studies showed that it is present in many other tissues and organs as a minor collagen component. Type V collagen occurs as heterotrimers of 3 different polypeptide chains, alpha-1, alpha-2 (COL5A2, 120190), and alpha-3 (COL5A3, 120216), or 2 copies of alpha-1 and 1 copy of alpha-2; it also occurs as a homotrimer of alpha-1 polypeptides. Takahara et al. (1991) reported the sequence of cDNA encoding the complete prepro-alpha-1 (V) chain. The collagenous region and COOH-terminal noncollagenous region closely resembled that of the alpha-1(XI) (120280) chain; however, codon usage differed, that the COL5A1 gene is evolutionarily distinct Similarly, Wenstrup et al. (2000) found that 8 of 28 probands with classic EDS, who were heterozygous for expressed polymorphisms in COL5A1, showed complete or nearly complete loss of expression 1 COL5A1 allele. Reduced levels of COL5A1 mRNA relative to levels of COL5A2 mRNA were also observed in the cultured fibroblasts from EDS probands. Products of the 2 COL5A1 alleles were approximately equal after the addition of cycloheximide to the fibroblast cultures.

After harvesting of mRNAs from cycloheximide-treated cultured fibroblasts, heteroduplex analysis of overlapping RT-PCR segments spanning the complete COL5A1 cDNA showed anomalies in 4 of the 8 probands, leading to identification of causative mutations; in the remaining 4 probands, targeting of CGA-to-TGA, mutations in genomic DNA revealed a premature stop codon in one of them. Wenstrup et al. (2000) estimated that one-third of persons with classic EDS have mutations of the COL5A1 gene that result in haploinsufficiency. These findings indicated that normal formation of the heterotypic collagen fibrils that contain types I, III, and V collagen require the expression of both COL5A1 alleles Full details of the abovementioned studies are described in the following publications, the disclosure of which are hereby incorporated by reference:

Takahara, K.; Sato, Y.; Okazawa, K.; Okamoto, N.; Noda, A.; Yaoi, Y.; Kato, I.: Complete primary structure of human collagen alpha-1(V) chain. J. Biol. Chem. 266: 13124-13129, 1991. PubMed ID: 2071595 17. Wenstrup, R. J.; Florer, J. B.; Willing, M. C.; Giunta, C.; Steinmann, B.; Young, F.; Susic, M.; Cole, W. G.: COL5A1 haploinsufficiency is a common molecular mechanism underlying the classical form of EDS. Am. J. Hum. Genet. 66: 1766-1776, 2000.

Further studies establishing the function and utilities of COL5A1 are found in John Hopkins OMIM database record ID 120215, and in references numbered 580-597 listed hereinbelow.

Referring now to COL5A1 BINDING SITE. Collagen type V, alpha 1 (COL5A1) is a target gene of GAM26, corresponding to GAM26-TARGET GENE of FIG. 26A. COL5A1 BINDING SITE is a binding site found in an untranslated region of COL5A1, corresponding to BINDING SITE of FIG. 26A. FIG. 26D illustrates the complementarity of the nucleotide sequence of COL5A1 BINDING SITE, designated SEQ ID:114314, to the nucleotide sequence of GAM26 RNA of FIG. 26A, designated SEQ ID:20604.

An additional function of GAM26 is therefore inhibition of collagen, type V, alpha 1 (COL5A1), a gene which encodes a protein that is associated with EHLERS-DANLOS SYNDROME. Accordingly, utilities of GAM26 include diagnosis and treatment of the abovementioned diseases and clinical conditions. The function and utilities of COL5A1 have been established by previous studies, as described hereinabove with reference to FIG. 26D.

Reference is now made to CPE BINDING SITE. Carboxypeptidase E (CPE) is a target gene of GAM126, corresponding to GAM26-TARGET GENE of FIG. 26A. CPE BINDING SITE is a binding site found in an untranslated region of CPE, corresponding to BINDING SITE of FIG. 26A. FIG. 26D illustrates the complementarity of the nucleotide sequence of (CPE BINDING SITE, designated SEQ ID:116431, to the nucleotide sequence of GAM26 RNA of FIG. 26A, designated SEQ ID:20604.

A further function of GAM26 is therefore inhibition of carboxypeptidase E (CPE), a gene which encodes a enzyme that removes residual c-terminal arg or lys remaining after initial endoprotease cleavage, and is associated with hyperproinsulinemia and diabetes. Accordingly, utilities of GAM26 include diagnosis and treatment of the abovementioned diseases and clinical conditions.

The function of CPE has been established by previous studies. Naggert et al. (1995) stated that mice homozygous for the 'fat' mutation develop obesity and hyperglycemia that can be suppressed by treatment with exogenous insulin. The 'fat' mutation maps to mouse chromosome 8, very close to the gene for carboxypeptidase E (Cpe), which encodes an enzyme (CPE) that processes prohormone intermediates such as proinsulin. Naggert et al. (1995) demonstrated a defect in proinsulin processing associated with the virtual absence of CPE activity in extracts of fat/fat pancreatic islets and pituitaries. A single ser202-to-pro mutation distinguished the mutant Cpe allele and abolished enzymatic activity in vitro. Thus, the 'fat' mutation represents the first demonstration of an obesity-diabetes syndrome elicited by a genetic defect in a prohormone processing pathway. As indicated, CPE is involved in the biosynthesis of peptide hormones and neurotransmitters, including insulin. One of the features of type II diabetes mellitus (125853) is an elevation in the proinsulin level and/or molar ratio of proinsulin to insulin, suggesting that mutations in proinsulin processing enzymes may contribute to the development of this form of diabetes. Chen et al. (2001) scanned the CPE gene for mutations in a collection of Ashkenazi type II diabetes families and identified 5 novel single-nucleotide polymorphisms. One of these, C-to-T transition at nucleotide 847, changed arginine to tryptophan (arg283 to trp; R283W). The arg283 residue is conserved among CPE orthologs as well as most enzymatically active metallocarboxypeptidases. Of the 272 Ashkenazi pedigrees with type II diabetes, Chen et al. (2001) found 4 families segregating R283W. Within these 4 families, patients who inherited one copy of this variant had much earlier age of onset of type II diabetes. The R283W CPE protein was found to cleave peptide substrates with substantially lower efficiencies and was, furthermore, less stable at elevated temperature. In addition, the R283W CPE variant had a narrower pH optimum and was much less active at pH 6.0 to 6.5, indicating that the R283W CPE variant would be substantially less active than wildtype CPE in the trans-Golgi network and immature secretory vesicles where the enzyme functions in vivo. Chen et al. (2001) predicted that in the homozygous state this mutant could cause hyperproinsulinemia and diabetes.

Full details of the abovementioned studies are described in the following publications, the disclosure of which are hereby incorporated by reference:

Naggert, J. K.; Fricker, L. D.; Varlamov, O.; Nishina, P. M.; Rouille, Y.; Steiner, D. F.; Carroll, R. J.; Paigen, B. J.; Leiter, E. H.: Hyperproinsulinaemia in obese fat/fat mice associated with a carboxypeptidase E mutation which reduces enzyme activity. Nature Genet 10: 135-142, 1995. PubMed ID: 7663508 1. Chen, H.; Jawahar, S.; Qian, Y.; Duong, Q.; Chan, G.; Parker, A.; Meyer, J. M.; Moore, K. J.; Chayen, S.; Gross, D. J.; Glaser, B.; Permutt, M. A.; Fricker, L. D.: Missense polymorphism in the human carboxypeptidase E gene alters enzymatic activity. Hum. Mutat. 18: 120-131, 2001.

Further studies establishing the function and utilities of CPE are found in John Hopkins OMIM database record ID 114855, and in references numbered 598-602 listed hereinbelow.

Reference is now made to CSNK1D BINDING SITE. Casein kinase 1, delta (CSNK1D) is a target gene of GAM26, corresponding to GAM26-TARGET GENE of FIG. 26A. CSNK1D BINDING SITE is a binding site found in an untranslated region of CSNK1D, corresponding to BINDING SITE of FIG. 26A. FIG. 26D illustrates the complementarity of the nucleotide sequence of CSNK1D BINDING SITE, designated SEQ ID:120331, to the nucleotide sequence of GAM26 RNA of FIG. 26A, designated SEQ ID:20604.

Yet a further function of GAM26 is therefore inhibition of casein kinase 1, delta (CSNK1D), a gene which encodes a protein that can phosphorylate a large number of proteins. Accordingly, utilities of GAM26 include diagnosis and treatment of the abovementioned diseases and clinical conditions.

The function of CSNK1D has been established by previous studies. Casein kinase I is a ubiquitous serine/threonine-specific protein kinase that constitutes most of the kinase activity in eukaryotic cells, where it is distributed in the nucleus, cytoplasm, and membrane fraction. The monomeric enzyme (34 to 55 kD) phosphorylates hierarchically a variety of substrates without the involvement or the so-called second messenger in signal transduction. A full-length rat CKI-delta cDNA was cloned by Graves et al. (1993). Fish et al. (1995) mapped the human CKI-delta locus to 17q25 by fluorescence in situ hybridization. Kusuda et al. (1996) isolated and sequenced a cDNA clone for human casein kinase I. An open reading frame of 415 amino acids was identified, showing 97% homology to rat CKI-delta; within the kinase domain of 284 amino acids the 2 were completely identical. The amino acid sequence of the kinase domain of human CSNK1D to yeast enzymes that are involved in the repair of DNA strand breaks supported speculation that the human gene product acts in DNA metabolism through excision and recombinational repair. By fluorescence in situ hybridization and PCR analysis of human/rodent hybrid cell panels, Kusuda et al. (1996) mapped CSNK1D to 17q25.2-q25.3.

Full details of the abovementioned studies are described in the following publications, the disclosure of which are hereby incorporated by reference:

Graves, P. R.; Haas, D. W.; Hagedorn, C. H.; DePaoli-Roach, A. A.; Roach, P. J.: Molecular cloning, expression, and characterization of a 49-kilodalton casein kinase I isoform from rat testis. J. Biol. Chem. 268: 6394-6401, 1993. PubMed ID: 8454611 3. Kusuda, J.; Hidari, N.; Hirai, M.; Hashimoto, K.: Sequence analysis of the cDNA for the human casein kinase 1-delta (CSNK1D) gene and its chromosomal localization. Genomics 32: 140-143, 1996.

Further studies establishing the function and utilities of CSNK1D are found in John Hopkins OMIM database record ID 600864, and in references numbered 603-605 listed hereinbelow.

Reference is now made to CUGBP1 BINDING SITE. CUG triplet repeat, RNA-binding protein 1 (CUGBP1) is a target gene of GAM26, corresponding to GAM26-TARGET GENE of FIG. 26A. CUGBP1 BINDING SITE is a binding site found in an untranslated region of CUGBP1, corresponding to BINDING SITE of FIG. 26A. FIG. 26D illustrates the complementarity of the nucleotide sequence of CUGBP1 BINDING SITE, designated SEQ ID:122870, to the nucleotide sequence of GAM26 RNA of FIG. 26A, designated SEQ ID:20604.

Another function of GAM26 is therefore inhibition of CUG triplet repeat, RNA-binding protein 1 (CUGBP1), a gene which encodes a receptor that regulates splicing and translation of various RNAs, and is associated with myotonic dystrophy. Accordingly, utilities of GAM26 include diagnosis and treatment the abovementioned diseases and clinical conditions.

The function of CUGBP1 has been established by previous studies. While an unstable CTG triplet repeat expansion is responsible for myotonic dystrophy (DM; 160900), the mechanism whereby this genetic defect induces the disease is unknown. To detect proteins that bind to CTG triplet repeats, Timchenko et al. (1996) performed bandshift analysis using as probes double-stranded DNA fragments having CTG repeats and single-stranded oligonucleotides having CTG repeats or CUG repeats. The proteins were derived from nuclear and cytoplasmic extracts of HeLa cells, fibroblasts, and myotubes. Proteins binding to the double-stranded DNA repeat were inhibited by the nonlabeled repeat but not by a nonspecific DNA fragment. Another protein binding to the single-stranded CTG probe and the RNA CUG probe was inhibited by nonlabeled CTG(8) and CUG(8) repeats. The protein binding only to the RNA repeat (CUG)8 was inhibited by nonlabeled (CUG)8 but not by nonlabeled single- or double-stranded CTG repeats. Furthermore, the protein, designated CUG-binding protein (CUGBP) by the authors, exhibited no binding to an RNA oligonucleotide of triplet repeats of the same length but having a different sequence, CGG. The CUG-binding protein was localized to the cytoplasm, whereas double-stranded DNA binding proteins were localized to the nuclear extract. Thus, Timchenko et al. (1996) concluded that several trinucleotide-binding proteins exist and their specificity is determined by the triplet sequence. CTG trinucleotide repeats encode CUG repeat regions in the corresponding mRNAs. Timchenko et al. (1996) identified 2 proteins, termed CUGBP1 and CUGBP2, that bind specifically to CUG repeats in RNA. They suggested that these 2 proteins, with masses of 49 kD and 51 kD, respectively, are isoforms encoded by the same gene. Timchenko et al. (1996) cloned a gene, termed NAB50 by them, based on the interaction between its protein product and the yeast Nab2 protein. The authors stated that the NAB50 gene encodes the CUGBP1 and CUGBP2 proteins because anti-Nab50 antibodies cross-reacted with both CUGBP isoforms. The gene predicts a 482-amino acid protein with a calculated molecular mass of 52 kD. The predicted protein contains 3 RNA-binding domains and is homologous to the hnRNPs Full detail of the abovementioned studies are described in the following publications, the disclosure of which are hereby incorporated by reference:

Timchenko L. T.; Miller, J. W.; Timchenko, N. A.; DeVore, D. R.; Datar, K. V.; Lin, L.; Roberts, R.; Caskey, C. T.; Swanson, M. S.: Identification of a (CUG)n triplet repeat RNA-binding protein and its expression in myotonic dystrophy. Nucleic Acids Res. 24: 4407-4414, 1996. PubMed ID: 8948631 1. Good, P. J.; Chen, Q.; Warner, S. J.; Herring, D. C.: A family of human RNA-binding proteins related to the *Drosophila* Bruno transcriptional regulator. J. Biol. Chem. 275: 28583-28592, 2000.

Further studies establishing the function and utilities of CUGBP1 are found in John Hopkins OMIM database record ID 601074, and in references numbered 606-609 listed hereinbelow.

Referring now to CUGBP1 BINDING SITE. CUG triplet repeat, RNA-binding protein 1 (CUGBP1) is a target gene of GAM26, corresponding to GAM26-TARGET GENE of FIG. 26A. CUGBP1 BINDING SITE is a binding site found in an untranslated region of CUGBP1, corresponding to BINDING SITE of FIG. 26A. FIG. 26D illustrates the complementarity of the nucleotide sequence of CUGBP1 BINDING SITE, designated SEQ ID: 122874, to the nucleotide sequence of GAM26 RNA of FIG. 26A, designated SEQ ID:20604.

Yet another function of GAM26 is therefore inhibition of CUG triplet repeat, RNA-binding protein 1 (CUGBP1), a gene which encodes a receptor that regulates splicing and translation of various RNAs, and is associated with myotonic dystrophy. Accordingly, utilities of GAM26 include diagnosis and treatment of the abovementioned diseases and clinical conditions. The function and utilities of CUGBP1 have been established by previous studies, as described hereinabove with reference to FIG. 26D.

Reference is now made to DAG1 BINDING SITE. Dystroglycan 1 (dystrophin-associated glycoprotein 1) (DAG1) is a target gene of GAM26, corresponding to GAM26-TARGET GENE of FIG. 26A. DAG1 BINDING SITE is a binding site found in an untranslated region of DAG1, corresponding to BINDING SITE of FIG. 26A. FIG. 26D illustrates the complementarity of the nucleotide sequence of DAG1 BINDING SITE, designated SEQ ID:127812, to the nucleotide sequence of GAM26 RNA of FIG. 26A, designated SEQ ID:20604.

An additional function of GAM26 is therefore inhibition of dystroglycan 1 (dystrophin-associated glycoprotein 1) (DAG1), a gene which encodes a protein that may provide linkage between the sarcolemma and extracellular matrix (ECM) and is associated with Fukuyama-type congenital muscular dystrophy. Accordingly, utilities of GAM26 include diagnosis and treatment of the abovementioned diseases and clinical conditions.

The function of DAG1 has been established by previous studies. Ibraghimov-Beskrovnaya et al. (1992) demonstrated that the transmembrane 43-kD and extracellular 156-kD dystrophin (300377)-associated glycoproteins are encoded by a single messenger RNA and that the extracellular 156-kD DAG binds laminin. Thus, the 156-kD DAG is a laminin-binding glycoprotein that may provide linkage between the sarcolemma and extracellular matrix (ECM). The dramatic reduction in the 156K DAG in Duchenne muscular dystrophy (310200) led to a loss of linkage between the sarcolemma and extracellular matrix, rendering muscle fibers more susceptible to necrosis. Ibraghimov-Beskrovnaya et al. (1992, 1992, 1993) mapped the DAG gene to chromosome 3 by Southern blot analysis of human/Chinese hamster somatic cell hybrid DNAs. One hybrid cell line with an isochromosome 3q was negative, suggesting location of the gene on 3p. The regional assignment was confirmed and further refined by fluorescence in situ hybridization, the localization being 3p21. The coding sequence of the DAG1 gene is organized into 2 exons, separated by a large intron (Ibraghimov-Beskrovnaya et al., 1993). The predicted amino acid sequence of human and rabbit dystroglycan are 93% identical, with predicted glycosylation sites being conserved. Human dystroglycan is expressed in a variety of fetal and adult tissues. The muscle and nonmuscle isoforms of dystroglycan differ by carbohydrate moities but not protein sequence. Using PCR, immunohistochemistry, and immunoblotting to analyze samples from patients with Fukuyama congenital muscular dystrophy (FCMD; 253800), Hayashi et al. (2001) confirmed a deficiency of fukutin and found marked deficiency of highly glycosylated DAG1 in skeletal and cardiac muscle and reduced mounts of DAG1 in brain tissue. Beta-dystroglycan was normal in all tissues examined. These findings supported the suggestion that fukutin deficiency affects the modification of glycosylation of DAG1, which then cannot localize or function properly and may be degraded or eluted from the extracellular surface membrane of the muscle fiber. Hayashi et al. (2001) concluded that this disruption underlies the developmental, structural, and functional damage to muscles in patients with FCMD.

Animal model experiments lend further support to the function of DAG1. Cohn et al. (2002) found that striated muscle-specific disruption of the Dag1 gene in mice resulted in loss of the dystrophin-glycoprotein complex in differentiated muscle and a remarkably mild muscular dystrophy with hypertrophy and without tissue fibrosis. They found that satellite cells, expressing dystroglycan, supported continued efficient regeneration of skeletal muscle along with transient expression of dystroglycan in regenerating muscle fibers. Cohn et al. (2002) demonstrated a similar phenomenon of reexpression of functional dystroglycan in regenerating muscle fibers in a mild form of human muscular dystrophy caused by disruption of posttranslational dystroglycan processing. They concluded that maintenance of regenerative capacity by satellite cells expressing dystroglycan is likely responsible for mild disease progression in mice and possibly humans. Cohn et. al. (2002) suggested that inadequate repair of skeletal muscle by satellite cells represents an important mechanism affecting the pathogenesis of muscular dystrophy.

It is appreciated that the abovementioned animal model for DAG1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Ibraghimov Beskrovnaya, O.; Ervasti, J. M.; Leveille, C. J.; Slaughter, C. A.; Sernett, S. W.; Campbell, K. P.: Primary structure of dystrophin-associated glycoproteins linking dystrophin to the extracellular matrix. Nature 355: 696-702, 1992. PubMed ID: 1741056 8. Hayashi, Y. K.; Ogawa, M.; Tagawa, K.; Noguchi, S.; Ishihara, T.; Nonaka, I.; Arahata, K.: Selective deficiency of alpha-dystroglycan in Fukuyama-type congenital muscular dystrophy. Neurology 57: 115-121, 2001.

Further studies establishing the function and utilities of DAG1 are found in John Hopkins OMIM database record ID 128239, and in references numbered 610-634 listed hereinbelow.

Referring now to DAG1 BINDING SITE. Dystroglycan 1 (dystrophin-associated glycoprotein 1) (DAG1) is a target gene of GAM26, corresponding to GAM26-TARGET GENE of FIG. 26A. DAG1 BINDING SITE is a binding site found in an untranslated region of DAG1, corresponding to BINDING SITE of FIG. 26A. FIG. 26D illustrates the complementarity of the nucleotide sequence of DAG1 BINDING SITE, designated SEQ ID:127882, to the nucleotide sequence of GAM26 RNA of FIG. 26A, designated SEQ ID:20604.

A further function of GAM26 is therefore inhibition of dystroglycan 1 (dystrophin-associated glycoprotein 1) (DAG1), a gene which encodes a protein that may provide linkage between the sarcolemma and extracellular matrix (ECM) and is associated with Fukuyama-type congenital muscular dystrophy. Accordingly, utilities of GAM26 include diagnosis and treatment of the abovementioned diseases and clinical conditions. The function and utilities of DAG1 have been established by previous studies, as described hereinabove with reference to FIG. 26D.

Reference is now made to DDEF2 BINDING SITE. Development and differentiation enhancing factor 2 (DDEF2) is a target gene of GAM26, corresponding to GAM26-TARGET GENE of FIG. 26A. DDEF2 BINDING SITE is a binding site found in an untranslated region of DDEF2, corresponding to BINDING SITE of FIG. 26A. FIG. 26D illustrates the complementarity of the nucleotide sequence of DDEF2 BINDING SITE, designated SEQ ID:129959, to the nucleotide sequence of GAM26 RNA of FIG. 26A, designated SEQ ID:20604.

Yet a further function of GAM26 is therefore inhibition of development and differentiation enhancing factor 2 (DDEF2), a gene which encodes a protein that interacts with members of the Arf and Src family. Accordingly, utilities of GAM26 include diagnosis and treatment of the abovementioned diseases and clinical conditions.

The function of DDEF2 has been established by previous studies. By screening human brain cDNAs for those encoding large proteins, Ishikawa et al. (1997) identified a cDNA, which they called KIAA0400, encoding development- and differentiation-enhancing factor-2. They found that the deduced 1,006-amino acid DDEF2 protein contains a 60-amino acid zinc finger motif thought to be associated with GTPase activating protein (GAP) activity. Using PYK2 (601212) as bait in a yeast 2-hybrid screen, Andreev et al. (1999) isolated DDEF2, a PYK2-binding protein which they designated PAP. DDEF2 is a multidomain protein composed of an N-terminal alpha-helical region with a coiled-coil motif, followed by a pleckstrin homology domain, an Arf-GAP domain, an ankyrin homology region, a proline-rich region, and a C-terminal SH3 domain. DDEF2 shares 95% sequence identity with the mouse homolog and 68% sequence identity with human DDEF1 (605953). Andreev et al. (1999) identified 2 DDEF2 isoforms, designated PAP-alpha and PAP-beta, which differ by deletion of 45 amino acids from the proline-rich region and 172 amino acids from the N terminus. Northern blot analysis detected expression of an approximately 5.7-kb transcript at high levels in brain, kidney, and heart, and at lower levels in placenta, lung, and pancreas. Immunofluorescence studies demonstrated that DDEF2 is localized in the Golgi apparatus and at the plasma membrane, where it is colocalized with PYK2. DDEF2 forms a stable complex with PYK2 and activation of PYK2 leads to tyrosine phosphorylation of DDEF2 in vivo. The interaction of DDEF2 and PYK2 appears to be mediated by binding of the SH3 domain of DDEF2 to the proline-rich region in the C terminus of PYK2. In addition, in vitro recombinant DDEF2 exhibits strong GAP activity towards the small GTPases ARF1 (103180) and ARF5 (103188) and weak activity towards ARF6 (600464).

Full details of the abovementioned studies are described in the following publications, the disclosure of which are hereby incorporated by reference:

Andreev, J.; Simon, J. -P.; Sabatini, D. D.; Kam, J.; Plowman, G.; Randazzo, P. A.; Schlessinger, J.: Identification of a new Pyk2 target protein with Arf-GAP activity. Molec. Cell. Biol. 19: 2338-2350, 1999. PubMed ID: 10022920 2. Ishikawa, K.; Nagase, T. Nakajima, D.; Seki, N.; Ohira, M.; Miyajima, N.; Tanaka, A.; Kotani, H.; Nomura, N.; Ohara, O.: Prediction of the coding sequences of unidentified human genes. VIII. 78 new cDNA clones from brain which code for large proteins in vitro. DNA Res. 4: 307-313, 1997.

Further studies establishing the function and utilities of DDEF2 are found in John Hopkins OMIM database record ID 603817, and in references numbered 635 listed hereinbelow.

Referring now to DDEF2 BINDING SITE. Development and differentiation enhancing factor 2 (DDEF2) is a target gene of GAM26, corresponding to GAM26-TARGET GENE of FIG. 26A. DDEF2 BINDING SITE is a binding site found in an untranslated region of DDEF2, corresponding to BINDING SITE of FIG. 26A. FIG. 26D illustrates the complementarity of the nucleotide sequence of DDEF2 BINDING SITE, designated SEQ ID:129968, to the nucleotide sequence of GAM26 RNA of FIG. 26A, designated SEQ ID:20604.

Another function of GAM26 is therefore inhibition of development and differentiation enhancing factor 2 (DDEF2), a gene which encodes a protein that interacts with members of the Arf and Src family. Accordingly, utilities of GAM26 include diagnosis and treatment of the abovementioned diseases and clinical conditions. The function and utilities of DDEF2 have been established by previous studies, as described hereinabove with reference to FIG. 26D.

Referring now to DDEF2 BINDING SITE. Development and differentiation enhancing factor 2 (DDEF2) is a target gene of GAM26, corresponding to GAM26-TARGET GENE of FIG. 26A. DDEF2 BINDING SITE is a binding site found in an untranslated region of DDEF2, corresponding to BINDING SITE of FIG. 26A. FIG. 26D illustrates the complementarity of the nucleotide sequence of DDEF2 BINDING SITE, designated SEQ ID:129973, to the nucleotide sequence of GAM26 RNA of FIG. 26A, designated SEQ ID:20604.

Yet another function of GAM26 is therefore inhibition of development and differentiation enhancing factor 2 (DDEF2), a gene which encode a protein that interacts with members of the Arf and Src family. Accordingly, utilities of GAM26 include diagnosis and treatment of the abovementioned diseases and clinical conditions. The function and utilities of DDEF2 have been established by previous studies, as described hereinabove with reference to FIG. 26D.

Reference is now made to DHFR BINDING SITE. Dihydrofolate reductase (DHFR) is a target gene of GAM26, corresponding to GAM26-TARGET GENE of FIG. 26A. DHFR BINDING SITE is a binding site found in an untranslated region of DHFR, corresponding to BINDING SITE of FIG. 26A. FIG. 26D illustrates the complementarity of the nucleotide sequence of DHFR BINDING SITE, designated SEQ ID:133111, to the nucleotide sequence of GAM26 RNA of FIG. 26A, designated SEQ ID:20604.

An additional function of GAM26 is therefore inhibition of dihydrofolate reductase (DHFR), a gene which encodes an enzyme that converts dihydrofolate into tetrahydrofolate. Accordingly, utilities of GAM26 include diagnosis and treatment of the abovementioned diseases and clinical conditions.

The function of DHFR has been established by previous studies. Dihydrofolate reductase (EC 1.5.1.3) converts dihydrofolate into tetrahydrofolate, a methyl group shuttle required for the de novo synthesis of purines, thymidylic acid, and certain amino acids. DHFR is inhibited by methotrexate (MTX), a folate analog used as an antineoplastic and immunosuppressive agent. From comparisons of eukaryotic gene sequences and protein sequences of homologous enzymes from bacterial and mammalian organisms, Craik et al. (1983) noted that intron-exon junctions often coincide with variable surface loops of the protein structure. Proteins studied included DHFR, trypsin, and chymotrypsin. They pointed out that altered surface structures can account for functional differences among the members of a family, e.g., the serine proteases. 'Sliding' of the intron-exon junctions may constitute a mechanism for generating length polymorphisms and divergent sequences. Different function can thus be achieved without disrupting the stability of the protein core. DNA sequence amplification is one of the most frequent manifestations of genomic instability in human tumors. In most human tumor cells, amplified DNA sequences are borne on unstable, extrachromosomal double minutes (DMs). Singer et al. (2000) isolated a large number of independent methotrexate-resistant human cell lines, all of which contained DHFR-bearing DMs. All but one of these also had suffered partial or complete loss of one of the parental DHFR-bearing chromosomes. Cells in a few populations displayed what could be transient intermediates in the amplification process, including an initial homogeneously staining chromosome region (HSR), its subsequent breakage, the appearance of DHFR-containing fragments, and, finally, DMs. The studies suggested that both HSRs and DMs are initiated by chromosome breaks, but that cell types differ in how the extra sequences ultimately are processed and/or maintained.

Full details of the abovementioned studies are described in the following publications, the disclosure of which are hereby incorporated by reference:

Singer, M. J.; Mesner, L. D.; Friedman, C. L.; Trask B. J.; Hamlin, J. L.: Amplification of the human dihydrofolate reductase gene via double minutes is initiated by chromosome breaks. Proc. Nat. Acad. Sci. 97: 7921-7926, 2000. PubMed ID: 10859355 7. Craik, C. S.; Rutter, W. J.; Fletterick, R.: Splice junctions: association with variation in protein structure. Science 220: 1125-1129, 1983.

Further studies establishing the function and utilities of DHFR are found in John Hopkins OMIM database record ID 126060, and in references numbered 636-653 listed hereinbelow.

Referring now to DLG3 BINDING SITE. Discs large (*Drosophila*) homolog 3 (neuroendocrine-dlg) (DLG3) is a target gene of GAM26, corresponding to GAM26-TARGET GENE of FIG. 26A. DLG3 BINDING SITE is a binding site found in an untranslated region of DLG3, corresponding to BINDING SITE of FIG. 26A. FIG. 26D illustrates the complementarity of the nucleotide sequence of DLG3 BINDING SITE, designated SEQ ID:134695, to the nucleotide sequence of GAM26 RNA of FIG. 26A, designated SEQ ID:20604.

A further function of GAM26 is therefore inhibition of discs, large (*Drosophila*) homolog 3 (neuroendocrine-dlg) (DLG3), a gene which encodes a protein that mediates protein-protein interactions at the cytoplasmic surface of the cell membrane. Accordingly, utilities of GAM26 include diagnosis and treatment of the abovementioned diseases and clinical conditions. The function and utilities of DLG3 have been established by previous studies, as described hereinabove with reference to FIG. 26D.

Referring now to DLG3 BINDING SITE. Discs large (*Drosophila*) homolog 3 (neuroendocrine-dlg) (DLG3) is a target gene of GAM26, corresponding to GAM26-TARGET GENE of FIG. 26A. DLG3 BINDING SITE is a binding site found in an untranslated region of DLG3, corresponding to BINDING SITE of FIG. 26A. FIG. 26D illustrates the complementarity of the nucleotide sequence of DLG3 BINDING SITE, designated SEQ ID:134697, to the nucleotide sequence of GAM26 RNA of FIG. 26A, designated SEQ ID:20604.

Yet a further function of GAM26 is therefore inhibition of discs, large (*Drosophila*) homolog 3 (neuroendocrine-dig) (DLG3), a gene which encodes a protein that mediates protein-protein interactions at the cytoplasmic surface of the cell membrane. Accordingly, utilities of GAM26 include diagnosis and treatment of the abovementioned diseases and clinical conditions. The function and utilities of DLG3 have been established by previous studies, as described hereinabove with reference to FIG. 26D.

Referring now to DR1 BINDING SITE. Down-regulator of transcription 1, TBP-binding (negative cofactor 2) (DR1) is a target gene of GAM26, corresponding to GAM26-TARGET GENE of FIG. 26A. DR1 BINDING SITE is a binding site found in an untranslated region of DR1, corresponding to BINDING SITE of FIG. 26A. FIG. 26D illustrates the complementarity of the nucleotide sequence of DR1 BINDING SITE, designated SEQ ID:138522, to the nucleotide sequence of GAM26 RNA of FIG. 26A, designated SEQ ID:20604.

Another function of GAM26 is therefore inhibition of down-regulator of transcription 1, TBP-binding (negative cofactor 2) (DR1), a gene which encodes a protein that influences functional repression of both activated and basal transcription of class II genes. Accordingly, utilities of GAM26 include diagnosis and treatment of the abovementioned diseases and clinical conditions. The function and utilities of DR1 have been established by previous studies, as described hereinabove with reference to FIG. 26D.

Referring now to DR1 BINDING SITE. Down-regulator of transcription 1, TBP-binding (negative cofactor 2) (DR1) is a target gene of GAM26, corresponding to GAM26-TARGET GENE of FIG. 26A. DR1 BINDING SITE is a binding site found in an untranslated region of DR1, corresponding to BINDING SITE of FIG. 26A. FIG. 26D illustrates the complementarity of the nucleotide sequence of DR1 BINDING SITE, designated SEQ ID:138525, to the nucleotide sequence of GAM26 RNA of FIG. 26A, designated SEQ ID:20604.

Yet another function of GAM26 is therefore inhibition of down-regulator of transcription 1, TBP-binding (negative cofactor 2) (DR1), a gene which encodes a protein that influences functional repression of both activated and basal transcription of class II genes. Accordingly, utilities of GAM26 include diagnosis and treatment of the abovementioned diseases and clinical conditions. The function and utilities of DR1 have been established by previous studies, as described hereinabove with reference to FIG. 26D.

Referring now to DR1 BINDING SITE. Down-regulator of transcription 1, TBP-binding (negative cofactor 2) (DR1) is a target gene of GAM26, corresponding to GAM26-TARGET GENE of FIG. 26A. DR1 BINDING SITE is a binding site found in an untranslated region of DR1, corresponding to BINDING SITE of FIG. 26A. FIG. 26D illustrates the complementarity of the nucleotide sequence of DR1 BINDING SITE, designated SEQ ID:138526, to the nucleotide sequence of GAM26 RNA of FIG. 26A, designated SEQ ID:20604.

An additional function of GAM26 is therefore inhibition of down-regulator of transcription 1, TBP-binding (negative cofactor 2) (DR1), a gene which encodes a protein that influences functional repression of both activated and basal transcription of class II genes. Accordingly, utilities of GAM26 include diagnosis and treatment of the abovementioned diseases and clinical conditions. The function and utilities of DR1 have been established by previous studies, as described hereinabove with reference to FIG. 26D.

Referring now to DR1 BINDING SITE. Down-regulator of transcription 1, TBP-binding (negative cofactor 2) (DR1) is a target gene of GAM26, corresponding to GAM26-TARGET GENE of FIG. 26A. DR1 BINDING SITE is a binding site found in an untranslated region of DR1, corresponding to BINDING SITE of FIG. 26A. FIG. 26D illustrates the complementarity of the nucleotide sequence of DR1 BINDING SITE, designated SEQ ID:138546, to the nucleotide sequence of GAM26 RNA of FIG. 26A, designated SEQ ID:20604.

A further function of GAM26 is therefore inhibition of down-regulator of transcription 1, TBP-binding (negative cofactor 2) (DR1), a gene which encodes a protein that influences functional repression of both activated and basal transcription of class II genes. Accordingly, utilities of GAM26 include diagnosis and treatment of the abovementioned diseases and clinical conditions. The function and utilities of DR1 have been established by previous studies, as described hereinabove with reference to FIG. 26D.

Reference is now made to DSCAM BINDING SITE. Down syndrome cell adhesion molecule (DSCAM is a target gene of GAM26, corresponding to GAM26-TARGET GENE of FIG. 26A. DSCAM BINDING SITE is a binding site found in an untranslated region of DSCAM, corresponding to BINDING SITE of FIG. 26A. FIG. 26D illustrates the complementarity of the nucleotide sequence of DSCAM BINDING SITE, designated SEQ ID: 139794, to the nucleotide sequence of GAM26 RNA of FIG. 26A, designated SEQ ID:20604.

Yet a further function of GAM26 is therefore inhibition of Down syndrome cell adhesion molecule (DSCAM), a gene which encodes a protein that is a cell adhesion molecule that can mediate cation-independent homophilic binding activity. Accordingly, utilities of GAM26 include diagnosis and treatment other abovementioned diseases and clinical conditions.

The function of DSCAM has been established by previous studies. Schmucker et al. (2000) isolated a *Drosophila* homolog of the human DSCAM gene by its affinity to Dock (see DOCK1; 601403), an SH3/SH2 adaptor protein required for axon guidance. Dscam binds directly to both the SH2 and SH3 domains of Dock. Genetic studies revealed that Dscam, Dock, and Pak (see 602590), a serine/threonine kinase, act together to direct pathfinding of Bolwig's nerve, which contains a subclass of sensory axons, to an intermediate target in the embryo. Dscam also is required for the formation of axon pathways in the embryonic central nervous system. cDNA and genomic analyses revealed the existence of multiple forms of Dscam with a conserved architecture containing variable immunoglobulin and transmembrane domains. Alternative splicing can potentially generate more than 38,000 Dscam isoforms in *Drosophila*. The authors suggested that this molecular diversity may contribute to the specificity of neuronal connectivity. Barlow et al. (2001) studied a panel of 19 individuals with partial trisomy 21 (see 190685) and evaluated them using quantitative Southern blot dosage analysis and fluorescence in situ hybridization with subsets of 32 BACs spanning the region defined by D21S16 through the telomere. Fourteen individuals were duplicated for the candidate region, of whom 8 (57%) had the characteristic spectrum of Down syndrome-congenital heart disease (DS-CHD). Combining the results from these 8 individuals suggests that the candidate region for DS-CHD is demarcated by D21S3 (defined by ventricular septal defect), through PFKL (defined by tetralogy of Fallot). Barlow et al. (2001) concluded that the presence of 3 copies of gene(s) from this region is sufficient for the production of subsets of DS-CHD. This region does not include genes located near D21S55, previously proposed as a Down syndrome critical region, or the genes encoding collagens VI (see 120220) and XVIII (120328). Of the potential gene candidates in the narrowed DS-CHD region, DSCAM is notable in that it encodes a cell adhesion molecule, spans more than 840 kb of the candidate region, and is expressed in the heart during cardiac development. Given these properties, Barlow et al. (2001) proposed DSCAM as a candidate for DS-CHD.

Full details of the abovementioned studies are described in the following publications, the disclosure of which are hereby incorporated by reference:

Barlow G. M.; Chen, X. -N.; Shi, Z. Y.; Lyons, G. E.; Kurnit, D. M.; Celle, L.; Spinner, N. B.; Zackai, E.; Pettenati, M. J.; Van Riper, A. J.; Vekemans, M. J.; Mjaatvedt, C. H.; Korenberg, J. R.: Down syndrome congenital heart disease: a narrowed region and a candidate gene. Genet. Med. 3: 91-101, 2001. PubMed ID: 11280955 2. Schmucker, D.; Clemens, J. C.; Shu, H.; Worby, C. A.; Xiao, J.; Muda, M.; Dixon, J. E.; Zipursky, S. L.: *Drosophila* Dscam is an axon guidance receptor exhibiting extraordinary molecular diversity. Cell 101: 671-684, 2000.

Further studies establishing the function and utilities of DSCAM are found in John Hopkins OMIM database record ID 602523, and in references numbered 654-656 listed hereinbelow.

Referring now to DSCAM BINDING SITE. Down syndrome cell adhesion molecule (DSCAM) is target gene of GAM26, corresponding GAM26-TARGET GENE of FIG. 26A. DSCAM BINDING SITE is a binding site found in an untranslated region of DSCAM, corresponding to BINDING SITE of FIG. 26A. FIG. 26D illustrates the complementarity of the nucleotide sequence of DSCAM BINDING SITE, designated SEQ ID:139795, to the nucleotide sequence of GAM26 RNA of FIG. 26A, designated SEQ ID:20604.

Another function of GAM26 is therefore inhibition of Down syndrome cell adhesion molecule (DSCAM), a gene which encodes a protein that is a cell adhesion molecule that can mediate cation-independent homophilic binding activity. Accordingly, utilities of GAM26 include diagnosis and treatment the abovementioned diseases and clinical conditions. The function and utilities of DSCAM have been established by previous studies, as described hereinabove with reference to FIG. 26D.

Referring now to DSCAM BINDING SITE. Down syndrome cell adhesion molecule (DSCAM) is a target gene of GAM26, corresponding to GAM26-TARGET GENE of FIG. 26A. DSCAM BINDING SITE is a binding site found in an untranslated region of DSCAM, corresponding to BINDING SITE of FIG. 26A. FIG. 26D illustrates the complementarity of the nucleotide sequence of DSCAM BINDING SITE, designated SEQ ID:139808, to the nucleotide sequence of GAM26 RNA of FIG. 26A, designated SEQ ID:20604.

Yet another function of GAM26 is therefore inhibition of Down syndrome cell adhesion molecule (DSCAM), a gene which encodes a protein that is a cell adhesion molecule that can mediate cation-independent homophilic binding activity. Accordingly, utilities of GAM26 include diagnosis and treatment of the abovementioned diseases and clinical conditions. The function and utilities of DSCAM have been established by previous studies, as described hereinabove with reference to FIG. 26D.

Reference is now made to DSCR1 BINDING SITE. Down syndrome critical region gene 1 (DSCR1) is a target gene of GAM26, corresponding to GAM26-TARGET GENE of FIG. 26A. DSCR1 BINDING SITE is a binding site found in an untranslated region of DSCR1, corresponding to BINDING SITE of FIG. 26A. FIG. 26D illustrates the complementarity of the nucleotide sequence of DSCR1 BINDING SITE, designated SEQ ID:139913, to the nucleotide sequence of GAM26 RNA of FIG. 26A, designated SEQ ID:20604.

An additional function of GAM26 is therefore inhibition of Down syndrome critical region gene 1 (DSCR1), a gene which encode a protein that inhibits calcineurin-dependent transcriptional responses. Accordingly, utilities of GAM26 include diagnosis and treatment of the abovementioned diseases and clinical conditions.

The function of DSCR1 has been established by previous studies. The study of patients with partial trisomy 21 has defined an area of approximately 3 Mb at chromosomal region 21q22 as the minimal candidate region for the Down syndrome phenotype (190685). Using a novel exon cloning strategy, Fuentes et al. (1995) identified several putative exons from region 21q22.1-q22.2. One exon was used to isolate fetal brain cDNAs corresponding to a gene that the authors designated DSCR1. The predicted 171-amino acid protein contains 2 proline-rich regions, a putative DNA-binding domain, and an acidic region. Northern blot analysis revealed that the 2.2-kb DSCR1 transcript is expressed at the highest levels in fetal brain and adult heart and at lower levels in various other tissues. An addition 2-kb mRNA was detected in fetal and adult liver. Increased expression in the brains of young rats compared with adults suggested to Fuentes et al. (1995) that DSCR1 plays a role during central nervous system development. Fuentes et al. (1997) determined that DSCR1 spans nearly 45 kb and contain 7 exons, 4 of which are alternative first exons. They found tissue-specific express on patterns for the alternative transcripts. Kingsbury and Cunningham (2000) referenced to the proteins encoded by the MCIP genes as calcipressins. Functional analysis showed that when expressed in yeast, DSCR1 and ZAKI4 inhibited calcineurin function. The authors proposed that increased expression of DSCR1 in trisomy-21 individuals may contribute to the neurologic, cardiac, or immunologic defects of Down syndrome.

Full details of the abovementioned studies are described in the following publications, the disclosure of which are hereby incorporated by reference:

Fuentes, J. J.; Pritchard, M. A.; Estivill, X.: Genomic organization, alternative splicing, and expression patterns of the DSCR1 (Down syndrome candidate region 1) gene. Genomics 44: 358-361, 1997. PubMed ID: 9325060 4. Kingsbury, T. J.; Cunningham, K. W.: A conserved family of calcineurin regulators. Genes Dev. 14: 1595-1604, 2000.

Further studies establishing the function and utilities of DSCR1 are found in John Hopkins OMIM database record ID 602917, and in references numbered 657 and 658-662 listed hereinbelow.

Reference is now made to DUSP5 BINDING SITE. Dual specificity phosphatase 5 (DUSP5) is a target gene of GAM26, corresponding to GAM26-TARGET GENE of FIG. 26A. DUSP5 BINDING SITE is a binding site found in an untranslated region of DUSP5, corresponding to BINDING SITE of FIG. 26A. FIG. 26D illustrates the complementarity of the nucleotide sequence of DUSP5 BINDING SITE, designated SEQ ID:141448, to the nucleotide sequence of GAM26 RNA of FIG. 26A, designated SEQ ID:20604.

A further function of GAM26 is therefore inhibition of dual specificity phosphatase 5 (DUSP5), a gene which encodes a protein that displays phosphatase activity toward several substrates. Accordingly, utilities of GAM26 include diagnosis and treatment of the abovementioned diseases and clinical conditions.

The function of DUSP5 has been established by previous studies. The VH1 phosphatase encoded by vaccinia virus is a dual-specificity protein-tyrosine phosphatase (PTPase) which hydrolyzes substrates phosphorylated on both tyrosine and serine/threonine residues VH1-like PTPases have been identified in humans and other organisms. See DUSP1 (500714). To identify additional human dual-specificity PTPases, Martell et al. (1994) screened a genomic library with a partial DUSP1 cDNA. They isolated several novel PTPase genes, including 1 which they designated HVH3 for human VH1-like PTPase-3. Kwak and Dixon (1995) cloned human placental HVH3 cDNAs and reported that the predicted protein has 384 amino acids. Using immunofluorescence, they determined that epitope-tagged HVH3 is localized primarily in the nucleus of mammalian cells. Ishibashi et al. (1994) isolated HVH3 cDNAs from a human mammary epithelial cell cDNA library and found that the predicted protein has 397 amino acids. In vitro, recombinant protein containing the catalytic domain of HVH3 displayed phosphatase activity toward several substrates. The highest relative activity was toward ERK1 (601795), suggesting that it may be a target for HVH3 activity in vivo. Northern blot analysis revealed that HVH3 is expressed as a 2.5-kb mRNA in a variety of tissues, with the highest levels in pancreas and brain. HVH3 expression was induced by serum stimulation of fibroblasts and by heat shock, with similar kinetics to those observed with DUSP1. As has been proposed for other dual-specificity PTPases like DUSP1 and DUSP2 (603068), Ishibashi et al. (1994) suggested that the induction of HVH3 may lead to the deactivation of mitogen- or stress-activated protein kinases, hereby restoring these signaling pathways to their mitogen- or stress-sensitive state. By fluorescence in situ hybridization, Martell et al. (1994) mapped the HVH3 gene to 10q25

Full details of the abovementioned studies are described in the following publications, the disclosure of which are hereby incorporated by reference:

Ishibashi, T.; Bottaro, D. P.; Michieli, P.; Kelley, C. A.; Aaronson, S. A.: A novel dual specificity phosphatase induced by serum stimulation and heat shock. J. Biol. Chem. 269: 29897-29902, 1994. PubMed ID: 7961985 3. Martell, K. J.; Kwak, S.; Hakes, D. J.; Dixon, J. E.; Trent, J. M.: Chromosomal localization of four human VH1-like protein-tyrosine phosphatases. Genomics 22: 462-464, 1994.

Further studies establishing the function and utilities of DUSP5 are found in John Hopkins OMIM database record ID 603069, and in references numbered 663-665 listed hereinbelow.

Reference is now made to DVL3 BINDING SITE. Dishevelled 3 (homologous to *Drosophila* dsh) (DVL3) is a target gene of GAM26, corresponding to GAM26-TARGET GENE of FIG. 26A. DVL3 BINDING SITE is a binding site found in an untranslated region of DVL3, corresponding to BINDING SITE of FIG. 26A. FIG. 26D illustrates the complementarity of the nucleotide sequence of DVL3 BINDING SITE, designated SEQ ID:141937, to the nucleotide sequence of GAM26 RNA of FIG. 26A, designated SEQ ID:20604.

Yet a further function of GAM26 is therefore inhibition of dishevelled 3 (homologous to *Drosophila* dsh) (DVL3), a gene which encodes a protein that regulates cell proliferation. Accordingly, utilities of GAM26 include diagnosis and treatment of the abovementioned diseases and clinical conditions.

The function of DVL3 has been established by previous studies. The *Drosophila* dishevelled gene (dsh) encodes a cytoplasmic phosphoprotein (Klingensmith et al., 1994) that regulates cell proliferation, acting as a transducer molecule for developmental processes, including segmentation and neuroblast specification. Pizzuti et al. (1996) noted that dsh is required for the function of the wingless gene product wg, a segment polarity gene homologous to the mammalian protooncogene WNT1 (164820). Pizzuti et al. (1996) reported the isolation and chromosomal mapping of 2 human dsh homologs, designated DVL1 (601365) and DVL3 by them. The human dsh homologs were isolated from a fetal brain cDNA library. DVL3 encodes a predicted 716-amino acid polypeptide that shows 74% nucleotide homology with human DVL1 and 71% homology with the mouse Dvl1 gene. DVL1 and DVL3 share 64% amino acid identity. Pizzuti et al. (1996) reported that homology is particularly high in the N-terminal region and that there is more divergence in the C-terminal regions. PCR carried out using DNA from rodent human somatic cell hybrids and DVL3 specific primers led to the assignment of DVL3 to human chromosome 3. Pizzuti et al. (1996) regionally assigned DVL3 to band 3q27 using fluorescence in situ hybridization. Hybridization of poly(A) mRNA with the DVL3 cDNA revealed a 2.9-kb transcript with abundant expression in skeletal muscle, pancreas and heart. They also detected 5.9-kb and 5.0-kb transcripts in skeletal muscle, adult liver, adult heart, pancreas, and placenta. The 5.9-kb form was abundant in fetal tissues but the 5.0 kb form was absent from these tissues. Pizzuti et al. (1996) noted that Charcot-Marie-Tooth type 2B (600882) maps to chromosome 3q. Bui et al. (1997) also isolated human DVL3, which shares 98% amino acid identity with mouse Dvl3 and 49% with *Drosophila* dsh. The authors confirmed the chromosomal localization at 3p27. Semenov and Snyder (1997) isolated 3 human genes encoding proteins homologous to *Drosophila* dsh. The cDNA sequence of DVL3 reported by Semenov and Snyder (1997) differs from the previously reported sequences deposited in GenBank. Bui et al. (1997) detected expression of DVL3 mRNA in B cells, breast, kidney, bladder, endometrium, and 2 primary endometrial cultures. It was detected equally in normal human breast tissues and tumors and in colorectal samples of normal tissues, polyps, and tumors.

Full details of the abovementioned studies are described in the following publications, the disclosure of which are hereby incorporated by reference:

Pizzuti, A.; Amati, F.; Calabrese, G.; Mari, A.; Colosimo, A.; Silani, V.; Giardino, L.; Ratti, A.; Penso, D.; Calza, L.; Palka, G.; Scarlato, G.; Novelli, G.; Dallapicolla, B.: cDNA characterization and chromosomal mapping of two human homologs of the *Drosophila* dishevelled polarity gene. Hum. Molec. Genet. 5: 953-958, 1996. PubMed ID: 8817329 4. Semenov, M. V.; Snyder, M.: Human dishevelled genes constitute a DHR-containing multigene family. Genomics 42: 302-310, 1997.

Further studies establishing the function and utilities of DVL3 are found in John Hopkins OMIM database record ID 601368, and in references numbered 666-669 listed hereinbelow.

Reference is now made to DXYS155E BINDING SITE. (DXYS155E) is a target gene of GAM26, corresponding to GAM26-TARGET GENE of FIG. 26A. DXYS155E BINDING SITE is a binding site found in an untranslated region of DXYS155E, corresponding to BINDING SITE of FIG. 26A. FIG. 26D illustrates the complementarity of the nucleotide sequence of DXYS155E BINDING SITE, designated SEQ ID:142341, to the nucleotide sequence of GAM26 RNA of FIG. 26A, designated SEQ ID:20604.

Another function of GAM26 is therefore inhibition of (DXYS155E), a gene which encodes a protein that may be involved in b-cell activation, may also be involved in sign al transduction and gene regulation. Accordingly, utilities of GAM26 include diagnosis and treatment of the abovementioned diseases and clinical conditions.

The function of DXYS155E has been established by previous studies. In the 2.6-megabase segment of the distal short arms of the X and Y chromosomes, called the pseudoautosomal region, Ellison et al. (1992) identified an expressed gene designated XE7. (See also 465000.) They reported the structure of the XE7 gene and its expression in various human tissues. The analysis of genomic and cDNA clones showed that alternative RNA splicing results in the production of 2 protein isoforms, one containing 385 amino acids and the other containing 695 residues. The smaller polypeptide is a truncated version of the larger and results from the inclusion of a cassette exon that has an in-frame stop codon. The XE7 gene appears to be ubiquitously expressed, and the production of both protein isoforms was predicted in each of the several tissues examined.

Full details of the abovementioned studies are described in the following publications, the disclosure of which are hereby incorporated by reference:

Ellison, J.; Passage, M.; Yu, L. -C.; Yen, P.; Mohandas, T. K.; Shapiro, L.: Directed isolation of human genes that escape X inactivation. Somat. Cell Molec. Genet 18: 259-268, 1992. PubMed ID: 1496421 2. Ellison, J. W.; Ramos, C.; Yen, P. H.; Shapiro, L. J.: Structure and expression of the human pseudoautosomal gene XE7. Hum. Molec. Genet 1: 691-696, 1992.

Further studies establishing the function and utilities of DXYS155E are found in John Hopkins OMIM database record ID 312095, and in references numbered 670-671 listed hereinbelow.

Reference is, now made to DYRK2 BINDING SITE. Dual-specificity tyrosine-(Y)-phosphorylation regulated kinase 2 (DYRK2) is a target gene of GAM26, corresponding to GAM26-TARGET GENE of FIG. 26A. DYRK2 BINDING SITE is a binding site found in an untranslated region of DYRK2, corresponding to BINDING SITE of FIG. 26A. FIG. 26D illustrates the complementarity of the nucleotide sequence of DYRK2 BINDING SITE, designated SEQ ID:142933, to the nucleotide sequence of GAM26 RNA of FIG. 26A, designated SEQ ID:20604.

Yet another function of GAM26 is therefore inhibition of dual-specificity tyrosine (Y)-phosphorylation regulated kinase 2 (DYRK2), a gene which encodes a protein that can phosphorylate histones h3 and h2b on ser and thr residues. Accordingly, utilities of GAM26 include diagnosis and treatment of the abovementioned diseases and clinical conditions.

The function of DYRK2 has been established by previous studies. DYRK1 (600855) is a dual-specificity protein kinase that catalyzes its autophosphorylation on serine/threonine and tyrosine residues and is presumably involved in brain development. By PCR using sequences conserved between DYRK1 and the related proteins MNB of *Drosophila* and Yak1 of *S. cerevisiae*, Becker et al. (1998) identified DYRK2 and DYRK3 (603497), kinases related to DYRK1. Human fetal brain DYRK2 (GenBank Y13493) cDNAs encode 2 isoforms: a deduced 528-amino acid protein and a protein containing 73 additional amino acids at the N terminus. The DYRK2 proteins contain a canonical kinase domain located between a large N-terminal re ion and a short C-terminal extension, and features specific to DYRK-related kinases DYRK2 shares 46% identity with DYRK1 in the catalytic domain, but lacks the striking sequence motifs identified in DYRK1. The DYRK2 and DYRK3 proteins are related over their entire sequences except for the N-terminal region. Northern blot analysis of rat tissues detected Dyrk2 expression in testis, only after the onset of spermatogenesis. Recombinant DYRK2 was found predominantly in the cytoplasm of transfected mammalian cells. DYRK2 expressed in *E. coli* demonstrated tyrosine autophosphorylation and catalyzed phosphorylation of histones H3 and H2B in vitro. Based on sequence similarity to EST Z25301, Becker et al. (1998) tentatively mapped the DYRK2 gene to chromosome 12.

Full details of the abovementioned studies are described in the following publications, the disclosure of which are hereby incorporated by reference:

Becker, W.; Weber, Y.; Wetzel, K.; Eirmbter, K.; Tejedor, F. J.; Joost, H. G.: Sequence characteristics, subcellular localization, and substrate specificity of DYRK-related kinases, a novel family of dual specificity protein kinases J. Biol. Chem. 273: 25893-25902, 1998.

Further studies establishing the function and utilities of DYRK2 are found in John Hopkins OMIM database record ID 603496, and in references numbered 672 listed hereinbelow.

Referring now to DYRK2 BINDING SITE. Dual-specificity tyrosine-(Y)-phosphorylation regulated kinase 2 (DYRK2) is a target gene of GAM26, corresponding to GAM2-TARGET GENE of FIG. 26A. DYRK2 BINDING SITE is a binding site found in an untranslated region of DYRK2, corresponding to BINDING SITE of FIG. 26A. FIG. 26D illustrates the complementarity of the nucleotide sequence of DYRK2 BINDING SITE, designated SEQ ID:142953, to the nucleotide sequence of GAM26 RNA of FIG. 26A, designated SEQ ID:20604.

An additional function of GAM26 is therefore inhibition of dual-specificity tyrosine-(Y)-phosphorylation regulated kinase 2 (DYRK2), a gene which encodes a protein that can phosphorylate histones h3 and h2b on ser and thr residues. Accordingly, utilities of GAM26 include diagnosis and treatment of the abovementioned diseases and clinical conditions. The function and utilities of DYRK2 have been established by previous studies, as described hereinabove with reference to FIG. 26D.

Reference is now made to EFNA3 BINDING SITE. Ephrin-A3 (EFNA3) is a target gene of GAM26, corresponding to GAM26-TARGET GENE of FIG. 26A. EFNA3 BINDING SITE is a binding site found in an untranslated region of EFNA3, corresponding to BINDING SITE of FIG. 26A. FIG. 26D illustrates the complementarity of the nucleotide sequence of EFNA3 BINDING SITE, designated SEQ ID:144685, to the nucleotide sequence of GAM26 RNA of FIG. 26A, designated SEQ ID:20604.

A further function of GAM26 is therefore inhibition of ephrin-A3 (EFNA3), a gene which encodes a protein that is a ligand of Eph-related receptor tyrosine kinases. Accordingly, utilities of GAM26 include diagnosis and treatment of the abovementioned diseases and clinical conditions.

The function of EFNA3 has been established by previous studies. Proteins in the LERK subfamily of ligands, called ephrins, bind to members of the EPH group of receptor tyrosine kinases. The various ephrins are characterized by sequence similarities and the fact that they are attached to the cell membrane by glycosylphosphatidylinositol (GPI) anchors or by a single transmembrane domain. See 179610 for additional information on ephrins and the Eph receptor family. By fluorescence in situ hybridization, Cerretti et al. (1996) mapped the EPLG3 gene to a cluster on chromosome 1q21-q22, together with EPLG1 (EFNA1; 191164) and EPLG4 (EFNA4; 601380). By interspecific backcross analysis, they mapped the mouse EPLG3 homolog (Epl3: to the central region of mouse chromosome 3. Cerretti and Nelson (1998) reported that the mouse Efna3 gene has 5 exons. The gene structures of human EFNA2 (602756) and mouse Efna3, Efna4 (601380), and Efnb1 (300035) are conserved through the first 3 exons.

Full details of the abovementioned studies are described in the following publications, the disclosure of which are hereby incorporated by reference:

Cerretti, D. P.; Lyman, S. D.; Kozlosky, C. J.; Copeland, N. G.; Gilbert, D. J.; Jenkins, N. A.; Valentine, V.; Kirstein, M. N.; Shapiro, D. N.; Morris, S. W.: The genes encoding the Eph-related receptor tyrosine kinase ligands LERK-1 (EPLG1, Epl1), LERK-3 (EPLG3, Epl3, and LERK-4 (EPLG4, Epl4) are clustered on human chromosome 1 and mouse chromosome 3. Genomics 33: 277-282, 1996. PubMed ID: 8660976 2. Cerretti D. P.; Nelson, N.: Characterization of the genes for mouse LERK-3/Ephrin-A3 (Epl3), mouse LERK-4Ephrin-A4 (Epl4), and human LERK-6/Ephrin-A2 (EPLG6): conservation of intron/exon structure. Genomics 47: 131-135, 1998.

Further studies establishing the function and utilities of EFNA3 are found in John Hopkins OMIM database record ID 601381, and in references numbered 673-674 listed hereinbelow.

Referring now to EFNA3 BINDING SITE. Ephrin-A3 (EFNA3) is a target gene of GAM26, corresponding to GAM26-TARGET GENE of FIG. 26A. EFNA3 BINDING SITE is a binding site found in an untranslated region of EFNA3, corresponding to BINDING SITE of FIG. 26A. FIG. 26D illustrates the complementarity of the nucleotide sequence of EFNA3 BINDING SITE, designated SEQ ID:144687, to the nucleotide sequence of GAM26 RNA of FIG. 26A, designated SEQ ID:20604.

Yet a further function of GAM26 is therefore inhibition of ephrin-A3 (EFNA3), a gene which encodes a protein that is a ligand of Eph-related receptor tyrosine kinases. Accordingly, utilities of GAM26 include diagnosis and treatment of the abovementioned diseases and clinical conditions. The function and utilities of EFNA3 have been established by previous studies, as described hereinabove with reference to FIG. 26D.

Reference is now made to EGLN1 BINDING SITE. egl nine homolog 1 (*C. elegans*) (EGLN1) is a target gene of GAM26, corresponding to GAM26-TARGET GENE of FIG. 26A. EGLN1 BINDING SITE is a binding site found in an untranslated region of EGLN1, corresponding to BINDING SITE of FIG. 26A. FIG. 26D illustrates the complementarity of the nucleotide sequence of EGLN1 BINDING SITE, designated SEQ ID:145984, to the nucleotide sequence of GAM26 RNA of FIG. 26A, designated SEQ ID:20604.

Another function of GAM26 is therefore inhibition of egl nine homolog 1 (*C. elegans*) (EGLN1), a gene which encodes a protein that is expressed in the cytoplasm of arterial smooth muscle cells. Accordingly, utilities of GAM26 include diagnosis and treatment of the abovementioned diseases and clinical conditions.

The function of EGLN1 has been established by previous studies. HIF is a transcriptional complex that plays a central role in mammalian oxygen homeostasis. Posttranslational modification by prolyl hydroxylation is a key regulatory event that targets HIF-alpha (HIF1; 603348) subunits for proteasomal destruction via the von Hippel-Lindau (VHL; 193300) ubiquitylation complex. Epstein et al. (2001) defined a conserved HIF-VHL-prolyl hydroxylase pathway in *C. elegans* and identified Egl9 as a dioxygenase that regulates HIF by prolyl hydroxylation. In mammalian cells, they showed that the HIF-prolyl hydroxylases are represented by 3 proteins with a conserved 2-histidine-1-carboxylate iron coordination motif at the catalytic site. The genes encoding these proteins were cloned and termed PHD1 (606424), PHD2, and PHD3 (606426) by the authors. Direct modulation of recombinant enzyme activity by graded hypoxia, iron chelation, and cobaltous ions mirrored the characteristics of HIF induction in vivo, fulfilling requirements for these enzymes being oxygen sensors that regulate HIF. In cultured mammalian cells, Bruick and McKnight (2001) found that the inappropriate accumulation of HIF caused by forced expression of the HIF1-alpha (603348) subunit under normoxic conditions was attenuated by coexpression of HPH. Suppression of HPH in cultured *Drosophila melanogaster* cells by RNA interference resulted in elevated expression of the hypoxia inducible gene LDH (see 150000) under normoxic conditions. Bruick and McKnight (2001) concluded that HPH is an essential component of the pathway through which cells sense oxygen.

Full details of the abovementioned studies are described in the following publications, the disclosure of which are hereby incorporated by reference:

Bruick, R. K.; McKnight, S. L.: A conserved family of prolyl-4-hydroxylases that modify HIF. Science 294: 1337-1340, 2001. PubMed ID: 11598268 3. Epstein, A. C. R.; Gleadle J. M.; McNeill, L. A.; Hewitson, K. S.; O'Rourke, J.; Mole, D. R.; Mukherji, M.; Metzen E.; Wilson, M. I.; Dhanda, A.; Tian, Y. -M.; Masson, N.; Hamilton, D. L.; Jaakkola, P.; Barstead, R.; Hodgkin, J.; Maxwell, P. H.; Pugh, C. W.; Schofield, C. J.; Ratcliffe, P. J.: *C. elegans* EGL-9 and mammalian homologs define a family of dioxygenases that regulate HIF by prolyl hydroxylation. Cell 107: 43-54, 2001.

Further studies establishing the function and utilities, EGLN1 are found in John Hopkins OMIM database record ID 606425, and in referent numbered 675-677 listed hereinbelow.

Reference is now made to EGR3 BINDING SITE. early growth response 3 (EGR3) is a target gene of GAM26, corresponding to GAM26-TARGET GENE of FIG. 26A. EGR3 BINDING SITE is a binding site found in an untranslated region of EGR3, corresponding to BINDING SITE of FIG. 26A. FIG. 26D illustrates the complementarity of the nucleotide sequence of EGR3 BINDING SITE, designated SEQ ID:146843, to the nucleotide sequence of GAM26 RNA of FIG. 26A, designated SEQ ID:20604.

Yet another function of GAM26 is therefore inhibition of early growth response 3 (EGR3) a gene which encodes a protein that is a putative transcription factor. Accordingly, utilities of GAM26 include diagnosis and treatment of the abovementioned diseases and clinical conditions.

The function of EGR3 has been established by previous studies. The human EGR3 gene was described by Patwardhan et al. (1991) as predicting a 387-amino acid protein containing 3 C2H2 zinc fingers nearly identical to those of EGR1 and EGR2. The EGR3 gene has a single intron. The gene was known to be induced in various brain regions in response to stress or following focal brain injury. Morris et al. (1998) stated that, in the SCN, it probably participates in the transcriptional regulation of genes in response to retinal input, as had been proposed for FOS. Muscle spindles are skeletal muscle sensory organs that provide axial and limb position information (proprioception) to the central nervous system. Spindles consist of encapsulated muscle fibers (intrafusal fibers) that are innervated by specialized motor and sensory axons. Tourtellotte and Milbrandt (1998) found that mice rendered deficient in Egr3 by gene targeting had gait ataxia, increased frequency of perinatal mortality, scoliosis, resting tremors, and ptosis. Although extrafusal skeletal muscle fibers appeared normal, Egr3-deficient animals lacked muscle spindles, a finding that is consistent with their profound gait ataxia. Egr3 was highly expressed in developing muscle spindles, but not in IIa afferent neurons or their terminals during developmental periods that coincided with the induction of spindle morphogenesis by sensory afferent axons. These results indicated that type I myotubes are dependent upon Egr3-mediated transcription for proper spindle development.

Full details of the abovementioned studies are described in the following publications, the disclosure of which are hereby incorporated by reference:

Morris M. E.; Viswanathan, N.; Kuhlman, S.; Davis, F. C.; Weitz, C. J.: A screen for genes induced in the suprachiasmatic nucleus by light. Science 279: 1544-1547, 1998. PubMed ID:9488654 3. Tourtellotte, W. G.; Milbrandt, J.: Sensory ataxia and muscle spindle agenesis in mice lacking the transcription factor Egr3. Nature Genet. 20: 87-91, 1998.

Further studies establishing the function and utilities of EGR3 are found in John Hopkins OMIM database record ID 602419, and in referent numbered 678-680 listed hereinbelow.

Referring now to EGR3 BINDING SITE. Early growth response 3 (EGR3) is a target gene of GAM26, corresponding to GAM26-TARGET GENE of FIG. 26A. EGR3 BINDING SITE is a binding site found in an untranslated region of EGR3, corresponding to BINDING SITE of FIG. 26A. FIG. 26 illustrates the complementarity of the nucleotide sequence of EGR3 BINDING SITE, designated SEQ ID:146845, to the nucleotide sequence of GAM26 RNA of FIG. 26A, designated SEQ ID:20604.

An additional function of GAM26 is therefore inhibition of early growth response 3 (EGR3), a genie which encodes a protein that is a putative transcription factor. Accordingly, utilities of GAM26 include diagnosis and treatment of the abovementioned diseases and clinical conditions. The function and utilities of EGR3 have been established by previous studies, as described hereinabove with reference to FIG. 26D.

Referring now to EGR3 BINDING SITE. Early growth response 3 (EGR3) is a target gene of GAM26, corresponding to GAM26-TARGET GENE of FIG. 26A. EGR3 BINDING SITE is a binding site found in an untranslated region of EGR3, corresponding to BINDING SITE of FIG. 26A. FIG. 26D illustrates the complementarity of the nucleotide sequence of EGR3 BINDING SITE, designated SEQ ID:146876, to the nucleotide sequence of GAM26 RNA of FIG. 26A, designated SEQ ID:20604.

A further function of GAM26 is therefore inhibition of early growth response 3 (EGR3), a gene which encodes a protein that is a putative transcription factor. Accordingly, utilities of GAM26 include diagnosis and treatment of the abovementioned diseases and clinical conditions. The function and utilities of EGR3 have been established by previous studies, as described hereinabove with reference to FIG. 26D.

Referring now to EGR3 BINDING SITE. Early growth response 3 (EGR3) is a target gene of GAM26, corresponding to GAM26-TARGET GENE of FIG. 26A, EGR3 BINDING SITE is a binding site found in an untranslated region of EGR3, corresponding to BINDING SITE of FIG. 26A. FIG. 26D illustrates the complementarity of the nucleotide sequence of EGR3 BINDING SITE, designated SEQ ID:146919, to the nucleotide sequence of GAM26 RNA of FIG. 26A, designated SEQ ID:20604.

Yet a further function of GAM26 is therefore inhibition of early growth response 3 (EGR3), a gene which encodes a protein that is a putative transcription factor. Accordingly, utilities of GAM26 include diagnosis and treatment of the abovementioned diseases and clinical conditions. The function and utilities of EGR3 have been established by previous studies, as described hereinabove with reference to FIG. 26D.

Reference is now made to EIF2C1 BINDING SITE. Eukaryotic translation initiation factor 2C, 1 (EIF2C1) is a target gene of GAM26, corresponding to GAM26-TARGET GENE of FIG. 26A. EIF2C1 BINDING SITE is a binding site found in an untranslated region of EIF2C1, corresponding to BINDING SITE of FIG. 26A. FIG. 26D illustrates the complementarity of the nucleotide sequence of EIF2C1 BINDING SITE, designated SEQ ID:148159, to the nucleotide sequence of GAM26 RNA of FIG. 26A, designated SEQ ID:20604.

Another function of GAM26 is therefore inhibition of eukaryotic translation initiation factor 2C, 1 (EIF2C1), a gene which encode a protein that plays an important role in the eukaryotic peptide chain initiation process. Accordingly, utilities of GAM26 include diagnosis and treatment of the abovementioned diseases and clinical conditions.

The function of EIF2C1 has been established by previous studies. Koesters et al. (1999) isolated an EIF2C1 cDNA from a human fetal kidney cDNA library. To obtain genomic sequence information, they isolated a P1 genomic clone containing the EIF2C1 locus. The human EIF2C1 gene encodes a protein of 857 amino acids. The 2,571-bp open reading frame is flanked by 238 bp of 5-prime sequence and an extremely large 3-prime untranslated region with multiple short repeated segments composed of mono-, tri-, or quatronucleotides interspersed throughout. Northern blot analysis demonstrated that the human EIF2C1 gene is ubiquitously expressed at low to medium levels. Differential polyadenylation and splicing resulted in a complex transcriptional pattern. Martinez et al. (2002) demonstrated that a single-stranded small interfering RNA (siRNA) resides in the human RNA-induced silencing complex (RISC) together with the EIF2C1 and/or EIF2C2 (606229) proteins. RISC could be rapidly formed in HeLa cell cytoplasmic extract supplemented with 21-nucleotide siRNA duplexes, but also by adding single-stranded antisense RNAs, which range in size between 19 and 29 nucleotides.

Full details of the abovementioned studies are described in the following publications, the disclosure of which are hereby incorporated by reference:

Koesters, R.; Adams, V.; Betts, D.; Moos, R.; Schmid, M.; Siermann, A.; Hassam, S.; Weitz, S.; Lichter, P.; Heitz, P. U.; von Knebel Doeberitz, M.; Briner, J.: Human eukaryotic initiation factor EIF2C1 gene: cDNA sequence, genomic organization, localization to chromosomal bands 1q34p35, and expression. Genomics 61: 210-218, 1999. PubMed ID: 105344062. Martinez, J.; Patkaniowska, A.; Urlaub, H.; Luhrmann, R.; Tuschi, T.: Single-stranded antisense siRNAs guide target RNA cleavage in RNAi. Cell 110: 563-574, 2002.

Further studies establishing the function and utilities of EIF2C1 are found in John Hopkins OMIM database record ID 606228, and in references numbered 681-682 listed hereinbelow.

Reference is now made to EIF4G1 BINDING SITE. Eukaryotic translation initiation fact or 4 gamma, 1 (EIF4G1) is a target gene of GAM26, corresponding to GAM26-TARGET GENE of FIG. 26A. EIF4G1 BINDING SITE is a binding site found in an untranslated region of EIF4G1, corresponding to BINDING SITE of FIG. 26A. FIG. 26D illustrates the complementarity of the nucleotide sequence of EIF4G1 BINDING SITE, designated SEQ ID:148798, to the nucleotide sequence of GAM26 RNA of FIG. 26A, designated SEQ ID:20604.

Yet another function of GAM26 is therefore inhibition of eukaryotic translation initiation factor 4 gamma, 1 (EIF4G1), a gene which encodes a protein that is a Translation initiation factor. Accordingly, utilities of GAM26 include diagnosis and treatment of the above mentioned diseases and clinical conditions.

The function of EIF4G1 has been established by previous studies. Gradi et al. (1998) identified a second human eIF4G gene. They designated the original gene eIF4GI and the novel gene eIF4GII (EIF4G3; 603929). Imataka et al. (1998) found that the human eIF4GI protein contains an additional 156 N-terminal amino acids compared to the sequence published by Yan et al. (1992). They demonstrated that this N-terminal region binds poly(A)-binding protein (PABP; 604679). In an in vitro translation system, an N-terminal fragment of eIF4GI that included the PABP-binding site inhibited poly(A)-dependent translation, but had no effect on translation of a deadenylated mRNA. Imataka et al. (1998) concluded that eIF4G probably functions in poly(A)-dependent translation in mammalian cells. By screening a rabbit brain library with oligonucleotide probes based on the sequence of rabbit eIF4-gamma peptides, Yan et al. (1992) identified partial eIF4-gamma cDNAs. They used the rabbit cDNAs as probes and isolated human brain cDNAs encoding eIF4-gamma. The predicted human protein contains 1,396 amino acids. Western blot analysis of poliovirus-infected Hela cell extracts revealed that eIF4-gamma has an apparent molecular weight of 200 to 220 kD and is cleaved by this picornavirus. Imataka and Sonenberg (1997) stated that the N-terminal region of eIF4G contains a binding site for eIF4E. They demonstrated that the central third of eIF4G contains an eIF3 (see 602039)-binding region and an eIF4A-binding domain. A second, separate eIF4A-binding site is present in the C-terminal third. Neither eIF4A-binding domain alone activates translation. In contrast to eIF4G, the eIF4G-related translation regulator p97 (602325) binds eIF4A only through its N-terminal domain, which is homologous to the central domain of eIF4G Full details of the abovementioned studies are described in the following publications, the disclosure of which are hereby incorporated by reference:

Imataka, H.; Gradi, A.; Sonenberg, N.: A newly identified N-terminal amino acid sequence of human eIF4G binds poly(A)-binding protein and functions in poly(A)-dependent translation. EMBO J. 17: 7480-7489, 1998. PubMed ID: 9857202 4. Imataka, H.; Sonenberg, N.: Human eukaryotic translation initiation factor 4G (eIF4G) possesses two separate and independent binding sites for eIF4A. Molec. Cell. Biol. 17: 6940-6947, 1997.

Further studies establishing the function and utilities of EIF4G1 are found in John Hopkins OMIM database record ID 600495, and in references numbered 683-690 listed hereinbelow.

Referring now to EIF4G1 BINDING SITE. Eukaryotic translation initiation factor 4 gamma, 1 (EIF4G1) is a target gene of GAM26, corresponding to GAM26-TARGET GENE of FIG. 26A. EIF4G1 BINDING SITE is a binding site found in an untranslated region of EIF4G1, corresponding to BINDING SITE of FIG. 26A. FIG. 26D illustrates the complementarity of the nucleotide sequence of EIF4G1 BINDING SITE, designated SEQ ID:148812, to the nucleotide sequence of GAM26 RNA of FIG. 26, designated SEQ ID:20604.

An additional function of GAM26 is therefore inhibition of eukaryotic translation initiation factor 4 gamma, 1

(EIF4G1), a gene which encodes a protein that is a Translation initiation factor. Accordingly, utilities of GAM26 include diagnosis and treatment of the abovementioned diseases and clinical conditions. The function and utilities of EIF4G1 have been established by previous studies, as described hereinabove with reference to FIG. 26D.

Reference is now made to EIF4G2 BINDING SITE. Eukaryotic translation initiation factor 4 gamma, 2 (EIF4G2) is a target gene of GAM26, corresponding to GAM26-TARGET GENE of FIG. 26A. EIF4G2 BINDING SITE is a binding site found in an untranslated region of EIF4G2, corresponding to BINDING SITE of FIG. 26A. FIG. 26D illustrates the complementarity of the nucleotide sequence of EIF4G2 BINDING SITE, designated SEQ ID:148906, to the nucleotide sequence of GAM26 RNA of FIG. 26A, designated SEQ ID:20604.

A further function of GAM26 is therefore inhibition of eukaryotic translation initiation factor 4 gamma, 2 (EIF4G2), a gene which encodes a protein that is a repressor of translation. Accordingly, utilities of GAM26 include diagnosis and treatment of the abovementioned diseases and clinical conditions.

The function of EIF4G2 has been established by previous studies. Imataka et al. (1997) used immunoprecipitation studies with HA- or FLAG-tagged proteins to show that p97 specifically binds to EIF4A and EIF3, but not to EIF4E (133440) in vitro. Transient transfection experiments showed that p97 suppressed both cap-dependent and independent translation, and that overexpression of p97 reduced overall protein synthesis. Imataka et al. (1997) suggested that p97 is a general repressor of translation that acts by forming translationally inactive complexes. Levy-Strumpf et al. (1997) showed that while a fragment of DAP5 cDNA from the C-terminal region (encoding a 28-kD 'miniprotein') protected cells from IFNG-induced programmed cell death at low levels of expression, higher levels of express ion were toxic. They proposed that the miniprotein may be a dominant-negative inhibitor of the essential DAP5 protein, and that DAP5 may play a specific role in apoptosis.

Full details of the abovementioned studies are described in the following publications, the disclosure of which are hereby incorporated by reference:

Imataka, H.; Olsen, H. S.; Sonenberg, N.: A new translational regulator with homology to eukaryotic translation initiation factor 4G. EMBO J. 16: 817-825, 1997. PubMed ID: 9049310 2. Levy-Strumpf, N.; Deiss, L. P.; Berissi, H.; Kimchi, A.: DAP-5, a novel homolog of eukaryotic translation initiation factor 4G isolated as a putative modulator of gamma interferon-induced programmed cell death. Molec. Cell. Biol. 17: 1615-1625, 1997.

Further studies establishing the function and utilities of EIF4G2 are found in John Hopkins OMIM database record ID 602325, and in references numbered 691-692, 688 and 693-694 listed hereinbelow.

Reference is now made to EIF5A BINDING SITE. Eukaryotic translation initiation factor 5A (EIF5A) is a target gene of GAM26, corresponding to GAM26-TARGET GENE of FIG. 26A. EIF5A BINDING SITE is a binding site found in an untranslated region of EIF5A, corresponding to BINDING SITE of FIG. 26A. FIG. 26D illustrates the complementarity of the nucleotide sequence of EIF5A BINDING SITE, designated SEQ ID:148944, to the nucleotide sequence of GAM26 RNA of FIG. 26A, designated SEQ ID:20604.

Yet a further function of GAM26 is therefore inhibition of eukaryotic translation initiation factor 5A (EIF5A), a gene which encodes a protein that is an initiation factor. Accordingly, utilities of GAM26 include diagnosis and treatment of the abovementioned diseases and clinical conditions.

The function of EIF5A has been established by previous studies. The eukaryotic initiation factor 5A is an 18-kD protein composed of 154 amino acids. It contains a unique amino acid residue, hypusine, which is formed posttranslationally via the transfer and hydroxylation of the butylamino-group from the polyamine spermidine to a lys50 within the EIF5A protein. Koettnitz et al. (1994) isolated and characterized the human EIF5A pseudogene. Subsequently, Koettnitz et al. (1995) identified a genomic clone with an EIF5A containing 3 introns and spanning about 4.8 kb. The authors showed that this sequence would successfully complement yeast carrying the HYP2 mutation (the homolog of EIF5A), whereas the pseudogenes could not. Steinkasserer et al. (1995) mapped the EIF5A gene to 17p13-p12 by fluorescence in situ hybridization. Three pseudogenes were mapped to 10q23.3, 17q25, and 19q13.2.

Full details of the abovementioned studies are described in the following publications, the disclosure of which are hereby incorporated by reference:

Koettnitz, K.; Wohl, T.; Kappel, B.; Lottspeich, F.; Hauber, J.; Bevec, D.: Identification of a new member of the human eIF-5A gene family. Gene 159: 283-284, 1995. PubMed ID: 7622067 3. Steinkasserer, A.; Jones, T.; Sheer, D.; Koettnitz, K.; Hauber, J.; Bevec, D.: The eukaryotic cofactor for the human immunodeficiency virus type 1 (HIV-1) rev protein, eIF-5A, maps to chromosome 17p12-p13: three eIF-5A pseudogenes map to 10q23.3, 17q25, and 19q13.2. Genomics 25: 749-752, 1995.

Further studies establishing the function and utilities of EIF5A are found in John Hopkins OMIM database record ID 600187, and in references numbered 695-697 listed hereinbelow.

Referring now to EIF5A BINDING SITE. Eukaryotic translation initiation factor 5A (EIF5A) is a target gene of GAM26, corresponding to GAM26-TARGET GENE of FIG. 26A. EIF5A BINDING SITE is a binding site found in an untranslated region of EIF5A, corresponding to BINDING SITE a FIG. 26A. FIG. 26D illustrates the complementarity of the nucleotide sequence of EIF5A BINDING SITE, designated SEQ ID:148945, to the nucleotide sequence of GAM26 RNA of FIG. 26A, designated SEQ ID:20604.

Another function of GAM26 is therefore inhibition of eukaryotic translation initiation facto 5A (EIF5A), a gene which encodes a protein that is an initiation factor. Accordingly, utilities of GAM26 include diagnosis and treatment of the abovementioned diseases and clinical conditions. The function and utilities of EIF5A have been established by previous studies, as described hereinabove with reference to FIG. 26D.

Referring now to EIF5A BINDING SITE. Eukaryotic translation initiation factor 5A (EIF5A) is a target gene of GAM26, corresponding to GAM26-TARGET GENE of FIG. 26A. EIF5A BINDING SITE is a binding site found in an untranslated region of EIF5A, corresponding to BINDING SITE of FIG. 26A. FIG. 26D illustrates the complementarity of the nucleotide sequence of EIF5A BINDING SITE, designated SEQ ID:148952, to the nucleotide sequence of GAM26 RNA of FIG. 26A, designated SEQ ID:20604.

Yet another function of GAM26 is therefore inhibition of eukaryotic translation initiation factor 5A (EIF5A), a gene which encodes a protein that is an initiation factor. Accordingly, utilities of GAM26 include diagnosis and treatment of the abovementioned diseases and clinical conditions. The function and utilities of EIF5A have been established by previous studies, as described hereinabove with reference to FIG. 26D.

Reference is now made to EP300 BINDING SITE. E1A binding protein p300 (EP300) is a target gene of GAM26, corresponding to GAM26-TARGET GENE of FIG. 26A. EP300 BINDING SITE is a binding site found in an untranslated region of EP300, corresponding to BINDING SITE of FIG. 26A. FIG. 26D illustrates the complementarity of the nucleotide sequence of EP300 BINDING SITE, designated SEQ ID:151947, to the nucleotide sequence of GAM26 RNA of FIG. 26A, designated SEQ ID:20604.

An additional function of GAM26 is therefore inhibition of E1A binding protein p300 (EP300), a gene which encodes a protein that may have a function in cell cycle regulation, and is associated with COLORECTAL CANCER. Accordingly, utilities of GAM26 include diagnosis and treatment of the abovementioned diseases and clinical conditions.

The function of EP300 has been established by previous studies. The growth-controlling functions of the adenovirus E1A oncoprotein depend on its ability to interact with a set of cellular proteins. Among these are the retinoblastoma protein, p107, p130, and p300. Eckner et al. (1994) isolated a cDNA encoding full-length human p300. p300 contains 3 cysteine- and histidine-rich regions of which the most carboxy-terminal region interacts specifically with E1A. In its center, p300 contains a bromodomain, a hallmark of certain transcriptional coactivators. p300 and CREB-binding protein (CREBBP, or CBP; 600140) are highly related in primary structure (Arany et al., 1994). Several protein motifs such as a bromodomain, a KIX domain, and 3 regions rich in cys/his residues are well conserved between these 2 proteins.

Animal model experiments lend further support to the function of EP300. The EP300 protein is a histone acetyltransferase that regulates transcription via chromatin remodeling and is important in the processes of cell proliferation and differentiation. A role for EP300 in cancer had been implied by the fact that it is targeted by viral oncoproteins (Arany et al., 1995), it is fused to MLL (159555) in leukemia (Ida et al., 1997), and 2 missense sequence alterations in EP300 were identified in epithelial malignancies (Muraoka et al., 1996). Gayther et al. (2000) described EP300 mutations that predicted a truncated protein in 6 (3%) of 193 epithelial cancer analyzed. Of these 6 mutations, 2 were in primary tumors (a colorectal cancer and a breast cancer) and 4 were in cancer cell lines (colorectal, breast, and pancreatic). In addition, they identified a somatic in-frame insertion in a primary breast cancer and missense alterations in a primary colorectal cancer and 2 cell lines (breast and pancreatic). Inactivation of the second allele was demonstrated in 5 of the 6 cases with truncating mutations and in 2 other cases. The data shored that EP300 is mutated in epithelial cancers and provided the first evidence that it behaves as a classic tumor suppressor gene.

It is appreciated that the abovementioned anima model for EP300 is acknowledged by those skilled in the art as a scientifically valid a mal model, as can be further appreciated from the publications sited hereinbelow.

Full detail the abovementioned studies are described in the following publications, the disclosure of which are hereby incorporated by reference:

Tini, M.; Benecke, A.; Um, S. -I.; Torchia, J.; Evans, R. M.; Chambon, P.: Association of CBP/p300 acetylase and thymine DNA glycosylase links DNA repair and transcription. Molec. Cell 9: 265-277, 2002. PubMed ID: 11864601 8. Lin, C. H.; Hare, B. J.; Wagner, G.; Harrison, S. C.; Maniatis, T.; Fraenkel, E.: A small domain of CBP/p300 binds diverse proteins: solution structure and functional studies. Molec. Cell 8: 581-590, 2001.

Further studies establishing the function and utilities of EP300 are found in John Hopkins OMIM database record ID 602700, and in referent numbered 698-710 listed hereinbelow.

Reference is now made to EZH2 BINDING SITE. Enhancer of zeste (*Drosophila*) homolog 2 (EZH2) is a target gene of GAM26, corresponding to GAM26-TARGET GENE of FIG. 26A. EZH2 BINDING SITE is a binding site found in an untranslated region of EZH2, corresponding to BINDING SITE of FIG. 26A. FIG. 26D illustrates the complementarity of the nucleotide sequence of EZH2 BINDING SITE, designated SEQ ID:156540, to the nucleotide sequence of GAM26 RNA of FIG. 26A, designated SEQ ID:20604.

A further function of GAM26 is therefore inhibition of enhancer of zeste (*Drosophila*) homolog 2 (EZH2), a gene which encodes a protein that may be involved in the regulation of gene transcription and chromatin structure and is associated with this protein may pray a role in the hematopoietic and central nervous systems. Accordingly, utilities of GAM26 include diagnosis and treatment of the abovementioned diseases and clinical conditions.

The function of EZH2 has been established by previous studies. To identify genes that map on human chromosome 21 that may contribute to the phenotype of Down syndrome, Chen et al. (1996) applied exon trapping to cosmid DNA from a chromosome 21-specific library. One of the potential exons that was cloned and partially characterized showed strong homology to the *Drosophila* 'enhancer of zeste' protein from amino acid 665 to amino acid 694. The *Drosophila* protein is a member of the Polycomb group, which maintains homeotic gene repression and is thought to control gene expression by regulating chromatin. Chen et al. (1996) cloned the full-length cDNA for this human homolog, termed EZH2. Chen et al. (1996) mapped the human EZH2 cDNA within YACs between marker D21S65 and ERG (165080) on 21q22.2. However, Cardoso et al. (2000) later showed by FISH that the functional EZH2 gene map to 7q35, not 21q22, and that the sequence isolated from the chromosome 21 cosmid corresponds to a pseudogene. By FISH, Laible et al. (1999) mapped the mouse Ezh2 gene to chromosome 6. Varambally et al. (2002) demonstrated through gene expression profiling that EZH2 is overexpressed in hormone-refractory, metastatic prostate cancer. Small interfering RNA (siRNA) duplexes targeted against EZH2 reduced the amounts of EZH2 protein present in prostate cells and also inhibited cell proliferation in vitro. Ectopic expression of EZH2 in prostate cells induced transcriptional repression of a specific cohort of genes. Gene silencing mediated by EZH2 requires the SET domain and is attenuated by inhibiting histone deacetylase activity. Amounts of both EZH2 mRNA an EZH2 protein were increased in metastatic prostate cancer. In addition, clinically localized prostate cancers that expressed higher concentrations of EZH2 showed a poorer prognosis. Thus, Varambally et al. (2002, concluded that dysregulated expression of EZH2 may be involved in the progression of prostate cancer as well as being a marker that distinguishes indolent prostate cancer from those at risk of lethal progression.

Full details of the abovementioned studies are described in the following publications, the disclosure of which are hereby incorporated by reference:

Chen, H.; Rossier, C.; Antonarakis, S. E.: Cloning of a human homolog of the *Drosophila* enhancer of zeste gene (EZH2) that maps to chromosome 21q22.2. Genomics 38: 30-37, 1996. PubMed ID: 8954776 6. Varambally, S.; Dhanasekaran, S. M.; Zhou, M.; Barrette, T. R.; Kumar-Sinha, C.; Sanda, M. G.; Ghosh, D.; Pienta, K. J.; Sewalt, R. G. A. B.; Otte, A. P.; Rubin, M. A.; Chinnaiyan, A. M.: The polycomb group protein EZH2 is involved in progression of prostate cancer. Nature 419: 624-629, 2002.

Further studies establishing the function and utilities of EZH2 are found in John Hopkins OMIM database record ID 601573, and in references numbered 711-712, 712-713, 713-714, 714-715, 715-716 and 716 listed hereinbelow.

Referring now to EZH2 BINDING SITE. Enhancer of zeste (*Drosophila*) homolog 2 (EZH2) is a target gene of GAM26, corresponding to GAM26-TARGET GENE of FIG. 26A. EZH2 BINDING SITE is a binding site found in an untranslated region of EZH2, corresponding to BINDING SITE of FIG. 26A. FIG. 26D illustrates the complementarity of the nucleotide sequence of EZH2 BINDING SITE, designated SEQ ID:156546, to the nucleotide sequence of GAM26 RNA of FIG. 26A, designated SEQ ID:20604.

Yet a further function of GAM26 is therefore inhibition of enhancer of zeste (*Drosophila*) homolog 2 (EZH2), a gene which encodes a protein that may be involved in the regulation of gene transcription and chromatin structure, and is associated with This protein may play a role in the hematopoietic and central nervous systems. Accordingly, utilities of GAM26 include diagnosis and treatment of the abovementioned diseases and clinical conditions. The function and utilities of EZH2 have been established by previous studies, as described hereinabove with reference to FIG. 26D.

Referring now to EZH2 BINDING SITE. Enhancer of zeste (*Drosophila*) homolog 2 (EZH2) is a target gene of GAM26, corresponding to GAM26-TARGET GENE of FIG. 26A. EZH2 BINDING SITE is a binding site found in an untranslated region of EZH2, corresponding to BINDING SITE of FIG. 26A. FIG. 26D illustrates the complementarity of the nucleotide sequence of EZH2 BINDING SITE, designated SEQ ID:156547, to the nucleotide sequence of GAM26 RNA of FIG. 26A, designated SEQ ID:20604.

Another function of GAM26 is therefore inhibition of enhancer of zeste (*Drosophila*) homolog 2 (EZH2), a gene which encodes a protein that may be involved in the regulation of gene transcription and chromatin structure and is associated with This protein may play a role in the hematopoietic and central nervous systems. Accordingly, utilities of GAM26 include diagnosis and treatment of the abovementioned diseases and clinical conditions. The function and utilities of EZH2 have been established by previous studies, as described hereinabove with reference to FIG. 26D.

Referring now to FGF18 BINDING SITE. Fibroblast growth factor 18 (FGF18) is a target gene of GAM26, corresponding to GAM26-TARGET GENE of FIG. 26A. FGF18 BINDING SITE is a binding site found in an untranslated region of FGF18, corresponding to BINDING SITE of FIG. 26A. FIG. 26D illustrates the complementarity of the nucleotide sequence of FGF18 BINDING SITE, designated SEQ ID:163374, to the nucleotide sequence of GAM26 RNA of FIG. 26A, designated SEQ ID:20604.

Yet another function of GAM26 is therefore inhibition of fibroblast growth factor 18 (FGF18), a gene which encodes a protein that stimulates hepatic and intestinal proliferation. Accordingly, utilities of GAM26 include diagnosis and treatment of the abovementioned diseases and clinical conditions. The function and utilities of FGF18 have been established by previous studies, as described hereinabove with reference to FIG. 26D.

Reference is now made to SERPINB8 BINDING SITE. Serine (or cysteine) proteinase inhibitor, clade B (ovalbumin), member (SERPINB8) is a target gene of GAM26, corresponding to GAM26-TARGET GENE of FIG. 26A. SERPINB8 BINDING SITE is a binding site found in an untranslated region of SERPINB8, corresponding to BINDING SITE of FIG. 26A. FIG. 26D illustrates the complementarity of the nucleotide sequence of SERPINB8 BINDING SITE, designated SEQ ID:163374, to the nucleotide sequence of GAM26 RNA of FIG. 26A, designated SEQ ID:20604.

An additional function of GAM26 is therefore inhibition of serine (or cysteine) proteinase inhibitor, clade B (ovalbumin), member (SERPINB18), a gene which encodes a protein that protease inhibitors; may be a serpin serine protease inhibitor that binds thrombin. Accordingly, utilities of GAM26 include diagnosis and treatment of the abovementioned diseases and clinical conditions.

The function of SERPINB8 has been established by previous studies. High molecular weight serine proteinase inhibitors (serpins) are a large superfamily of proteins which bind to and inactivate serine proteinases. These interactions are involved in many cellular processes including coagulation, fibrinolysis, complement fixation, matrix remodeling, and apoptosis. Sprecher et al. (1995) cloned 2 novel serpins, termed PI8 and PI9 (601799), from a human placenta cDNA library. Sequence analysis showed that PI8 encodes a 376-amino acid polypeptide with over 60% identity to PI6 (173321). Using Northern blotting, they observed that PI8 was expressed as 2 transcripts of 1.4 and 3.8 kb. The 1.4-kb transcript was most abundant in liver and lung while the 3.8-kb transcript was most abundant in skeletal muscle and heart. They showed that PI8 was localized to the cytoplasm of transfected cells and that it was able to form an SDS-insoluble complex with human thrombin (176930)). Serpins are characterized by a well-conserved tertiary structure that consists of 3 beta sheets and 8 or 9 alpha helices (Huber and Carrell, 1989). A critical portion of the molecule, the reactive center loop, connects beta sheets A and C and, in most cases, serves as bait for a target serine proteinase. Bartuski et al. (1997) stated that more than 100 members of the serpin superfamily are known, including C1 esterase inhibitor (C1NH; 606860), antithrombin III (AT3; 107300), protease inhibitor 7 (PI7; 177010), and maspin (PI5; 154790), which are involved in complement activation, coagulation, cell differentiation, and tumor suppression, respectively, as well as many others. The ovalbumin-type serpins (ov-serpins) are a subset of the serpin superfamily and are characterized by their high degree of homology to chicken ovalbumin, the lack of N- and C-terminal extensions, the absence of a signal peptide, and a serine rather than an asparagine residue at the penultimate position. Four members of the ov-serpin family had been mapped to a 300-kb region within 18q21.3: PI5, SCCA1 (600517), SCCA2 (600518), and PAI2 (173390). Using a panel of 18q21.3 AC clones, PCR, and DNA blotting, Bartuski et al. (1997) mapped 2 additional ov-serpins, cytoplasmic antiproteinase 2 (CAP2 or PI8) and bone marrow-associated serpin bomapin (PI10; 602058), to the same region. Three of the serpins (PI8, PI10, and PAI2) mapped to the same YACs. Bartuski et al. (1997) estimated that the size of the 18q21.3 serpin cluster spans approximately 500 kb and contains at least 6 serpin genes. The gene order is cen--PI5--SCCA2--SCCA1--PAI2--PI10--PI8--tel. The characterization the serpin gene cluster at 18q21 provided new opportunities to study coordinate gene regulation and the evolution of gene families.

Full details of the abovementioned studies are described in the following publications, the disclosure of which are hereby incorporated by reference:

Bartuski, A. J.; Kamachi, Y.; Schick, C.; Overhauser, J.; Silverman, G. A.: Cytoplasmic antiproteinase 2 (PI8) and bomapin (PI10) map to the serpin cluster at 18q21.3. Genomics 43: 321-328, 1997. PubMed ID: 9268635 3. Sprecher, C. A.; Morgenstern, K. A.; Mathewes, S.; Dahlen, J. R.; Schrader, S. K.; Foster, D. C.; Kisiel, W.: Molecular cloning, expression, and partial characterization of two members of the ovalbumin family of serine proteinase inhibitors. J. Biol. Chem. 270: 29854-29861, 1995.

Further studies establishing the function and utilities of SERPINB8 are found in John Hopkins OMIM database record ID 601697, and in references numbered 717-718, 718-719 and 715 listed hereinbelow.

Referring now to FGF18 BINDING SITE. Fibroblast growth factor 18 (FGF18) is a target gene of GAM26, corresponding GAM26-TARGET GENE of FIG. 26A. FGF18 BINDING SITE is a binding site found in an untranslated region of FGF18, corresponding to BINDING SITE of FIG. 26A. FIG. 26D illustrates the complementarity of the nucleotide sequence of FGF18 BINDING SITE, designated SEQ ID:163376, to the nucleotide sequence of GAM26 RNA of FIG. 26A, designated SEQ ID:20604.

A further function of GAM26 is therefore inhibition of fibroblast growth factor 18 (FGF18), a gene which encodes a protein that stimulates hepatic and intestinal proliferation. Accordingly, utilities of GAM26 include diagnosis and treatment of the abovementioned diseases and clinical conditions. The function and utilities of FGF18 have been established by previous studies, as described hereinabove with reference to FIG. 26D.

Referring now to FGF18 BINDING SITE. Fibroblast growth factor 18 (FGF18) is a target gene of GAM26, corresponding to GAM26-TARGET GENE of FIG. 26A. FGF18 BINDING SITE is a binding site found in an untranslated region of FGF18, corresponding to BINDING SITE of FIG. 26A. FIG. 26D illustrates the complementarity of the nucleotide sequence of FGF18 BINDING SITE, designated SEQ ID:163380, to the nucleotide sequence of GAM26 RNA of FIG. 26A, designated SEQ ID:20604.

Yet a further function of GAM26 is therefore inhibition of fibroblast growth factor 18 (FGF18), a gene which encodes a protein that stimulates hepatic and intestinal proliferation. Accordingly, utilities of GAM26 include diagnosis and treatment of the abovementioned diseases and clinical conditions. The function and utilities of FGF18 have been established by previous studies, as described hereinabove with reference to FIG. 26D.

Reference is now made to FKRP BINDING SITE. FUKUTIN-RELATED PROTEIN (FKRP) is a target gene of GAM26, corresponding to GAM26-TARGET GENE of FIG. 26A. FKRP BINDING SITE is a binding site found in an untranslated region of FKRP, corresponding to BINDING SITE of FIG. 26A. FIG. 26D illustrates the complementarity of the nucleotide sequence of FKRP BINDING SITE, designated SEQ ID:166297, to the nucleotide sequence of GAM26 RNA of FIG. 26A, designated SEQ ID:20604.

Another function of GAM26 is therefore inhibition of FUKUTIN-RELATED PROTEIN (FKRP), a gene which encodes a protein that is associated with congenital muscular dystrophies MDC1C. Accordingly, utilities of GAM26 include diagnosis and treatment of the abovementioned diseases and clinic conditions.

The function of FKRP has been established by previous studies. Brockington et al. (2001) identified the fukutin-related protein gene (FKRP) by database screening using the mouse fukutin sequence. The human version of the sequence was determined by a combination of EST assembly, RT-PCR, and RACE. The cDNA had a 1,488-bp open reading frame that encoded a 495-amino acid protein. Sequence analysis predicted a molecular organization similar to that found in several Golgi-resident glycosyltransferases. Northern blot analysis detected a 4.0 kb FKRP transcript expressed predominantly in skeletal muscle, placenta, and heart and relatively weakly in other tissues. Brockington et al (2001) determined that the 12-kb FKRP gene is composed of 3 noncoding exons and a single large exon of 3.8 kb that contained part of the 5-prime untranslated region and the entire open reading frame and 3-prime untranslated region. By radiation hybrid mapping, Brockington et al. (2001) localized the FKRP gene to chromosome 19q13.3. Driss et al. (2000) demonstrated that autosomal recessive limb-girdle muscular dystrophy type 2I (LGMD2I; 607155), a mild later-onset muscular dystrophy, maps to chromosome 19q13.3. The congenital muscular dystrophies (CMD) are a heterogeneous group of autosomal recessive disorders presenting in infancy with muscle weakness, contractures, and dystrophic changes on skeletal muscle biopsy. Structural brain defects, with or without mental retardation, are additional features of several CMD syndromes. Approximately 40% of patients with CMD have a primary deficiency (MDC1A) of the laminin alpha-2 chain of merosin (laminin-2) due to mutations in the LAMA2 gene (156225), which maps to 6q. In addition, a secondary deficiency of laminin alpha-2 is apparent in some CMD syndromes, including MDC1B (604801), which is mapped to chromosome 1q42, and both muscle-eye-brain disease (MEB; 253280), which maps to 1p, and Fukuyama CMD (FCMD; 253800) on 9q31, both of which are forms with severe brain involvement. The FCMD gene encodes a protein, fukutin, predicted through sequence analysis to be a phosphoryl-ligand transferase. Brockington et al. (2001) identified a member of the fukutin-related-protein family, which was found to be mutated in a severe form of CMD that they called MDC1C (606612). Patients harboring mutations in this gene had a secondary deficiency of laminin alpha-2 and a profound reduction in alpha-dystroglycan immunostaining. In addition, the molecular weight of alpha-dystroglycan was reduced in muscle. Together, these findings suggested that this protein is abnormally glycosylated in MDC1C and is central to the pathogenesis of the disorder. Brockington et al. (2001) identified mutations in the FKRP gene in 7 families with CMD characterized by disease onset in the first weeks of life and a severe phenotype with inability to walk, muscle hypertrophy, marked elevation of serum creatine kinase, and normal brain structure and function. Nine of the mutations were missense mutation and 2 were nonsense mutations. In 4 families, the affected individuals were compound heterozygotes; in the other 3 the patients were homozygous for the particular mutation. The 11 mutations were all different Brockington et al. (2001) found FKRP mutations in 17 of 25 LGMD2I families, including some with a severe and early-onset phenotype. Affected individuals from 15 of 17 families had an identical C826A (leu276-to-ile; 606596.0004) mutation, and individual in 5 families were homozygous for this recurrent mutation. Linkage analysis identified at least 2 possible haplotypes in linkage disequilibrium with this mutation. Patients with the C826A change had the clinically less severe LGMD2I phenotype, suggesting that this is a less disruptive FKRP mutation than those found in MDC1C. A variable reduction of alpha-dystroglycan (DAG1; 128239) expression was observed in the skeletal muscle biopsy of all individuals studied. In addition, several cases showed a deficiency of laminin 2 (LAMA2; 156225) either by immunocytochemistry or western blotting.

Full details of the abovementioned studies are described in the following publications, the disclosure of which are hereby incorporated by reference:

Brockington, M.; Blake, D. J.; Prandini, P.; Brown, S. C.; Torelli, S.; Benson, M. A.; Ponting, C. P.; Estournet, B.; Romero, N. B.; Mercuri, E.; Voit, T.; Sewry, C. A.; Guicheney, P.; Muntoni, F.: Mutations in the fukutin-related protein gene (FKRP) cause a form of congenital muscular dystrophy with secondary laminin alpha-2 deficiency and abnormal glycosylation of alpha-dystroglycan. Am. J. Hum. Genet. 69: 1198-1209, 2001. PubMed ID: 11592034 4. Mercuri, E.; Sewry, C. A.; Brown, S. C.; Brockington, M.; Jungbluth, H. DeVile, C.; Counsell, S.; Manzur, A.; Muntoni, F.: Congenital muscular dystrophy with secondary merosin deficiency and normal brain MRI: a novel entity? Neuropediatrics 31: 186-189, 2000.

Further studies establishing the function and utilities of FKRP are found in John Hopkins OMIM data base record ID 606596, and in references numbered 720-723 listed hereinbelow.

Reference is now made to FLT1 BINDING SITE. Fms-related tyrosine kinase 1 (vascular endothelial growth factor/vasc (FLT1) is a target gene of GAM26, corresponding to GAM26-TARGET GENE of FIG. 26A. FLT1 BINDING SITE is a binding site found in an untranslated region of FLT1, corresponding to BINDING SITE of FIG. 26A. FIG. 26D illustrates the complementarity of the nucleotide sequence of FLT1 BINDING SITE, designated SEQ ID:167123, to the nucleotide sequence of GAM26 RNA of FIG. 26A, designated SEQ ID:20604.

Yet another function of GAM26 is therefore inhibition of fms-related tyrosine kinase 1 (vascular endothelial growth factor/vasc (FLT1), a gene which encodes a receptor that receptor for vegf, vegfb and pgf has a tyrosine-protein kinase activity. Accordingly, utilities of GAM26 include diagnosis and treatment of the abovementioned diseases and clinical conditions.

The function of FLT1 has been established by previous studies. Oncogene FLT belongs to the src gene family and is related to oncogene ROS (165020). Like other members of this family, it shows tyrosine protein kinase activity that is important for the control of cell proliferation and differentiation. The sequence structure of the FLT gene resembles that of the FMS gene (164770); hence, Yoshida et al. (1987) proposed the name FLT as an acronym for FMS-like tyrosine kinase. Satoh et al. (1987) and Yoshida et al. (1987) mapped FLT to 13q12 by probing of DNA from a panel of human-mouse somatic cell hybrids and by in situ hybridization. By the isolation and analysis of a YAC containing the FLT1 and (136351) genes, Imbert et al. (1994) confirmed their close physical linkage. FLT1 and FLT3 are linked in a head-to-tail configuration and are separated by about 150 kb. Imbert et al. (1994) found that the region contains 3 CpG islands, 2 of which were thought to correspond to FLT1 and FLT3 and the third to a putative, unidentified receptor-type tyrosine kinase (RTK) gene. They referred to studies performed by fluorescence in situ hybridization using the YAC as a probe. Wiesmann et al. (1997) reported the crystal structure to 1.7-angstrom resolution of the complex between the receptor-binding domain of VEGF and FLT1 domain 2. The crystal structure of the complex between VEGF and the second domain of FLT1 shows domain 2 in a predominantly hydrophobic interaction with the 'poles' of the VEGF dimer. Based on this structure and on mutational data, Wiesmann et al. (1997) presented a model of VEGF bound to the first 4 domains of FLT1.

Animal model experiments lend further support to the function of FLT1. VEGF and its high-affinity binding receptors, the tyrosine kinases FLK1 and FLT1, are thought to be important for the development of embryonic vasculature. Studying transgenic mice in whom the Flk1 gene was disrupted, Shalaby et al (1995) demonstrated a total failure of embryonic mice to develop blood vessels and failure of blood island formation in the yolk sac. Fong et al. (1995) reported that in mice Flt1 is essential for the organization of embryonic vasculature, but is not essential for endothelial cell differentiation. Transgenic mouse embryos homozygous for a targeted mutation in the Flt1 locus formed endothelial cells in both embryonic and extraembryonic regions, but assembled these cells into abnormal vascular channels and died in utero at mid-somite stages. At earlier stages, the blood islands of homozygous mice were abnormal with angioblasts in the interior as well as on the periphery. Fong et al. (1995) suggested that the Flt1 signaling pathway may regulate normal endothelial cell-cell or cell-matrix interactions during vascular development.

It is appreciated that the abovementioned animal model for FLT1 is acknowledged by those skilled in the art as a scientifically valid animal model as can be further appreciated from the publications sited hereinbelow.

Full details of the abovementioned studies are described in the following publications, the disclosure of which are hereby incorporated by reference:

Yoshida, M. C.; Satoh, H.; Matsushime, H.; Shibuya, M.; Sasaki, M.: Two ros-related protooncogenes, c-ros-1 and flt, are regionally mapped on human chromosomes 6q22 and 13q12, respectively. (Abstract) Cytogen. Cell Genet. 46: 724 only, 1987. 3. Imbert, A.; Rosnet, O.; Marchetto, S.; Ollendorff, V.; Birnbaum, D.; Pebusque, M.-J.: Characterization of a yeast artificial chromosome from human chromosome band 13q12 containing the FLT1 and FLT3 receptor-type tyrosine kinase genes. Cytogenet. Cell Genet. 67: 175-177, 1994.

Further studies establishing the function and utilities of FLT1 are found in John Hopkins OMIM database record ID 165070, and in references numbered 724-732 listed hereinbelow.

Referring now to FLT1 BINDING SITE. Fms-related tyrosine kinase 1 (vascular endothelial growth factor/vasc (FLT1) is a target gene of GAM26, corresponding to GAM26-TARGET GENE of FIG. 26A. FLT1 BINDING SITE is a binding site found in an untranslated region of FLT1, correspond to BINDING SITE of FIG. 26A. FIG. 26D illustrates the complementarity of the nucleo de sequence of FLT1 BINDING SITE, designated SEQ ID:167194, to the nucleotide sequence of GAM26 RNA of FIG. 26A, designated SEQ ID:20604.

An additional function of GAM26 is therefore inhibition of fms-related tyrosine kinase 1 (vascular endothelial growth factor/vasc (FLT1), a gene which encodes a receptor that receptor for vegf, vegfb and pgf. has a tyrosine-protein kinase activity. Accordingly, utilities of GAM26 include diagnosis and treatment of the abovementioned diseases and clinical conditions. The function and utilities of FLT1 have been established by previous studies, as described hereinabove with reference to FIG. 26D.

Referring now to FMR1 BINDING SITE. Fragile X mental retardation 1 (FMR1) is a target gene of GAM26, corresponding to GAM26-TARGET GENE of FIG. 26A. FMR1 BINDING SITE is a binding site found in an untranslated region of FMR1, corresponding to BINDING SITE of FIG. 26A. FIG. 26D illustrates the complementarity of the nucleotide sequence of FMR1 BINDING SITE, designated SEQ ID:167700, to the nucleotide sequence of GAM26 RNA of FIG. 26A, designated SEQ ID:20604.

A further function of GAM26 is therefore inhibition of fragile X mental retardation 1 (FMR1), a gene which encodes a protein that is associated with fragile x syndrome. Accordingly, utilities of GAM26 include diagnosis and treatment of the abovementioned diseases and clinical conditions. The function and utilities of FMR1 have been established by previous studies, as described hereinabove with reference to FIG. 26D.

Referring now to FMR1 BINDING SITE. Fragile X mental retardation 1 (FMR1) is a target gene of GAM26, corresponding to GAM26-TARGET GENE of FIG. 26A. FMR1 BINDING SITE is a binding site found in an untranslated region of FMR1, corresponding to BINDING SITE of FIG. 26A. FIG. 26D illustrates the complementarity of the nucleotide sequence of FMR1 BINDING SITE, designated SEQ ID:167700, to the nucleotide sequence of GAM26 RNA of FIG. 26A, designated SEQ ID:20604.

Yet a further function of GAM26 is therefore inhibition of fragile X mental retardation 1 (FMR1), a gene which encodes a protein that is associated with fragile x syndrome. Accordingly, utilities of GAM26 include diagnosis and treatment of the abovementioned diseases and clinical conditions. The function and utilities of FMR1 have been established by previous studies, as described hereinabove with reference to FIG. 26D.

Reference is now made to SMURF1 BINDING SITE. SMAD UBIQUITINATION REGULATORY FACTOR 1 (SMURF1) is a target gene of GAM26, corresponding to GAM26-TARGET GENE of FIG. 26A. SMURF1 BINDING SITE is a binding site found in an untranslated region of SMURF1, corresponding to BINDING SITE of FIG. 26A. FIG. 26D illustrates the complementarity of the nucleotide sequence of SMURF1 BINDING SITE, designated SEQ ID:167709, to the nucleotide sequence of GAM26 RNA of FIG. 26A, designated SEQ ID:20604.

Another function of GAM26 is therefore inhibition of SMAD UBIQUITINATION REGULATORY FACTOR 1 (SMURF1), a gene which encodes enzyme that triggers ubiquitination and degradation of smads specific for the BMP pathway. Accordingly, utilities of GAM26 include diagnosis and treatment of the abovementioned diseases and clinical conditions.

The function of SMURF1 has been established by previous studies. Using a yeast 2-hybrid screen with frog Smad1 as bait, Zhu et al. (1999) identified cDNAs encoding frog and human SMURF1 (SMAD ubiquitination regulatory factor-1). Sequence analysis predicted that frog and human SMURF1 contain 731 amino acids, share 91% identity, are most closely related to yeast Pub1, and have significant homology to the Hect subclass of E3 ubiquitin ligases. Expression of SMURF1 caused a dose-dependent decrease in expression of SMAD1 and SMAD5, which function in BMP signaling, but not in expression of SMAD2 or SMAD3, which function in TGFB signaling. Pulse-chase analysis demonstrated that degradation of SMAD proteins occurs by ubiquitination of the SMAD Hect domain and transport to the proteasome. Mutational analysis indicated that the WW motif of SMURF1 associates with SMAD1 and SMAD5 through their PY motifs. In frog eggs, Smurf1 mRNA was localized to the animal pole; ectopic Smurf1 in frog embryos inhibited the transmission of BMP signals, affecting pattern formation.

Full detail of the abovementioned studies are described in the following publications, the disclosure of which are hereby incorporated by reference:

Zhu H.; Kavsak, P.; Abdollah, S.; Wrana, J. L.; Thomsen, G. H.: A SMAD ubiquitin ligase targets the BMP pathway and affect embryonic pattern formation. Nature 400: 687-693, 1999.

Further studies establishing the function and utilities SMURF1 are found in John Hopkins OMIM database record ID 605568, and in references numbered 733-734 listed hereinbelow.

Referring now to FMR1 BINDING SITE. Fragile X mental retardation 1 (FMR1) is target gene of GAM26, corresponding to GAM26-TARGET GENE of FIG. 26A. FMR1 BINDING SITE is a binding site found in an untranslated region of FMR1, corresponding to BINDING SITE of FIG. 26A. FIG. 26D illustrates the complementarity of the nucleotide sequence of FMR1 BINDING SITE, designated SEQ ID:167713, to the nucleotide sequence of GAM26 RNA of FIG. 26A, designated SEQ ID:20604.

Yet another function of GAM26 is therefore inhibition of fragile X mental retardation 1 (FMR1), a gene which encodes a protein that is associated with fragile x syndrome. Accordingly, utilities of GAM26 include diagnosis and treatment of the abovementioned diseases and clinical conditions. The function and utilities of FMR1 have been established by previous studies, as described hereinabove with reference to FIG. 26D.

Referring now to FMR1 BINDING SITE. Fragile X mental retardation 1 (FMR1) is a target gene of GAM26, correspond to GAM26-TARGET GENE of FIG. 26A. FMR1 BINDING SITE is a binding site found in an untranslated region of FMR1, corresponding to BINDING SITE of FIG. 26A. FIG. 26D illustrates the complementarity of the nucleotide sequence of FMR1 BINDING SITE, designated SEQ ID:167713, to the nucleotide sequence of GAM26 RNA of FIG. 26A, designated SEQ ID:20604.

An additional function of GAM26 is therefore inhibition of fragile X mental retardation 1 (FMR1), a gene which encodes a protein that is associated with fragile x syndrome. Accordingly, utilities of GAM26 include diagnosis and treatment of the abovementioned diseases and clinical conditions. The function and utilities of FMR1 have been established by previous studies, as described hereinabove with reference to FIG. 26D.

Referring now to FMR1 BINDING SITE. Fragile X mental retardation 1 (FMR1) is a target gene of GAM26, corresponding to GAM26-TARGET GENE of FIG. 26A. FMR1 BINDING SITE is a binding site found in an untranslated region of FMR1, corresponding to BINDING SITE of FIG. 26A. FIG. 26D illustrates the complementarity of the nucleotide sequence of FMR1 BINDING SITE, designated SEQ ID:167717, to the nucleotide sequence of GAM26 RNA of FIG. 26A, designated SEQ ID:20604.

A further function of GAM26 is therefore inhibition of fragile X mental retardation 1 (FMR1), a gene which encodes a protein that is associated with fragile x syndrome. Accordingly, utilities of GAM26 include diagnosis and treatment of the abovementioned diseases and clinical conditions. The function and utilities of FMR1 have been established by previous studies, as described hereinabove with reference to FIG. 26D.

Referring now to FMR1 BINDING SITE. Fragile X mental retardation 1 (FMR1) is a target gene of GAM26, corresponding to GAM26-TARGET GENE of FIG. 26A. FMR1 BINDING SITE is a binding site found in an untranslated region of FMR1, corresponding to BINDING SITE of FIG. 26A. FIG. 26D illustrates the complementarity of the nucleotide sequence of FMR1 BINDING SITE, designated SEQ ID:167717, to the nucleotide sequence of GAM26 RNA of FIG. 26A, designated SEQ ID:20604.

Yet a further function of GAM26 is therefore inhibition of fragile X mental retardation 1 (FMR1), a gene which encodes a protein that is associated with fragile x syndrome. Accordingly, utilities of GAM26 include diagnosis and treatment of the abovementioned diseases and clinical conditions. The function and utilities of FMR1 have been established by previous studies, as described hereinabove with reference to FIG. 26D.

Referring now to FMR1 BINDING SITE. Fragile X mental retardation 1 (FMR1) is a target gene of GAM26, corresponding to GAM26-TARGET GENE of FIG. 26A. FMR1 BINDING SITE is a binding site found in an untranslated region of FMR1, corresponding to BINDING SITE of FIG. 26A. FIG. 26D illustrates the complementarity of the nucleotide sequence of FMR1 BINDING SITE, designated SEQ ID:167722, to the nucleotide sequence of GAM26 RNA of FIG. 26A, designated SEQ ID:20604.

Another function of GAM26 is therefore inhibition of fragile X mental retardation 1 (FMR1), a gene which encodes a protein that is associated with fragile x syndrome. Accordingly, utilities of GAM26 include diagnosis and treatment of the abovementioned diseases and clinical conditions. The function and utilities of FMR1 have been established by previous studies, as described hereinabove with reference to FIG. 26D.

Referring now to FMR1 BINDING SITE. Fragile X mental retardation 1 (FMR1) is a target gene of GAM26, corresponding to GAM26-TARGET GENE of FIG. 26A. FMR1 BINDING SITE is a binding site found in an untranslated region of FMR1, corresponding to BINDING SITE of FIG. 26A. FIG. 26D illustrates the complementarity of the nucleotide sequence of FMR1 BINDING SITE, designated SEQ ID:167722, to the nucleotide sequence of GAM26 RNA of FIG. 26A, designated SEQ ID:20604.

Yet another function of GAM26 is therefore inhibition of fragile X mental retardation 1 (FMR1), a gene which encodes a protein at is associated with fragile x syndrome. Accordingly, utilities of GAM26 include diagnosis and treatment of the abovementioned diseases and clinical conditions. The function and utilities of FMR1 have been established by previous studies, as described hereinabove with reference to FIG. 26D.

Reference is now made to GNB1 BINDING SITE. Guanine nucleotide binding protein (G protein), beta polypeptide 1 (GNB1) is a target gene of GAM26, corresponding to GAM26-TARGET GENE of FIG. 26A. GNB1 BINDING SITE is a binding site found in an untranslated region of GNB1, corresponding to BINDING SITE of FIG. 26A. FIG. 26D illustrates the complementarity of the nucleotide sequence of GNB1 BINDING SITE, designated SEQ ID:167722, to the nucleotide sequence of GAM26 RNA of FIG. 26A, designated SEQ ID:20604.

An additional function of GAM26 is therefore inhibition of guanine nucleotide binding protein (G protein), beta polypeptide 1 (GNB1), a gene which encodes a protein that transduces signals from G protein-coupled receptors to intracellular effectors. Accordingly, utilities of GAM26 include diagnosis and treatment of the abovementioned diseases and clinical conditions.

The function of GNB1 has been established by previous studies. Heterotrimeric guanine nucleotide-binding proteins (G proteins) transduce extracellular signals received by transmembrane receptors to effector proteins. Each subunit of the G protein complex is encoded by a member of 1 of 3 corresponding gene families. Hurowitz et al. (2000) counted 16 different members of the alpha-subunit family, 5 different members of the beta-subunit family, and 11 different members of the gamma-subunit family, as described in mammals. They identified and characterized BACs containing the human homologs of each of the alpha-, beta-, and gamma-subunit genes. The gene structure and chromosome location of each gene was determined, as were the orientations of paired genes. Using a cDNA probe against a mouse/human somatic cell hybrid panel, Sparkes et al. (1987) mapped the human beta-1 polypeptide of protein to human chromosome 1. Levine et al. (1990) confirmed the assignment to chromosome 1 by Southern analysis of somatic cell hybrids, and Levine et al. (1990) and Modi et al. (1991) regionalized the assignment to 1pter-p31.2 by in situ hybridization. Although Sparkes et al. (1987) had mapped the mouse Gnb1 gene to chromosome 19, later studies showed that Gnb1 is located on distal mouse chromosome 4 (Danciger et al., 199).

Full details of the abovementioned studies are descried in the following publications, the disclosure of which are hereby incorporated by reference:

Hurowitz, E. H.; Melnyk, J. M.; Chen, Y. -J.; Kouros-Mehr, H.; Simon, M. I.; Shizuya, H.: Genomic characterization of the human heterotrimeric G protein alpha, beta, and gamma subunit genes. DNA Res. 7: 111-120, 2000. 6.

Sparkes, R. S.; Cohn, V. H.; Mohandas, T.; Zollman, S.; Cire-Eversole, P.; Amatatruda, T. T.; Reed, R. R.; Lochrie, M. A.; Simon, M. I.: Mapping of genes encoding the subunits of guanine nucleotide-binding protein (G-proteins) in humans. (Abstract) Cytogenet. Cell Genet. 46: 696 only, 1987.

Further studies establishing the function and utilities of GNB1 are found in John Hopkins OMIM database record ID 139380, and in references numbered 735-740 listed hereinbelow.

Referring now to ZNF6 BINDING SITE. Zinc finger protein 6 (CMPX1) (ZNF6) is a target gene of GAM26, corresponding to GAM26-TARGET GENE of FIG. 26A. ZNF6 BINDING SITE is a binding site found in an untranslated region of ZNF6, corresponding to BINDING SITE of FIG. 26A. FIG. 26D illustrates the complementarity of the nucleotide sequence of ZNF6 BINDING SITE, designated SEQ ID:167722, to the nucleotide sequence of GAM26 RNA of FIG. 26A, designated SEQ ID:20604.

A further function of GAM26 is therefore inhibition of zinc finger protein 6 (CMPX1) (ZNF6), a gene which encodes a protein that is probably a transcriptional activator. Accordingly, utilities of GAM26 include diagnosis and treatment of the abovementioned diseases and clinical conditions. The function and utilities of ZNF6 have been established by previous studies, as described hereinabove with reference to FIG. 26D.

Referring now to FMR1 BINDING SITE. Fragile X mental retardation 1 (FMR1) is a target gene of GAM26, corresponding to GAM26-TARGET GENE of FIG. 26A. FMR1 BINDING SITE is a binding site found in an untranslated region of FMR1, corresponding to BINDING SITE of FIG. 26A. FIG. 26D illustrates the complementarity of the nucleotide sequence of FMR1 BINDING SITE, designated SEQ ID:167723, to the nucleotide sequence of GAM26 RNA of FIG. 26A, designated SEQ ID:20604.

Yet a further function of GAM26 is therefore inhibition of fragile X mental retardation 1 (FMR1), a gene which encodes a protein that is associated with fragile x syndrome. Accordingly, utilities of GAM26 include diagnosis and treatment of the abovementioned diseases and clinical conditions. The function and utilities of FMR1 have been established by previous studies, as described hereinabove with reference to FIG. 26D.

Referring now to FMR1 BINDING SITE. Fragile X mental retardation 1 (FMR1) is a target gene of GAM26, corresponding to GAM26-TARGET GENE of FIG. 26A. FMR1 BINDING SITE is a binding site found in an untranslated region of FMR1, corresponding to BINDING SITE of FIG. 26A. FIG. 26D illustrates the complementarity of the nucleotide sequence of FMR1 BINDING SITE, designated SEQ ID:167756, to the nucleotide sequence of GAM26 RNA of FIG. 26A, designated SEQ ID:20604.

Another function of GAM26 is therefore inhibition of fragile X mental retardation 1 (FMR1), a gene which encodes a protein that is associated with fragile x syndrome. Accordingly, utilities of GAM26 include diagnosis and treatment of the abovementioned diseases and clinical conditions. The function and utilities of FMR1 have been established by previous studies, as described hereinabove with reference to FIG. 26D.

Reference is now made to FOXD2 BINDING SITE. Forkhead box D2 (FOXD2) is a tare gene of GAM26, corresponding to GAM26-TARGET GENE of FIG. 26A. FOXD2 BINDING SITE is a binding site found in an untranslated region of FOXD2, corresponding to BINDING SITE of FIG. 26A. FIG. 26D illustrates the complementarity of the nucleotide sequence of FOXD2 BINDING SITE, designated SEQ ID:169035, to the sequence of GAM26 RNA of FIG. 26A, designated SEQ ID:20604.

Yet another function of GAM26 is therefore inhibition of forkhead box D2 (FOXD2), a gene which encodes a transcription factor that is a probable transcription factor. Accordingly, utilities of GAM26 include diagnosis and treatment of the abovementioned diseases and clinical conditions.

The function of FOXD2 has been established by previous studies. Ernstsson et al. (1997) described the cloning of a nearly full-length 4,258-bp cDNA encoding the human forkhead gene FREAC9 (FKHL17). The 5-prime untranslated region is unusual since it is very long (2,127 bp) and contains 15 upstream AUG codons. Hybridization to a panel consisting of RNA derived from 50 different tissues showed that the FKHL17 gene is transcribed exclusively in the kidney. By a combination of fluorescence in situ hybridization and somatic cell hybrid analyses, they localized the FKHL17 gene to 1p32. The conceptual translation produce predicts a protein of 372 amino acids within a N-terminal domain rich in acidic amino acids and with a high likelihood of forming an amphipathic helix, a DNA binding forkhead domain, and a C-terminal region that has a high probability of forming an amphipathic beta-sheet. The amino acid sequence of the DNA binding forkhead motif of this protein is identical to that of another forkhead protein, FREAC4 (601091), whereas 12 substitutions are present at the nucleotide level. There are no similarities in region outside of the DNA binding domains of FREAC9 and FREAC4, and since the gene encoding the latter protein maps to 5q12-q13, it is likely that evolutionary selection has acted to maintain identical DNA binding domains between these 2 kidney-expressed transcript on factors. Ernstsson et al. (1997) tabulated the chromosomal localization of 15 human forkhead genes in their Table 1

Full details of the abovementioned studies are described in the following publications, the disclosure of which are hereby incorporated by reference:

Ernstsson, S.; Betz, R.; Lagercrantz, S.; Larsson C.; Ericksson, S.; Cederberg, A.; Carlsson, P.; Enerback, S.: Cloning and characterization of freac-9 (FKHL17), a novel kidney-expressed human forkhead gene that maps to chromosome 1p32-p34. Genomics 46: 78-85, 1997.

Further studies establishing the function and utilities of FOXD2 are found in John Hopkins OMIM database record ID 602211, and in references numbered 741 listed hereinbelow.

Reference is now made to FOXF1 BINDING SITE. Forkhead box F1 (FOXF1) is a target gene of GAM26, corresponding to GAM26-TARGET GENE of FIG. 26A. FOXF1 BINDING SITE is a binding site found in an untranslated region of FOXF1, corresponding to BINDING SITE of FIG. 26A. FIG. 26D illustrates the complementarity of the nucleotide sequence of FOXF1 BINDING SITE, designated SEQ ID:169360, to the nucleotide sequence of GAM26 RNA of FIG. 26A, designated SEQ ID:20604.

An additional function of GAM26 is therefore inhibition of forkhead box F1 (FOXF1), a gene which encodes a transcription factor that is a probable transcription activator for a number of lung-specific genes. Accordingly, utilities of GAM26 include diagnosis and treatment of the abovementioned diseases and clinical conditions.

The function of FOXF1 has been established by previous studies. The forkhead genes are transcription factors distinguished by a characteristic 100-amino acid motif that was originally identified in *Drosophila* (see 164874). Pierrou et al. (1994) identified 7 human genes containing forkhead domains and designated them forkhead related activators (FREAC) 1 through 7. Northern blot analysis revealed that the FREAC1, or FKHL5, gene is expressed as a 2.6-kb mRNA in placenta and adult and fetal lung. Hellqvist et al. (1996) reported the FREAC1 cDNA sequence. The predicted 354-amino acid protein is nearly identical to FREAC2 (FKHL6; 603250) within a 112-residue region containing the forkhead domain and adjacent sequences, and within the C-terminal region. Using a reporter gene construct containing FREAC2 binding sequences in the promoter, Hellqvist et al. (1996) demonstrated that both FREAC1 and FREAC2 have C-terminal transcriptional activation domains. FREAC1/FREAC2 binding sequences are present in the promoters of several lung-specific genes, including CC10 (192020) and SPB (SFTPB; 178640). While both FREAC1 and FREAC2 transactivated an SPB promoter construct, CC10 was activated only by FREAC1. CC10 activation occurred specifically in a lung cell line with Clara cell-like characteristics. Hellqvist et al. (1996) reported that the mouse HFH8 gene and FREAC1 share 90% nucleotide sequence identity. By resequencing of HFH8, these authors demonstrated that 5 frameshifts in the HFH8 sequence reported by Clevidence et al. (1994) were due to sequencing errors.

Full details of the abovementioned studies are described in the following publications, the disclosure of which are hereby incorporated by reference:

Clevidence, D. E.; Overdier; D. G.; Peterson, R. S.; Porcella, A.; Ye, H.; Paulson, K. E.; Costa, R. H.: Members of the HNF-3/forkhead family of transcription factors exhibit distinct cellular expression patterns in lung and regulate the surfactant protein B promoter. Dev. Biol. 166: 195-

209, 1994. PubMed ID: 7958446 2. Hellqvist, M.; Mahlapuu, M.; Blixt, A.; Enerback, S.; Carlsson, P.: The human forkhead protein FREAC-2 contains two functionally redundant activation domains and interacts with TBP and TFIIB. J. Biol. Chem. 273: 23335-23343, 1998.

Further studies establishing the function and utilities of FOXF1 are found in John Hopkins OMIM database record ID 601089, and in references numbered 742-746 listed hereinbelow.

Reference is now made to FUS1 BINDING SITE. FUS1 GENE (FUS1) is a target gene of GAM26, corresponding to GAM26-TARGET GENE of FIG. 26A. FUS1 BINDING SITE is a binding site found in an untranslated region of FUS1, corresponding to BINDING SITE of FIG. 26A. FIG. 26D illustrates the complementarity of the nucleotide sequence of FUS1 BINDING SITE, designated SEQ ID:170829, to the nucleotide sequence of GAM26 RNA of FIG. 26A, designated SEQ ID:20604.

A further function of GAM26 is therefore inhibition of FUS1 GENE (FUS1), a gene which encodes a protein that may function as a tumor suppressor and is associated with lung cancer. Accordingly, utilities of GAM26 include diagnosis and treatment of the abovementioned diseases and clinical conditions.

The function of FUS1 has been established by previous studies. Lerman and Minna (2000) identified a FUS1 mutation in 2 nonsmall cell lung cancer (NSCLC) cell lines that resulted in a 28-bp truncation at the 3-prime end of exon 2 and a predicted protein of only 82 amino acids. Using SSCP and CpG island promoter methylation analyses, Kondo et al. (2001) failed to detect mutations, polymorphisms, or methylation of FUS1 in lung cancer specimens. Western blot analysis indicated low or no expression of FUS1 in lung cancer cell lines. Overexpression of transfected wildtype but not mutant FUS1 in NSCLCs led to the detection of an approximately 20-kD protein and a dramatic reduction in colony-forming cells. Ecdysone-induced expression of FUS1 had the same effects. Flow cytometric analysis indicated that the arrest occurred in G1 phase.

Full details of the abovementioned studies are described in the following publications, the disclosure of which are hereby incorporated by reference:

Kondo, M.; Ji, L.; Kamibayashi, C.; Tomizawa, Y.; Randle, D.; Sekido, Y.; Yokota, J.; Kashuba, V.; Zabarovsky, E.; Kuzmin, I.; Lerman, M.; Roth, J.; Minna, J. D.: Overexpression of candidate tumor suppressor gene FUS1 isolated from the 3p21.3 homozygous deletion region leads to G1 arrest and growth inhibition of lung cancer cells. Oncogene 20: 6258-6262, 2001. PubMed ID: 11593436 2. Lerman, M. I.; Minna, J. D.: The 630-kb lung cancer homozygous deletion region on human chromosome 3p21.3: identification and evaluation of the resident candidate tumor suppressor genes. Cancer Res. 60: 6116-6133, 2000.

Further studies establishing the function and utilities of FUS1 are found in John Hopkins OMIM database record ID 607052, and in reference numbered 747-748 listed hereinbelow.

Referring now to FUS1 BINDING SITE. FUS1 GENE (FUS1) is a target gene of GAM26, corresponding to GAM26-TARGET GENE of FIG. 26A. FUS1 BINDING SITE is a binding site found in an untranslated region of FUS1, corresponding to BINDING SITE of FIG. 26A. FIG. 26D illustrates the complementarity of the nucleotide sequence of FUS1 BINDING SITE, designated SEQ ID:170846, to the nucleotide sequence of GAM26 RNA of FIG. 26A, designated SEQ ID:20604.

Yet a further function of GAM26 is therefore inhibition of FUS1 GENE (FUS1), a gene which encodes a protein that may function as a tumor suppressor and is associated with lung cancer. Accordingly, utilities of GAM26 include diagnosis and treatment of the abovementioned diseases and clinical conditions. The function and utilities of FUS1 have been established by previous studies, as described hereinabove with reference to FIG. 26D.

Reference is now made to FZD2 BINDING SITE. Frizzled (*Drosophila*) homolog 2 (FZD2) is a target gene of GAM26, corresponding to GAM26-TARGET GENE of FIG. 26A. FZD2 BINDING SITE is a binding site found in an untranslated region of FZD2, corresponding to BINDING SITE FIG. 26A. FIG. 26D illustrates the complementarity of the nucleotide sequence of FZD2 BINDING SITE, designated SEQ ID:172450, to the nucleotide sequence of GAM26 RNA of FIG. 26A, designated SEQ ID:20604.

Another function of GAM26 is therefore inhibition of frizzled (*Drosophila*) homolog 2 (FZD2), a gene which encodes a protein that is aputative receptor with a role in transmembrane signal transmission. Accordingly, utilities of GAM26 include diagnosis and treatment of the abovementioned diseases and clinical conditions.

The function of FZD2 has been established by previous studies. Following up on the identification of trinucleotide repeat expansions as the basis of many inherited human disorders, Zhao et al. (1995) isolated and characterized cDNAs containing trinucleotide repeats. In the course of these studies, they discovered a human homolog of the *Drosophila* polarity gene 'frizzled' (fz). The fz locus in *Drosophila* is required for the transmission of polarity signals across the plasma membrane in epidermal cells. The *Drosophila* fz gene encodes a protein with 7 putative transmembrane domains that is thought to function as a G protein-coupled receptor. Zhao et al. (1995) isolated a human homolog, symbolized FZD2, from a human ovarian cDNA library and mapped this gene to 17q21.1 by fluorescence in situ hybridization using a corresponding cosmid. The full-length cDNA of FZD2 encodes a protein of 565 amino acids that shares 56% sequence identity with *Drosophila* fz protein. Zhao et al. (1995) found that the expression of the FZD2 gene appears to be developmentally regulated, with high levels of expression in fetal kidney and lung and in adult colon and ovary. The structure of FZD2 suggests that it has a role in transmembrane signal transmission, although its precise physiologic function and associated pathways have yet to be determined. Wang et al. (1996) showed that a large family of frizzled homologs exists in mammals. They mapped FZD2 to mouse chromosome 11, syntenic to human chromosome 17q, by interspecific backcross analysis. Another human homolog termed 'frizzled 5,' (601723) was also isolated by Wang et al. (1996).

Full details of the abovementioned studies are described in the following publications, the disclosure of which are hereby incorporated by reference:

Wang, Y.; Macke, J. P.; Abella, B. S.; Andreasson, K.; Worley, P.; Gilbert, D. J.; Copeland, N. G.; Jenkins, N. A.; Nathans, J.: A large family of putative transmembrane receptors homologous to the product of the *Drosophila* tissue polarity gene frizzled. J. Biol. Chem. 271: 4468-4476, 1996. PubMed ID: 8626800 2. Zhao, Z. Y.; Lee, C. C.; Baldini, A.; Caskey, C. T.: A human homologue of the *Drosophila* polarity gene frizzled has been identified and mapped to 17q21.1. Genomics 27: 370-373, 1995.

Further studies establishing the function and utilities of FZD2 are found in John Hopkins OMIM database record ID 600667, and in references numbered 749-750 listed hereinbelow.

Reference is now made to GABRB3 BINDING SITE. Gamma-aminobutyric acid (GABA) A receptor, beta 3 (GABRB3) is a target gene of GAM26, corresponding to GAM26-TARGET GENE of FIG. 26A. GABRB3 BINDING SITE is a binding site found in an untranslated region of GABRB3, corresponding to BINDING SITE of FIG. 26A. FIG. 26D illustrates the complementarity of the nucleotide sequence of GABRB3 BINDING SITE, designated SEQ ID:173934, to the nucleotide sequence of GAM26 RNA of FIG. 26A, designated SEQ ID:20604.

Yet another function of GAM26 is therefore inhibition of gamma-aminobutyric acid (GABA) A receptor, beta 3 (GABRB3), a gene which encodes a receptor that mediates neuronal inhibition by binding to the gaba/benzodizepine receptor and opening an integral chloride channel, and is associated with Angelman syndrome and Prader-Willi syndrome. Accordingly, utilities GAM26 include diagnosis and treatment of the abovementioned diseases and clinical conditions.

The function of GABRB3 has been established by previous studies. Wagstaff et al. (1991) showed that the gene encoding the beta-3 subunit of the GABA-A receptor (GABRB3) maps to the region of 15q involved in Angelman syndrome (AS; 105830) and Prader-Willi syndrome (PWS; 176270). Deletion of the gene was found in patients of both types with interstitial cytogenetic deletions. The gene was also deleted in an Angelman syndrome patient with an unbalanced 13;15 translocation but not in a PWS patient with an unbalanced 9;15 translocation. Wagstaff et al. (1991) suggested that this receptor gene may be involved in the pathogenesis of one or both of these syndromes. This is the first gene to be mapped to this region. Wagstaff et al. (1991) showed that the gene is located on mouse chromosome 7, very closely linked to 2 other genes that in the human have been mapped to the 15q11-q13 region. Saitoh et al. (1992) studied a highly informative family in which 3 sibs had Angelman syndrome and a deletion of one GABRB3 gene. The mother had the same deletion which she had inherited from her father. The finding supposed the possibility that GABRB3 is the Angelman gene and indicated that the genes for AS and PWS are different since transmission of the deletion from the grandfather to the mother of the affected children did not result in PWS. Using the combined techniques of field-inversion gel electrophoresis (FIGE) and phage genomic library screening, Sinnett et al. (1993) constructed a high-resolution physical map covering nearly 1.0 Mb in the proximal region of 15q. The map showed that GABRB3 and GABRA5 (gamma-aminobutyric acid receptor alpha-5 subunit gene; 137142) are separated by less than 100 kb and are arranged in a head-to-head configuration. GABRB3 encompasses approximately 250 kb, while GABRA5 is contained within 70 kb. The difference in size is due largely to an intron of 150 kb within GABRB3. Chromosomal rearrangement breakpoints in 2 patients with Angelman syndrome were located within the large GABRB3 intron. Russek and Farb (1994) stated that the gene encoding the gamma-3 form of the GABA-A receptor (GABRG3; 600233) is located on 15q11-q13 in a cluster with GABRA5 and GAB B3.

Full details of the abovementioned studies are described in the following publications, the disclosure of which are hereby incorporated by reference:

Saitoh, S.; Kubota, T.; Ohta, T.; Jinno, Y.; Niikawa, N.; Sugimoto, T.; Wagstaff, J.; Lalande, M.: Familial Angelman syndrome caused by imprinted submicroscopic deletion encompassing GABA(A) receptor beta(3)-subunit gene. (Letter) Lancet 339: 366-367, 1992. PubMed ID: 1346439 15. Wagstaff, J.; Knoll, J. H. M.; Fleming, J.; Kirkness, E. F.; Martin-Gallardo, A.; Greenberg, F.; Graham, J. M., Jr.; Menninger, J.; Ward, D.; Venter, J. C.; Lalande, M.: Localization of the gene encoding the GABA(A) receptor beta-3 subunit to the Angelman/Prader-Willi region of human chromosome 15. Am. J. Hum. Genet. 49: 330-337, 1991.

Further studies establishing the function and utilities of GABRB3 are found in John Hopkins OMIM database record ID 137192, and in references numbered 751-765 listed hereinbelow.

Reference is now made to NPAS2 BINDING SITE. Neuronal PAS domain protein 2 (NPAS2) is a target gene of GAM26, corresponding to GAM26-TARGET GENE of FIG. 26A. NPAS2 BINDING SITE is a binding site found in an untranslated region of NPAS2, corresponding to BINDING SITE of FIG. 26A. FIG. 26D illustrates the complementarity of the nucleotide sequence of NPAS2 BINDING SITE, designated SEQ ID:173934, to the nucleotide sequence of GAM26 RNA of FIG. 26A, designated SEQ ID:20604.

An additional function of GAM26 is therefore inhibition of neuronal PAS domain protein 2 (NPAS2), a gene which encodes a protein that is a member of basic helix-loop-helix-PAS family of transcription factors. Accordingly, utilities of GAM26 include diagnosis and treatment of the abovementioned diseases and clinical conditions.

The function of NPAS2 has been established by previous studies. Members of the bHLH-PAS family are transcription factors that contain a basic helix-loop-helix (bHLH) DNA-recognition motif located N-terminal to a PAS do main composed of 2 imperfect direct repeats. See BMAL1 (602550). By searching an EST database, Zhou et al. (1997) identified hum an and mouse cDNAs encoding 2 novel bHLH-PAS proteins, NPAS1 (603346) and NPAS2. The predicted 824-amino acid human NPAS2 protein shares 87% sequence identity with mouse Npas2. Northern blot analysis of mouse tissues revealed that Npas2 is expressed predominantly in brain. In situ hybridization indicated that the pattern of Npas2 mRNA distribution in mouse brain is broad and complex, and is largely nonoverlapping with that of Npas1. Hogenesch et al. (1997) identified NPAS2 as MOP4 (member of the PAS superfamily 4). McNamara et al. (2001) reported a hormone-dependent interaction of the nuclear receptors RARA (180240) and RXRA (180245) with CLOCK (601851) and MOP4. They found that these interactions negatively regulate CLOCK-BMAL1 and MOP4-BMAL1 heterodimer-mediated transcriptional activation of clock gene expression in vascular cells. MOP4 exhibited a robust rhythm in the vasculature, and retinoic acid could phase shift PER2 (603426) mRNA rhythmicity in vivo and in serum-induced smooth muscle cells in vitro, providing a molecular mechanism for hormonal control of clock gene expression. McNamara et al. (2001) proposed that circadian or periodic availability of nuclear hormones may play a critical role in resetting a peripheral vascular clock.

Full details of the abovementioned studies are described in the following publications, the disclosure of which are hereby incorporated by reference:

McNamara P.; Seo, S.; Rudic, R. D.; Sehgal, A.; Chakravarti, D.; FitzGerald, G. A.: Regulation of CLOCK and MOP4 by nuclear receptors in the vasculature: a humoral mechanism to reset a peripheral clock. Cell 105: 877-889, 2001. PubMed ID: 114391846. Zhou, Y. -D.; Barnard, M.; Tian, H.; Li, X.; Ring, H. Z.; Francke, U.; Shelton, J.; Richardson, J.; Russell, D. W.; McKnight, S. L.: Molecular characterization of two mammalian bHLH-PAS domain proteins selectively expressed in the central nervous system. Proc. Nat. Acad. Sci. 94: 713-718, 1997.

Further studies establishing the function and utilities are found in John Hopkins OMIM database record ID 603347, and in references numbered 766-771 listed hereinbelow.

Reference is now made to REPS2 BINDING SITE, RALBP1 associated Eps domain containing 2 (REPS2) is a target gene of GAM26, corresponding to GAM26-TARGET GENE of FIG. 26A. REPS2 BINDING SITE is a binding site found in an untranslated region of REPS2, corresponding to BINDING SITE of FIG. 26A. FIG. 26D illustrates the complementarity of the nucleotide sequence of REPS2 BINDING SITE, designated SEQ ID:173934, to the nucleotide sequence of GAM26 RNA of FIG. 26A, designated SEQ ID:20604.

A further function of GAM26 is therefore inhibition RALBP1 associated Eps domain containing 2 (REPS2), a gene which encodes a protein that interacts with the active form of RAS with adaptor protein GRB2 and binds calcium. Accordingly, utilities of GAM26 include diagnosis and treatment of the abovementioned diseases and clinical conditions.

The function of REPS2 has been established by previous studies. Small G proteins have GDP-bound inactive and GTP-bound active forms; RAL proteins (e.g., RALA; 179550) shift from the inactive to the active state through the actions of RALGDS (601619). RALGDS interacts with the active form of RAS (see HRAS; 190020). Using RALA-binding protein-1 (RALBP1; 605801) as bait in a yeast 2-hybrid screen of a brain cDNA library, Ikeda et al. (1998) isolated cDNAs encoding REPS2, which they termed POB1 Sequence analysis predicted that the 521-amino acid protein has 2 potential initiator methionines in its N terminus, a central EPS15 (600051)-like domain, and 2 proline-rich regions and a putative coiled-coil structure in its C terminus. Northern blot analysis revealed strong expression in rat cerebrum cerebellum, lung, and testis, with weak expression in kidney and no expression in heart, thymus, liver, spleen, or adrenal gland. Immunoprecipitation and immunoblot analyses confirmed that the C-terminal 146 amino acids of REPS2 and the C-terminal 147 residues of RALBP1 interact in intact cells. RAL interacts with a distinct region of RALBP1, just N terminal of the REPS2-binding domain, and both proteins can interact simultaneously with RALBP1. Immunoblot analysis established that REPS2 is tyrosine phosphorylated in response to epidermal growth factor (EGF; 131530) and interacts with the EGF receptor (EGFR; 131550), possibly through the adaptor protein GRB2 (108355) with which REPS2 interacts specifically. Using nuclear magnetic resonance spectroscopy, Koshiba et al. (1999) showed that the EPS15 homology domain of REPS2 consists of 2 EF-hand structures, the second of which binds calcium.

Full details of the abovementioned studies are described in the following publications, the disclosure of which are hereby incorporated by reference:

Ikeda, M.; Ishida, O.; Hinoi, T.; Kishida, S.; Kikuchi, A.: Identification and characterization of a novel protein interacting with Ral-binding protein 1, a putative effector protein of Ral. J. Biol. Chem. 273: 814-821, 1998. PubMed ID: 9422736 2. Koshiba, S.; Kigawa, T.; Iwahara, J.; Kikuchi, A.; Yokoyama, S.: Solution structure of the Eps15 homology domain of a human POB1 (partner of RalBP1). FEBS Lett. 442: 138-142, 1999.

Further studies establishing the function and utilities of REPS2 are found in John Hopkins OMIM database record ID 300317, and in references numbered 772-773 listed hereinbelow.

Referring now to SERPINB8 BINDING SITE. Serine (or cysteine) proteinase inhibitor, clade B (ovalbumin), member (SERPINB8) is a target gene of GAM26, corresponding to GAM26-TARGET GENE of FIG. 26A. SERPINB8 BINDING SITE is a binding site found in an untranslated region of SERPINB8, corresponding to BINDING SITE of FIG. 26A. FIG. 26D illustrates the complementarity of the nucleotide sequence of SERPINB8 BINDING SITE, designated SEQ ID:173934, to the nucleotide sequence of GAM26 RNA of FIG. 26A, designated SEQ ID:20604.

Yet a further function of GAM26 is therefore inhibition of serine (or cysteine) proteinase inhibitor, lade B (ovalbumin), member (SERPINB8), a gene which encodes a protein that protease inhibitors; may be a serpin serine protease inhibitor that binds thrombin. Accordingly, utilities of GAM26 include diagnosis and treatment of the abovementioned diseases and clinical conditions. The function and utilities of SERPINB8 have been established by previous studies, as described hereinabove with reference to FIG. 26D.

Reference is now made to GAL BINDING SITE. Galanin (GAL) is a target gene of GAM26, corresponding to GAM26-TARGET GENE of FIG. 26A. GAL BINDING SITE is a binding site found in an untranslated region of GAL, corresponding to BINDING SITE of FIG. 26A. FIG. 26D illustrates the complementarity of the nucleotide sequence of GAL BINDING SITE, designated SEQ ID:174735, to the nucleotide sequence of GAM26 RNA of FIG. 26A, designated SEQ ID:20604.

Another function of GAM26 is therefore inhibition of galanin (GAL), a gene which encodes a hormone that stimulates LH secretion and enhances LHRH-induced LH release from dispersed anterior pituitary cells in vitro. Accordingly, utilities of GAM26 include diagnosis and treatment of the abovementioned diseases and clinical conditions.

The function of GAL has been established by previous studies. Galanin is a 29-amino acid peptide widely distributed in the peripheral and cent al nervous systems. In the brain, the highest concentrations are observed in the hypothalamus and particularly in the nerve terminals of the median eminence. Since the establishment of the neurovascular concept in the regulation of the hypothalamus-pituitary axis (Harris, 1948), it is well known that the median eminence represents a key area for neuroendocrine regulation. Hypothalamic releasing and inhibiting factors are secreted from median eminence terminals into the portal circulation to reach the adenohypophyseal cells where they exert specific actions. Lopez et al. (1991) presented evidence that galanin meets the criteria to be considered a hypothalamic-hypophysiotropic hormone. They found a possibly meaningful colocalization and cosecretion of galanin and LHRH (152760). Galanin stimulates LH secretion and enhances LHRH-induced LH release from dispersed anterior pituitary cells in vitro. Galanin is important to gastrointestinal function also (Rattan, 1991).

Animal model experiments lend further support to the function of GAL. The neuropeptide galanin is predominantly expressed by the lactotrophs (the prolactin-secreting cell type) in the rodent anterior pituitary and in the median eminence and paraventricular nucleus of the hypothalamus. Prolactin (PRL; 76760) and galanin colocalize in the same secretory granule, and the expression of both proteins is extremely sensitive to the estrogen status of the animal. Administration of estradiol-17-beta induces pituitary hyperplasia followed by adenoma formation and causes a 3,000-fold increase in the galanin mRNA content of the lactotroph. To further study the role of galanin in prolactin release and lactotroph growth, Wynick et al. (1998) generated mice carrying a loss-of-function mutation of the endogenous galanin gene. There was no evidence of embryonic lethality and the mutant mice grew normally. The specific endocrine abnormalities identified related to the expression of prolactin. Pituitary prolactin message levels and protein content of adult female mutant mice were reduced by 30 to 40% compared with wildtype controls. Mutant females failed to lactate and pups died of starvation/dehydration unless fostered onto wildtype mothers. Prolactin secretion in mutant females was markedly reduced at 7 days postpartum compared with wildtype controls with an associated failure in mammary gland maturation. There was almost complete abrogation of the proliferative response of the lactotroph to high doses of estrogen, with a failure to upregulate prolactin release and STAT5 (601511) expression or to increase pituitary cell number. These data supported the hypothesis that galanin acts as a paracrine regulator of prolactin expression and as a growth factor to the lactotroph.

It is appreciated that the abovementioned animal model for GAL is acknowledged by those skilled in the art as a scientifically valid animal model, as can be further appreciated from the publications sited hereinbelow.

Full details of the abovementioned studies are described in the following publications, the disclosure of which are hereby incorporated by reference:

Wynick, D.; Small, C. J.; Bacon, A.; Holmes, F. E.; Norman, M.; Ormandy, C. J.; Kilic, E.; Kerr, N. C. H.; Ghatei, M.; Talamantes, F.; Bloom, S. R.; Pachnis, V.: Galanin regulates prolactin release and lactotroph proliferation. Proc. Nat. Acad. Sci. 95: 12671-12676, 1998. PubMed ID: 9770544 6. Lopez, F. J.; Merchenthaler, I.; Ching, M.; Wisniewski, M. G.; Negro-Vilar, A.: Galanin: a hypothalmic-hypophysiotropic hormone modulating reproductive functions. Proc. Nat. Acad. Sci. 88: 4508-4512, 1991.

Further studies establishing the function and utilities of GAL are found in John Hopkins OMIM database record ID 137035, and in referent numbered 774-785 listed hereinbelow.

Referring now to GAL BINDING SITE. Galanin (GAL) is a target gene of GAM26, corresponding to GAM26-TARGET GENE of FIG. 26A. GAL BINDING SITE is a binding site found in an untranslated region of GAL, corresponding to BINDING SITE of FIG. 26A. FIG. 26D illustrates the complementarity of the nucleotide sequence of GAL BINDING SITE, designated SEQ ID:174743, to the nucleotide sequence of GAM26 RNA of FIG. 26A, designated SEQ ID:20604.

Yet another function of GAM26 is therefore inhibition of galanin (GAL), a gene which encodes a hormone that stimulates LH secretion and enhances LHRH-induced LH release from dispersed anterior pituitary cells in vitro. Accordingly, utilities of GAM26 include diagnosis and treatment of the abovementioned diseases and clinical conditions. The function and utilities of GAL have been established by previous studies, as described hereinabove with reference to FIG. 26D.

Reference is now made to GDI1 BINDING SITE. GDP dissociation inhibitor 1 (GDI1) is a target gene of GAM26, corresponding to GAM26-TARGET GENE of FIG. 26A. GDI1 BINDING SITE is a binding site found in an untranslated region of GDI1, corresponding to BINDING SITE of FIG. 26A. FIG. 26D illustrates the complementarity of the nucleotide sequence of GDI1 BINDING SITE, designated SEQ ID:178360, to the nucleotide sequence of GAM26 RNA of FIG. 26A, designated SEQ ID:20604.

An additional function of GAM26 is therefore inhibition of GDP dissociation inhibitor 1 (GDI1), a gene which encodes a protein that is associated with x-linked nonspecific mental retardation (xlmr) types 41 (mrx41) and 48 (mrx48). Accordingly, utilities of GAM26 include diagnosis and treatment of the abovementioned diseases and clinical conditions.

The function of GDI1 has been established by previous studies. GDI binds to the small G proteins of the Rab family, particularly the brain-specific form RAB3A (179490), and modulates their activity and vesicle-mediated transport D'Adamo et al. (1997) noted that GDI is expressed in all parts of the adult brain and, by in situ hybridization analysis, it is detectable in post-mitotic neural cells during mouse development, with the same timing and in the same cell type as Rab3a. Since the RABGDIA gene has these properties and maps to Xq28, it is a plausible candidate gene for one or more forms of X-linked nonspecific mental retardation (MRX) that map to this chromosomal region. Five families with X-linked nonspecific mental retardation had been mapped to Xq28; these families, which are reviewed in 309541, were designated MRX3, MRX25, MRX28, MRX41, and MRX48. D'Adamo et al. (1997) found unique mutations in the RABGDIA gene in affected members of the MRX41 (300104.0001) and MRX48 (300104.0002) families. Chelly (1999) referred to the protein mutant in MRX41 as oligophrenin-2 (OPHN2). Bienvenu et al. (1998) carried out mutation screening of the whole coding region of the GDI1 gene, using a combination of denaturing gradient gel electrophoresis and direct sequencing, in 164 patients found negative for expansions across the FRAXA GCC repeat. In addition to the nonsense mutation found in the MRX48 family (300104.002), they identified a novel missense mutation in exon 11 of the GDI1 gene in a family with nonspecific mental retardation. In this large French family, all affected allowed moderate to severe mental retardation. X-linked semidominant inheritance was strongly suggested by the severe phenotypes in males in comparison to mildly affected females or unaffected obligate carriers. The study suggested that the prevalence of GDI1 mutations in nonspecific mental retardation may be 0.5 to 1%. One of the families included in the study by Bienvenu et al. (1998) was the so-designated MRX16 family reported by Moraine et al. (1994), known to be located in Xq28, in a genetic interval encompassing GDI1. Gendrot et al. (1999) found no mutation in the GDI1 gene in a large MRX16 family.

Full details of the abovementioned studies are described in the following publications, the disclosure of which are hereby incorporated by reference:

Bienvenu, T.; des Portes, V.; Saint Martin, A.; McDonell, N.; Billuart, P.; Carrie, A.; Vinet, M. -C.; Couvert, P.; Toniolo, D.; Ropers, H. -H.; Moraine, C.; van Bokhoven, H.; Fryns, J. -P.; Kahn, A.; Beldjord, C.; Chelly, J.: Nonspecific X-linked semidominant mental retardation by mutations in a Rab GDP-dissociation inhibitor. Hum. Molec. Genet. 7: 1311-1315, 1998. PubMed ID: 9668174
4. D'Adamo, P.; Gulisano, M.; Oostra, B. A.; Chelly, J.; Toniolo, D.: GDI is responsible for X-linked mental retardation. (Abstract) Am. J. Hum. Genet. 61 (suppl.): A11 only, 1997.

Further studies establishing the function and utilities of GDI1 are found in John Hopkins OMIM database record ID 300104, and in references numbered 786-799 listed hereinbelow.

Referring now to GNB1 BINDING SITE. Guanine nucleotide binding protein (G protein), beta polypeptide 1 (GNB1) is a target gene of GAM26, corresponding to GAM26-TARGET GENE of FIG. 26A. GNB1 BINDING SITE is a binding site found in an untranslated region of GNB1, corresponding to BINDING SITE of FIG. 26A. FIG. 26D illustrates the complementarity of the nucleotide sequence of GNB1 BINDING SITE, designated SEQ ID:182802, to the nucleotide sequence of GAM26 RNA of FIG. 26A, designated SEQ ID:20604.

A further function of GAM26 is therefore inhibition of guanine nucleotide binding protein (G protein), beta polypeptide 1 (GNB1), a gene which encodes a protein that transduces signals from G protein-coupled receptors to intracellular effectors. Accordingly, utilities of GAM26 include diagnosis and treatment of the abovementioned diseases and clinical conditions. The function and utilities of GNB1 have been established by previous studies, as described hereinabove with reference to FIG. 26D.

Reference is now made to GPRK5 BINDING SITE. G protein-coupled receptor kinase 5 (GPRK5) is a target gene of GAM26, corresponding to GAM26-TARGET GENE of FIG. 26A. GPRK5 BINDING SITE is a binding site found in an untranslated region of GPRK5, corresponding to BINDING SITE of FIG. 26A. FIG. 26D illustrates the complementarity of the nucleotide sequence of GPRK5 BINDING SITE, designated SEQ ID:186691, to the nucleotide sequence of GAM26 RNA of FIG. 26A, designated SEQ ID:20604.

Yet a further function of GAM26 is therefore inhibition of G protein-coupled receptor kinase 5 (GPRK5) a gene which encodes an enzyme that regulates the activity of G protein-coupled receptors. Accordingly, utilities of GAM26 include diagnosis and treatment of the abovementioned diseases and clinical conditions.

The function of GPRK5 has been established by previous studies. By PCR on neutrophil cDNA using primers based on sequences of known receptor kinases, Haribabu and Snyderman (1993) identified GPRK5 and GPRK6 (600869) sequences. Bullrich et al. (1995) used a rodent-human hybrid panel to map 2 newly identified members of the GRK family: GPRK5 and GPRK6 (600869) to 10q24-qter and 5q35, respectively. The hybrid cells containing parts of chromosomes 10 and 5 were used for the regionalization.

Full details of the abovementioned studies are described in the following publications, the disclosure of which are hereby incorporated by reference:

Bullrich, F.; Druck, T.; Kunapuli, P.; Gomez, J.; Gripp, K. W.; Schlegelberger, B.; Lasota, J.; Aronson, M.; Cannizzaro, L. A.; Huebner, K.; Benovic, J. L.: Chromosomal mapping of the genes GPRK5 and GPRK6 encoding G protein-coupled receptor kinases GRK5 and GRK6. Cytogenet. Cell Genet. 70: 250-254, 1995. PubMed ID: 7789183 2. Haribabu, B.; Snyderman, R.: Identification of additional members of human G-protein-coupled receptor kinase multigene family. Proc. Nat. Acad. Sci. 90: 9398-9402, 1993.

Further studies establishing the function and utilities of GPRK5 are found in John Hopkins OMIM database record ID 600870, and in references numbered 800-801 listed hereinbelow.

Referring now to GSPT1 BINDING SITE. G1 to S phase transition 1 (GSPT1) is a target gene of GAM26, corresponding to GAM26-T GET GENE of FIG. 26A. GSPT1 BINDING SITE is a binding site found in an untranslated region of GSPT1, corresponding to BINDING SITE of FIG. 26A. FIG. 26D illustrates the complementarity of the nucleotide sequence of GSPT1 BINDING SITE, designated SEQ ID:189737, to the nucleotide sequence of GAM26 RNA of FIG. 26A, designated SEQ ID:20604.

Another function of GAM26 is therefore inhibition of G1 to S phase transition 1 (GSPT1), a gene which encodes a protein that involves in regulation of mammalian cell growth. Accordingly, utilities of GAM26 include diagnosis and treatment of the abovementioned diseases and clinical conditions. The function and utilities of GSPT1 have been established by previous studies, as, described hereinabove with reference to FIG. 26D.

Referring now to GSPT1 BINDING SITE. G1 to S phase transition 1 (GSPT1) is a target gene of GAM26, corresponding to GAM26-TARGET GENE of FIG. 26A. GSPT1 BINDING SITE is a binding site found in an untranslated region of GSPT1, corresponding to BINDING SITE of FIG. 26A. FIG. 26D illustrates the complementarity of the nucleotide sequence of GSPT1 BINDING SITE, designated SEQ ID:189752, to the nucleotide sequence of GAM26 RNA of FIG. 26A, designated SEQ ID:20604.

Yet another function of GAM26 is therefore inhibition of G1 to S phase transition 1 (GSPT1), a gene which encodes a protein that involves in regulation of mammalian cell growth. Accordingly, utilities of GAM26 include diagnosis and treatment of the abovementioned diseases and clinical conditions. The function and utilities of GSPT1 have been established by previous studies, as described hereinabove with reference to FIG. 26D.

Referring now to GSPT1 BINDING SITE. G1 to S transition 1 (GSPT1) is a target gene of GAM26, corresponding to GAM26-TARGET GENE of FIG. 26A. GSPT1 BINDING SITE is a binding site found in an untranslated region of GSPT1, corresponding to BINDING SITE of FIG. 26A. FIG. 26D illustrates the complementarity of the nucleotide sequence of GSPT1 BINDING SITE, designated SEQ ID:189763, to the nucleotide sequence of GAM26 RNA of FIG. 26A, designated SEQ ID:20604.

An additional function of GAM26 is therefore inhibition of G1 to S phase transition 1 (GSPT1), a gene which encodes a protein that involves in regulation of mammalian cell growth. Accordingly, utilities of GAM261 include diagnosis and treatment of the abovementioned diseases and clinical conditions. The function and utilities of GSPT1 have been established by previous studies, as described hereinabove with reference to FIG. 26D.

Referring now to GSPT1 BINDING SITE. G1 to S phase transition 1 (GSPT1) is a target gene of GAM26, corresponding to GAM26-TARGET GENE of FIG. 26A. GSPT1 BINDING SITE is a binding site found in an untranslated region of GSPT1, corresponding to BINDING SITE of FIG. 26A. FIG. 26D illustrates the complementarity of the nucleotide sequence of GSPT1 BINDING SITE, designated SEQ ID:189764, to the nucleotide sequence of GAM26 RNA of FIG. 26A, designated SEQ ID:20604.

A further function of GAM26 is therefore inhibition of G1 to S phase transition 1 (GSPT1), a gene which encodes a protein that involves in regulation of mammalian cell growth. Accordingly, utilities of GAM26 include diagnosis and treatment of the abovementioned diseases and clinical conditions. The function and utilities of GSPT1 have been established by previous studies, as described hereinabove with reference to FIG. 26D.

Referring now to GSPT1 BINDING SITE. G1 to S phase transition 1 (GSPT1) is a target gene of GAM26, corresponding to GAM26-TARGET GENE of FIG. 26A. GSPT1 BINDING SITE is a binding site found in an untranslated region of GSPT1, corresponding to BINDING SITE of FIG. 26A. FIG. 26D illustrates the complementarity of the nucleotide sequence of GSPT1 BINDING SITE, designated SEQ ID:189765, to the nucleotide sequence of GAM26 RNA FIG. 26A, designated SEQ ID:20604.

Yet a further function of GAM26 is therefore inhibition of G1 to S phase transition 1 (GSPT1 a gene which encodes a protein that involves in regulation of mammalian cell growth. Accordingly, utilities of GAM26 include diagnosis and treatment of the abovementioned diseases and clinical conditions. The function and utilities of GSPT1 have been established by previous studies, as described hereinabove with reference to FIG. 26D.

Referring now to GSPT1 BINDING SITE. G1 to S transition 1 (GSPT1) is a target gene of GAM26, corresponding to GAM26-TARGET GENE of FIG. 26A. GSPT1 BINDING SITE is a binding site found in an untranslated region of GSPT1, corresponding to BINDING SITE of FIG. 26A. FIG. 26D illustrates the complementarity of the nucleotide sequence of GSPT1 BINDING SITE, designated SEQ ID:189777, to the nucleotide sequence of GAM26 RNA of FIG. 26A, designated SEQ ID:20604.

Another function of GAM26 is therefore inhibition of G1 to S phase transition 1 (GSPT1), a gene which encodes a protein that involves in regulation of mammalian cell growth. Accordingly, utilities of GAM26 include diagnosis and treatment of the abovementioned diseases and clinical conditions. The function and utilities of GSPT1 have been established by previous studies, as described hereinabove with reference to FIG. 26D.

Reference is now made to GTF2I BINDING SITE. General transcription factor II, I (GTF2I) is a target gene of GAM26, corresponding to GAM26-TARGET GENE of FIG. 26A. GTF2I BINDING SITE is a binding site found in an untranslated region of GTF2I, corresponding to BINDING SITE of FIG. 26A. FIG. 26D illustrates the complementarity of the nucleotide sequence of GTF2I BINDING SITE, designated SEQ ID:190454, to the nucleotide sequence of GAM26 RNA of FIG. 26A, designated SEQ ID:20604.

Yet another function of GAM26 is therefore inhibition of general transcription factor II, I (GTF2I), a gene which encodes a transcription factor that interacts with the basal transcription machinery by coordinating the formation of a multiprotein complex at the c-fos promoter, and linking specific signal responsive activator complexes and is associated with Williams-Beuren syndrome. Accordingly, utilities of GAM26 include diagnosis and treatment of the abovementioned diseases and clinical conditions.

The function of GTF2I has been established by previous studies. Through transfection experiments, Roy et al. (1997) found that GTF21 is capable of binding to both a pyrimidine-rich initiator (Inr) and an E-box for upstream stimulatory factor-1 (USF1; 191523). GTF2I and USF1 can also act synergistically to activate transcription through both Inr and the E-box elements of the adenovirus major late promoter. By in vitro cotranslation followed by coimmunoprecipitation studies, Roy et al. (1997) confirmed direct protein interaction between GTF2I and USF1. Williams-Beuren syndrome (WBS; 194050) is a neurodevelopmental disorder with multisystemic manifestations caused by heterozygosity for a partial deletion of 7q11.23. The breakpoints luster within regions located approximately 1 cM at either side of the elastin locus (ELN; 130160). Perez Jurado et al. (1998) characterized a duplicated region near the common deletion breakpoints, which includes a transcribed gene. The centromeric (C) and telomeric (T) copies are almost identical in the duplicated 3-prime portions but diverge at the 5-prime ends. C-specific 4.3-kb mRNA and T-specific 5.4-kb mRNA are widely expressed in embryonic and adult tissues. The telomeric gene gives rise to several tandemly spliced forms and is deleted in all WBS individuals who have documented ELN deletions. Database searches show that this gene encodes BAP135, a protein phosphorylated by BTK in B cells, as well as the multifunctional transcription factor TFII-I; hence, the gene name GTF2I. The centromeric gene is not deleted in WBS and appears to be a partially truncated expressed pseudogene (GTF2IP1) with no protein product. Both loci map to different genomic clone contigs that also contain other deleted and nondeleted loci. The duplicated region containing GTF2I and GTF2IP1, respectively, is located close to the deletion breakpoints and may predispose to unequal meiotic recombination between chromosome 7 homologs and/or to intrachromosomal rearrangements. Hemizygosity for GTF2I may also contribute to the WBS phenotype.

Full details of the abovementioned studies are described in the following publications, the disclosure of which are hereby incorporated by reference:

Perez Jurado, L. A.; Wang, Y. -K.; Peoples, R.; Coloma, A.; Cruces, J.; Francke, U.: A duplicated gene in the breakpoint regions of the 7q11.23 Williams-Beuren syndrome deletion encodes the initiator binding protein TFII-I and BAP-135, a phosphorylation target of BTK Hum. Molec. Genet 7: 325-334, 1998. PubMed ID: 9466987 2. Roy, A. L.; Du, H.; Gregor, P. D.; Novina, C. D.; Martinez, E.; Roeder, R. G.: Cloning of an Inr- and E-box binding protein, TFII-I, that interacts physically and functionally with USF1. EMBO J. 16: 7091-7104, 1997.

Further studies establishing the function and utilities of GTF2I are found in John Hopkins OMIM database record ID 601679, and in references numbered 802-804 listed hereinbelow.

Reference is now made to HCCS BINDING SITE. Holocytochrome c synthase (cytochrome c heme-lyase) (HCCS) is a target gene of GAM26, corresponding to GAM26-TARGET GENE of FIG. 26A. HCCS BINDING SITE is a binding site found in an untranslated region of HCCS, corresponding to BINDING SITE of FIG. 26A. FIG. 26D illustrates the complementarity of the nucleotide sequence of HCCS BINDING SITE, designated SEQ ID:192464, to the nucleotide sequence of GAM26 RNA of FIG. 26A, designated SEQ ID:20604.

An additional function of GAM26 is therefore inhibition of holocytochrome c synthase (cytochrome c heme-lyase) (HCCS), a gene which encodes a enzyme that catalyzes the covalent addition of a heme group onto c-type cytochromes in mitochondria and is associated with Microphthalmia with linear skin defects syndrome and Rett syndrome. Accordingly, utilities of GAM26 include diagnosis and treatment of the abovementioned diseases and clinical conditions.

The function of HCCS has been established by previous studies. Microphthalmia with linear skin defects syndrome (MLS; 309801) is an X-linked male-lethal disorder associated with X-chromosomal rearrangements resulting in monosomy from Xpter to Xp22. Features include microphthalmia, sclerocornea, linear skin defects, and agenesis of the corpus callosum. Using a cross-species conservation strategy, Schaefer et al. (1996) isolated an expressed sequence from the 450- to 550-kb MLS critical region on Xp22 by screening a human embryo cDNA library. Northern analysis demonstrated a transcript of approximately 2.6 kb in all tissues examined, with weaker expression of 1.2- and 5.2-kb transcripts. The strongest expression was observed in heart and skeletal muscle. Sequence analysis of a 3-kb cDNA contig revealed an 807-bp open reading frame encoding putative 268-amino acid protein. Comparison of the sequence with sequences in databases revealed homology with holocytochrome c-type synthetases, which catalyze the covalent addition of a heme group onto c-type cytochromes in mitochondria. The c-type cytochromes are required for proper functioning of the electron transport pathway. The human gene, symbolized HCCS, and the corresponding murine gene characterized by Schaefer et al. (1996) share 83% nucleotide sequence identity and 85% amino acid identity. The authors stated that, because of the lack of a neuromuscular phenotype in MLS, it is uncertain how the deletion of a mitochondrial holocytochrome synthetase would contribute to phenotype seen in MLS. The expression pattern of the gene and knowledge of the function of holocytochrome synthetase suggested, however, that it is a good candidate for X-linked encephalomyopathies typically associated with mitochondrial dysfunction. Based on its chromosomal location and its role in the mitochondrial respiratory chain, HCCS was considered a candidate gene for Rett syndrome (RTT; 312750). The genomic structure of the gene, which occupies an 11-kb region and consists of 7 exons, was determined. No mutational abnormality of the gene was found in 20 RTT patients (Van den Veyver et al., 1998).

Full details of the abovementioned studies are described in the following publications, the disclosure of which are hereby incorporated by reference:

Schaefer, L.; Ballabio, A.; Zoghbi, H. Y.: Cloning and characterization of a putative human holocytochrome c-type synthetase gene (HCCS) isolated from the critical region for microphthalmia with linear skin defects (MLS). Genomics 34: 166-172, 1996. PubMed ID: 8661044 2. Van den Veyver, I. B.; Subramanian, S.; Zoghbi, H. Y.: Genomic structure of a human holocytochrome c-type synthetase gene in Xp22.3 and mutation analysis in patients with Rett syndrome. Am. J. Med. Genet. 78: 179-181, 1998.

Further studies establishing the function and utilities of HCCS are found in John Hopkins OMIM database record ID 300056, and in references numbered 805-806 listed hereinbelow.

Reference is now made to HCN2 BINDING SITE. Hyperpolarization activated cyclic nucleotide-gated potassium channel (HCN2) is a target gene of GAM26, corresponding to GAM26-TARGET GENE of FIG. 26A. HCN2 BINDING SITE is a binding site found in an untranslated region of HCN2, corresponding to BINDING SITE of FIG. 26A. FIG. 26D illustrate the complementarity of the nucleotide sequence of HCN2 BINDING SITE, designated SEQ ID:192735, to the nucleotide sequence of GAM26 RNA of FIG. 26A, designated SEQ ID:20604.

A further function of GAM26 is therefore inhibition of hyperpolarization activated cyclic nucleotide-gated potassium channel (HCN2), a gene which encodes a channel that is hyperpolarization-activated cyclic nucleotide-gated cation channel 2 and may act as a pacemaker in the brain and the heart. Accordingly, utilities of GAM26 include diagnosis and treatment of the abovementioned diseases and clinical conditions.

The function of HCN2 has been established by previous studies. Ludwig et al. (1999) observed that when expressed in HEK293 cells, HCN2 gives rise to hyperpolarization-activated cation currents with the hallmark features of the native cation current. HCN2 has fast activation kinetics, and Ludwig et al. (1999) concluded that HCN2 may underlie the fast component of the cardiac hyperpolarization-activated cation current. By constructing truncation mutants, Wainger et al. (2001) demonstrated that the CNBD inhibits activation of the core transmembrane domain of HCN family members. Cyclic AMP binding relieves this inhibition. Differences in activation gating and extent of cAMP modulation between the HCN1 and HCN2 isoforms result largely from differences in the efficacy of CNBD inhibition.

Full details of the abovementioned studies are described in the following publications, the disclosure of which are hereby incorporated by reference:

Ludwig, A.; Zong, X.; Stieber, J.; Hullin, R.; Hofmann, F.; Biel, M.: Two pacemaker channels from human heart with profoundly different activation kinetics. EMBO J. 18: 2323-2329, 1999. PubMed ID: 10228147 2. Santoro, B.; Grant, S. G. N.; Bartsch, D.; Kandel, E. R.: Interactive cloning with the SH3 domain of N-src identifies a new brain specific ion channel protein, with homology to Eag and cyclic nucleotide-gated channels. Proc. Nat. Acad. Sci. 94: 14815-14820, 1997.

Further studies establishing the function and utilities of HCN2 are found in John Hopkins OMIM database record ID 602781, and in references numbered 807-810 listed hereinbelow.

Reference is now made to HDAC2 BINDING SITE. Histone deacetylase 2 (HDAC2) is a target gene of GAM26, corresponding to GAM26-TARGET GENE of FIG. 26A. HDAC2 BINDING SITE is a binding site found in an untranslated region of HDAC2, corresponding to BINDING SITE of FIG. 26A. FIG. 26D illustrates the complementarity of the nucleotide sequence of HDAC2 BINDING SITE, designated SEQ ID:193593, to the nucleotide sequence of GAM26 RNA of FIG. 26A, designated SEQ ID:20604.

Yet a further function of GAM26 is therefore inhibition of histone deacetylase 2 (HDAC2), gene which encodes an enzyme that is responsible for the deacetylation of lysine residues on the n-terminal part of the core histones and mediates transcriptional repression. Accordingly, utilities of GAM26 include diagnosis and treatment of the abovementioned diseases and clinical conditions.

The function of HDAC2 has been established by previous studies. Zhang et al. (1998) identified the SIN3-associated 30-kD protein SAP30 (603378) as a novel component of the human histone deacetylase complex which is conserved among eukaryotic organisms. This complex includes SIN3, SAP18 (02949), the histone deacetylases HDAC1 (601241) and HDAC2, the histone-binding proteins RbAp46 (RBBP7; 602922) and RbAp48 (RBBP4; 602923), as well as other polypeptides. Yarden and Brody (1999) reported that BRCA1 (113705) interacts in vivo and in vitro with RBBP7 and RBBP4, with RB1 (180200), and that the BRCT domain of BRCA1 associates with HDAC1 and HDAC2. Rountree et al. (2000) showed that DNMT1 (126375) can establish a repressive transcription complex consisting of DNMT1, HDAC2, and DMAP1 (605077). The noncatalytic amino terminus of DNMT1 binds to HDAC2 and to DMAP1 and can mediate transcriptional repression. DMAP1 is targeted to replication foci through interaction with the far N terminus of DNMT1 throughout S phase, whereas HDAC2 joins DNMT1 and DMAP1 only during late S phase, providing a platform for how histones may become deacetylated in heterochromatin following replication.

Full details of the abovementioned studies are described in the following publications, the disclosure of which are hereby incorporated by reference:

Yarden, R. I.; Brody, L. C.: BRCA1 interacts with components of the histone deacetylase complex. Proc. Nat. Acad. Sci. 96: 4983-4988, 1999. PubMed ID: 10220405 4. Rountree, M. R.; Bachman, K. E.; Baylin, S. B.: DNMT1 binds HDAC2 and a new co-repressor, DMAP1, to form a complex at replication foci. Nature Genet. 25: 269-277, 2000.

Further studies establishing the function and utilities of HDAC2 are found in John Hopkins OMIM database record ID 605164, and in references numbered 811-817 listed hereinbelow.

Referring now to HDAC2 BINDING SITE. Histone deacetylase 2 (HDAC2) is a target gene of GAM26, corresponding to GAM26-TARGET GENE of FIG. 26A. HDAC2 BINDING SITE is a binding site found in an untranslated region of HDAC2, corresponding to BINDING SITE of FIG. 26A. FIG. 2 illustrates the complementarity of the nucleotide sequence of HDAC2 BINDING SITE, designated SEQ ID:193594, to the nucleotide sequence of GAM26 RNA of FIG. 26A, designated SEQ ID:20604.

Another function of GAM26 is therefore inhibition of histone deacetylase 2 (HDAC2), a gene which encodes an enzyme that is responsible for the deacetylation of lysine residues on the n-terminal part of the core histones and mediates transcriptional repression. Accordingly, utilities of GAM26 include diagnosis and treatment of the abovementioned diseases and clinical conditions. The function and utilities of HDAC2 have been established by previous studies, as described hereinabove with reference to FIG. 26D.

Reference is now made to IRS1 BINDING SITE. Insulin receptor substrate 1 (IRS1) is a target gene of GAM26, corresponding GAM26-TARGET GENE of FIG. 26A. IRS1 BINDING SITE is a binding site found in an untranslated region of IRS1, corresponding to BINDING SITE of FIG. 26A. FIG. 26D illustrates the complementarity of the nucleotide sequence of IRS1 BINDING SITE, designated SEQ ID:193594, to the nucleotide sequence of GAM26 RNA of FIG. 26A, designated SEQ ID:20604.

Yet another function of GAM26 is therefore inhibition of insulin receptor substrate 1 (IRS1), a gene which encodes a receptor that may mediate the control of various cellular processes by insulin and is associated with DIABETES MELLITUS, TYPE II. Accordingly, utilities of GAM26 include diagnosis and treatment of the abovementioned diseases and clinical conditions.

The function of IRS1 has been established by previous studies. Sun et al. (1991) isolated cDNAs encoding a 160- to 185-kD phosphotyrosyl protein that is a substrate of the insulin receptor tyrosine kinase and a putative participant in insulin (INS; 176730) signaling. This protein, designated insulin receptor substrate-1 (IRS1), is found in a variety of insulin responsive cells and tissues. It exhibits no intrinsic enzyme activity but is believed to serve as a docking protein involved in binding and activating other signal transduction molecules after being phosphorylated on tyrosine by the insulin receptor kinase Almind et al. (1996) examined insulin-stimulated processes in a cultured myeloid progenitor cell stably overexpressing the insulin receptor when transfected with either wildtype human IRS1 or the gly972-to-arg common variant (numbering according to Nishiyama and Wands, 1992). They showed that the mutation in codon 972 of the IRS1 gene impairs insulin-stimulated signaling, especially along the phosphatidylinositol 3-kinase (171834) pathway, and may contribute to insulin resistance in normal and diabetic populations.

Animal model experiments lend further support to the function of IRS1. Clancy et al. (2001) found that mutation of chico extends fruit fly lifespan by up to 48% in homozygotes and 36% in heterozygotes. Extension of lifespan was not a result of impaired oogenesis in chico females, nor was it consistently correlated with increased stress resistance. The dwarf phenotype of chico homozygotes was also unnecessary for extension of lifespan. The role of insulin/IGF signaling in regulating animal aging is therefore evolutionarily conserved.

It is appreciated that the abovementioned animal for IRS1 is acknowledged by those skilled in the art as a scientifically valid an animal model, as can be further appreciated from the publications sited hereinbelow.

Full details of the abovementioned studies are described in the following publications, the disclosure of which are hereby incorporated by reference:

Esposito, D. L.; Mammarella, S.; Ranieri, A.; Loggia, F. D.; Capani, F.; Consoli, A.; Marani-Costantini, R.; Caramia, F. G.; Cama, A.; Battista, P.: Deletion of gly723 in the insulin receptor substrate-1 of a patient with noninsulin-dependent diabetes mellitus. Hum. Mutat. 7: 364-366, 1996. PubMed ID: 8723689 4. Almind, K.; Inoue, G.; Pedersen, O.; Kahn, C. R.: A common amino acid polymorphism in insulin receptor substrate-1 causes impaired insulin signaling: evidence from transfection studies. J. Clin. Invest. 97: 2569-2575, 1996.

Further studies establishing the function and utilities of IRS1 are found in John Hopkins OMIM record ID 147545, and in referent numbered 818-839 listed hereinbelow.

Reference is now made to HIC1 BINDING SITE. Hypermethylated in cancer 1 (HIC1) is a target gene of GAM26, corresponding to GAM26-TARGET GENE of FIG. 26A. HIC1 SITE is a binding site found in an untranslated region of HIC1, corresponding to BINDING SITE of FIG. 26A. FIG. 26D illustrates the complementarity of the nucleotide sequence of HIC1 BINDING SITE, designated SEQ ID:195147, to the nucleotide sequence of GAM26 RNA of FIG. 26A, designated SEQ ID:20604.

An additional function of GAM26 is therefore inhibition of hypermethylated in cancer 1 (HIC1), a gene which encodes a transcription factor that is a transcriptional repressor and may act as a tumor suppressor, and is associated with miller-dieker syndrome. Accordingly, utilities of GAM26 include diagnosis and treatment of the abovementioned diseases and clinical conditions.

The function of HIC1 has been established by previous studies. The human HIC1 (hypermethylated in cancer) gene maps to 17p13.3 and is deleted in the contiguous gene disorder Miller-Dieker syndrome (MDS; 247200) (Makos Wales et al., 1995; Chong et al., 1996). Grimm et al. (1999) isolated the murine Hic1 gene, which encodes a zinc finger protein with a poxvirus and zinc finger (POZ) domain. Comparison of genomic and cDNA sequences predicted 2 exons for the murine Hic1 gene. The second exon exhibits 88% identity at the DNA level to the corresponding region of the human HIC1 gene. During embryonic development, Hic1 is expressed in mesenchymes of the sclerotomes, lateral body wall, limb, and craniofacial regions embedding the outgrowing peripheral nerves during their differentiation. During fetal development, Hic1 is also expressed in mesenchymes apposed to the precartilaginous condensations, at many interfaces to budding epithelia of inner and weakly in muscles. Grimm et al. (1999) observed activation of Hic1 expression in the embryonic anlagen of many tissues displaying anomalies in MDS patients. Besides lissencephaly, MDS patients exhibit facial dysmorphism and frequently additional birth defects, e.g., anomalies of the heart, kidney, gastrointestinal tract, and the limbs. Thus, HIC1 activity may correlate with the defective development of the nose, jaws, extremities, gastrointestinal tract, and kidney in MDS patients.

Animal model experiments lend further support to the function of HIC1. The location of HIC1 in the Miller-Dieker syndrome critical dele on region on 17p13.3 makes it a candidate gene for involvement in the MDS gene deletion syndrome. To study the function of murine Hic1 in development, Carter et al. (2000) created Hic1-deficient mice. They found that these animals died perinatally and exhibited varying combinations of gross developmental defects throughout the second half of development, including acrania, exencephaly, cleft palate, limb anomalies, and omphalocele. These abnormalities demonstrated a role for Hic1 in the development of structures affected in the Miller-Dieker syndrome, and provided functional evidence to strengthen its candidacy as a gene involved in that disorder.

It is appreciated that the abovementioned animal model for HIC1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Carter, M. G.; Johns, M. A.; Zeng, X.; Zhou, L.; Zink, M. C.; Mankowski, J. L.; Donovan, D. M.; Baylin, S. B.: Mice deficient in the candidate tumor suppressor gene Hic1 exhibit developmental defects of structures affected the Miller-Dieker syndrome. Hum. Molec. Genet. 9: 413-419, 2000. PubMed ID: 10655551 3. Grimm, C.; Sporle, R.; Schmid, T. E.; Adler, I. -D.; Adamski, J.; Schughart, K.; Graw, J.: Isolation and embryonic expression of the novel mouse gene Hic1, the homologue of HIC1, a candidate gene for the Miller-Dieker syndrome. Hum. Molec. Genet. 8: 697-710, 1999.

Further studies establishing the function and utilities of HIC1 are found in John Hopkins OMIM database record ID 603825, and in references numbered 840-843 listed hereinbelow.

Referring now to HIRA BINDING SITE. HIR (histone cell cycle regulation defective, S. cerevisiae) homolog A (HIRA) is a target gene of GAM26, corresponding to GAM26-TARGET GENE of FIG. 26A. HIRA BINDING SITE is a binding site found in an untranslated region of HIRA, corresponding to BINDING SITE of FIG. 26A. FIG. 26D illustrates the complementarity of the nucleotide sequence of BINDING SITE, designated SEQ ID:195839, to the nucleotide sequence of GAM26 RNA of FIG. 26A, designated SEQ ID:20604.

A further function of GAM26 is therefore inhibition of HIR (histone cell cycle regulation defective, S. cerevisiae) homolog A (HIRA), a gene which encodes a transcription factor that could have a part in mechanisms of transcriptional regulation similar to that played by yeast hir1 and hir2 together and is associate with DiGeorge syndrome. Accordingly, utilities of GAM26 include diagnosis and treatment of the abovementioned diseases and clinical conditions. The function and utilities of HIRA have been established by previous studies, as described hereinabove with to FIG. 26D.

Referring now to HIRA BINDING SITE. HIR (histone cell cycle regulation defective, S. cerevisiae) homolog A (HIRA) is a target gene of GAM26, corresponding to GAM26-TARGET GENE of FIG. 26A. HIRA BINDING SITE is a binding site found in an translated region of HIRA, corresponding to BINDING SITE of FIG. 26A. FIG. 26D illustrates the complementarity of the nucleotide sequence of HIRA BINDING SITE, designated SEQ ID:195850, to the nucleotide sequence of GAM26 RNA of FIG. 26A, designated SEQ ID:20604.

Yet a further function of GAM26 is therefore inhibition of HIR (histone cell cycle regulation defective, S. cerevisiae) homolog A (HIRA), a gene which encodes a transcription factor that could have a part in mechanisms of transcriptional regulation similar to that played by yeast hir1 and hir2 together, and is associated with DiGeorge syndrome. Accordingly, utilities of GAM26 include diagnosis and treatment of the abovementioned diseases and clinical conditions. The function and utilities of HIRA have been established by previous studies, as described hereinabove with reference to FIG. 26D.

Reference is now made to HMGA2 BINDING SITE (HMGA2) is a target gene of GAM26, corresponding to GAM26-TARGET GENE of FIG. 26A. HMGA2 BINDING SITE is a binding site found in an untranslated region of HMGA2, corresponding to BINDING SITE of FIG. 26A. FIG. 26D illustrates the complementarity of the nucleotide sequence of HMGA2 BINDING SITE, designated SEQ ID:197765, to the nucleotide sequence of GAM26 RNA of FIG. 26A, designated SEQ ID:20604.

Another function of GAM26 is therefore inhibition of (HMGA2), a gene which encodes a transcription factor that may affect transcription and cell differentiation; shares common DNA-binding motif with other HMG HMG I/Y family members, and is associated with lipoma. Accordingly, utilities of GAM26 include diagnosis and treatment of the abovementioned diseases and clinical conditions.

The function of HMGA2 has been established by previous studies. Ashar et al. (1995) considered the HMGIC gene a good candidate for involvement in lipoma for several reasons, including the facts that it encodes a transcriptional regulating factor, that the pygmy mouse had disproportionately less fat than normal litter mates, and that the mouse gene maps to a region of chromosome 10 with homology of synteny to human 12q14q15. Therefore, they cloned the human gene and investigated its possible role in lipomas. In FISH studies, Ashar et al. (1995) found apparent deletion of the 3-prime end of the HMGIC gene in translocations associated with lipoma. Chimeric transcripts were isolated from 2 lipomas in which HMGIC DNA-binding domains (AT hook motifs) were fused to either a LIM or an acidic transactivator domain. The identification of a gene rearranged in a benign neoplastic process suggests a role for HMGIC in adipogenesis and mesenchymal differentiation.

Animal model experiments lend further support to the function of HMGA2. To evaluate the role of the HMGIC component in the development of lipoma, Arlotta et al. (2000) expressed the DNA-binding domains of HMGIC in transgenic mice. Despite the ubiquitous expression of the truncated HMGIC protein, the transgenic mice developed a selective abundance of fat tissue early in life, showed marked adipose tissue inflammation, and had an abnormally high incidence of lipomas. These findings demonstrated that the DNA-binding domain of HMGIC, in the absence of a C-terminal fusion partner, are sufficient to perturb adipogenesis and predispose lipomas.

It is appreciated that the abovementioned animal model for HMGA2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Ashar, H. R.; Schoenberg Fejzo, M.; Tkachenko, A.; Zhou, X.; Fletcher, J. A.; Weremowicz, S.; Morton, C. C.; Chada, K.: Disruption of the architectural factor HMGI-C: DNA-binding AT hook motifs fused in lipomas to distinct transcriptional regulatory domains. Cell 82: 57-65, 1995. PubMed ID: 7606786 2. Arlotta, P.; Tai, A. K. -F.; Manfioletti, G.; Clifford, C.; Jay, G.; Ono, S. J.: Transgenic mice expressing a truncated form of the high mobility group I-C protein develop adiposity and an abnormally high prevalence of lipomas. J. Biol. Chem. 275: 14394-4400, 2000.

Further studies establishing the function and utilities of HMGA2 are found in John Hopkins OMIM database record ID 600698, and in references numbered 844-862 listed hereinbelow.

Referring now to HMGA2 BINDING (HMGA2) is a target gene of GAM26, corresponding to GAM26-TARGET GENE of FIG. 26A. HMGA2 BINDING SITE is a binding site found in an untranslated region of HMGA2, corresponding to BINDING SITE of FIG. 26A. FIG. 26D illustrates the complementarity of the nucleotide sequence of HMGA2 BINDING SITE, designated SEQ ID:197853, to the nucleotide sequence of GAM26 RNA of FIG. 26A, designated SEQ ID:20604.

Yet another function of GAM26 is therefore inhibition of (HMGA2), a gene which encodes a transcription factor that may affect transcription and cell differentiation; shares common DNA-binding motif with other HMG HMG I/Y family members and is associated with lipoma. Accordingly, utilities of GAM26 include diagnosis and treatment of the abovementioned diseases and clinical conditions. The function and utilities of HMGA2 have been established by previous studies, as described hereinabove with reference to FIG. 26D.

Reference is now made to HPCAL1 BINDING SITE. Hippocalcin-like 1 (HPCAL1) is a target gene of GAM26, corresponding to GAM26-TARGET GENE of FIG. 26A. HPCAL1 BINDING SITE is a binding site found in an untranslated region of HPCAL1, corresponding to BINDING SITE of FIG. 26A. FIG. 26D illustrates the complementarity of the nucleotide sequence of HPCAL1 BINDING SITE, designated SEQ ID:201019, to the nucleotide sequence of GAM26 RNA of FIG. 26A, designated SEQ ID:20604.

An additional function of GAM26 is therefore inhibition of hippocalcin-like 1 (HPCAL1), a gene which encodes a protein that is a neuron-specific Ca(2+)-binding proteins. Accordingly, utilities of GAM26 include diagnosis and treatment of the abovementioned diseases and clinical conditions.

The function of HPCAL1 has been established by previous studies. Hippocalcin-like-1 is a member of a family of neuron-specific Ca(2+)-binding proteins found in the retina and brain. Using rat hippocalcin (142622) cDNA as a probe in the screening of a human hippocampus cDNA library under low stringency conditions, Kobayashi et al. (1994) isolated a clone that encoded a novel calcium-binding protein structurally related to hippocalcin. They showed that this hippocalcin-like protein has a primary structure of 193 amino acids and contains 3 EF-hand structures and a possible NH2-terminal myristoylation site. A single transcript of 1.7 kb was detected only in the brain.

Full details of the abovementioned studies are described in the following publications, the disclosure of which are hereby incorporated by reference:

Kobayashi, M.; Takamatsu, K.; Fujishiro, M.; Saitoh, S.; Noguchi, T.: Molecular cloning of a novel calcium-binding protein structurally related to hippocalcin from human brain and chromosomal mapping of its gene. Biochim. Biophys. Acta 1222: 515-518, 1994.

Further studies establishing the function and utilities of HPCAL1 are found in John Hopkins OMIM record ID 600207, and in references numbered 863 listed hereinbelow.

Reference is now made to HRB BINDING SITE. HIV-1 Rev binding protein (HRB) is a target gene of GAM26, corresponding to GAM26-TARGET GENE of FIG. 26A. HRB BINDING SITE is a binding site found in an untranslated region of HRB, corresponding to BINDING SITE of FIG. 26A. FIG. 26D illustrates the complementarity of the nucleotide sequence of HRB BINDING SITE, designated SEQ ID:201812, to the nucleotide sequence of GAM26 RNA of FIG. 26A, designated SEQ ID:20604.

A further function of GAM26 is therefore inhibition of HIV-1 Rev binding protein (HRB), a gene which encodes a protein that may function as a cofactor for the Rev/Rex class of RNA export factors. Accordingly, utilities of GAM26 include diagnosis and treatment of the abovementioned diseases and clinical conditions.

The function of HRB has been established by previous studies. Fritz et al. (1995) reported the isolation of a gene they designated 'Rev-interacting protein' (RIP). The cDNA was isolated using the yeast 2-hybrid screening system in a study to identify proteins that interact with the Rev protein of HIV-1 and which thereby assist in HIV replication. A partial clone from the initial screen was used to obtain a full-length 2.4-kb RIP cDNA. The authors found that the predicted 562-amino acid protein is related to the nucleoporins (e.g., 114350), a class of proteins that mediate nucleocytoplasmic transport. The protein was detected in the nuclear extract of HeLa cells and by immunofluorescence on the nuclear surface. Expression studies showed that recombinant RIP did indeed lead to increased Rev activity Salcini et al. (1997) reported that both the RAB and RABR (604018) proteins bind to the EH protein-protein interaction domain found in EPS15 (600051) and other proteins. Coimmunoprecipitation studies demonstrated that RAB and EPS15 are associated in vivo.

Animal model experiments lend further support to the function of HRB. Kang-Decker et al. (2001) generated mice deficient in HRB by targeted disruption. Male mice with a null mutation in Hrb were infertile and displayed round-headed spermatozoa that lacked an acrosome. In wildtype spermatids, Hrb was associated with the cytosolic surface of proacrosomic transport vesicles that fuse to create a single large acrosomic vesicle at step 3 of spermiogenesis. Although proacrosomic vesicles for in spermatids that lack Hrb, the vesicles are unable to fuse, blocking acrosome development at step 2. Kang-Decker et al. (2001) concluded that HRB is required for docking and/or fusion of proacrosomic vesicles during acrosome biogenesis.

It is appreciated that the abovementioned animal model for HRB is acknowledged by those skilled in the art as a scientifically valid animal model, as can be further appreciated from the publications sited hereinbelow.

Full details of the abovementioned studies are described in the following publications, the disclosure of which are hereby incorporated by reference:

Jones, T.; Sheer, D.; Bevec, D.; Kappel, B.; Hauber, J.; Steinkasserer, A.: The human HIV-1 Rev binding-protein hRIP/Rab (HRB) maps to chromosome 2q36. Genomics 40: 198-199, 1997. PubMed ID: 9070945 4. Kang-Decker, N.; Mantchev, G. T.; Juneja, S. C.; McNiven, M. A.; van Deursen, J. M. A.: Lack of acrosome formation in Hrb-deficient mice. Science 294: 1531-1533, 2001.

Further studies establishing the function and utilities of HRB are found in John Hopkins OMIM database record ID 600862, and in references numbered 864-868 listed hereinbelow.

Reference is now made to HS3ST3B1 BINDING SITE. heparan sulfate (glucosamine) 3-O-sulfotransferase 3B1 (HS3ST3B1) is a target gene of GAM26, corresponding to GAM26-TARGET GENE of FIG. 26A. HS3ST3B1 BINDING SITE is a binding site found in an untranslated region of HS3ST3B1, corresponding to BINDING SITE of FIG. 26A. FIG. 26D illustrates the complementarity of the nucleotide sequence of HS3ST3B1 BINDING SITE, designated SEQ ID:202532, to the nucleotide sequence of GAM26 RNA of FIG. 26A, designated SEQ ID:20604.

Yet a further function of GAM26 is therefore inhibition of heparan sulfate (glucosamine) 3-O-sulfotransferase 3B1 (HS3ST3B1), a gene which encodes an enzyme that plays a role in the generation of heparan sulfate proteoglycan. Accordingly, utilities of GAM26 include diagnosis and treatment of the abovementioned diseases and clinical conditions.

The function of HS3ST3B1 has been established by previous studies. Heparan sulfate biosynthetic enzymes are key components in generating a myriad of distinct heparan sulfate fine structures that carry out multiple biologic activities. The heparan sulfate D-glucosaminyl 3-O-sulfotransferases (3OSTs) place the rare 3-O-sulfate group in various sequence contexts. See 3OST2 (604056). Shworak et al. (1999) isolated cDNAs encoding 3OST2, 3OST3A1 (604057), 3OST3B1, and 3OST4 (604059). Like 3OST2 and 3OST3A1, the predicted 390-amino acid 3OST3B1 protein is a type II integral membrane protein. Although the 3OST2 and 3OST3 enzymes have a similar regional organization, the homology between them is limited to their C-terminal sulfotransferase domains. In a companion paper, Liu et al. (1999) demonstrated that the 3OST3A and 3OST3B isoforms sulfate an identical disaccharide. By Southern blot analysis, Shworak et al. (1999) determined that the human genome contains 2 copies of the 3OST3A1 and 3OST3B1 genes; they named the duplicate genes 3OST3A2 and 3OST3B2. Northern blot analysis revealed that the 3OST3B gene was widely expressed as multiple transcripts, with the most abundant expression in liver and placenta. Using an interspecific backcross, Shworak et al. (1999) found that the mouse 3Ost3A and 3Ost3B genes are tightly linked on chromosome 11, suggesting that the 2 genes arose by a tandem duplication. By inclusion within mapped clones, the mapped the human 3OST3A1 and 3OST3B1 genes to 17p12-p11.2.

Full details of the abovementioned studies are described in the following publications, the disclosure of which are hereby incorporated by reference:

Liu, J.; Shworak N. W.; Sinay, P.; Schwartz, J. J.; Zhang, L.; Fritze, L. M.; Rosenberg, R. D.: Expression of heparan sulfate D-glucosaminyl 3-O-sulfotransferase isoforms reveals novel substrate specificities. J. Biol. Chem. 274: 5185-5192, 1999. PubMed ID: 9988768 Shworak, N. W.; Liu, J.; Petros, L. M.; Zhang, L.; Kobayashi, M.; Copeland, N. G.; Jenkins, N. A.; Rosenberg, R. D.: Multiple isoforms of heparan sulfate D-glucosaminyl 3-O-sulfotransferase: isolation, characterization, and expression of human cDNAs and identification of distinct genomic loci. J. Biol. Chem. 274: 5170-5184, 1999.

Further studies establishing the function and utilities of HS3ST3B1 are found in John Hopkins OMIM database record ID 604058, and in references numbered 869-870 listed hereinbelow.

Reference is now made to ING1L BINDING SITE. Inhibitor of growth family, member 1-like (ING1L) is a target gene of GAM26, corresponding to GAM26-TARGET GENE of FIG. 26A. ING1L BINDING SITE is a binding site found in an untranslated region of ING1L, corresponding to BINDING SITE of FIG. 26A. FIG. 26D illustrates the complementarity of the nucleotide sequence of ING1L BINDING SITE, designated SEQ ID:213784, to the nucleotide sequence of GAM26 RNA of FIG. 26A, designated SEQ ID:20604.

Another function of GAM26 is therefore inhibition of inhibitor of growth family, member 1-like (ING1L), a gene which encodes a protein that may interfere with signals transmitted through p53 and p33 (ING1), and is associated with colon tumors and hepatocellular carcinoma. Accordingly, utilities of GAM26 include diagnosis and treatment of the abovementioned diseases and clinical conditions.

The function of ING1L has been established by previous studies. The ING1 gene (601566) encodes a putative tumor suppressor. By searching a human EST database for cDNAs with sequence similarity to ING1, Shimada et al. (1998) identified a partial ING1-like (ING1L) cDNA. Using this partial cDNA, they isolated a full-length human fetal brain ING1L cDNA. The deduced 280-amino acid ING1L protein shares 58.9% sequence identity with ING1. ING1L contains a C-terminal PHD-type zinc finger domain. The PHD zinc finger was first identified in 2 closely related plant homeodomain-containing proteins. It is a cys4-his-cys3 (C4HC3)-type motif spanning 50 to 80 amino acids. PHD zinc fingers have been found in a number of proteins implicated in chromatin-mediated transcriptional control. Northern blot analysis of normal human tissues detected ubiquitous expression of 1.3- and 1.5-kb ING1L transcripts. The authors found that ING1L expression was significantly higher in colon tumors than in the adjacent normal colon tissue. Nagashima et al. (2001) cloned ING1L, which they termed p33ING2. Western blot analysis showed ubiquitous but variable expression of ING1, while p33ING2 expression was highly variable or absent in many cell lines. Highest expression of p33ING2 occurred in cell lines with null or mutant p53 (191170). The DNA-damaging agents etoposide and neocarzinostatin induced expression of p33ING2 but not ING1. Like ING1, p33ING2 was found to negatively regulate cell growth and survival in a p53-dependent manner through the induction of G1-phase cell-cycle arrest and apoptosis. p33ING2 enhanced the transcriptional transactivation activity of p53 and increased the acetylation of p53 at lys382. Western blot analysis detected ING1 but not p33ING2 in p53 immunoprecipitates. Nagashima et al. (2001) concluded that p33ING2 is a DNA damage-inducible gene that negatively regulates cell proliferation through activation of p53 by enhancing its acetylation.

Full details of the abovementioned studies are described in the following publications, the disclosure of which are hereby incorporated by reference:

Nagashima, M.; Shiseki, M.; Miura, K.; Hagiwara, K.; Linke, S. P.; Pedeux, R.; Wang, X. W.; Yokota, J.; Riabowol, K.; Harris, C. C.: DNA damage-inducible gene p33ING2 negatively regulates cell proliferation through acetylation of p53. Proc. Nat. Acad. Sci. 98: 9671-9676, 2001. PubMed ID: 11481424 2. Shimada, Y.; Saito, A.; Suzuki, M.; Takahashi, E.; Horie, M.: Cloning of a novel gene (ING1L) homologous to ING1, a candidate tumor suppressor. Cytogenet Cell Genet. 83: 232-235, 1998.

Further studies establishing the function and utilities of ING1L are found in John Hopkins OMIM database record ID 604215, and in references numbered 871-872 listed hereinbelow.

Referring now to ING1L BINDING SITE. Inhibitor of growth family, member 1-like (ING1L) is a target gene of GAM26, corresponding to GAM26-TARGET GENE of FIG. 26A. ING1L BINDING SITE is a binding site found in an untranslated region of ING1L, corresponding to BINDING SITE of FIG. 26A. FIG. 26D illustrates the complementarity of the nucleotide sequence of ING1L BINDING SITE, designated SEQ ID:213788, to the nucleotide sequence of GAM26 RNA of FIG. 26A, designated SEQ ID:20604.

Yet another function of GAM26 is therefore inhibition of inhibitor of growth family, member 1-like (ING1L), a gene which encodes a protein that may interfer with signals transmitted through p53 and p33 (ING1), and is associated with colon tumors and hepatocellular carcinoma. Accordingly, utilities of GAM26 include diagnosis and treatment of the abovementioned diseases and clinical conditions. The function and utilities of ING1L have been established by previous studies, as described hereinabove with reference to FIG. 26D.

Referring now to IRS1 BINDING SITE. Insulin receptor substrate 1 (IRS1) is a target gene GAM26, corresponding to GAM26-TARGET GENE of FIG. 26A. IRS1 BINDING SITE a binding site found in an untranslated region of IRS1, corresponding to BINDING SITE of FIG. 26A. FIG. 26D illustrates the complementarity of the nucleotide sequence of IRS1 BINDING SITE, designated SEQ ID:215707, to the nucleotide sequence of GAM26 RNA of FIG. 26A, designated SEQ ID:20604.

An additional function of GAM26 is therefore inhibition of insulin receptor substrate 1 (IRS1), a gene which encodes a receptor that may mediate the control of various cellular processes by insulin and is associated with DIABETES MELLITUS, TYPE II. Accordingly, utilities of GAM26 include diagnosis and treatment of the abovementioned diseases and clinical conditions. The function and utilities of IRS1 have been established by previous studies, as described hereinabove with reference to FIG. 26D.

Reference is now made to KCNA6 BINDING SITE. Potassium voltage-gated channel, shaker-related subfamily, member 6 (KCNA6) is a target gene of GAM26, corresponding to GAM26-TARGET GENE of FIG. 26. KCNA6 BINDING SITE is a binding site found in an untranslated region of KCNA6, corresponding to BINDING SITE of FIG. 26A. FIG. 26D illustrates the complementarity of the nucleotide sequence of KCNA6 BINDING SITE, designated SEQ ID:221336, to the nucleotide sequence of GAM26 RNA of FIG. 26A, designated SEQ ID:20604.

A further function of GAM26 is therefore inhibition of potassium voltage-gated channel, shaker-related subfamily, member 6 (KCNA6), a gene which encodes a protein that mediates the voltage-dependent potassium ion permeability of excitable membranes. Accordingly, utilities of GAM26 include diagnosis and treatment of the abovementioned diseases and clinical conditions.

The function of KCNA6 has been established by previous studies. By screening a human fetal cDNA library with a rat RCK3 potassium channel cDNA, Grupe et al. (1990) isolated cDNAs encoding a protein that they designated HBK2 (human brain potassium channel-2). The authors also cloned cDNAs corresponding to the rat homolog, RCK2. The predicted 52-amino acid HBK2 protein shares 94% identity with RCK2. HBK2 and RCK2 have the characteristic structure of voltage-gated ionic channels, with 6 potential membrane-spanning segments. When expressed in Xenopus oocytes, the HBK2/RCK2 channels exhibited the functional characteristics of a delayed-rectifier channel that acts especial in the more positive membrane voltage range. The functional and pharmacologic properties of HBK2/RCK2 potassium channels were distinct from those of previously characterized channels. Grupe et al. (1990) determined that the HBK2 gene did not contain introns. Using interspecific backcrosses between Mus musculus and Mus spretus, Klocke et al. (1993) mapped the mouse gene encoding the Kv1.6 potassium voltage-gated channel, Kcna6, to chromosome 6 in a cluster with Kcna1, Kcna5 (176267), and the homolog of human TPI1 (190450). Since human TPI1 is located on band 12p13, Klocke et al. (1993) predicted that the human KCNA6 gene is located on 12p near other genes of the Shaker-related subfamily, KCNA1 and 5. Albrecht et al. (1995) determined that a 300-kb cluster on chromosome 12p13 contains the human KCNA6, KCNA1, and KCNA5 genes arranged in tandem Full details of the abovementioned studies are described in the following publications, the disclosure of which are hereby incorporated by reference:

Albrecht, B.; Weber, K.; Pongs, O.: Characterization of a voltage-activated K-channel gene cluster on human chromosome 12p13. Receptors Channels 3: 213-220, 1995. PubMed ID: 8821794 2. Grupe, A.; Schroter, K. H.; Ruppersberg, J. P.; Stocker, M.; Drewes, T.; Beckh, S.; Pongs, O.: Cloning and expression of a human voltage-gated potassium channel: a novel member of the RCK potassium channel family. EMBO J. 9: 1749-1756, 1990.

Further studies establishing the function and utilities KCNA6 are found in John Hopkins OMIM database record ID 176257, and in references numbered 873-875 listed hereinbelow.

Reference is now made to KCNA7 BINDING SITE. Potassium voltage-gated channel, shaker-related subfamily, member 7 (KCNA7) is a target gene of GAM26, corresponding to GAM26-TARGET GENE of FIG. 26. KCNA7 BINDING SITE is a binding site found in an untranslated region of KCNA7, corresponding to BINDING SITE of FIG. 26A. FIG. 26D illustrates the complementarity of the nucleotide sequence of KCNA7 BINDING SITE, designated SEQ ID:221548, to the nucleotide sequence of GAM26 RNA of FIG. 26A, designated SEQ ID:20604.

Yet a further function of GAM26 is therefore inhibition of potassium voltage-gated channel, shaker-related subfamily, member 7 (KCNA7), a gene which encodes a protein allows nerve cells to efficiently repolarize following an action potential. Accordingly, utilities of GAM26 include diagnosis treatment of the abovementioned diseases and clinical conditions.

The function of KCNA7 has been established by previous studies. See 176260 for a general discussion of potassium voltage-gated ion channels. Using a probe from the mouse in the study of somatic cell hybrids, McPherson et al. (1991) found that a seventh member of the Shaker-related potassium voltage-gated channel is encoded by a gene on chromosome 19. Kalman et al. (1998) reported the isolation of the mouse voltage-gated Shaker-related potassium channel gene, Kv1.7 (Kcna7). Unlike other known Kv1 family genes that have intronless coding regions, the protein-coding region of Kv1.7 was interrupted by 1.9-kb intron. The gene was mapped to mouse chromosome 7 and human chromosome 19q13.3. The mouse Kv1.7 channel was voltage-dependent and exhibited cumulative inactivation. Northern blot analysis revealed transcripts of approximately 3 kb in mouse heart and skeletal muscle. Bardien Kruger et al. (2002) deduced the coding region of KCNA7 by aligning the mouse cDNA sequence with a human BAC clone and mouse EST sequences. The region encodes a protein of 456 amino acid residues containing cytoplasmic N- and C-termini, a central core domain composed of 6 transmembrane segments and the characteristic pore-loop. The human intron was 1153 bp in length and smaller than that of mouse (1929 bp). Using the deduced amino acid sequences, the potassium-channels of the 2 species were highly conserved (greater than 95%). The expression of KCNA7 in human adult heart was confirmed by RT-PCR studies. Bardien-Kruger et al. (2002) refined the location of the KCNA7 gene within chromosome 19q13.3 by bioinformatic in silico mapping and implicated it as a positional candidate gene for progressive familial heart block type I (604559), an autosomal dominant cardiac conduction disorder mapped to 19q13.3. In affected individuals, Bardien-Kruger et al. (2002) screened the coding region of KCNA7 by PCR-SSCP analysis and direct DNA sequencing, which did not reveal any pathogenic sequence changes Full details of the abovementioned studies are described in the following publications, the disclosure of which are hereby incorporated by reference:

Bardien-Kruger, S.; Wulff, H.; Arieff, Z.; Brink, P.; Chandy, K. G.; Corfield, V.: Characterisation of the human voltage-gated potassium channel gene, KCNA7, a candidate gene for inherited cardiac disorders, and its exclusion as cause of progressive familial heart block I (PFHBI). Europ. J. Hum. Genet. 10: 36-43, 2002. PubMed ID: 11896454 2. Kalman, K.; Nguyen, A.; Tseng-Crank, J.; Dukes, I. D.; Chandy, G.; Hustad, C. M.; Copeland, N. G.; Jenkins, N. A.; Mohrenweiser, H.; Brandriff, B.; Cahalan, M.; Gutman, G. A.; Chandy, K. G.: Genomic organization, chromosomal localization, tissue distribution, and biophysical characterization of a novel mammalian Shaker-related voltage-gated potassium channel, Kv1.7. J. Biol. Chem. 273: 5851-5857, 1998.

Further studies establishing the function and utilities of KCNA7 are found in John Hopkins OMIM database record ID 176268, and in references numbered 876-878 listed hereinbelow.

Referring now to KCNA7 BINDING SITE. Potassium voltage-gated channel, shaker-related subfamily, member 7 (KCNA7) is a target gene of GAM26, corresponding to GAM26-TARGET GENE of FIG. 26A. KCNA7 BINDING SITE is a binding site found in an untranslated region of KCNA7, corresponding to BINDING SITE of FIG. 26A. FIG. 26D illustrates the complementarity of the nucleotide sequence of KCNA7 BINDING SITE, designated SEQ ID:221616, to the nucleotide sequence of GAM26 RNA of FIG. 26A, designated SEQ ID:20604.

Another function of GAM26 is therefore inhibition of potassium voltage-gated channel, shaker-related subfamily, member 7 (KCNA7), a gene which encodes a protein that allows nerve cells to efficiently repolarize following an action potential. Accordingly, utilities of GAM26 include diagnosis and treatment of the abovementioned diseases and clinical conditions. The function and utilities of KCNA7 have been established by previous studies, as described hereinabove with reference to FIG. 26D.

Referring now to KCNA7 BINDING SITE. Potassium voltage-gated channel, shaker-related subfamily, member 7 (KCNA7) is a target gene of GAM26, corresponding to GAM26-TARGET GENE of FIG. 26A. KCNA7 BINDING SITE is a binding site found in an untranslated region of KCNA7, corresponding to BINDING SITE of FIG. 26A. FIG. 26D illustrates the complementarity of the nucleotide sequence of KCNA7 BINDING SITE, designated SEQ ID:221618, to the nucleotide sequence of GAM26 RNA of FIG. 26A, designated SEQ ID:20664.

Yet another function of GAM26 is therefore inhibition of potassium voltage-gated channel, shaker-related subfamily, member 7 (KCNA7), a gene which encodes a protein that allows nerve cells to efficiently repolarize following an action potential. Accordingly, utilities of GAM26 include diagnosis and treatment of the abovementioned diseases and clinical conditions. The function and utilities of KCNA7 have been established by previous studies, as described hereinabove, with reference to FIG. 26D.

Reference is now made to KCNF1 BINDING SITE. Potassium voltage-gated channel, subfamily F, member 1 (KCNF1) is a target gene of GAM26, corresponding to GAM26-TARGET GENE of FIG. 26A. KCNF1 BINDING SITE is a binding site found in an untranslated region of KCNF1, corresponding to BINDING SITE of FIG. 26A. FIG. 26D illustrates the complementarity of the nucleotide sequence of KCNF1 BINDING SITE, designated SEQ ID:222269, to the nucleotide sequence of GAM26 RNA of FIG. 26A, designated SEQ ID:20604.

An additional function of GAM26 is therefore inhibition of potassium voltage-gated channel, subfamily F, member 1 (KCNF1), a gene which encodes a protein that mediates the voltage-dependent potassium ion permeability of excitable membranes. Accordingly, utilities of GAM26 include diagnosis and treatment of the abovementioned diseases and clinical conditions.

The function of KCNF1 has been established by previous studies. Voltage-gated potassium channels are a family of plasma membrane proteins containing 6 putative transmembrane domains. See KCNA1 (176260). Su et al. (1997) identified ESTs encoding 2 novel putative potassium channels, KH1 and KH2 (603788). By screening a fetal brain library with a probe derived from the KH1 EST, they isolated cDNAs corresponding to the entire KH1 coding region. The KH1 gene shares 88% nucleotide homology with a rat potassium channel gene, IK8. The predicted 495-amino acid human protein contains 6 putative transmembrane domains. Northern blot analysis revealed that KH1 was expressed as a 5-kb mRNA in all tissues tested, with the highest levels in heart. A 2.4 kb transcript was detected only in brain. By fluorescence in situ hybridization, Su et al. (1997) mapped the KCNF1 gene to 2p25

Full details of the abovementioned studies are described in the following publications, the disclosure of which are hereby incorporated by reference:

u, K.; Kyaw, H.; Fan, P.; Zeng, Z.; Shell, B. K.; Carter, K. C.; Li, Y.: Isolation, characterization and mapping of two human potassium channels. Biochem. Biophys. Res. Commun. 241: 675-681, 1997.

Further studies establishing the function and utilities of KCNF1 are found in John Hopkins OMIM database record ID 603787, and in references numbered 879 listed hereinbelow.

Reference is now made to KCNK3 BINDING SITE. Potassium channel, subfamily K, member 3 (TASK-1) (KCNK3) is a target gene of GAM26, corresponding to GAM26-TARGET GENE of FIG. 26A. KCNK3 BINDING SITE is a binding site found in an untranslated region of KCNK3, corresponding to BINDING SITE of FIG. 26A. FIG. 26D illustrates the complementarity of the nucleotide sequence of KCNK3 BINDING SITE, designated SEQ ID:223599, to the nucleotide sequence of GAM26 RNA of FIG. 26, designated SEQ ID:20604.

A further function of GAM26 is therefore inhibition of potassium channel, subfamily K, member 3 (TASK-1) (KCNK3), a gene which encodes a protein that is a ph-dependent, voltage-insensitive, background potassium channel. Accordingly, utilities of GAM26 include diagnosis and treatment of the abovementioned diseases and clinical conditions.

The function of KCNK3 has been established by previous studies. Potassium channels are ubiquitous multisubunit membrane proteins that regulate membrane potential in numerous cell types. One family of mammalian K+ channels is characterized by the presence of 4 transmembrane domains and 2 P domains per subunit; this family includes TASK, TWIK (KCNK1; 601745), and TREK (KCNK2; 603219). Duprat et al. (1997) identified mouse expressed sequence tags with similarity to TREK and TWIK and cloned a corresponding cDNA from a mouse bra library. The mouse cDNA was used to clone the human counterpart from a kidney cDNA library. The human cDNA, designated TASK encodes a 394-amino acid polypeptide with 85% identity to the mouse ortholog. The sequence contains consensus sites for N-linked glycosylation and for phosphorylation at the C-terminal. Northern blot analysis showed that TASK is expressed in a variety of human tissues, with highest levels in pancreas and placenta. Expression of the TASK cDNA revealed that the functional protein creates currents that are K(+)-selective, instantaneous, and noninactivating. These currents showed an outward rectification when external K+ was low, but evinced absence of activation and inactivation kinetics as well as voltage independence, characteristics of so-called leak or background conductance. TASK currents were very sensitive to small changes in extracellular pH, suggesting that TASK has a role in cellular responses to changes in extracellular pH. Lesage and Lazdunski (1998) used a radiation hybrid mapping panel to map the human KCNK3 gene to chromosome 2p23 between markers WI13615 and WI11298. By fluorescene in situ hybridization, Manjunath et al. (1999) mapped the KCNK3 gene to 2p24.1-p23.3 and the mouse homolog to chromosome 5B.

Full details of the abovementioned studies are described in the following publications, the disclosure of which are hereby incorporated by reference:

Lesage, F.; Lazdunski, M.: Mapping of human potassium channel genes TREK-1 (KCNK2) and TASK (KCNK3) to chromosomes 1q41 and 2p23. Genomics 51: 478-479, 1998. PubMed ID: 9721223 3. Manjunath, N. A.; Bray-Ward, P.; Goldstein, S. A. N.; Gallagher, P. G.: Assignment of the 2P domain, acid-sensitive potassium channel OAT1 gene KCNK3 to human chromosome bands 2p24.1-p23.3 an murine 5B by in situ hybridization. Cytogenet. Cell Genet. 86: 242-243, 1999.

Further studies establishing the function and utilities of KCNK3 are found in John Hopkins OMIM database record ID 603220, and in references numbered 880-882 listed hereinbelow.

Referring now to KCNK3 BINDING SITE. Potassium channel, subfamily K, member 3 (TASK-1) (KCNK3) is a target gene of GAM26, corresponding to GAM26-TARGET GENE of FIG. 26A. KCNK3 BINDING SITE is a binding site found in an untranslated region of KCNK3, corresponding to BINDING SITE of FIG. 26A. FIG. 26D illustrates the complementarity of the nucleotide sequence of KCNK3 BINDING SITE, designated SEQ ID:223678, to the nucleotide sequence of GAM26 RNA of FIG. 26A, designated SEQ ID:20604.

Yet a further function of GAM26 is therefore inhibition of potassium channel, subfamily K, member 3 (TASK-1) (KCNK3), a gene which encodes a protein that is a ph-dependent voltage-insensitive, background potassium channel. Accordingly, utilities of GAM26 include diagnosis and treatment of the abovementioned diseases and clinical conditions. The function and utilities of KCNK3 have been established by previous studies, as described hereinabove with reference to FIG. 26D.

Referring now to KCNK3 BINDING SITE. Potassium channel, subfamily K, member 3 (TASK-1) (KCNK3) is a target gene of GAM26, corresponding to GAM26-TARGET GENE of FIG. 26A. KCNK3 BINDING SITE is a binding site found in an untranslated of KCNK3, corresponding to BINDING SITE of FIG. 26A. FIG. 26D illustrates the complementarity of the nucleotide sequence of KCNK3 BINDING SITE, designated SEQ ID:223685, to the nucleotide sequence of GAM26 RNA of FIG. 26A, designated SEQ ID:20604.

Another function of GAM26 is therefore inhibition of potassium channel, subfamily K, member 3 (TASK-1) (KCNK3), a gene which encodes a protein that is a ph-dependent, voltage-insensitive, background potassium channel. Accordingly, utilities of GAM26 include diagnosis and treatment of the abovementioned diseases and clinical conditions. The function and utilities of KCNK3 have been established by previous studies, as described hereinabove with reference to FIG. 26D.

Reference is now made to KCNMB4 BINDING SITE. Potassium large conductance calcium-activated channel, subfamily M, be (KCNMB4) is a target gene of GAM26, corresponding to GAM26-TARGET GENE of FIG. 26A. KCNMB4 BINDING SITE is a binding site found in an untranslated region of KCNMB4, corresponding to BINDING SITE of FIG. 26A. FIG. 26D illustrates the complementarity of the nucleotide sequence of KCNMB4 BINDING SITE, designated SEQ ID:224477, to the nucleotide sequence of GAM26 RNA of FIG. 26A, designated SEQ ID:20604.

Yet another function of GAM26 is therefore inhibition of potassium large conductance calcium-activated channel, subfamily M, be (KCNMB4), a gene which encodes a protein that regulates gating kinetics of slow K channels in a Ca-sensitive manner. Accordingly, utilities of GAM26 include diagnosis and treatment of the abovementioned diseases and clinical conditions.

The function of KCNMB4 has been established by previous studies. The large conductance, calcium-activated potassium (BK) channel is a member of the Shaker-related 6-transmembrane domain potassium channel superfamily that is sensitive to voltage and calcium. BK channels are composed of a pore-forming alpha subunit (KCNMA1, or HSLO; 600150) and, in some tissues, a beta subunit. The beta-1 subunit (KCNMB1; 603951) is expressed predominantly in smooth muscle cells, whereas the beta-2 subunit (KCNMB2; 605214) is expressed in endocrine tissue, such as adrenal chromaffin cells. By searching EST databases, Behrens et al. (2000) and Brenner et al. (2000) identified cDNAs encoding KCNMB4. Sequence analysis predicted that the 210-amino acid KCNMB4 protein contains 2 conserved transmembrane domains and an extracellular domain containing an N-glycosylation site and 4 cys residues; however, like KCNMB3 (605222), KCNMB4 lacks the putative charybdotoxin/iberiotoxin-binding site. RNA dot blot analysis by Behrens et al. (2000) revealed high and specific expression of KCNMB4 in central nervous system tissue, with no expression in nonneuronal tissue. Northern blot analysis by Behrens et al. (2000) and Brenner et al. (2000) detected major 1.9- and minor 3.0- and 6.1-kb KCNMB4 transcripts in all brain tissues. Functional analysis of the effects of KCNMB4 on KCNMA1 showed that KCNMB4 slows activation kinetics, leads to steeper calcium sensitivity, and shifts the voltage range of BK current activation to more negative potentials than does KCNMB1. KCNMA1/KCNMB4 channels were not blocked by charybdotoxin or iberiotoxin and were activated by 17-beta-estradiol (Behrens et al., 2000). By electronic PCR, Behrens et al. (2000) mapped the KCNMB4 gene to 12q14.1-q15

Full details of the abovementioned studies are described in the following publications, the disclosure of which are hereby incorporated by reference:

Behrens, R.; Nolting, A.; Reimann, F.; Schwarz, M.; Waldschutz, R.; Pongs, O.: hKCNMB3 and hKCNMB4, cloning and characterization of two members of the large-conductance calcium-activated potassium channel beta subunit family. FEBS Lett. 474: 99-106, 2000. PubMed ID:10828459 2. Brenner, R.; Jegla, T. J.; Wickenden, A.; Liu, Y.; Aldrich, R. W.: Cloning and functional characterization of novel large conductance calcium-activated potassium channel beta subunits, hKCNMB3 and hKCNMB4. J. Biol. Chem. 275: 6453-6461, 2000.

Further studies establishing the function and utilities of KCNMB4 are found in John Hopkins OMIM database record ID 605223, and references numbered 883-884 listed hereinbelow.

Referring now to KCNMB4 BINDING SITE. Potassium large conductance calcium-activated channel, subfamily M, be (KCNMB4) is a target gene of GAM26, corresponding to GAM26-TARGET GENE of FIG. 26A. KCNMB4 BINDING SITE is a binding site found in an untranslated region of KCNMB4, corresponding to BINDING SITE of FIG. 26A. FIG. 26D illustrates the complementarity of the nucleotide sequence of KCNMB4 BINDING SITE, designated SEQ ID:224480, to the nucleotide sequence of GAM26 RNA of FIG. 26A, designated SEQ ID:20604.

An additional function of GAM26 is therefore inhibition of potassium large conductance calcium-activated channel, subfamily M, be (KCNMB4), a gene which encodes a protein that regulates gating kinetics of slow K channels in a Ca-sensitive manner. Accordingly, utilities of GAM26 include diagnosis and treatment of the abovementioned diseases and clinical conditions. The function and utilities of KCNMB4 have been established by previous studies, as described hereinabove to FIG. 26D.

Reference is now made to KCNS2 BINDING SITE. Potassium voltage-gated channel, delayed-rectifier, subfamily S, membe (KCNS2) is a target gene of GAM26, corresponding to GAM26-TARGET GENE of FIG. 26A. KCNS2 BINDING SITE is a binding site found in an untranslated region of KCNS2, corresponding to BINDING SITE of FIG. 26A. FIG. 26D illustrates the complementarity of the nucleotide sequence of KCNS2 BINDING SITE, designated SEQ ID:224998, to the nucleotide sequence of GAM26 RNA of FIG. 26A, designated SEQ ID:20604.

A further function of GAM26 is therefore inhibition of potassium voltage-gated channel, delayed-rectifier, subfamily S, membe (KCNS2), a gene which encodes a protein that mediates the voltage-dependent potassium ion permeability of excitable membranes. Accordingly, utilities of GAM26 include diagnosis and treatment of the abovementioned diseases and clinical conditions.

The function of KCNS2 has been established by previous studies. See KCNS1 (602905). By searching an expressed sequence tag (EST) database with the peptide sequence of the silent Kv8.1 alpha subunit, Salinas et al. (1997) identified human cDNAs encoding KCNS2, which they called Kv9.2. Using these ESTs, the authors isolated a mouse Kcns2 cDNA from a brain cDNA library. The predicted 477-amino acid Kcns2 protein has all of the structural characteristics of an outward rectifier Kv alpha subunit, namely 6 transmembrane domains, a transmembrane region with 5 positively charged amino acids, and a conserved pore-forming region. Several putative phosphorylation sites are located in the cytoplasmic regions. Northern blot analysis showed that Kcns2 is expressed only in the brain. In situ hybridization detected high levels of Kcns2 mRNA in the olfactory bulb, cerebral cortex, hippocampal formation, habenula, basolateral amygdaloid nuclei, and cerebellum; expression was also found in the retina and spinal cord. Salinas et al. (1997) demonstrated that Kcns2 does not have potassium channel activity by itself but can modulate the activities of the Kv2.1 (see KCNB1; 600397) and Kv2.2 alpha subunits. By fluorescence in situ hybridization and radiation hybrid mapping, Banfi et al. (1996) mapped an EST (GenBank R19352) corresponding to the human KCNS2 gene (Salinas et al., 1997) to 8q22.

Full details of the abovementioned studies are described in the following publications, the disclosure of which are hereby incorporated by reference:

Banfi, S.; Borsani, G.; Rossi, E.; Bernard, L.; Guffanti, A.; Rubboli, F.; Marchitiello, A.; Giglio, S.; Coluccia, E.; Zollo, M.; Zuffardi, O.; Ballabio, A.: Identification and mapping of human cDNAs homologous to Drosophila mutant genes through EST database searching. Nature Genet. 13: 167-174, 1996. PubMed ID: 8640222 2. Salinas, M.; Duprat, F.; Heurteaux, C.; Hugnot, J. -P. Lazdunski, M.: New modulatory alpha subunits for mammalian Shab K(+) channels. J. Biol. Chem. 272: 24371-24379, 1997.

Further studies establishing the function and utilities of KCNS2 are found in John Hopkins OMIM database record ID 602906, and in references numbered 885-886 listed hereinbelow.

Reference is now made to KRAS2 BINDING SITE. V-Ki-ras2 Kirsten rat sarcoma 2 viral oncogene homolog (KRAS2) is a target gene of GAM26, corresponding to GAM26-TARGET GENE of FIG. 26A. KRAS2 BINDING SITE is a binding site found in an untranslated region of KRAS2, corresponding to BINDING SITE of FIG. 26A. FIG. 26D illustrates the complementarity of the nucleotide sequence of KRAS2 BINDING SITE, designated SEQ ID:229032, to the nucleotide sequence of GAM26 RNA of FIG. 26A, designated SEQ ID:20604.

Yet a further function of GAM26 is therefore inhibition of v-Ki-ras2 Kirsten rat sarcoma 2 viral oncogene homolog (KRAS2), a gene which encodes a protein that ras proteins bind gdp/gtp and possess intrinsic gtpase activity and is associated with LUNG CANCER and STOMACH CANCER. Accordingly, utilities of GAM26 include diagnosis and treatment of the abovementioned diseases and clinical conditions.

The function of KRAS2 has been established by previous studies. See 190020. KRAS2 is on chromosome 12; KRAS1P, a pseudogene, is on chromosome 6. Weinberg (1982) suggested that the then-recognized cellular oncogenes could be assigned to a small number of gene families; e.g., the ras family with at least 4 distinct oncogenes, and the src-yes-mos family with another 3. The probable role of at least 2 oncogenes in normal differentiation is indicated by the findings of transcription of KRAS and the McDonough strain of feline sarcoma virus (FMS) during mouse development (Muller et al., 1983). Furthermore, the differences in transcription in different tissues suggested a specific role for each: FMS was expressed in extraembryonic structures or in transport in these tissues, whereas KRAS was expressed ubiquitously. KRAS, with a length of more than 30 kb, is much larger than HRAS (190020) or NRAS (164790). Although the 3 ras genes, HRAS, KRAS, and NRAS, have different genetic structures, all code for proteins of 189 amino acid residues, generically designated p21. These genes acquire malignant properties by single point mutations that affect the incorporation of the 12th or 61st amino acid residue of their respective p21. KRAS is involved in malignancy much more often than is HRAS. In a study of 96 human tumors or tumor cell lines in the NIH 3T3 transforming system, Pulciani et al. (1982) found a mutated HRAS locus only in T24 bladder cancer cells, whereas transforming KRAS genes were identified in 8 different carcinomas and sarcomas. Holland et al. (2000) transferred, in a tissue-specific manner, genes encoding activated forms of Ras and Akt (164730) to astrocytes and neural progenitors in mice. Holland et al. (2000) found that although neither activated Ras nor Akt alone was sufficient to induce glioblastoma multiforme (GBM; 137800) formation, the combination of activated Ras and Akt induced high-grade gliomas with the histologic features of human GBMs. These tumors appeared to arise after gene transfer to neural progenitors, but not after transfer to differentiated astrocytes. Increased activity of RAS is found in many human GBMs, and Holland et al. (2000) demonstrated that Akt activity is increased in most of these tumors, implying that combined activation of these 2 pathways accurately models the biology of this disease. Bezieau et al. (2001) used ARMS (allele-specific amplification method) to evaluate the incidence of NRAS- and KRAS2-activating mutations in patients with multiple myeloma and related disorders. Mutations were more frequent in KRAS2 than in NRAS. The authors concluded that early mutations in these 2 oncogenes may play a major role in the oncogenesis of multiple myeloma and primary plasma cell leukemia. Rajagopalan et al. (2002) systematically evaluated mutation in BRAF (164757) and KRAS in 330 colorectal tumors. There were 32 mutations in BRAF, 28 with a V599E mutation (164757.0001) and 1 each with the R461I (164757.0002), I462S (164757.0003), G463E (164757.0004), or K600E (164757.0005) mutations. All but 2 mutations seemed to be heterozygous, and in all 20 cases for which normal tissue was available, the mutations were shown to be somatic. In the same set of tumors there were 169 mutations in KRAS. No tumor exhibited mutations in both BRAF and KRAS. There was also a striking difference in the frequency of BRAF mutations between cancers with and without mismatch repair deficiency. All but 1 of the 15 BRAF mutations identified in mismatch repair deficient cases resulted in a V599E substitution. Rajagopalan et al. (2002) concluded their results provide strong support for the hypothesis that BRAF and KRAS mutations are equivalent in their tumorigenic effects. Both genes seem to be mutated at a similar phase of tumorigenesis, after initiation but before malignant conversion. Moreover, no tumor concurrently contained both BRAF and KRAS mutations.

Animal model experiments lend further support to the function of KRAS2. Costa et al. (2002) crossed Nf1 heterozygote mice with mice heterozygous for a null mutation in the Kras gene and tested the Nf1 descendants. They found that the double heterozygotes with decreased Ras function had improved learning relative to Nf1 heterozygote mice. Costa et al. (2002) also showed that the Nf1 +/− mice have increased GABA-mediated inhibition and specific deficits in long-term potentiation, both of which can be reversed by decreasing Ras function. Costa et al. (2002) concluded that learning deficits associated with Nf1 may be caused by excessive Ras activity, which leads to impairments in long-term potentiation caused by increased GABA-mediated inhibition.

It is appreciated that the abovementioned animal model for KRAS2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Costa, R. M.; Federov, N. B.; Kogan, J. H.; Murphy, G. G.; Stern, J.; Ohno, M.; Kucherlapati, R.; Jacks, T.; Silva, A. J.: Mechanism for the learning deficits in a mouse model of neurofibromatosis type 1. Nature 415: 526-530, 2002. PubMed ID: 11793011 39. Rajagopalan, H.; Bardelli, A.; Lengauer, C.; Kinzler, K. W.; Vogelstein, B.; Velculescu, V. E.: RAF/RAS oncogenes and mismatch-repair status. (Letter) Nature 418: 934 only, 2002.

Further studies establishing the function and utilities of KRAS2 are found in John Hopkins OMIM database record ID 190070, and in references numbered 887-942 listed hereinbelow.

Referring now to KRAS2 BINDING SITE. V-Ki-ras2 Kirsten rat sarcoma 2 viral oncogene homolog (KRAS2) is a target gene of GAM26, corresponding to GAM26-TARGET GENE of FIG. 26A. KRAS2 BINDING SITE is a binding site found in an untranslated region of KRAS2, corresponding to BINDING SITE of FIG. 26A. FIG. 26D illustrates the complementarity of the nucleotide sequence of KRAS2 BINDING SITE, designated SEQ ID:229035, to the nucleotide sequence of GAM26 RNA of FIG. 26A, designated SEQ ID:20604.

Another function of GAM26 is therefore inhibition of v-Ki-ras2 Kirsten rat sarcoma 2 viral oncogene homolog (KRAS2), a gene which encodes a protein that ras proteins bind gdp/gtp and possess intrinsic gtpase activity and is associated with LUNG CANCER and STOMACH CANCER. Accordingly, utilities of GAM26 include diagnosis and treatment of the abovementioned diseases and clinical conditions. The function and utilities of KRAS2 have been established by previous studies, as described hereinabove with reference to FIG. 26D.

Referring now to KRAS2 BINDING SITE. V-Ki-ras2 Kirsten rat sarcoma 2 viral oncogen homolog (KRAS2) is a target gene of GAM26, corresponding to GAM26-TARGET GENE of FIG. 26A. KRAS2 BINDING SITE is a binding site found in an untranslated region of KRAS2, corresponding to BINDING SITE of FIG. 26A. FIG. 26D illustrates the complementarity of the nucleotide sequence of KRAS2

BINDING SITE, designated SEQ ID:229036, to the nucleotide sequence of GAM26 RNA of FIG. 26A, designated SEQ ID:20604.

Yet another function of GAM26 is therefore inhibition of v-Ki-ras2 Kirsten rat sarcoma 2 viral oncogene homolog (KRAS2), a gene which encodes a protein that ras proteins bind gdp/gtp and possess intrinsic gtpase activity and is associated with LUNG CANCER and STOMACH CANCER. Accordingly, utilities of GAM26 include diagnosis and treatment of the abovementioned diseases and clinical conditions. The function and utilities of KRAS2 have been established by previous studies, as described hereinabove with reference FIG. 26D.

Referring now to KRAS2 BINDING SITE. V-Ki-ras2 Kirsten rat sarcoma 2 viral oncogene homolog (KRAS2) is a target gene of GAM26, corresponding to GAM26-TARGET GENE of FIG. 26A. KRAS2 BINDING SITE is a binding site found in an untranslated region of KRAS2, corresponding to BINDING SITE of FIG. 26A. FIG. 26D illustrates the complementarity of the nucleotide sequence of KRAS2 BINDING SITE, designated SEQ ID:229050, to the nucleotide sequence of GAM26 RNA of FIG. 26A, designated SEQ ID:20604.

An additional function of GAM26 is therefore inhibition of v-Ki-ras2 Kirsten rat sarcoma 2 viral oncogene homolog (KRAS2), a gene which encodes a protein that ras proteins bind gdp/gtp and possess intrinsic gtpase activity, and is associated with LUNG CANCER and STOMACH CANCER. Accordingly, utilities of GAM26 include diagnosis and treatment of the abovementioned diseases and clinical conditions. The function and utilities of KRAS2 have been established by previous studies, as described hereinabove with reference to FIG. 26D.

Referring now to KRAS2 BINDING SITE. V-Ki-ras2 Kirsten rat sarcoma 2 viral oncogene homolog (KRAS2) is a target gene of GAM26, corresponding to GAM26-TARGET GENE of FIG. 26A. KRAS2 BINDING SITE is a binding site found in an untranslated region of KRAS2, corresponding to BINDING SITE of FIG. 26A. FIG. 26D illustrates the complementarity of the nucleotide sequence of KRAS2 BINDING SITE, designated SEQ ID:229059, to the nucleotide sequence of GAM26 RNA of FIG. 26A, designated SEQ ID:20604.

A further function of GAM26 is therefore inhibition of v-Ki-ras2 Kirsten rat sarcoma 2 viral oncogene homolog (KRAS2), a gene which encodes a protein that ras proteins bind gdp/gtp and possess intrinsic gtpase activity, and is associated with LUNG CANCER and STOMACH CANCER. Accordingly, utilities of GAM26 include diagnosis and treatment of the abovementioned diseases and clinical conditions. The function and utilities of KRAS2 have been established by previous studies, as described hereinabove with reference to FIG. 26D.

Reference is now made to LASS1 BINDING SITE. Longevity assurance (LAG1, *S. cerevisiae*) homolog 1 (LASS1) is a tar et gene of GAM26, corresponding to GAM26-TARGET GENE of FIG. 26A. LASS1 BINDING SITE is a binding site found in an untranslated region of LASS1, corresponding to BINDING SITE of FIG. 26A. FIG. 26D illustrates the complementarity of the nucleotide sequence of LASS1 BINDING SITE, designated SEQ ID:231693, to the nucleotide sequence of GAM26 RNA of FIG. 26A, designated SEQ ID:20604.

Yet a further function of GAM26 is therefore inhibition of longevity assurance (LAG1, *S. cerevisiae*) homolog 1 (LASS1), a gene which encodes an enzyme that may mediate cell differentiation events during embryonic development. Accordingly, utilities of GAM26 include diagnosis and treatment of the abovementioned diseases and clinical conditions.

The function of LASS1 has been established by previous studies. Longevity assurance gene-1 (Lag1) is preferentially expressed in young yeast, i.e., yeast cells that have undergone a small number of cell divisions. By screening genomic and cDNA libraries using a yeast Lag1 probe and degenerate PCR primers, followed by database searching, Jiang et al. (1998) identified a cDNA encoding LASS1. LASS1 had been identified previously by Lee (1991), who designated it UOG1 for upstream of GDF1 (602880). Lee (1991) showed that the potential 350-amino acid human and mouse UOG1 proteins are 81% identical. Jiang et al. (1998) determined that the deduced LASS1 protein contains a conserved 52-residue stretch termed the Lag1 motif, as well as a transmembrane domain. Complementation analysis indicated that LASS1, but not a similar gene, TRAM (605190), can replace yeast Lag1 in spite of limited amino acid homology. Northern blot analysis revealed expression of a 3.0-kb transcript in brain, skeletal muscle, and testis, as well as in glioblastoma and neuroblastoma cell lines. By PCR screening of a BAC library, Jiang et al. (1998) determined that the LASS1 gene contains 8 exons and spans approximately 30 kb. The translation start codon is in a GC-rich region. There are no TATA boxes.

Full details of the abovementioned studies are described in the following publications, the disclosure of which are hereby incorporated by reference:

Jiang, J. C.; Kirchman, P. A.; Zagulski, M.; Hunt, J.; Jazwinski, S. M.: Homologs of the yeast longevity gene LAG1 in *Caenorhabditis elegans* and human. Genome Res. 8: 1259-1272, 1998. PubMed ID: 9872981 2. Lee, S. -J.: Expression of growth/differentiation factor 1 in the nervous system: conservation of a bicistronic structure. Proc. Nat. Acad. Sci. 88: 4250-4254, 1991.

Further studies establishing the function and utilities of LASS1 are found in John Hopkins OMIM database record ID 606919, and in references numbered 943-944 listed hereinbelow.

Reference is now made to LASS2 BINDING SITE. (LASS2) is a target gene of GAM26, corresponding to GAM26-TARGET GENE of FIG. 26A. LASS2 BINDING SITE is a binding site found in an untranslated region of LASS2, corresponding to BINDING SITE of FIG. 26A. FIG. 26D illustrates the complementarity of the nucleotide sequence of LASS2 BINDING SITE, designated SEQ ID:231822, to the nucleotide sequence of GAM26 RNA of FIG. 26A, designated SEQ ID:20604.

Another function of GAM26 is therefore inhibition of (LASS2), a gene which encodes a protein that interacts with asialoglycoprotein receptor-1. Accordingly, utilities of GAM26 include diagnosis and treatment of the abovementioned diseases and clinical conditions.

The function of LASS2 has been established by previous studies. Longevity assurance gene-1 (Lag1) is preferentially expressed in young yeast, i.e., yeast cells that have undergone a small number of cell divisions. Yeast lifespan can be increased or decreased by mutation or overexpression of this gene. By EST database searching for homologs of Lag1, followed by 5-prime RACE, Pan et al. (2001) identified a cDNA encoding LASS2. The deduced 230-amino acid protein is 29% identical to LASS1 (606919) over 224 amino acids. It has 4 transmembrane helices (2 fewer than most Lag1 homologs), a Lag1 motif, and a C-terminal acidic domain. Northern blot analysis revealed expression of a 2.4-kb transcript in kidney and liver, with lower levels in brain, heart placenta, and lung. GENE FUNCTION By yeast 2-hybrid screening of liver and fetal brain cDNA libraries with LASS2 as bait, followed by GST pull-down assays, Pan et al. (2001) showed that LASS2 interacts with asialoglycoprotein receptor-1 (ASGR1; 108360) and -2 (ASGR2, 108361), the C-terminal half of OCT1 (SLC22A1; 602607), and ATP6L (108745). Expression of LASS2 in hepatocellular carcinoma cell lines led to suppression of cancer cell growth Full details of the abovementioned studies are described in the following publications, the disclosure of which are hereby incorporated by reference:

Pan, H.; Qin, W. -X.; Huo, K. -K.; Wan, D. -F.; Yu, Y.; Yu, Z. -G.; Hu, Q. -D.; Gu, K. T.; Zhou, X. -M.; Jiang, H. -Q.; Zhang, P. -P.; Huang, Y.; Li, Y. -Y.; Gu, J. -R.: Cloning, mapping, and characterization of a human homologue of the yeast longevity assurance gene LAG1. Genomics 77: 58-64, 2001.

Further studies establishing the function and utilities of LASS2 are found in John Hopkins OMIM database record ID 606920, and in references numbered 945 listed hereinbelow.

Reference is now made to LMO2 BINDING SITE. LIM domain only 2 (rhombotin-like 1) (LM 2) is a target gene of GAM26, corresponding to GAM26-TARGET GENE of FIG. 26A. LMO2 BINDING SITE is a binding site found in an untranslated region of LMO2, corresponding to BINDING SITE of FIG. 26A. FIG. 26D illustrates the complementarity of the nucleotide sequence of LMO2 BINDING SITE, designated SEQ ID:236309, to the nucleotide sequence of GAM26 RNA of FIG. 26A, designated SEQ ID:20604.

Yet another function of GAM26 is therefore inhibition of LIM domain only 2 (rhombotin-like 1) (LMO2), a gene which encodes a protein that binds to the basic helix-loop-helix protein tal-1, and is associated with lymphoblastic leukemia. Accordingly, utilities of GAM26 include diagnosis and treatment of the abovementioned diseases and clinical conditions.

The function of LMO2 has been established by previous studies. Rhombotin comprises multigene family. Rhombotin-1, implicated in an unusual subset of T-cell acute lymphoblastic leukemia, is located in the 11p15 region. A second member of the family, rhombotin-2, maps to 11p13 (see 186921). The known translocation breakpoints in the T-ALL cluster are at the 5-prime end of the RBTN2 gene within 25 kb of the presumed transcriptional start site Royer-Pokora et al. (1991) cloned 70 kb of DNA from 11p13 at the site of a recurrent translocation in T-cell leukemia: t(11;14)(p13;q11). The translocation involves the TCR-delta gene (186810) on 14q11 and a new site on 11p13. They found 2 new and 10 previously identified translocations mapping within 25 kb of each other on 11p13 and constituting the so-called 11p13. T-cell translocation cluster (11p13 ttc). A search for expressed sequences surrounding breakpoint cluster region identified a gene telomeric of all breakpoints that was overexpressed in 3 T-ALL samples with a t(11;14). This new gene, called T-cell translocation gene-2 (TTG2), encodes a small cysteine-rich protein. It showed 48% amino acid identity with T-cell translocation gene-1, or rhombotin (186921), in 11p15. Both proteins contain 2 copies of a cysteine-rich motif. The proteins encoded by these 2 translocation-deregulated genes belong to a class of cysteine-rich proteins with the LIM motif and are important in normal development.

Full detail of the abovementioned studies are described in the following publications, the disclosure of which are hereby incorporated by reference:

Royer-Pokora, B.; Loos, U.; Ludwig, W. -D.: TTG-2, a new gene encoding a cysteine-rich protein with the LIM motif, is overexpressed in acute T-cell leukaemia with the t(11; 14)(13;q11). Oncogene 6: 1887-1893, 1991.

Further studies establishing the function and utilities of LMO2 are found in John Hopkins OMIM database record ID 180385, and in referent numbered 946-950 listed hereinbelow.

Referring now to LMO2 BINDING SITE. LIM domain only 2 (rhombotin-like 1) (LMO2) is a target gene of GAM26, corresponding to GAM26-TARGET GENE of FIG. 26A. LMO2 BINDING SITE is a binding site found in; an untranslated region of LMO2, corresponding to BINDING SITE of FIG. 26A. FIG. 26D illustrates the complementarity of the nucleotide sequence of LMO2 BINDING SITE, designated SEQ ID:236311, to the nucleotide sequence of GAM26 RNA of FIG. 26A, designated SEQ ID:20604.

An additional function of GAM26 is therefore inhibition of LIM domain only 2 (rhombotin-like 1)(LMO2), a gene which encodes a protein that binds to the basic helix-loop-helix protein tal-1, and is associated with lymphoblastic leukemia. Accordingly, utilities of GAM26 include diagnosis and treatment of the abovementioned diseases and clinical conditions. The function and utilities of LMO2 have been established by previous studies, as described hereinabove with reference to FIG. 26D.

Referring now to LMO2 BINDING SITE. LIM domain only 2 (rhombotin-like 1) (LMO2) is a target gene of GAM26, corresponding to GAM26-TARGET GENE of FIG. 26A. LMO2 BINDING SITE is a binding site found in an untranslated region of LMO2, corresponding to BINDING SITE of FIG. 26A. FIG. 26D illustrates the complementarity of the nucleotide sequence of LMO2 BINDING SITE, designated SEQ ID:236328, to the nucleotide sequence of GAM26 RNA of FIG. 26A, designated SEQ ID:20604.

A further function of GAM26 is therefore inhibition of LIM domain only 2 (rhombotin-like 1) (LMO2), a gene which encodes a protein that binds to the basic helix-loop-helix protein tal-1 and is associated with lymphoblastic leukemia. Accordingly, utilities of GAM26 include diagnosis and treatment the abovementioned diseases and clinical conditions. The function and utilities of LMO2 have been established by previous studies, as described hereinabove with reference to FIG. 26D.

Referring now to LMO2 BINDING SITE. LIM domain only 2 (rhombotin-like 1) (LMO2) is a target gene of GAM26, corresponding to GAM26-TARGET GENE of FIG. 26A. LMO2 BINDING SITE is a binding site found in an untranslated region of LMO2, corresponding to BINDING SITE of FIG. 26A. FIG. 26D illustrates the complementarity of the nucleotide sequence of LMO2 BINDING SITE, designated SEQ ID:236380, to the nucleotide sequence of GAM26 RNA of FIG. 26A, designated SEQ ID:20604.

Yet a further function of GAM26 is therefore inhibition of LIM domain only 2 (rhombotin-like 1) (LMO2), a gene which encodes a protein that binds to the basic helix-loop-helix protein tal-1, and is associated with lymphoblastic leukemia. Accordingly, utilities of GAM26 include diagnosis and treatment of the abovementioned diseases and clinical conditions. The function and utilities of LMO2 have been established by previous studies, as described hereinabove with reference to FIG. 26D.

Referring now to LMO2 BINDING SITE. LIM domain only 2 (rhombotin-like 1) (LMO2) is a target gene of GAM26, corresponding to GAM26-TARGET GENE of FIG. 26A. LMO2 BINDING SITE is a binding site found in an untranslated region of LMO2, corresponding to BINDING SITE of FIG. 26A. FIG. 26D illustrates the complementarity of the nucleotide sequence of LMO2 BINDING SITE, designated SEQ ID:236383, to the nucleotide sequence of GAM26 RNA of FIG. 26A, designated SEQ ID:20604.

Another function of GAM26 is therefore inhibition of LIM domain only 2 (rhombotin-like 1) (LMO2), a gene which encodes a protein that binds to the basic helix-loop-helix protein tal-1, and is associated with lymphoblastic leukemia. Accordingly, utilities of GAM26 include diagnosis and treatment of the abovementioned diseases and clinical conditions. The function and utilities of LMO2 have been established by previous studies, as described hereinabove with reference to FIG. 26D.

Referring now to LMO2 BINDING SITE. LIM domain only 2 (rhombotin-like 1) (LMO2) is a target gene of GAM26, corresponding to GAM26-TARGET GENE of FIG. 26A. LMO2 BINDING SITE is a binding site found in an untranslated region of LMO2, corresponding to BINDING SITE of FIG. 26A. FIG. 26D illustrates the complementarity of the nucleotide sequence of LMO2 BINDING SITE, designated SEQ ID:236384, to the nucleotide sequence of GAM26 RNA of FIG. 26A, designated SEQ ID:20604.

Yet another function of GAM26 is therefore inhibition of LIM domain only 2 (rhombotin-like 1) (LMO2), a gene which encodes a protein that binds to the basic helix-loop-helix protein tal-1, and is associated with lymphoblastic leukemia. Accordingly, utilities of GAM26 include diagnosis and treatment the abovementioned diseases and clinical conditions. The function and utilities LMO2 have been established by previous studies, as described hereinabove with reference to FIG. 26D.

Referring now to LMO2 BINDING SITE. LIM domain only 2 (rhombotin-like 1) (LMO2) is a target gene of GAM26, corresponding to GAM26-TARGET GENE of FIG. 26A. LMO2 BINDING SITE is a binding site found in an untranslated region of LMO2, corresponding to BINDING SITE of FIG. 26A. FIG. 26D illustrates the complementarity of the nucleotide sequence of LMO2 BINDING SITE, designated SEQ ID:236385, to the nucleotide sequence of GAM26 RNA of FIG. 26A, designated SEQ ID:20604.

An additional function of GAM26 is therefore inhibition of LIM domain only 2 (rhombotin-like 1) (LMO2), a gene which encodes a protein that binds to the basic helix-loop-helix protein tal-1, and is associated with lymphoblastic leukemia. Accordingly, utilities of GAM26 include diagnosis and treatment of the abovementioned diseases and clinical conditions. The function and utilities of LMO2 have been established by previous studies, as described hereinabove with reference to FIG. 26D.

Reference is now made to LRP8 BINDING SITE. low density lipoprotein receptor-related protein 8, apolipoprotein e r (LRP8) is a target gene of GAM26, corresponding to GAM26-TARGET GENE of FIG. 26A. LRP8 BINDING SITE is a binding site found in an untranslated region of LRP8, corresponding to BINDING SITE of FIG. 26A. FIG. 26D illustrates the complementarity of the nucleotide sequence of LRP8 BINDING SITE, designated SEQ ID:238167, to the nucleotide sequence of GAM26 RNA of FIG. 26A, designated SEQ ID:20604.

A further function of GAM26 is therefore inhibition of low density lipoprotein receptor-related protein 8, apolipoprotein e r (LRP8), a gene which encodes a receptor that binds vldl and transports it into cells by endocytosis. Accordingly, utilities of GAM26 include diagnosis and treatment of the abovementioned diseases and clinical conditions.

The function of LRP8 has been established by previous studies. Apolipoprotein E (APOE; 107741) is a 34-kD lipophilic protein that mediates high-affinity binding of APOE-containing lipoproteins to the low density lipoprotein receptor (see LDLR; 606945) and the very low density lipoprotein receptor (VLDLR; 192977). By screening a human placenta cDNA library with degenerate oligonucleotides based on a highly conserved region between LDLR and VLDLR, Kim et al. (1996) identified a cDNA encoding APOE receptor-2 (APOER2). The predicted 963-amino acid protein contains a putative 41 amino acid signal sequence and 5 functional domains that resemble those of LDLR and VLDLR. APOER2 appears specific for APOE-containing ligands: LDLR-deficient mammalian cells expressing APOER bound APOE-rich beta-VLDL with high affinity, but bound LDL and VLDL with much lower affinities. Northern blot analysis revealed that APOER2 is expressed as 4.5- and 8.5-kb mRNAs in brain and placenta Kim et al. (1997) reported that the APOER2 gene contains 19 exons and spans approximately 60 kb. Alternative splicing generates multiple transcripts encoding receptors with different numbers of cysteine rich repeats in the ligand-binding domain.

Full details of the abovementioned studies are described in the following publications, the disclosure of which are hereby incorporated by reference:

Kim, D. -H.; Iijima, H.; Goto, K.; Sakai, J.; Ishii H.; Kim, H. -J.; Suzuki, H.; Kondo, H.; Saeki, S.; Yamamoto, T.: Human apolipoprotein E receptor 2: a novel lipoprotein receptor of the low density lipoprotein receptor family predominantly expressed in brain. J. Biol. Chem. 271: 8373-8380, 1996. PubMed ID: 8626535.: Kim, D. -H.; Magoori, K.; Inoue, T. R.; Mao, C. C.; Kim, H. -J.; Suzuki, H.; Fujita, T.; Endo, Y.; Saeki, S.; Yamamoto, T. T.: Exon/intron organization, chromosome localization, alternative splicing, and transcription units of the human apolipoprotein E receptor 2 gene. J. Biol. Chem. 272: 8498-8504, 1997.

Further studies establishing the function and utilities of LRP8 are found in John Hopkins OMIM database record ID 602600, and in references numbered 497, 951-952 and 504 listed herein below.

Referring now to LRP8 BINDING SITE. Low density lipoprotein receptor-related protein 8, apolipoprotein e r (LRP8) is a target gene of GAM26, corresponding to GAM26-TARGET GENE of FIG. 26A. LRP8 BINDING SITE is a binding site found in an untranslated region of LRP8, corresponding to BINDING SITE of FIG. 26A. FIG. 26D illustrates the complementarity of the nucleotide sequence of LRP8 BINDING SITE, designated SEQ ID:238167, to the nucleotide sequence of GAM26 RNA of FIG. 26A, designated SEQ ID:20604.

Yet a further function of GAM26 is therefore inhibition of low density lipoprotein receptor-related protein 8, apolipoprotein e r (LRP8), a gene which encodes a receptor that binds vldl and transports it into cells by endocytosis. Accordingly, utilities of GAM26 include diagnosis and treatment of the abovementioned diseases and clinical conditions. The function and utilities of LRP8 have been established by previous studies, as described hereinabove with reference to FIG. 26D.

Referring now to LRP8 BINDING SITE. Low density lipoprotein receptor-related protein 8, apolipoprotein e r (LRP8) is a target gene of GAM26, corresponding to GAM26-TARGET GENE of FIG. 26A. LRP8 BINDING SITE is a binding site found in an untranslated region of LRP8, corresponding to BINDING SITE of FIG. 26A. FIG. 26D illustrates the complementarity of the nucleotide sequence of LRP8 BINDING SITE, designated SEQ ID:238168, to the nucleotide sequence of GAM26 RNA of FIG. 26A, designated SEQ ID:20604.

Another function of GAM26 is therefore inhibition of low density lipoprotein receptor-related protein 8, apolipoprotein e r (LRP8), a gene which encodes a receptor that binds vldl and transports it into cells by endocytosis. Accordingly, utilities of GAM26 include diagnosis and treatment of the abovementioned diseases and clinical conditions. The function and utilities of LRP8 have been established by previous studies, as described hereinabove with reference to FIG. 26D.

Referring now to LRP8 BINDING SITE. Low density lipoprotein receptor-related protein 8, apolipoprotein e r (LRP8) is a target gene of GAM26, corresponding to GAM26-TARGET GENE of FIG. 26A. LRP8 BINDING SITE is a binding site found in an untranslated region of LRP8, corresponding to BINDING SITE of FIG. 26A. FIG. 26D illustrates the complementarity of the nucleotide sequence of LRP8 BINDING SITE, designated SEQ ID:238188, to the nucleotide sequence of GAM26 RNA of FIG. 26A, designated SEQ ID:20604.

Yet another function of GAM26 is therefore inhibition of low density lipoprotein receptor-related protein 8, apolipoprotein e r (LRP8), a gene which encodes a receptor that binds vldl and transports it into cells by endocytosis. Accordingly, utilities of GAM26 include diagnosis and treatment of the abovementioned diseases and clinical conditions. The function and utilities of LRP8 have been established by previous studies, as described hereinabove with reference to FIG. 26D.

Referring now to LRP8 BINDING SITE. Low density lipoprotein receptor-related protein 8, apolipoprotein e r (LRP8) is a target gene of GAM26, corresponding to GAM26-TARGET GENE of FIG. 26A. LRP8 BINDING SITE is a binding site found in an untranslated region of LRP8, corresponding to BINDING SITE of FIG. 26A. FIG. 26D illustrates the complementarity of the nucleotide sequence of LRP8 BINDING SITE, designated SEQ ID:238204, to the nucleotide sequence of GAM26 RNA of FIG. 26A, designated SEQ ID:20604.

An additional function of GAM26 is therefore inhibition of low density lipoprotein receptor-related protein 8, apolipoprotein e r (LRP8), a gene which encodes a receptor that binds vldl and transports it into cells by endocytosis. Accordingly, utilities of GAM26 include diagnosis and treatment of the abovementioned diseases and clinical conditions. The function and utilities of LRP8 have been established by previous studies, as described hereinabove with reference to FIG. 26D.

Referring now to LRP8 BINDING SITE. Low density lipoprotein receptor-related protein 8, apolipoprotein e r (LRP8) is a target gene of GAM26, corresponding to GAM26-TARGET GENE of FIG. 26A. LRP8 BINDING SITE is a binding site found in an untranslated region of LRP8, corresponding to BINDING SITE of FIG. 26A. FIG. 26D illustrates the complementarity of the nucleotide sequence of LRP8 BINDING SITE, designated SEQ ID:238208, to the nucleotide sequence of GAM26 RNA of FIG. 26A, designated SEQ ID:20604.

A further function of GAM26 is therefore inhibition of low density lipoprotein receptor-related protein 8, apolipoprotein e r (LRP8), a gene which encodes a receptor that binds vldl and transports it into cells by endocytosis. Accordingly, utilities of GAM26 include diagnosis and treatment of the abovementioned diseases and clinical conditions. The function and utilities of LRP8 have been established by previous studies, as described hereinabove with reference to FIG. 26D.

Referring now to LRP8 BINDING SITE. Low density lipoprotein receptor-related protein 8, apolipoprotein e r (LRP8) is a target gene of GAM26, corresponding to GAM26-TARGET GENE of FIG. 26A. LRP8 BINDING SITE is a binding site found in an untranslated region of LRP8, corresponding to BINDING SITE of FIG. 26A. FIG. 26D illustrates the complementarity of the nucleotide sequence of LRP8 BINDING SITE, designated SEQ ID:238239, to the nucleotide sequence of GAM26 RNA of FIG. 26A, designated SEQ ID:20604.

Yet a further function of GAM26 is therefore inhibition of low density lipoprotein receptor-related protein 8, apolipoprotein e r (LRP8), a gene which encodes a receptor that binds vldl and transports it into cells by endocytosis. Accordingly, utilities of GAM26 include diagnosis and treatment of the abovementioned diseases and clinical conditions. The function and utilities of LRP8 have been established by previous studies, as described hereinabove with reference to FIG. 26D.

Reference is now made to MAD BINDING SITE. MAX dimerization protein (MAD) is a target gene of GAM26, corresponding to GAM26-TARGET GENE of FIG. 26A. MAD BINDING SITE is a binding site found in an untranslated region of MAD, corresponding to BINDING SITE of FIG. 26A. FIG. 26D illustrates the complementarity of the nucleotide sequence of MAD BINDING SITE, designated SEQ ID:241104, to the nucleotide sequence of GAM26 RNA of FIG. 26A, designated SEQ ID:20604.

Another function of GAM26 is therefore inhibition of MAX dimerization protein (MAD), a gene which encodes a protein that forms a heterodimer with MAX and represses transcription, antagonizes c-Myc (MYC), and promotes cellular differentiation. Accordingly, utilities of GAM26 include diagnosis and treatment of the abovementioned diseases and clinical conditions.

The function of MAD has been established by previous studies. The MAD and MXI1 (600020) genes encode proteins that belong to a distinct subfamily of MAX-interacting proteins. The MAX protein (154950) specifically interacts with the MYC protein family (190080) by forming heterodimers mediated by their basic-helix-loop-helix-leucine zipper interaction domains. Binding to MAX is essential for MYC transcription and transforming activity; MYC homodimers are inactive. Both MAD and MXI1 bind MAX in vitro, forming a sequence-specific DNA-binding complex similar to the MYC-MAX heterodimer. MAD and MYC compete for binding to MAX. In addition, MAD acts as a transcriptional repressor, while MYC appears to function as an activator. MXI1 also appears to lack a transcriptional activation domain. Therefore, MXI1 and MAD might antagonize MYC function and are candidate tumor suppressor genes. Edelhoff et al. (1994) mapped the human MAD and MXI1 genes to 2p13 and 10q25, respectively, by fluorescence in situ hybridization. The homologous gene in the mouse was mapped to chromosome 6 by interspecific backcross analysis. Shapiro et al. (1994) confirmed the assignments of the MAD and MXI1 genes to chromosomes 2p13-p12 and 10q24-q25, respectively, by somatic cell mapping and fluorescene in situ hybridization. The designation MAD was derived from MAX dimerizer (Eisenman, 1994).

Full details of the abovementioned studies are described in the following publications, the disclosure of which are hereby incorporated by reference:

Edelhoff, S.; Ayer, D. E.; Zervos, A. S.; Steingrimsson, E.; Jenkins, N. A.; Copeland, N. G.; Eisenman, R. N.; Brent, R.; Disteche, C. M.: Mapping of two genes encoding members of a distinct subfamily of MAX interacting proteins: MAD to human chromosome 2 and mouse chromosome 6, and MXI1 to chromosome 10 and mouse chromosome 19. Oncogene 9: 665-668, 1994. PubMed ID: 8290278 Shapiro, D. N.; Valentine, V.; Eagle, L.; Yin, X.; Morris, S. W.; Prochownik, E. V.: Assignment of the human MAD and MXI1 genes to chromosomes 2p12-p13 and 10q24-q25. Genomics 23: 282-285, 1994.

Further studies establishing the function and utilities of MAD are found in John Hopkins OMIM database record ID 600021, and in references numbered 953-955 listed hereinbelow.

Reference is now made to MAD1L1 BINDING SITE. MAD1 (mitotic arrest deficient, yeast, homolog)-like 1 (MAD1L1) is a target gene of GAM26, corresponding to GAM26-TARGET GENE of FIG. 26A. MAD1L1 BINDING SITE is a binding site found in an untranslated region of MAD1L1, corresponding to BINDING SITE of FIG. 26A. FIG. 26D illustrates the complementarity of the nucleotide sequence of MAD1L1 BINDING SITE, designated SEQ ID:241126, to the nucleotide sequence of GAM26 RNA of FIG. 26A, designated SEQ ID:20604.

Yet another function of GAM26 is therefore inhibition of MAD1 (mitotic arrest deficient, yeast, homolog)-like 1 (MAD1L1), a gene which encodes a protein that appears to play a role in cytokinesis, cell shape, and specialized functions such as secretion and capping. Mitotic spindle checkpoint protein 1; may be a target for type 1 T cell leukemia virus oncoprotein Tax. Accordingly, utilities of GAM26 include diagnosis and treatment of the abovementioned diseases and clinical conditions.

The function of MAD1L1 has been established by previous studies. Aneuploidy is a characteristic of most human cancers, and defects of mitotic checkpoints appear to play a role in carcinogenesis. MAD1L1 is a checkpoint gene, and its dysfunction is associated with chromosomal instability. By RT PCR-SSCP and nucleotide sequencing, Tsukasaki et al. (2001) performed a mutation search on the MAD1L1 gene in a total of 44 cell lines (hematopoietic, prostate, osteosarcoma, breast, glioblastoma, and lung) and 133 fresh cancer cells (hematopoietic prostate, breast, and glioblastoma). Eight mutations consisting of missense, nonsense, and frameshift mutations were found, together with a number of nucleotide polymorphisms. All of the alterations in cell lines were heterozygous. The frequency of mutations was relatively high in prostate cancer (2 of 7 cell lines and 2 of 33 tumor specimens). Tsukasaki et al. (2001) placed a mutant truncated MAD1L1 gene from a lymphoma sample into 3 different cell lines and found that it was less inhibitory than wildtype MAD1L1 at decreasing cell proliferation. Coexpression experiments showed that the mutant form had a dominant-negative effect. Furthermore, this mutant impaired the mitotic checkpoint as shown by decreased mitotic indices in cells expressing mutant MAD1L1 after culture with the microtubule-disrupting agent nocodazole.

The results suggested a pathogenic role of mutations in the MAD1L1 gene in various types of human cancer Gene-specific targeting of the SIN3 corepressor complex (see 602949) by DNA-bound repressors is an important mechanism of gene silencing in eukaryotes. The SIN3 corepressor specifically associates with a diverse group of transcriptional repressors, including members of the MAD family, that play crucial roles in development. Brubaker et al. (2000) determined the nuclear magnetic resonance imaging structure of the complex formed by the PAH2 domain of mammalian Sin3a with the transrepression domain (SIN3-interaction domain, or SID) of human MAD1. They showed that the Sin3a PAH2 domain and the MAD1 SID undergo mutual folding transitions upon complex formation, generating an unusual left-handed, 4-helix bundle structure and an amphipathic alpha helix, respectively. The SID helix is wedged within a deep hydrophobic pocket defined by 2 PAH2 helices. Luo et al. (2002) showed that RNA interference-mediated suppression of MAD1 function in mammalian cells caused loss of MAD2 kinetochore localization and impairment of the spindle checkpoint. MAD1 and CDC20 (603618) contain MAD2-binding motifs that share a common consensus, and the authors identified a class of MAD2-binding peptides (MBPs) with a similar consensus. Binding of one of these ligands, MBP1, triggered an extensive rearrangement of the tertiary structure of MAD2. MAD2 also underwent a similar striking structural change upon binding to a MAD1 or CDC20 binding motif peptide. These data suggested that, upon checkpoint activation, MAD1 recruits MAD2 to unattached kinetochores and may promote binding of MAD2 to CDC20

Full details of the abovementioned studies are described in the following publications, the disclosure of which are hereby incorporated by reference:

Tsukasaki, K.; Miller, C. W.; Greenspun, E.; Eshaghian, S.; Kawabata, H.; Fujimoto, T.; Tomonaga, M.; Sawyers, C.; Said, J. W.; Koeffler, H. P.: Mutations in the mitotic check point gene, MAD1L1, in human cancers. Oncogene 120: 3301-3305, 2001. PubMed ID: 11423979 Luo, X.; Tang, Z.; Rizo, J.; Yu, H.: The Mad2 spindle checkpoint protein undergoes similar major conformational changes upon binding to either Mad1 or Cdc20. Molec. Cell 9: 59-71, 2002.

Further studies establishing the function and utilities of MAD1L1 are found in John Hopkins OMIM database record ID 602686, and in references numbered 956-960 listed hereinbelow.

Reference is now made to MAF BINDING SITE. V-maf musculoaponeurotic fibrosarcoma (avian) oncogene homolog (MAF) is a target gene of GAM26, corresponding to GAM26-TARGET GENE of FIG. 26A. MAF BINDING SITE is a binding site found in an untranslated region of MAF, corresponding to BINDING SITE of FIG. 26A. FIG. 26D illustrates the complementarity of the nucleotide sequence of MAF BINDING SITE, designated SEQ ID:241961, to the nucleotide sequence of GAM26 RNA of FIG. 26A, designated SEQ ID:20604.

An additional function of GAM26 is therefore inhibition of v-maf musculoaponeurotic fibrosarcoma (avian) oncogene homolog (MAF), a gene which encodes a transcription actor that is a transcription factor; contains a leucine zipper motif and is associated with hereditary congenital cataract. Accordingly, utilities of GAM26 include treatment of the abovementioned diseases and clinical conditions.

The function of MAF has been established by previous studies. Nishizawa et al. (1989) identified in the human genome a cellular analog of v-maf which was isolated from the provirus of the avian musculoaponeurotic fibrosarcoma virus AS42. The deduced amino acid sequence of the v-maf gene product contains a leucine zipper motif similar to that found in a number of DNA binding proteins, including the gene products of the FOS (164810), JUN (165160), and MYC (190080) oncogenes. Through the use of a cDNA probe for in situ hybridization, Yoshida et al. (1991) localized the MAF gene to 16q22-q23. Blank and Andrews (1997) reviewed the MAF transcription factors, a unique subclass of basic-leucine zipper transcription (bZIP) factors. Members of the MAF family appear to play important roles in the regulation of differentiation. Human congenital cataract and ocular anterior segment dysgenesis both demonstrate extensive genetic and phenotypic heterogeneity. Kim et al. (1999) demonstrated that the homozygous null mutant Maf mouse embryo exhibits defective lens formation and microphthalmia. Jamieson et al. (2002) identified a family where ocular developmental abnormalities (cataract, anterior segment dysgenesis, and microphthalmia) cosegregated with a translocation, t(5;16)(p15.3;q23.2), in both balanced and unbalanced forms. Cloning the 16q23.2 breakpoint demonstrated that it transected the genomic-control domain of MAF. The 16q23.2 breakpoint transected the common fragile site FRA16D (see 605131), providing a molecular demonstration of a germline break in a common fragile site. Through mutation screening of a panel of patients with hereditary congenital cataract, Jamieson et al. (2002) identified a mutation in the MAF gene in a 3-generation family with cataract, microcornea, and iris coloboma Full details of the abovementioned studies are described in the following publications, the disclosure of which are hereby incorporated by reference:

Jamieson, R. V.; Perveen, R.; Kerr, B.; Carette, M.; Yardley, J.; Heon, E.; Wirth, M. G.; van Heyningen, V.; Donnai, D.; Munier, F.; Black, C. M.: Domain disruption and mutation of the bZIP transcription factor, MAF, associated with cataract, ocular anterior segment dysgenesis and coloboma. Hum. Molec. Genet. 11: 33-42, 2002. PubMed ID: 11772997 Kim, J. I.; Li, T.; Ho, I. C.; Grusby, M. J.; Glimcher, L. H.: Requirement for the c-Maf transcription factor in crystallin gene regulation and lens development. Proc. Nat. Acad. Sci. 96: 3781-3785, 1999.

Further studies establishing the function and utilities of MAF are found in John Hopkins OMIM database record ID 177075, and in references numbered 961-965 listed hereinbelow.

Referring now to ADARB1 BINDING SITE. Adenosine deaminase, RNA-specific, B1 (homolog of rat RED1) (ADARB1) is a target gene of GAM26, corresponding GAM26-TARGET GENE of FIG. 26A. ADARB1 BINDING SITE is a binding site found in an untranslated region of ADARB1, corresponding to BINDING SITE of FIG. 26A. FIG. 26D illustrates the complementarity of the nucleotide sequence of ADARB1 BINDING SITE, designated SEQ ID:241978, to the nucleotide sequence of GAM26 RNA of FIG. 26A, designated SEQ ID:20604.

A further function of GAM26 is therefore inhibition of adenosine deaminase, RNA-specific, B1 (homolog of rat RED1) (ADARB1), a gene which encodes enzyme that RNA editing involves the deamination of adenosines at specific sites. Accordingly, utilities of GAM26 include diagnosis and treatment of the abovementioned diseases and clinical conditions. The function an utilities of ADARB1 have been established by previous studies, as described hereinabove with reference to FIG. 26D.

Referring now to BCL11B BINDING SITE. B-cell CLL/lymphoma 11B (zinc finger protein) (BCL11B) is a target gene of GAM26, corresponding to GAM26-TARGET GENE of FIG. 26A. BCL11B BINDING SITE is a binding site found in an untranslated region of BCL11B, corresponding to BINDING SITE of FIG. 26A. FIG. 26D illustrates the complementarity of the nucleotide sequence of BCL11B BINDING SITE, designated SEQ ID:241978, to the nucleotide sequence of GAM26 RNA of FIG. 26A, designated SEQ ID:20604.

Yet a further function of GAM26 is therefore inhibition of B-cell CLL/lymphoma 11B (zinc finger protein) (BCL11B), a gene which encodes a protein that is implicated in mouse and human leukemias and is associated with T-cell leukemia/lymphoma. Accordingly, utilities of GAM26 include diagnosis and treatment of the abovementioned diseases and clinical conditions. The function and utilities of BCL11B have been established by previous studies, as describe hereinabove with reference to FIG. 26D.

Referring now to FMR1 BINDING SITE. Fragile X mental retardation 1 (FMR1) is a target gene of GAM26, corresponding to GAM26-TARGET GENE of FIG. 26A. FMR1 BINDING SITE is a binding site found in an untranslated region of FMR1, corresponding to BINDING SITE of FIG. 26A. FIG. 26D illustrates the complementarity of the nucleotide sequence of FMR1 BINDING SITE, designated SEQ ID:241978, to the nucleotide sequence of GAM26 RNA of FIG. 26A, designated SEQ ID:20604.

Another function of GAM26 is therefore inhibition of fragile X mental retardation 1 (FMR1), a gene which encodes a protein that is associated with fragile x syndrome. Accordingly, utilities of GAM26 include diagnosis and treatment of the abovementioned diseases and clinical conditions. The function and utilities of FMR1 have been established by previous studies, as described hereinabove with reference to FIG. 26D.

Referring now to MAF BINDING SITE. V-maf musculoaponeurotic fibrosarcoma (avian) oncogene homolog (MAF) is a target gene of GAM26, corresponding to GAM26-TARGET GENE of FIG. 26A. MAF BINDING SITE is a binding site found in an untranslated region of MAF, corresponding to BINDING SITE of FIG. 26A. FIG. 26D illustrates the complementarity of the nucleotide sequence of MAF BINDING SITE, designated SEQ ID:241978, to the nucleotide sequence of GAM26 RNA of FIG. 26A, designated SEQ ID:20604.

Yet another function of GAM26 is therefore inhibition of v-maf musculoaponeurotic fibrosarcoma (avian) oncogene homolog (MAF), a gene which encodes a transcription factor that is a transcription factor; contains a leucine zipper motif and is associated with hereditary congenital cataract. Accordingly, utilities of GAM26 include diagnosis and treatment of the abovementioned diseases and clinical conditions. The function and utilities of MAF have been established by previous studies, as described hereinabove with reference to FIG. 26D.

Referring now to NPAS2 BINDING SITE. Neuronal PAS domain protein 2 (NPAS2) is a target gene of GAM26, corresponding to GAM26-TARGET GENE of FIG. 26A. NPAS2 BINDING SITE is a binding site found in an untranslated region of NPAS2, corresponding to BINDING SITE of FIG. 26A. FIG. 26D illustrates the complementarity of the nucleotide sequence of NPAS2 BINDING SITE, designated SEQ ID:241978, to the nucleotide sequence of GAM26 RNA of FIG. 26A, designated SEQ ID:20604.

An additional function of GAM26 is therefore inhibition of neuronal PAS domain protein 2 (NPAS2), a gene which encodes a protein that is a member of basic helix-loop-helix-PAS family of transcription factors. Accordingly, utilities of GAM26 include diagnosis and treatment of the abovementioned diseases and clinical conditions. The function and utilities of NPAS2 have been established by previous studies, as described hereinabove with reference to FIG. 26D.

Referring now to RELN BINDING SITE. Reelin (RELN) is a target gene of GAM26, corresponding to GAM26-TARGET GENE of FIG. 26A. RELN BINDING SITE is a binding site found in an untranslated region of RELN, corresponding to BINDING SITE of FIG. 26A. FIG. 26D illustrates the complementarity of the nucleotide sequence of RELN BINDING SITE, designated SEQ ID:241978, to the nucleotide sequence of GAM26 RNA of FIG. 26A, designated SEQ ID:20604.

A further function of GAM26 is therefore inhibition of reelin (RELN), a gene which encodes a transcription factor that is associated with Norman-Roberts syndrome. Accordingly, utilities of GAM26 include diagnosis and treatment of the abovementioned diseases and clinical conditions. The function and utilities of RELN have been established by previous studies, as described hereinabove with reference to FIG. 26D.

Referring now to ZNF6 BINDING SITE. Zinc finger protein 6 (CMPX1) (ZNF6) is a target gene of GAM26, corresponding to GAM26-TARGET GENE of FIG. 26A. ZNF6 BINDING SITE is a binding site found in an untranslated region of ZNF6, corresponding to BINDING SITE of FIG. 26A. FIG. 26D illustrates the complementarity of the nucleotide sequence of ZNF6 BINDING SITE, designated SEQ ID:241978, to the nucleotide sequence of GAM26 RNA of FIG. 26A, designated SEQ ID:20604.

Yet a further function of GAM26 is therefore inhibition of zinc finger protein 6 (CMPX1) (ZNF6), a gene which encodes a protein that is probably a transcriptional activator. Accordingly, utilities of GAM26 include diagnosis and treatment of the abovementioned diseases and clinical conditions. The function and utilities of ZNF6 have been established by previous studies, as described hereinabove with reference to FIG. 26D.

Reference is now made to MAFK BINDING SITE. V-maf musculoaponeurotic fibrosarcoma (avian) oncogene family, protein (MAFK) is a target gene of GAM26, corresponding to GAM26-TARGET GENE of FIG. 26A. MAFK BINDING SITE is a binding site found in an untranslated region of MAFK, corresponding to BINDING SITE of FIG. 26A. FIG. 26D illustrate the complementarity of the nucleotide sequence of MAFK BINDING SITE, designated SEQ ID:242287, to the nucleotide sequence of GAM26 RNA of FIG. 26A, designated SEQ ID:20604.

Another function of GAM26 is therefore inhibition of v-maf musculoaponeurotic fibrosarcoma (avian) oncogene family, protein (MAFK), a gene which encodes a transcription factor that is involved in regulation of transcription at NEF2 sites. Accordingly, utilities of GAM26 include diagnosis and treatment of the abovementioned diseases and clinical conditions.

The function of MAFK has been established by previous studies. The developmentally regulated expression of the globin genes depends on upstream regulatory elements termed locus control regions (LCRs). LCRs are associated with powerful enhancer activity that is mediated by the transcription factor NFE2 (nuclear factor erythroid-2). NFE2 recognition sites are also present in the gene promoters of 2 heme biosynthetic enzymes, porphobilinogen deaminase (PBGD; 176000) and ferrochelatase (FECH; 177000). NFE2 DNA-binding activity consists of a heterodimer containing an 18-kD Maf protein (MafF, MafG (602020), or MafK) and p45 (601490). Both subunits are members of the activator protein-1 superfamily of basic leucine zipper (bZip) proteins (see 165160). Maf homodimers suppress transcription at NFE2 sites. Toki et al. (1997) isolated a cDNA encoding human MAFK. The MAFK gene encodes a 156 amino acid polypeptide which is widely expressed, with highest levels seen in heart, placenta, skeletal muscle, and kidney. Toki et al. (1997) showed that MAFK could heterodimerize not only with p45, but also with NFE2-related factor 1 (NRF1; 163260) and NFE2-related factor 2 (600492); these heterodimers bound to NFE2 sites in vitro. In vivo, MAFK/p45 and MAFK/NRF1 heterodimers stimulated transcription from NFE2 sites. Similar results were found with MAFG. Iwata et al. (1998) showed that MAFK encoded by 3 exons spanning approximately 10 kb By use of 2 DNA mapping panels isolated from mice of a recombinant inbred strain set, Peters and Eicher (1994) demonstrated that the ubiquitous subunit is located on mouse chromosome 5. Since this region of the mouse genome shares linkage homology with human chromosome 7q, Peters and Eicher (1994) suggested that human NFE2U is probably located on 7q. Iwata et al. (1998) used FISH to map the MAFK gene to human chromosome 7p22. Motohashi et al. (2000) found that mouse embryos expressing abundant transgene-derived Mafk died of severe anemia, while lines expressing lower levels of small Maf lived to adulthood. Megakaryocytes from the latter overexpressing lines exhibited reduced proplatelet formation and MARE (Maf recognition element)-dependent transcription, phenocopying Mafg null mice (see Shavit et al. (1998)). When the Mafg null mice were bred to small Maf-overexpressing transgenic animals, both loss- and gain-of-function phenotypes were reversed Full details of the abovementioned studies are described in the following publications, the disclosure of which are hereby incorporated by reference:

Toki, T.; Itoh, J.; Kitazawa, J.; Arai, K.; Hatakeyama, K.; Akasaka, J.; Igarashi, K.; Nomura, N.; Yokoyama, M.; Yamamoto, M.; Ito, E.: Human small Maf proteins form heterodimers with CNC family transcription factors and recognize the NF-E2 motif. Oncogene 14: 1901-1910, 1997. PubMed ID: 9150357 Motohashi, H.; Katsuoka, F.; Shavit, J. A.; Engel, J. D.; Yamamoto, M.: Positive or negative MARE-dependent transcriptional regulation is determined by the abundance of small Maf proteins. Cell 103: 865-875, 2000.

Further studies establishing the function and utilities of MAFK are found in John Hopkins OMIM database record ID 600197, and in references numbered 966-970 listed hereinbelow.

Reference is now made to MAN2A1 BINDING SITE. Mannosidase alpha, class 2A, member 1 (MAN2A1) is a target gene of GAM26, corresponding to GAM26-TARGET GENE of FIG. 26A. MAN2A1 BINDING SITE is a binding site found in an untranslated region of MAN2A1, corresponding to BINDING SITE of FIG. 26A. FIG. 26D illustrates the complementarity of the nucleotide sequence of MAN2A1 BINDING SITE, designated SEQ ID:243405, to the nucleotide sequence of GAM26 RNA of FIG. 26A, designated SEQ ID:20604.

Yet another function of GAM26 is therefore inhibition of mannosidase, alpha, class 2A, member 1 (MAN2A1), a gene which encodes an enzyme that catalyzes the final hydrolytic step in the asparagine-linked oligosaccharide (N-glycan) maturation pathway and is associated with lupus erythematosus. Accordingly, utilities of GAM26 include diagnosis and treatment of the abovementioned diseases and clinical conditions.

The function of MAN2A1 has been established by previous studies. Alpha-mannosidase II catalyzes the first committed step in the biosynthesis of complex N-glycans. Genetic deficiency of this enzyme should abolish complex N-glycan production as reportedly does inhibition of the enzyme by swainsonine. Chui et al. (1997) found that mice in whom the alpha-mannosidase II gene had been disrupted developed a dyserythropoietic anemia concurrent with loss of erythrocyte complex N-glycans. Unexpectedly, nonerythroid cell types continued to produce complex N-glycans by an alternate pathway comprising a distinct alpha-mannosidase. These studies revealed cell type-specific variations in N-linked oligosaccharide biosynthesis and an essential role for alpha-mannosidase II in the formation of erythroid complex N-glycans. Alpha-mannosidase II deficiency elicited a phenotype in mice that corresponds to human congenital dyserythropoietic anemia type II. Although a genetic defect of MAN2A1 was thought to cause congenital dyserythropoietic anemia type II, or HEMPAS (224100), Gasparini et al. (1997) excluded it as a candidate gene by demonstrating linkage of the disorder to markers on chromosome 20. Protein glycosylation in the Golgi apparatus produces structural variation at the cell surface and contributes to immune self-recognition. Altered protein glycosylation and antibodies that recognize endogenous glycans have been associated with various autoimmune syndromes, with the possibility that such abnormalities may reflect genetic defects in glycan formation. Studying mice with a null allele for alpha-mannosidase II, Chui et al. (2001) showed that mutation in this gene, which regulates the hybrid to complex branching pattern of extracellular asparagine (N)-linked oligosaccharide chains (N-glycans), results in a systemic autoimmune disease similar to human systemic lupus erythematosus (152700). The findings demonstrated a genetic cause of autoimmune disease provoked by a defect in the pathway of protein N-glycosylation.

Full details of the abovementioned studies are described in the following publications, the disclosure of which are hereby incorporated by reference:

Chui, D.; Oh-Eda, M.; Liao, Y. -F.; Panneerselvam, K.; Lai, A.; Marek, K. W.; Freeze, H. H.; Moremen, K. W.; Fukuda, M. N.; Marth, J. D.: Alpha-mannosidase-II deficiency results in dyserythropoiesis and unveils an alternate pathway in oligosaccharide biosynthesis. Cell 90: 157-167, 1997. PubMed ID: 9230311 2. Chui, D.; Sellakumar, G.; Green, S.; Sutton-Smith, M.; McQuistan, T.; Marek, K. W.; Morris, H. R.; Dell, A.; Marth, J. D.: Genetic remodeling of protein glycosylation in vivo induces autoimmune disease. Proc. Nat. Acad. Sci. 98: 1142-1147, 2601.

Further studies establishing the function and utilities of MAN2A1 are found in John Hopkins OMIM database record ID 154582, and in references numbered 971-975 listed hereinbelow.

Reference is now made to MAP3K5 BINDING SITE. Mitogen-activated protein kinase kinase kinase 5 (MAP3K5) is a target gene of GAM26, corresponding to GAM26-TARGET GENE of FIG. 26A. MAP3K5 BINDING SITE is a binding site found in an untranslated region of MAP3K5, corresponding to BINDING SITE of FIG. 26A. FIG. 26D illustrates the complementarity of the nucleotide sequence of MAP3K5 BINDING SITE, designated SEQ ID:244540, to the nucleotide sequence of GAM26 RNA of FIG. 26A, designated SEQ ID:20604.

An additional function of GAM26 is therefore inhibition of mitogen-activated protein kinase kinase kinase 5 (MAP3K5), a gene which encodes an enzyme that phosphorylates and activates two different subgroups of map kinases, mkk4/sek1 and mkk3/mapkk6 (or mkk6) overexpression induces apoptotic cell death. Accordingly, utilities of GAM26 include diagnosis and treatment the abovementioned diseases and clinical conditions.

The function of MAP3K5 has been established by previous studies. Mitogen-activated protein kinase (MAPK) signaling cascades include MAPK or extracellular signal-regulated kinase (ERK), MAPK kinase (MAP2K, also called MKK or MEK), and MAPK kinase kinase (MAP3K, also called MAPKKK or MEKK). MAPKK kinase/MEKK phosphorylates and activates its downstream protein kinase, MAPK kinase/MEK, which in turn activates MAPK. The kinases of these signaling cascades are highly conserved, and homologs exist in yeast, *Drosophila*, and mammalian cells Ichijo et al. (1997) used a similar strategy to identify a nearly identical MAPKKK cDNA, termed ASK1 for apoptosis signal-regulating kinase. The deduced protein contains 1,375 amino acids, and is most closely related to yeast SSK2 and SSK22, which are upstream regulators of yeast HOG1 MAPK. ASK1 expression complements a yeast mutant lacking functional SSK2 and SSK22. ASK1 also activates MKK3 (60231), MKK4 (SEK1), and MKK6 (601254). Overexpression of ASK1 induces apoptotic cell death, and ASK1 is activated in cells treated with tumor necrosis factor-alpha (TNFA; 191160). Nishitoh et al. (1998) showed that ASK1 interacts with members of the TRAF family and is activated by TRAF2 (601895) in the TNF-signaling pathway. After activation by TRAF2, ASK1 activates MKK4, which in turn activates JNK. Thus, ASK1 is mediator of TRAF2-induced JNK activation.

Animal model experiments lend further support to the function of MAP3K5. Using a forward genetic screen of *C. elegans* mutants, Kim et al. (2002) showed that viable worms lacking esp2 and esp8, homologs of the mammalian MAP kinases SEK1 and ASK1, were highly susceptible to and died more rapidly from both a gram-negative bacterium, *P. aeruginosa*, and a gram-positive organism, *E. faecalis*, than wildtype worms. RNA-interference and biochemical analyses likewise implicated the p38 MAP kinase homolog, pmk1, in susceptibility to these pathogens. Kim et al. (2002) concluded that MAP kinase signaling, which is also involved in plant pathogen resistance, is a conserved element in innate metazoan immunity to diverse pathogens.

It is appreciated that the abovementioned animal model for MAP3K5 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Kim D. H.; Feinbaum, R.; Alloing, G.; Emerson, F. E.; Garsin, D. A.; Inoue, H.; Tanaka-Hino, M.; Hisamoto, N.; Matsumoto, K.; Tan, M. W.; Ausubel, F. M.: A conserved p38 MAP kinase pathway in *Caenorhabditis elegans* innate immunity. Science 297: 623-626, 2002. PubMed ID: 12142542 Nishitoh, H.; Saitoh, M.; Mochida, Y.; Takeda, K.; Nakano H.; Rothe, M.; Miyazono, K.; Ichijo, H.: ASK1 is essential for JNK/SAPK activation by TRAF2. Molec. Cell 2: 389-395, 1998.

Further studies establishing the function and utilities MAP3K5 are found in John Hopkins OMIM database record ID 602448, and in references numbered 976-985 listed hereinbelow.

Reference is now made to MAP4K5 BINDING SITE. Mitogen-activated protein kinase kinase kinase kinase 5 (MAP4K5) is a target gene of GAM26, corresponding to GAM26-TARGET GENE of FIG. 26A. MAP4K5 BINDING SITE is a binding site found in an untranslated region of MAP4K5, corresponding to BINDING SITE of FIG. 26A. FIG. 26D illustrates the complementarity of the nucleotide sequence of MAP4K5 BINDING SITE, designate SEQ ID:245274, to the nucleotide sequence of GAM26 RNA of FIG. 26A, designated SEQ ID:20604.

A further function of GAM26 is therefore inhibition of mitogen-activated protein kinase kinase kinase kinase 5 (MAP4K5), a gene which encodes an enzyme that is a serine/threonine protein kinase required for spore wall development, activates Jun N-terminal kinase; member of the STE20 kinase family. Accordingly, utilities of GAM26 include diagnosis and treatment of the abovementioned diseases and clinical conditions.

The function of MAP4K5 has been established by previous studies. Protein kinases (PKs) are critical to the regulation of many cellular processes, including growth factor response, cytoskeletal changes, gene expression, and metabolism. Mitogen-activated PKs (MAPKs) are a family of serine/threonine involved in highly conserved cascades that control these processes. MAPKs are activated by MAPK kinases (MAP2Ks), which are activated by MAP2K kinases (MAP3Ks), which are activated by MAP3K kinases (MAP4Ks). (For example, ERK2 (MAPK1; 16948) is activated by phosphorylation of ser/thr residues by its upstream kinase, MEK1 (MAP2K1; 176872), which is itself activated by MEKK1 (MAP3K1; 600982). Another MAPK, JNK (MAPK8; 601158), is predominantly activated in response to stress. JNK expression is also regulated by upstream kinases (e.g., MAP2K4; 601335), which are activated by MAP3Ks. Homologs of the S. cerevisiae STE20 and SPS1 proteins are predicted to link the membrane with the cytoplasmic signaling machinery; see 602255. By screening a T-cell library with a PCR-derived probe that was similar to yeast STE20, Tung and Blenis (1997) obtained a cDNA encoding MAP4K5, which they called 'kinase homologous to SPS1/STE20,' or KHS. Sequence analysis revealed that the 846-amino acid MAP4K5 protein contains an N-terminal catalytic domain and shares 55% amino acid identity with MAP4K2 (603166). Northern blot analysis detected a 4.5-kb MAP4K5 transcript in all tissues tested, namely spleen, thymus, prostate, testis, ovary, small intestine, colon, and peripheral blood leukocytes. SDS-PAGE and immunoblot analyses determined that MAP4K5 is expressed as a 95-kD protein. Confocal laser microscopy demonstrated cytoplasmic expression MAP4K5. Functional analyses showed that MAP4K5 has kinase activity and that it activates JNK but not ERK1 (MAPK3; 601795) or MAPK14 (600289) through MAP2K4.

Full details of the abovementioned studies are described in the following publications, the disclosure of which are hereby incorporated by reference:

Tung, R. M.; Blenis, J.: A novel human SPS1/STE20 homologue, KHS, activates Jun N-terminal kinase. Oncogene 14: 653-659, 1997.

Further studies establishing the function and utilities of MAP4K5 are found in John Hopkins OMIM database record ID 604923, and in references numbered 986 listed hereinbelow.

Referring now to MAP4K5 BINDING SITE. Mitogen-activated protein kinase kinase kinase kinase 5 (MAP4K5) is a target gene of GAM26, corresponding to GAM26-TARGET GENE of FIG. 26A. MAP4K5 BINDING SITE is a binding site found in an untranslated region of MAP4K5, corresponding to BINDING SITE of FIG. 26A. FIG. 26D illustrates the complementarity of the nucleotide sequence of MAP4K5 BINDING SITE, designated SEQ ID:245277, to the nucleotide sequence of GAM26 RNA of FIG. 26A, designated SEQ ID:20604.

Yet a further function of GAM26 is therefore inhibition of mitogen-activated protein kinase kinase kinase kinase 5 (MAP4K5), a gene which encodes a an enzyme that is a serine/threonine protein kinase required for spore wall development activates Jun N-terminal kinase; member of the STE20 kinase family. Accordingly, utilities of GAM26 include diagnosis and treatment of the abovementioned diseases and clinical conditions. The function and utilities of MAP4K5 have been established by previous studies, as described hereinabove with reference to FIG. 26D.

Referring now to MAP4K5 BINDING SITE. Mitogen-activated protein kinase kinase kinase kinase 5 (MAP4K5) is a target gene of GAM26, corresponding to GAM26-TARGET GENE of FIG. 26A. MAP4K5 BINDING SITE is a binding site found in an untranslated region of MAP4K5, corresponding to BINDING SITE of FIG. 26A. FIG. 26D illustrates the complementarity of the nucleotide sequence of MAP4K5 BINDING SITE, designated SEQ ID:245293, to the nucleotide sequence of GAM26 RNA of FIG. 26A, designated SEQ ID:20604.

Another function of GAM26 is therefore inhibition of mitogen-activated protein kinase kinase kinase kinase 5 (MAP4K5), a gene which encodes an enzyme that is a serine/threonine protein kinase required for spore wall development, activates Jun N-terminal kinase; member of the STE20 kinase family. Accordingly, utilities of GAM26 include diagnosis and treatment of the abovementioned diseases and clinical conditions. The function and utilities of MAP4K5 have been established by previous studies, as described hereinabove with reference to FIG. 26D.

Referring now to MAP4K5 BINDING SITE. Mitogen-activated protein kinase kinase kinase kinase 5 (MAP4K5) is a target gene of GAM26, corresponding to GAM26-TARGET GENE of FIG. 26A. MAP4K5 BINDING SITE is a binding site found in an untranslated region of MAP4K5, corresponding to BINDING SITE of FIG. 26A. FIG. 26D illustrates the complementarity of the nucleotide sequence of MAP4K5 BINDING SITE, designated SEQ ID:245294, to the nucleotide sequence of GAM26 RNA of FIG. 26A, designated SEQ ID:20604.

Yet another function of GAM26 is therefore inhibition of mitogen-activated protein kinase kinase kinase kinase 5 (MAP4K5), a gene which encodes an enzyme that is a serine/threonine protein kinase required for spore wall development, activates Jun N-terminal kinase; member of the STE20 kinase family. Accordingly, utilities of GAM26 include diagnosis and treatment of the abovementioned diseases and clinical conditions. The function and utilities of MAP4K5 have been established by previous studies, as described hereinabove with reference to FIG. 26D.

Reference is now made to MAPK1 BINDING SITE. Mitogen-activated protein kinase 1 (MAPK1) is a target gene of GAM26, corresponding to GAM26-TARGET GENE of FIG. 26A. MAPK1 BINDING SITE is a binding site found in an untranslated region of MAPK1, corresponding to BINDING SITE of FIG. 26A. FIG. 26D illustrates the complementarity of the nucleotide sequence of MAPK1 BINDING SITE, designated SEQ ID:245382, to the nucleotide sequence of GAM26 RNA of FIG. 26A, designated SEQ ID:20604.

An additional function of GAM26 is therefore inhibition of mitogen-activated protein kinase 1 (MAPK1), a gene which encodes an enzyme that phosphorylates microtubule-associated protein-2 (map2) myelin basic protein (mbp), and elk-1; may promote entry in the cell cycle. Accordingly, utilities of GAM26 include diagnosis and treatment of the abovementioned diseases and clinical conditions.

The function of MAPK1 has been established by previous studies. Forcet et al. (2002) showed that in embryonic kidney cells expression full-length, but not cytoplasmic domain-truncated, DCC (120470), NTN1 (601614) causes increased transient phosphorylation and activity of ERK1 and ERK2, but not of JNK1 (601158), JNK2 (602896), or p38 (MAPK14; 600289). This phosphorylation was mediated by MEK1 and/or MEK2. NTN1 also activated the transcription factor ELK1 (311040) and serum response element-regulated gene expression. Immunoprecipitation analysis showed interaction of full-length DCC with MEK1/2 in the present or absence of NTN1. Forcet et al. (2002) showed that activation of Dcc by Ntn1 in rat embryonic day-13 dorsal spinal cord stimulates and is required for the outgrowth of commissural axons and Erk1/2 activation. Immunohistochemical analysis demonstrated expression of activated Erk1/2 in embryonic commissural axons, and this expression was diminished in Dcc or Ntn1 knockout animals. Forcet et al. (2002) concluded that the MAPK pathway is involved in responses to NTN1 and proposed that ERK activation affects axonal growth by phosphorylation of microtubule-associated proteins and neurofilaments. Stefanovsky et al. (2001) showed that epidermal growth factor (131530) induces immediate, ERK1/ERK2-dependent activation of endogenous ribosomal transcription, while inactivation of ERK1/ERK2 causes an equally immediate reversion to the basal transcription level. ERK1/ERK2 was found to phosphorylate the architectural transcription factor UBF (600673) at amino acids 117 and 201 within HMG boxes 1 and 2, preventing their interaction with DNA. Mutation of these sites inhibited transcription activation and abrogated the transcriptional response to ERK1/ERK2. Thus, growth factor regulation of ribosomal transcription likely acts by a cyclic modulation of DNA architecture. The data suggested a central role for ribosome biogenesis in growth regulation Full details of the abovementioned studies are described in the following publications, the disclosure of which are hereby incorporated by reference:

Forcet, C.; Stein, E.; Pays, L.; Corset, V.; Llambi, F.; Tessier-Lavigne, M.; Mehlen, P.: Netrin-1-mediated axon outgrowth requires deleted in colorectal cancer-dependent MAPK activation. Nature 417: 443-447, 2002. PubMed ID:11986622. Stefanovsky, V. Y.; Pelletier, G.; Hannan, R.; Gagnon-Kugler, T.; Rothblum, L. I.; Moss, T.: An immediate response of ribosomal transcription to growth factor stimulation in mammals is mediated by ERK phosphorylation of UBF. Molec. Cell 8: 1063-1073, 2001.

Further studies establishing the function and utilities of MAPK1 are found in John Hopkins OMIM database record ID 176948, and in references numbered 987-1001 listed hereinbelow.

Referring now to MAPK1 BINDING SITE. Mitogen-activated protein kinase 1 (MAPK1) is a target gene of GAM26, corresponding to GAM26-TARGET GENE of FIG. 26A. MAPK1 BINDING SITE is a binding site found in an untranslated region of MAPK1, corresponding to BINDING SITE of FIG. 26A. FIG. 26D illustrates the complementarity of the nucleotide sequence of MAPK1 BINDING SITE, designated SEQ ID:245394, to the nucleotide sequence of GAM26 RNA of FIG. 26A, designated SEQ ID:20604.

A further function of GAM26 is therefore inhibition of mitogen-activated protein kinase 1 (MAPK1), a gene which encodes an enzyme that phosphorylates microtubule-associated protein-2 (map2). myelin basic protein (mbp), and elk-1; may promote entry in the cell cycle. Accordingly, utilities of GAM26 include diagnosis and treatment of the abovementioned diseases and clinical conditions. The function and utilities of MAPK1 have been established by previous studies, as described hereinabove with reference to FIG. 26D.

Reference is now made to MATK BINDING SITE. Megakaryocyte-associated tyrosine kinase (MATK) is a target gene of GAM26, corresponding to GAM26-TARGET GENE of FIG. 26A. MATK BINDING SITE is a binding site found in an untranslated region of MATK, corresponding to BINDING SITE of FIG. 26A. FIG. 26D illustrates the complementarity of the nucleotide sequence of MATK BINDING SITE, designated SEQ ID:247365, to the nucleotide sequence of GAM26 RNA of FIG. 26A, designated SEQ ID:20604.

Yet a further function of GAM26 is therefore inhibition of megakaryocyte-associated tyrosine kinase (MATK), a gene which encodes an enzyme that can phosphorylate members of the SRC family of PTKs at the regulatory tyrosine residue. Accordingly, utilities of GAM26 include diagnosis and treatment of the abovementioned diseases and clinical conditions.

The function of MATK has been established by previous studies. In the mouse, Klages et al. (1994) reported the molecular cloning and preliminary functional characterization of a nonreceptor protein tyrosine kinase (PTK) that is related to CSK (124095). This PTK, designated Ctk for CSK-type protein-tyrosine kinase, was found to be a 52-kD protein expressed primarily in brain and predicted to be structurally similar to CSK. Klages et al. (1994) found that, like CSK, Ctk can phosphorylate members of the SRC family of PTKs at the regulatory tyrosine residue. Thus, Ctk and CSK define a family of kinases that phosphorylate carboxy-terminal regulatory tyrosine residues. Protein-tyrosine kinases play major roles in signal transduction pathways. Bennett et al. (1994) cloned a novel tyrosine kinase, termed megakaryocyte-associated tyrosine kinase (MATK) from a human megakaryocyte cDNA library using degenerate PCR. The MATK cDNA encodes a 527-amino acid protein that shows 50% amino acid identity to CSK and has the structural features of the CSK subfamily: SRC homology SH (2) and SH3 domains, a catalytic domain, a unique N terminus, lack of myristylation signals, lack of a negative regulatory phosphorylation site, and lack of an autophosphorylation site Bennett et al. (1994) localized the MATK protein to the cytoplasm of megakaryocytic cells using immunofluorescence and immunoblot analysis of subcellular fractions. They showed by Northern blotting that the MATK gene is expressed abundantly in megakaryocytes and at a lower level in adult brain as a 2.3-kb transcript; it was not delectably expressed in any other examined tissue. Bennett et al. (1994) found that MATK expression is upregulated in megakaryocytic cells that are induced to differentiate by phorbol ester. They suggested that MATK functions in signal transduction pathways that are important in megakaryocyte growth and/or differentiation. Avraham et al. (1995) showed that MATK can phosphorylate the SRC (176947) protein in vitro. Sakano et al. (1994) cloned the MATK cDNA, name HYL by them, and localized the gene to 19p13.3 using fluorescence in situ hybridization. Avraham et al. (1995) mapped the MATK gene to chromosome 19 using somatic cell hybrids and found that the murine Matk gene maps within a region of synteny on chromosome 10. Zrihan-Licht et al. (1997) reported that MATK is expressed in human breast cancer but not in the adjacent normal breast tissues, suggesting that MATK might be involved in signaling in some cases of breast cancer. Zrihan-Licht et al. (1997) demonstrated that MATK interacts with ErbB-2 (164870) in vivo upon heregulin stimulation and that this interaction occurs via the SH2 domain of MATK.

Full details of the abovementioned studies are described in the following publications, the disclosure of which are hereby incorporated by reference:

Klages, S.; Adam, D.; Class, K.; Fargnoli, J.; Bolen, J. B.; Penhallow, R. C.: Ctk: a protein-tyrosine kinase related to Csk that defies an enzyme family. Proc. Nat. Acad. Sci. 91: 2597-2601, 1994. PubMed ID: 7511815 1. Avraham, S.; Jiang, S.; Ota, S.; Fu, Y.; Deng, B.; Dowler, L. L.; White, R. A.; Avraham, H.: Structural and functional studies of the intracellular tyrosine kinase MATK gene and its translated product. J. Biol. Chem. 270: 1833-1842, 1995.

Further studies establishing the function and utilities of MATK are found in John Hopkins OMIM database record ID 600038, and in references numbered 1002-1006 listed hereinbelow.

Reference is now made to MID2 BINDING SITE. Midline 2 (MID2) is a target gene of GAM26, corresponding to GAM26-TARGET GENE of FIG. 26A. MID2 BINDING SITE is a binding site found in an untranslated region of MID2, corresponding to BINDING SITE of FIG. 26A. FIG. 26D illustrates the complementarity of the nucleotide sequence of MID2 BINDING SITE, designated SEQ ID:254906, to the nucleotide sequence of GAM26 RNA of FIG. 26A, designated SEQ ID:20604.

Another function of GAM26 is therefore inhibition of midline 2 (MID2), a gene which encodes a protein that has a fibronectin type III domain, similar to FXY/MID1. Accordingly, utilities of GAM26 include diagnosis and treatment of the abovementioned diseases and clinical conditions.

The function of MID2 has been established by previous studies. By searching an EST database to identify human homologs of the MID1 gene, Buchner et al. (1999) identified MID2, a transcript closely related to MID1. MID1 and MID2 display 84% similarity and 77% identity at the protein level, and 70% identity at the nucleotide level. Like MID1, MID2 displays a RING finger, 2 B-boxes, a coiled-coil, and a conserved RFP-like C-terminal domain. The mouse Mid2 protein shows 99.3% identity with human MID2. MID2 appears to be part of a linkage group conserved between mouse and man. Buchner et al. (1999) found that the MID2 gene contains 9 exons. The junction sequences were all in agreement with the 5-prime and 3-prime splice site consensus motifs, with the exception of the exon 6 5-prime splice site which showed the sequence GCAAGT instead of the consensus GT dinucleotide reported in all but 0.13% of donor splice site sequences (Shapiro and Senapathy, 1987). MID1 and MID2 have similar intron-exon structures, with the exception of MID2 exon 6 which had 30 additional amino acids as compared with MID1.

Full details of the abovementioned studies are described in the following publications, the disclosure of which are hereby incorporated by reference:

Buchner, G.; Montini, E.; Andolfi, G.; Quaderi, N.; Cainarca, S.; Messali, S.; Bassi, M. T.; Ballabio, A.; Meroni, G.; Franco, B.: MID2, a homologue of the Opitz syndrome gene MID1: similarities in subcellular localization and differences in expression during development. Hum. Molec. Genet 8: 1397-1407, 1999. PubMed ID: 10400986 3. Shapiro, M. B.; Senapathy, P.: RNA splice junctions of different classes of eukaryotes: sequence statistics and functional implications in gene expression. Nucleic Acids Res. 15: 7155-7174, 1987.

Further studies establishing the function and utilities of MID2 are found in John Hopkins OMIM database record ID 300204, and in reference numbered 1007-1009 listed hereinbelow.

Referring now to MID2 BINDING SITE. Midline 2 (MID2) is a target gene of GAM26, corresponding to GAM26-TARGET GENE of FIG. 26A. MID2 BINDING SITE is a binding site found in an untranslated region of MID2, corresponding to BINDING SITE of FIG. 26A. FIG. 26D illustrates the complementarity of the nucleotide sequence of MID2 BINDING SITE, designated SEQ ID:254911, to the nucleotide sequence of GAM26 RNA of FIG. 26A, designated SEQ ID:20604.

Yet another function of GAM26 is therefore inhibition of midline 2 (MID2), a gene which encodes a protein that has a fibronectin type III domain, similar to FXY/MID1. Accordingly, utilities of GAM26 include diagnosis and treatment of the abovementioned diseases and clinical conditions. The function and utilities of MID2 have been established by previous studies, as described hereinabove with reference to FIG. 26D.

Referring now to MID2 BINDING SITE. Midline 2 (MID2) is a target gene of GAM26, corresponding to GAM26-TARGET GENE of FIG. 26A. MID2 BINDING SITE is a binding site found in an untranslated region of MID2, corresponding to BINDING SITE of FIG. 26A. FIG. 26D illustrates the complementarity of the nucleotide sequence of MID2 BINDING SITE, designated SEQ ID:254918, to the nucleotide sequence of GAM26 RNA of FIG. 26A, designated SEQ ID:20604.

An additional function of GAM26 is therefore inhibition of midline 2 (MID2), a gene which encodes a protein that Has fibronectin type III domain. Also has fibronectin type III domain, similar to FXY/MID1. Accordingly, utilities of GAM26 include diagnosis and treatment of the abovementioned diseases and clinical conditions. The function and utilities of MID2 have been established by previous studies, as described hereinabove with reference to FIG. 26D.

Referring now to MID2 BINDING SITE. Midline 2 (MID2) is a target gene of GAM26, corresponding to GAM26-TARGET GENE of FIG. 26A. MID2 BINDING SITE is a binding site found in an untranslated region of MID2, corresponding to BINDING SITE of FIG. 26A. FIG. 26D illustrates the complementarity of the nucleotide sequence of MID2 BINDING SITE, designated SEQ ID:254922, to the nucleotide sequence of GAM26 RNA of FIG. 26A, designated SEQ ID:20604.

A further function of GAM26 is therefore inhibition of midline 2 (MID2), a gene which encodes a protein that has fibronectin type III domain, similar to FXY/MID1. Accordingly, utilities of GAM26 include diagnosis and treatment of the abovementioned diseases and clinical conditions. The function and utilities of MID2 have been established by previous studies, as described hereinabove with reference to FIG. 26D.

Referring now to MID2 BINDING SITE. Midline 2 (MID2) is a target gene of GAM26, corresponding to GAM26-TARGET GENE of FIG. 26A. MID2 BINDING SITE is a binding site found in an untranslated region of MID2, corresponding to BINDING SITE of FIG. 26A. FIG. 26D illustrates the complementarity of the nucleotide sequence of MID2 BINDING SITE, designated SEQ ID:254923, to the nucleotide sequence of GAM26 RNA of FIG. 26A, designated SEQ ID:20604.

Yet a further function of GAM26 is therefore inhibition of midline 2 (MID2), a gene which encodes a protein that has fibronectin type III domain, similar to FXY/MID1. Accordingly, utilities of GAM26 include diagnosis and treatment of the abovementioned diseases and clinical conditions. The function and utilities of MID2 have been established by previous studies, as described hereinabove with reference to FIG. 26D.

Referring now to MLLT1 BINDING SITE. Myeloid/lymphoid or mixed-lineage leukemia (trithorax (*Drosophila*) horn (MLLT1) is a target gene of GAM26, corresponding to GAM26-TARGET GENE of FIG. 26A. MLLT1 BINDING SITE is a binding site found in an untranslated region of MLLT1, corresponding to BINDING SITE of FIG. 26A. FIG. 26D illustrates the complementarity of the nucleotide sequence of MLLT1 BINDING SITE, designated SEQ ID:255942, to the nucleotide sequence of GAM26 RNA of FIG. 26A, designated SEQ ID:20604.

Another function of GAM26 is therefore inhibition of myeloid/lymphoid or mixed-lineage leukemia trithorax (*Drosophila*) horn (MLLT1), a gene which encodes a protein that is associated with acute leukemias. Accordingly, utilities of GAM26 include diagnosis and treatment of the abovementioned diseases and clinical conditions. The function and utilities of MLLT1 have been established by previous studies, as described hereinabove with reference to FIG. 26D.

Referring now to MLLT1 BINDING SITE. Myeloid/lymphoid or mixed-lineage leukemia (trithorax (*Drosophila*) horn (MLLT1) is a target gene of GAM26, corresponding to GAM26-TARGET GENE of FIG. 26A. MLLT1 BINDING SITE is a binding site found in an untranslated region of MLLT1, corresponding to BINDING SITE of FIG. 26A. FIG. 26D illustrates the complementarity of the nucleotide sequence of MLLT1 BINDING SITE, designated SEQ ID:255948, to the nucleotide sequence of GAM26 RNA of FIG. 26A, designated SEQ ID:20604.

Yet another function of GAM26 is therefore inhibition of myeloid/lymphoid or mixed-lineage leukemia (trithorax (*Drosophila*) horn (MLLT1), a gene which encodes a protein that is associated with acute leukemias. Accordingly, utilities of GAM26 include diagnosis and treatment of the abovementioned diseases and clinical conditions. The function and utilities of MLLT1 have been established by previous studies, as described hereinabove with reference to FIG. 26D.

Referring now to NTRK3 BINDING SITE. Neurotrophic tyrosine kinase, receptor, type 3 (NTRK3) is a target gene of GAM26, corresponding to GAM26-TARGET GENE of FIG. 26A. NTRK3 BINDING SITE is a binding site found in an untranslated region of NTRK3, corresponding to BINDING SITE of FIG. 26A. FIG. 26D illustrates the complementarity of the nucleotide sequence of NTRK3 BINDING SITE, designated SEQ ID:255948, to the nucleotide sequence of GAM26 RNA of FIG. 26A, designated SEQ ID:20604.

An additional function of GAM26 is therefore inhibition of neurotrophic tyrosine kinase, receptor, type 3 (NTRK3), a gene which encodes a protein that is a tyrosine-protein kinase receptor. Accordingly, utilities of GAM26 include diagnosis and treatment of the abovementioned diseases and clinical conditions. The function and utilities of NTRK3 have been established by previous studies, as described here above with reference to FIG. 26D.

Referring now to MLLT1 BINDING SITE. Myeloid/lymphoid or mixed-lineage leukemia (trithorax (*Drosophila*) horn (MLLT1) is a target gene of GAM26, corresponding to GAM26-TARGET GENE of FIG. 26A. MLLT1 BINDING SITE is a binding site found in an untranslated region of MLLT1, corresponding to BINDING SITE of FIG. 26A. FIG. 26D illustrates the complementarity of the nucleotide sequence of MLLT1 BINDING SITE, designated SEQ ID:255952, to the nucleotide sequence of GAM26 RNA of FIG. 26A, designated SEQ ID:20604.

A further function of GAM26 is therefore inhibition of myeloid/lymphoid or mixed-lineage leukemia (trithorax (*Drosophila*) horn (MLLT1), a gene which encodes a protein that is associated with acute leukemias. Accordingly, utilities of GAM26 include diagnosis and treatment of the abovementioned diseases and clinical conditions. The function and utilities of MLLT1 have been established by previous studies, as described hereinabove with reference to FIG. 26D.

Referring now to MLLT1 BINDING SITE. Myeloid/lymphoid or mixed-lineage leukemia (trithorax (*Drosophila*) horn (MLLT1) is a target gene of GAM26, corresponding to GAM26-TARGET GENE of FIG. 26A. MLLT1 BINDING SITE is a binding site found in an untranslated region of MLLT1, corresponding to BINDING SITE of FIG. 26A. FIG. 26D illustrates the complementarity of the nucleotide sequence of MLLT1 BINDING SITE, designated SEQ ID:255957, to the nucleotide sequence of GAM26 RNA of FIG. 26A, designated SEQ ID:20604.

Yet a further function of GAM26 is therefore inhibition of myeloid/lymphoid or mixed-lineage leukemia (trithorax (*Drosophila*) horn (MLLT1), a gene which encodes a protein that is associated with acute leukemias. Accordingly, utilities of GAM26 include diagnosis and treatment of the abovementioned diseases and clinical conditions. The function and utilities of MLLT1 have been established by previous studies, as described hereinabove with reference to FIG. 26D.

Reference is now made to MPP6 BINDING SITE. MEMBRANE PROTEIN, PALMITOYLATED 6; MPP6 (MPP6) is a target gene of GAM26, corresponding to GAM26-TARGET GENE of FIG. 26A. MPP6 BINDING SITE is a binding site found in an untranslated region of MPP6, corresponding to BINDING SITE of FIG. 26A. FIG. 26D illustrates the complementarity of the nucleotide sequence of MPP6 BINDING SITE, designated SEQ ID:259906, to the nucleotide sequence of GAM26 RNA of FIG. 26A, designated SEQ ID:20604.

Another function of GAM26 is therefore inhibition of MEMBRANE PROTEIN, PALMITOYLATED 6; MPP6 (MPP6), a gene which encodes a protein that may regulate transmembrane proteins that bind calcium, calmodulin, or nucleotides. Accordingly, utilities of GAM26 include diagnosis and treatment of the abovementioned diseases and clinical conditions.

The function of MPP6 has been established by previous studies. By searching an EST database with DLG2 (603583) as the probe, followed by PCR of a brain cDNA library and 5-prime RACE, Tseng et al. (2001) obtained a cDNA encoding MPP6, which they called VAM1 for VELI (603380) associated MAGUK-1. The deduced 540-amino acid protein has a single PDZ domain, a central SH3 domain, and a C-terminal GUK domain, resembling other members of the p55 MAGUK subfamily. Like MPP1, MPP6 also contains a protein 4.1 (EPB41; 130500)-binding domain with its characteristic KKKK sequence, as well as a leucine zipper and 2 phosphorylation sites. Northern blot analysis revealed expression of an abundant 2.3-kb transcript and a minor 4.2-kb transcript only in testis. RT-PCR analysis detected predominant expression in testis, with lower amounts in ovary, prostate, thymus, small intestine, and several other tissues; VELI has a similar expression pattern. GST pull-down and mutation analyses indicated that a domain N-terminal of the PDZ region of VAM1 contains the minimal VELI-binding sequence. No binding between VAM1 and EPB41 was detected. Kamberov et al. (2000) cloned and characterized the mouse Mpp5 (606958) and Mpp6 genes, which they called Pals1 and Pals2, respectively. The Pals proteins bind to mouse Lin7 (VELI) through a region N-terminal to their PDZ domains.

Full details of the abovementioned studies are described in the following publications, the disclose of which are hereby incorporated by reference:

amberov, E.; Makarova, O.; Roh, M.; Liu, A.; Karnak, D.; Straight, S.; Margolis, B.: Molecular cloning and characterization of Pals, proteins associated with mLin-7. J. Biol. Chem. 275: 11425-11431, 2000. PubMed ID: 10753959 2. Tseng, T. C.; Marfatia, S. M.; Bryant, P. J.; Pack, S.; Zhuang, A.; O'Brien, J. E.; Lin, L.; Hanada, T.; Chishti, A. H.: VAM-1: a new member of the MAGUK family binds to human Veli-1 through a conserved domain. Biochim. Biophys. Acta 1518: 249-259, 2001.

Further studies establishing the function and utilities of MPP6 are found in John Hopkins OMIM database record ID 606959, and in references numbered 1010-1011 listed hereinbelow.

Referring now to MPP6 BINDING SITE MEMBRANE PROTEIN, PALMITOYLATED 6; MPP6 (MPP6) is a target gene of GAM26, corresponding to GAM26-TARGET GENE of FIG. 26A. MPP6 BINDING SITE is a binding site found in an untranslated region of MPP6, corresponding to BINDING SITE of FIG. 26A. FIG. 26D illustrates the complementarity of the nucleotide sequence of MPP6 BINDING SITE, designated SEQ ID:259910, to the nucleotide sequence of GAM26 RNA of FIG. 26A, designated SEQ ID:20604.

Yet another function of GAM26 is therefore inhibition of MEMBRANE PROTEIN, PALMITOYLATED 6; MPP6 (MPP6), a gene which encodes a protein that may regulate transmembrane proteins that bind calcium, calmodulin, or nucleotides. Accordingly, utilities of GAM26 include diagnosis and treatment of the abovementioned diseases and clinical conditions. The function and utilities of MPP6 have been established by previous studies, as described hereinabove with to FIG. 26D.

Reference is now made to MTA1L1 BINDING SITE. Metastasis-associated 1-like 1 (MTA1L1) is a target gene of GAM26, corresponding to GAM26-TARGET GENE of FIG. 26A. MTA1L1 BINDING SITE is a binding site found in an untranslated region of MTA1L1, corresponding to BINDING SITE of FIG. 26A. FIG. 26D illustrates the complementarity of the nucleotide sequence of MTA1L1 BINDING SITE, designated SEQ ID:261852, to the nucleotide sequence of GAM26 RNA of FIG. 26A, designated SEQ ID:20604.

An additional function of GAM26 is therefore inhibition of metastasis-associated 1-like 1 (MTA1L1), a gene which encodes a protein that regulates histone deacetylase core complex enzymatic activity. Accordingly, utilities of GAM26 include diagnosis and treatment of the abovementioned diseases and clinical conditions.

The function of MTA1L1 has been established by studies. The p53 tumor suppressor (191170) is a transcriptional factor whose activity is modulated by protein stability and posttranslational modifications including acetylation. Luo et al. (2000) showed that deacetylation of p53 is mediated by a histone deacetylase-1 (HDAC1; 601241)-containing complex. They also purified a p53 target protein, which they named PID, in the deacetylase complexes. PID is identical to MTA1L1, also called MTA2, which had been identified as a component of the nucleosome remodeling and histone deacetylation (NURD) complex. The authors found that MTA1L1 specifically interacts with p53 both in vitro and in vivo, and its expression reduces significantly the steady-state levels of acetylated p53. MTA1L1 expression strongly represses p53-dependent transcriptional activation, and, notably, it modulates p53-mediated cell growth arrest and apoptosis. Luo et al. (2000) concluded that their results show that deacetylation and functional interactions between the MTA1L1-associated NURD complex may represent an important pathway to regulate p53 function. Zhang et al. (1999) showed that MTA2 and the 32-kD MBD3 (603573) proteins are subunits of the NURD complex. Immunoprecipitation analysis showed that MBD3 interacts with HDAC1, RBBP4 (602923), and RBBP7 (602922), but not with MI2 (CHD4; 603277), suggesting that MBD3 is embedded within the NURD complex. The authors found that MTA2 directs the assembly of an active histone deacetylase complex and that the association of MTA2 with the complex requires MBD3. Gel mobility shift analysis determined that both NURD and MBD3 are unable to bind to methylated DNA in the absence of MBD2 (603547). Zhang et al. (1999) proposed that NURD is involved in the transcriptional repression of methylated DNA. Wade et al. (1999) also identified MTA1, MTA1L, and MBD3 as components of the NURD complex, which they referred to as the MI2 complex.

Full details of the abovementioned studies are described in the following publications, the disclosure of which are hereby incorporated by reference:

Futamura, M.; Nishimori, H.; Shiratsuchi, T.; Saji, S.; Nakamura, Y.; Tokino, T.: Molecular cloning, mapping, and characterization of a novel human gene, MTA1-L1, showing homology to a metastasis-associated gene, MTA1. J. Hum. Genet 44: 52-56, 1999. PubMed ID: 9929979 2. Luo, J.; Su, F.; Chen, D.; Shiloh, A.; Gu, W.: Deacetylation of p53 modulates its effect on cell growth and apoptosis. Nature 408: 377-381, 2000.

Further studies establishing the function and utilities of MTA1L1 are found in John Hopkins OMIM database record ID 603947, and in references numbered 1012-1015 listed hereinbelow.

Reference is now made to MTMR1 BINDING SITE. Myotubularin related protein 1 (MTMR1) is a target gene of GAM26, corresponding to GAM26-TARGET GENE of FIG. 26A. MTMR1 BINDING SITE is a binding site found in an untranslated region of MTMR1, corresponding to BINDING SITE of FIG. 26A. FIG. 26D illustrates the complementarity of the nucleotide sequence of MTMR1 BINDING SITE, designated SEQ ID:262287, to the nucleotide sequence of GAM26 RNA of FIG. 26A, designated SEQ ID:20604.

A further unction of GAM26 is therefore inhibition of myotubularin related protein 1 (MTMR1), a gene which encodes a protein that is a member of the myotubularin family of dual specificity protein phosphatases and is associated with biopsy-proven myotubular myopathy. Accordingly, utilities of GAM26 include diagnosis and treatment of the abovementioned diseases and clinical conditions.

The function of MTMR1 has been established by previous studies. X-linked myotubular myopathy is caused by mutations in the MTMR1 (310400) gene. The corresponding protein, myotubularin, contains the consensus active site of tyrosine phosphatases (PTP) and is a dual-specific phosphatase (DSP), acting on both phosphotyrosine and phosphoserine. By searching an EST database, Laporte et al. (1996) identified partial cDNAs encoding MTMR1 (myotubularin-related protein-1), MTMR2 (603557), and (603558). Kioschis et al. (1998) isolated additional cDNAs corresponding to the entire MTMR1 coding region. The predicted MTMR1 protein contains 662 amino acids. The MTMR1 gene contains 16 exons and spans 71 kb. The authors identified 1 cDNA, MTMR1-alpha, that appeared to result from alternative splicing of exon 13. Laporte et al. (1998) identified cDNAs encoding 4 additional MTM1 related proteins, MTMR4 (603559), MTMR5 (603560), MTMR6 (603561), and MTMR7(603562). Phylogenetic analysis of the consensus PTP/DSP region indicated that MTM1, MTMR1, MTMR2, a zebrafish ortholog of MTMR2, and *Drosophila* Mtmh1 form distinct subgroup of the myotubularin protein family. Using Northern blot analysis, Laporte et al. (1998) found that the 3.7-kb MTMR1 mRNA is expressed ubiquitously. An additional 3.1-kb transcript was detected only in placenta. By inclusion within mapped clones, Laporte et al. (1996) localized the MTMR1 gene to Xq28, within the 100 kb telomeric to the MTM1 gene. Kioschis al. (1998) determined that the 2 genes are transcribed in the same direction and are separated by 20 kb. Analysis of the genomic region containing MTM1 and MTMR1 revealed that the 2 genes share a similar structure, suggesting that they are related and arose from an intrachromosomal gene duplication. The authors stated that other examples of intrachromosomal gene duplications in Xq28 include the IDS (309900) gene duplication and a cluster of MAGE genes (see 300016). The MTMR1 gene shares structural similarities with the MTM1 gene, and is also located in the same chromosomal region. Because no MTM1 mutation was found in approximately 20% of males with biopsy-proven myotubular myopathy, Copley et al. (2002) screened the MTMR1 gene for mutations in 14 patients for whom no mutation was found in MTM1. Two of the pedigrees were consistent with X-linked recessive inheritance. No mutations were found in MTMR1.

Full details of the abovementioned studies are described in the following publications, the disclose of which are hereby incorporated by reference:

Copley, L. M.; Zhao, W. D.; Kopacz, K.; Herman, G. E.; Kioschis, P.; Poustka, A.; Taudien, S.; Platzer, M.: Exclusion of mutations in the MTMR1 gene as a frequent cause of X-linked myotubular myopathy. (Letter) Am. J. Med. Genet. 107: 256-258, 2002. PubMed ID: 11807911 2. Kioschis, P.; Wiemann, S.; Heiss, N. S.; Francis, F.; Gotz, C.; Poustka, A.; Taudien, S.; Platzer, M.; Wiehe, T.; Beckmann, G.; Weber, J.; Nordsiek, G.; Rosenthal, A.: Genomic organization of a 225-kb region in Xq28 containing the gene for X-linked myotubular myopathy (MTM1) and a related gene (MTMR1). Genomics 54: 256-266, 1998.

Further studies establishing the function and utilities of MTMR1 are found in John Hopkins OMIM database record ID 300171, and in references numbered 1016-1019 listed hereinbelow.

Reference is now made to MVK BINDING SITE. Mevalonate kinase (mevalonic aciduria) (MVK) is a target gene of GAM26, corresponding to GAM26-TARGET GENE of FIG. 26A. MVK BINDING SITE is a binding site found in an untranslated region of MVK, corresponding to BINDING SITE of FIG. 26A. FIG. 26D illustrates the complementarity of the nucleotide sequence of MVK BINDING SITE, designated SEQ ID:264118, to the nucleotide sequence of GAM26 RNA of FIG. 26A, designated SEQ ID:20604.

Yet a further function of GAM26 is therefore inhibition of mevalonate kinase (mevalonic aciduria) (MVK), a gene which encodes an enzyme that is associated with Mevalonicaciduria and hyperimmunoglobulinemia d and periodic fever syndrome (hids). Accordingly, utilities of GAM26 include diagnosis and treatment of the abovementioned diseases and clinical conditions.

The function of MVK has been established by previous studies. Mevalonicaciduria, the first recognized defect in the biosynthesis of cholesterol and isoprenoids, is a consequence of a deficiency of mevalonate kinase (ATP:mevalonate 5-phosphotransferase; EC 2.7.1.36). Mevalonic acid accumulates because of failure of conversion to 5-phosphomevalonic acid, which is catalyzed by mevalonate kinase. Mevalonic acid is synthesized from 3-hydroxy-3-methylglutaryl-CoA, a reaction catalyzed by HMG-CoA reductase (142910). Cuisset et al. (2001) screened the entire coding region of the MVK gene in 25 unrelated patients with HIDS. The patients (22 Dutch, 1 British, 1 Czech, and 1 Spanish), had mevalonate kinase enzyme activity varying from 1.8 to 28%. A total of 13 different mutations were identified, 7 of which were novel. The most common mutation was V377I (251170.0002), detected in 20 patients, followed by I268T (251170.0004), detected in 7 patients. The frequency or severity of febrile attacks did not differ between V377I positive and negative patients. The data of Cuisset et al. (2001), combined with results from previous reports, showed that HIDS mutations were evenly distributed along the coding region of the MVK gene, in contrast to mutations causing mevalonicaciduria, which clustered between amino acids 243 and 334. Three of the HIDS patients illustrated genotypic and phenotypic overlap with mevalonicaciduria, suggesting that factors in addition to specific mutations are important for the resultant phenotype Full details of the abovementioned studies are described in the following publications, the disclosure of which are hereby incorporated by reference:

Cuisset, L.; Drenth, J. P. H.; Simon, A.; Vincent, M. F.; van der Velde Visser, S.; van der Meer, J. W. M.; Grateau, G.; Delpech, M.; International Hyper-IgD Study Group: Molecular analysis of MVK mutations and enzymatic activity in hyper-IgD and periodic fever syndrome. Europ. J. Hum. Genet. 9: 260-266, 2001. PubMed ID: 11313769 3. Drenth, J. P. H.; Cuisset, L.; Grateau, G.; Vasseur, C.; van de Velde-Visser, S. D.; de Jong, J. G. N.; Beckmann, J. S.; van der Meer, J. W. M.; Delpech, M.; International Hyper-IgD Study Group: Mutations in the gene encoding mevalonate kinase cause hyper-IgD and periodic fever syndrome. Nature Genet. 22: 178-181, 1999.

Further studies establishing the function and utilities of MVK are found in John Hopkins OMIM database record ID 251170, and in references numbered 1020-1037 listed hereinbelow.

Reference is now made to NCKAP1 BINDING SITE. NCK-ASSOCIATED PROTEIN 1 (NCKAP1) is a target gene of GAM26, corresponding to GAM26-TARGET GENE of FIG. 26A. NCKAP1 BINDING SITE is a binding site found in an untranslated region of NCKAP1, corresponding to BINDING SITE of FIG. 26A. FIG. 26D illustrates the complementarity of the nucleotide sequence of NCKAP1 BINDING SITE, designated SEQ ID:268447, to the nucleotide sequence of GAM26 RNA of FIG. 26A, designated SEQ ID:20604.

Another function of GAM26 is therefore inhibition of NCK-ASSOCIATED PROTEIN 1 (NCKAP1), a gene which encodes a protein that is an apoptosis-related protein and is associated with Alzheimer disease. Accordingly, utilities of GAM26 include diagnosis and treatment of the abovementioned diseases and clinical conditions.

The function of NCKAP1 has been established by previous studies. Alzheimer disease (AD; 104300), a major cause of senile dementia, is a progressive neurodegenerative disease of the central nervous system. To identify molecules involved in the AD process, Suzuki et al. (2000) used a modified differential display method to search for genes showing unique expression profiles at the transcriptional level in sporadic AD-affected brains compared to normal brains. Among 31 differentially expressed genes, 1 gene, NCKAP1, showed markedly reduced expression in most of the AD-affected brains examined. Suzuki et al. (2000) isolated a human cDNA containing a full-length NCKAP1 coding sequence. The deduced 1,128-amino acid NCKAP1 protein shares 99.2% amino acid sequence identity with rat Nck-associated protein-1 (Nap1); thus, the authors referred to NCKAP1 as NAP1. NCKAP1 also shares significant sequence homology with HEM1 (141180). NCKAP1 is predicted type II transmembrane protein, a C-terminal transmembrane domain Northern blot analysis detected an approximately 4.2-kb NCKAP1 transcript in all tissues examined except peripheral blood leukocytes, with highest expression in brain, heart, and skeletal muscle. In the brain, NCKAP1 transcripts were present in all subregions examined, with slightly higher expression in the amygdala and hippocampus, which have dense populations of neurons. Northern blot analysis showed that NCKAP1 was expressed at a higher level in adult brain than in fetal brain. In situ hybridization of human brain indicated that NCKAP1 is expressed predominantly in neuronal cells. Suzuki et al. (2000) demonstrated that suppression of NCKAP1 expression using an antisense NCKAP1 oligonucleotide induces apoptosis of neuronal cells. By somatic cell hybrid analysis, Suzuki et al. (2000) mapped the NCKAP1 gene to chromosome 2. They localized the NCKAP1 gene to 2q32.1-q32.2 using FISH.

Full details of the abovementioned studies are described in the following publications, the disclosure of which are hereby incorporated by reference:

Suzuki, T.; Nishiyama, K.; Yamamoto, A.; Inazawa, J.; Iwaki, T.; Yamada, T.; Kanazawa, I.; Sakaki, Y.: Molecular cloning of a novel apoptosis-related gene, human Nap1 (NCKAP1), and its possible relation to Alzheimer disease. Genomics 63: 246-254, 2000.

Further studies establishing the function and utilities of NCKAP1 are found in John Hopkins OMIM database record ID 604891, and in references numbered 1038 listed hereinbelow.

Reference is now made to NFYA BINDING SITE. nuclear transcription factor Y, alpha (NFYA) is a target gene of GAM26, corresponding to GAM26-TARGET GENE of FIG. 26A. NFYA BINDING SITE is a binding site found in an untranslated region of NFYA, corresponding to BINDING SITE of FIG. 26A. FIG. 26D illustrates the complementarity of the nucleotide sequence of NFYA BINDING SITE, designated SEQ ID:272973, to the nucleotide sequence of GAM26 RNA of FIG. 26A, designated SEQ ID:20604.

Yet another function of GAM26 is therefore inhibition of nuclear transcription factor Y, alpha (NFYA), a gene which encodes a protein that stimulates the transcription of various genes by recognizing and binding to a ccaat motif in promoters. Accordingly, utilities of GAM26 include diagnosis and treatment of the abovementioned diseases and clinical conditions.

The function of NFYA has been established by previous studies. NF-Y is a transcription factor thought to be essential for expression of the class II genes of the major histocompatibility complex (MHC; see 142800). It recognizes a CCAAT motif upstream of gene promoters and is probably involved in the regulation of a variety of genes, including those for albumin (103600), alpha-globin (141800), collagen (see 120150), and beta-actin (102630). NF-Y is composed of 2 subunits, NFYA and NFYB (189904), both of which are necessary for DNA binding. This 2-subunit DNA-binding unit has been well conserved during evolution. NFYA and NFYB show striking sequence similarity with the yeast transcription factors Hap2 and Hap3, both which are required for specific binding to a CCAAT-like motif. By in situ hybridization and analysis of somatic cell hybrids, Li et al. (1991) assigned the NFYA gene to 6p21 (close to MHC) and the NFYB gene to human chromosome 12. After in situ hybridization, the maximum concentration of grains was in the region 12q22-q23. By Southern blot analysis of recombinant inbred lines and by in situ hybridization, the Nfya and Nfyb genes were assigned to mouse chromosome 17 and mouse chromosome 10, respectively. CCAAT, an upstream sequence element found in a multitude of higher eukaryotic promoters, serves as the recognition sequence for a variety of mammalian transcription factors. There are at least 3 chromatographically separable CCAAT-binding factors in cells: CP1, CP2, and CTF/NF-1 (600729). These factors recognize overlapping but distinct subsets of known CCAAT-containing promoters and make distinguishable patterns of contacts with DNA in and around the CCAAT motif. Becker et al. (1991) noted that of these 3 factors, CP1 bears the greatest resemblance to the yeast Hap complex. This complex of 3 genes, Hap2, Hap3, and Hap4, is required for the expression of respiration in *Saccharomyces cerevisiae*—in particular, for expression of the principal isoform of cytochrome C (CYC1; 123980). In the yeast, 3 proteins are associated in a heteromeric complex that binds to an upstream activation sequence in the CYC1 promoter. Like Hap2/3/4, CYP in the human consists of a heteromeric association of at least 2 components, CP1A and CP1B, both of which are required for binding. Most strikingly, the subunits of CP1 and Hap2/3/4 can be interchanged in vitro. Thus, CP1 likely represents the human homolog of the yeast Hap complex, with the CP1B fraction containing the Hap2 homolog and the CP1A fraction containing a Hap3 equivalent. Becker et al. (1991) reported the isolation of a HeLa cDNA whose expression in *S. cerevisiae* corrected the respiratory defect in a strain bearing a Hap2 deletion. The cDNA encoding the human Hap2 homolog encodes a protein of 257 amino acids which has a 62-amino acid C-terminal region that shares 73% identity with the essential core region of Hap2.

Full details of the abovementioned studies are described in the following publications, the disclosure of which are hereby incorporated by reference:

Becker, D. M.; Fikes, J. D.; Guarente, L.: A cDNA encoding a human CCAAT-binding protein cloned by functional complementation in yeast Proc. Nat. Acad. Sci. 88: 1968-1972, 1991. PubMed ID: 2000400 2. Li, X. -Y.; Mattei, M. G.; Zaleska-Rutczynska, Z.; Hooft van Huijsduijnen, R.; Figueroa, F.; Nadeau, J.; Benoist, C.; Mathis, D.: One subunit of the transcription factor NF-Y maps close to the major histocompatibility complex in murine and human chromosomes. Genomics 11: 630-634, 1991.

Further studies establishing the function and utilities of NFYA are found in John Hopkins OMIM database record ID 189903, and in reference numbered 1039-1040 listed hereinbelow.

Referring now to NFYA BINDING SITE. Nuclear transcription factor Y, alpha (NFYA) is a target gene of GAM26, corresponding to GAM26-TARGET GENE of FIG. 26A. NFYA BINDING SITE is a binding site found in an untranslated region of NFYA, corresponding to BINDING SITE of FIG. 26A. FIG. 26D illustrates the complementarity of the nucleotide sequence of NFYA BINDING SITE, designated SEQ ID:272979, to the nucleotide sequence of GAM26 RNA of FIG. 26A, designated SEQ ID:20604.

An additional function of GAM26 is therefore inhibition of nuclear transcription factor Y, alpha (NFYA), a gene which encodes a protein that stimulates the transcription of various genes by recognizing and binding to a ccaat motif in promoters. Accordingly, utilities of GAM26 include diagnosis and treatment of the abovementioned diseases and clinical conditions. The function and utilities of NFYA have been established by previous studies, as described hereinabove with reference to FIG. 26D.

Referring now to NPAS2 BINDING SITE. Neuronal PAS domain protein 2 (NPAS2) is a target gene of GAM26, corresponding to GAM26-TARGET GENE of FIG. 26A. NPAS2 BINDING SITE is a binding site found in an untranslated region of NPAS2, corresponding to BINDING SITE of FIG. 26A. FIG. 26D illustrates the complementarity of the nucleotide sequence of NPAS2 BINDING SITE, designated SEQ ID:275935, to the nucleotide sequence of GAM26 RNA of FIG. 26A, designated SEQ ID:20604.

A further function of GAM26 is therefore inhibition of neuronal PAS domain protein 2 (NPAS2) a gene which encodes a protein that is a member of basic helix-loop-helix-PAS family of transcription factors. Accordingly, utilities of GAM26 include diagnosis and treatment of the abovementioned diseases and clinical conditions. The function and utilities of NPAS2 have been established by previous studies, as described hereinabove with reference to FIG. 26D.

Referring now to NPAS2 BINDING SITE. Neuronal PAS domain protein 2 (NPAS2) is a target gene of GAM26, corresponding to GAM26-TARGET GENE of FIG. 26A. NPAS2 BINDING SITE is a binding site found in an untranslated region of NPAS2, corresponding to BINDING SITE of FIG. 26A. FIG. 26D illustrates the complementarity of the nucleotide sequence of NPAS2 BINDING SITE, designated SEQ ID:275947, to the nucleotide sequence of GAM26 RNA of FIG. 26A, designated SEQ ID:20604.

Yet a further function of GAM26 is therefore inhibition of neuronal PAS domain protein 2 (NPAS2), a gene which encodes a protein that is a member of basic helix-loop-helix-PAS family of transcription factors. Accordingly, utilities of GAM26 include diagnosis and treatment of the abovementioned diseases and clinical conditions. The function and utilities of NPAS2 have been established by previous studies, as described here above with reference to FIG. 26D.

Reference is now made to NRG2 BINDING SITE. Neuregulin 2 (NRG2) is a target gene of GAM26, corresponding to GAM26-TARGET GENE of FIG. 26A. NRG2 BINDING SITE is a binding site found in an untranslated region of NRG2, corresponding to BINDING SITE of FIG. 26A. FIG. 26D illustrates the complementarity of the nucleotide sequence of NRG2 BINDING SITE, designated SEQ ID:279264, to the nucleotide sequence of GAM26 RNA of FIG. 26A, designated SEQ ID:20604.

Another function of GAM26 is therefore inhibition of neuregulin 2 (NRG2), a gene which encodes a protein that recruits erbb1 and erbb2 coreceptors resulting in ligand-stimulated tyrosine phosphorylation and activation of the erbb receptors. Accordingly, utilities of GAM26 include diagnosis and treatment of the abovementioned diseases and clinical conditions.

The function of NRG2 has been established by previous studies. Neuregulins are a family of growth and differentiation factors that are related to epidermal growth factor (EGF; 131530). The receptors for neuregulins are the ERBB family of tyrosine kinase transmembrane receptors, which includes the EGF receptor (EGFR; 131550), ERBB2 (164870), ERBB3 (190151), and ERBB4 (600543). Through interaction with ERBB receptors, neuregulins induce the growth and differentiation of epithelial, neuronal, glial, and other types of cells (Burden and Yarden, 1997). In particular, the neuregulin-ERBB signaling pathways play crucial roles in regulating the proliferation and differentiation of Schwann cells, the myelin-forming cells in the peripheral nervous system. For additional information about neuregulins, see NRG1 (142445). Using homologous mouse cDNA as probe, Busfield et al. (1997) cloned 2 NRG2 variants, which they called DON-1r and DON-1b, from a human fetal brain library. The clones predict mosaic proteins containing an N-terminal domain, an immunoglobulin-C2 loop, an EGF-like domain, a transmembrane sequence, and a large cytoplasmic tail showing a number of potential N-linked and O-linked glycosylation sites. DON-1b differs from DON-1r by an 8-amino acid insertion proximal to the transmembrane domain. Northern blot analysis of adult human tissues revealed expression of 3- and 4-kb transcripts restricted to the cerebellum. Expression was also detected in fetal brain and lung. In situ hybridization of mouse brain sections revealed restricted expression in the cerebellum and dentate gyrus.

Full detail of the abovementioned studies are described in the following publications, the disclosure of which are hereby incorporated by reference:

Burden, S.; Yarden, Y.: Neuregulins and their receptors: a versatile signaling module in organogenesis and oncogenesis. Neuron 18: 847-855, 1997. PubMed ID: 9208852 2. Busfield, S. J.; Michnick, D. A.; Chickering, T. W.; Revett, T. L.; Ma, J.; Woolf, E. A.; Comrack, C. A.; Dussault, B. J.; Woolf, J.; Goodearl, A. D. J.; Gearing, D. P.: Characterization of a neuregulin-related gene, Don-1, that is highly expressed in restricted regions of the cerebellum and hippocampus. Molec. Cell. Biol. 17: 4007-4014, 1997.

Further studies establishing the function and utilities of NRG2 are found in John Hopkins OMIM database record ID 603818, and in references numbered 1041-1046 listed hereinbelow.

Reference is now made to NUP98 BINDING SITE. Nucleoporin 98 kD (NUP98) is a target gene of GAM26, corresponding to GAM26-TARGET GENE of FIG. 26A. NUP98 BINDING SITE is a binding site found in an untranslated region of NUP98, corresponding to BINDING SITE of FIG. 26A. FIG. 26D illustrates the complementarity of the nucleotide sequence of NUP98 BINDING SITE, designated SEQ ID:281811, to the nucleotide sequence of GAM26 RNA of FIG. 26A, designated SEQ ID:20604.

Yet another function of GAM26 is therefore inhibition of nucleoporin 98 kD (NUP98), a gene which encodes a protein that functions in the nuclear transport of protein and RNA. Accordingly, utilities of GAM26 include diagnosis and treatment of the abovementioned diseases and clinical conditions.

The function of NUP98 has been established by previous studies. Nucleoporins are proteins that function in the nuclear transport of protein and RNA. Nakamura et al. (1996) showed that in 3 patients with t(7;11), the chromosome rearrangement created a genomic fusion between the HOXA9 gene (142956) and the nucleoporin gene NUP98 on 11p15. Expression of Hoxa7 and Hoxa9 is activated by proviral integration in BXH2 murine myeloid leukemias; this result, combined with the mapping of the HOXA cluster to 7p15, suggested that one of the HOXA genes may be involved in the human t(7;11)(p15;p15) translocation found in some myeloid leukemia patients. The translocation produced an invariant chimeric NUP98/HOXA9 transcript containing the amino terminal half of NUP98 fused in-frame to HOXA9. These studies identified HOXA9 as an important human myeloid leukemia gene and suggested an important role for nucleoporins in human myeloid leukemia, given that a second nucleoporin, NUP214 (114350), had also been implicated in human myeloid leukemia. The 11p15 gene was identified by exon trapping experiments. Borrow et al. (1996) likewise identified the HOXA9 and NUP98 genes as the parents of the fusion in t(7;11)(p15;p15) in acute myeloid leukemia of the FABM2 and M4 types. Borrow et al. (1996) suggested that the predicted NUP98/HOXA9 fusion protein may promote leukemogenesis through inhibition of HOXA9-mediated terminal differentiation and/or aberrant nucleocytoplasmic transport.

Full details of the abovementioned studies are described in the following publications, the disclosure of which are hereby incorporated by reference:

Borrow, J.; Shearman, A. M.; Stanton, V. P., Jr.; Becher, R.; Collins, T.; Williams, A. J.; Dube, I.; Katz, F.; Kwong, Y. L.; Morris, C.; Ohyashiki, K.; Toyama, K.; Rowley, J.; Housman, D. E.: The t(7;11)(p15;p15) translocation in acute myeloid leukaemia fuses the genes for nucleoporin NUP98 and class I homeoprotein HOXA9. Nature Genet. 12: 159-167, 1996. PubMed ID: 8563754 12. Nakamura, T.; Largaespada, D. A.; Lee, M. P.; Johnson, L. A.; Ohyashiki, K.; Toyama, K.; Chen, S. J.; Willman, C. L.; Chen, I. -M.; Feinberg A. P.; Jenkins, N. A.; Copeland, N. G.; Shaughnessy, J. D., Jr.: Fusion of the nucleoporin gene NUP98 to HOXA9 by the chromosome translocation t(7;11)(p15;p15) in human myeloid leukaemia. Nature Genet. 12: 154-158, 1996.

Further studies establishing the function and utilities of NUP98 are found in John Hopkins OMIM database record ID 601021, and in reference numbered 1047-1062 listed hereinbelow.

Referring now to NUP98 BINDING SITE. Nucleoporin 98 kD (NUP98) is a target gene GAM26, corresponding to GAM26-TARGET GENE of FIG. 26A. NUP98 BINDING SITE is a binding site found in an untranslated region of NUP98, corresponding to BINDING SITE of FIG. 26A. FIG. 26D illustrates the complementarity of the nucleotide sequence of NUP98 BINDING SITE, designated SEQ ID:281839, to the nucleotide sequence of GAM26 RNA of FIG. 26A, designated SEQ ID:20604.

An additional function of GAM26 is therefore inhibition of nucleoporin 98 kD (NUP98), a gene which encodes a protein that functions in the nuclear transport of protein and RNA. Accordingly, utilities of GAM26 include diagnosis and treatment of the abovementioned diseases and clinical conditions. The function and utilities of NUP98 have been established by previous studies, as described hereinabove with reference to FIG. 26D.

Reference is now made to OSR1 BINDING SITE. Oxidative-stress responsive 1 (OSR1) is a target gene of GAM26, corresponding to GAM26-TARGET GENE of FIG. 26A. OSR1 BINDING SITE is a binding site found in an untranslated region of OSR1, corresponding to BINDING SITE of FIG. 26A. FIG. 26D illustrates the complementarity of the nucleotide sequence of OSR1 BINDING SITE, designated SEQ ID:285281, to the nucleotide sequence of GAM26 RNA of FIG. 26A, designated SEQ ID:20604.

A further function of GAM26 is therefore inhibition of oxidative-stress responsive 1 (OSR1), a gene which encodes a protein that mediates stress-activated signals. Accordingly, utilities of GAM26 include diagnosis and treatment of the abovementioned diseases and clinical conditions.

The function of OSR1 has been established by previous studies. The 3p22-p21.3 chromosomal region is one of 3 regions of 3p that is commonly deleted in various carcinomas. By analyzing a cloned segment from this region, Tamari et al. (1999) identified a novel gene that they designated OSR1 (oxidative stress-responsive-1) because the predicted 527-amino acid protein shares 39% identity with Ste20/oxidant stress-response kinase-1 (602255). The OSR1 gene contains 18 exons and spans approximately 90 kb. Northern blot analysis revealed that OSR1 was expressed as a 4.6-kb major transcript in all tissues tested. A less abundant 7.5-kb mRNA was detected in heart and skeletal muscle. Daigo et al. (1999) reported that the OSR1 gene is located between the OCTL1 (604047) and MYD88 (602170) genes on 3p22-p21.3.

Full details of the abovementioned studies are described in the following publications, the disclosure of which are hereby incorporated by reference:

Tamari, M.; Daigo, Y.; Nakamura, Y.: Isolation characterization of a novel serine threonine kinase gene on chromosome 3q22-21.3. J. Hum. Genet. 44: 116-120, 1999. PubMed ID: 10083736 Daigo, Y.; Isomura, M.; Nishiwaki, T.; Tamari, M.; Ishikawa, S.; Kai, M.; Murata, Y.; Takeuchi, K.; Yamane, Y.; Hayashi, R.; Minami, M.; Fujino, M. A.; Hojo, Y.; Uchiyama, I.; Takagi, T.; Nakamura, Y.: Characterization of a 1200-kb genomic segment of chromosome 3p22-p21.3. DNA Res. 6: 37-44, 1999.

Further studies establishing the function and utilities of OSR1 are found in John Hopkins OMIM database record ID 604046, and in references numbered 1063-1064 listed hereinbelow.

Reference is now made to PACE4 BINDING SITE. Paired basic amino acid cleaving system 4 (PACE4) is a target gene of GAM26, corresponding to GAM26-TARGET GENE of FIG. 26A. PACE4 BINDING SITE is a binding site found in an untranslated region of PACE4, corresponding to BINDING SITE of FIG. 26A. FIG. 26D illustrates the complementarity of the nucleotide sequence of PACE4 BINDING SITE, designated SEQ ID:287686, to the nucleotide sequence of GAM26 RNA of FIG. 26A, designated SEQ ID:20604.

Yet a further function of GAM26 is therefore inhibition of paired basic amino acid cleaving system 4 (PACE4), a gene which encodes an enzyme that processes hormone precursors by cleaving paired basic amino acids. Accordingly, utilities of GAM26 include diagnosis and treatment of the abovementioned diseases and clinical conditions.

The function of PACE4 has been established by previous studies. Using PCR methods, Kiefer et al. (1991) identified a second human subtilisin-like protease gene on chromosome 15. PCR primers were designed to be specific for the subfamily of eukaryotic subtilisin-like proteases with specificity for paired basic amino acid residue processing motifs. The gene encoding this protease, designated PACE4, also encoded a smaller subtilisin-related polypeptide derived by alternative mRNA splicing. As with the product of the PACE gene (136950), the tissue distribution of PACE4 was widespread, with comparatively higher levels in the liver. By in situ hybridization using isolated cosmid clones, Kiefer et al. (1991) mapped the PACE4 gene to chromosome 15 in close proximity to the PACE gene at 15q25-q26. Double labeling in situ hybridization suggested that the 2 genes are within 5 megabases of each other. Mbikay et al. (1995) mapped the gene for PACE4 (Pcsk6) to mouse chromosome 7 by RFLP analysis of a DNA panel from an interspecific backcross. It was located at a distance of 13 cM from the Pcsk3 locus, which specifies furin (136950), another member of this family of enzymes previously mapped to mouse chromosome 7. This is in concordance with the known close proximity of these 2 loci in the homologous region on human 15q25-qter. Pcsk3 and Pcsk6 map to a region of mouse chromosome 7 that has been associated cytogenetically with post lethality in maternal disomy, suggesting that these genes may be imprinted.

Full details of the abovementioned studies are described in the following publications, the disclosure of which are hereby incorporated by reference:

Kiefer, M. C.; Tucker, J. E.; Joh, R.; Landsberg, K. E.; Saltman, D.; Barr, P. J.: Identification of a second human subtilisin-like protease gene in the fes/fps region of chromosome 15. DNA Cell Biol. 10: 757-769, 1991. PubMed ID: 1741956 2. Mbikay, M.; Seidah, N. G.; Chretien, M.; Simpson, E. M.: Chromosomal alignment of the genes for proprotein convertases PC4, PC5, and PACE 4 in mouse and Genomics 26: 123-129, 1995.

Further studies establishing the function and utilities PACE4 are found in John Hopkins OMIM record ID 167405, and in references numbered 1065-1066 listed hereinbelow.

Referring now to PACE4 BINDING SITE. Paired basic amino acid cleaving system 4 (PACE4) is a target gene of GAM26, corresponding to GAM26-TARGET GENE of FIG. 26A. PACE4 BINDING SITE is a binding site found in an untranslated region of PACE4, corresponding to BINDING SITE of FIG. 26A. FIG. 26D illustrates the complementarity of the nucleotide sequence of PACE4 BINDING SITE, designated SEQ ID:287698, to the nucleotide sequence of GAM26 RNA of FIG. 26A, designated SEQ ID:20604.

Another function of GAM26 is therefore inhibition of paired basic amino acid cleaving system 4 (PACE4), a gene which encodes an enzyme that processes hormone precursors by cleaving paired basic amino acids. Accordingly, utilities of GAM26 include diagnosis and treatment of the abovementioned diseases and clinical conditions. The function and utilities of PACE4 have been established by previous studies, as described hereinabove with reference to FIG. 26D.

Reference is now made to PACSIN1 BINDING SITE. protein kinase C and casein kinase substrate in neurons 1 (PACSIN1) is a target gene of GAM26, corresponding to GAM26-TARGET GENE of FIG. 26A. PACSIN1 BINDING SITE is a binding site found in an untranslated region of PACSIN1, corresponding to BINDING SITE of FIG. 26A. FIG. 26D illustrates the complementarity of the nucleotide sequence of PACSIN1 BINDING SITE, designated SEQ ID:287889, to the nucleotide sequence of GAM26 RNA of FIG. 26A, designated SEQ ID:20604.

Yet another function of GAM26 is therefore inhibition of protein kinase C and casein kinase substrate in neurons 1 (PACSIN1), a gene which encodes a protein that plays a role in vesicle formation and transport. Accordingly, utilities of GAM26 include diagnosis and treatment of the abovementioned diseases and clinical conditions.

The function of PACSIN1 has been established by previous studies. By screening brain cDNA libraries for sequences with the potential to encode large proteins, Nagase et al. (2000) identified a partial cDNA encoding PACSIN1, which they called KIAA1379. The deduced 434-amino acid protein was predicted to be a homolog of rat syndapin I. RT-PCR analysis detected expression only in brain, predominantly in hippocampus. By EST database searching with mouse Pacsin1 as the probe, followed by 5-prime RACE, Sumoy et al. (2001) obtained full-length cDNAs encoding PACSIN1 and PACSIN3 (606513). Sequence analysis predicted that the 444-amino acid PACSIN1 protein, which is 95% identical to the mouse protein, contains a conserved N-terminal Fes/CIP4 homology (FCH) domain (also called the RAEYL motif), a central coiled-coil region, and a C-terminal SH3 motif. Northern blot analysis revealed strong expression of a 4.4 kb PACSIN1 transcript in brain, with much lower levels in heart, pancreas, and liver. In contrast, PACSIN2 (604960) and PACSIN3 were found to have ubiquitous expression patterns.

Full details the abovementioned studies are described in the following publications, the disclosure of which are hereby incorporated by reference:

Sumoy, L.; Pluvinet, R.; Andreu, N.; Estivill, X.; Escarceller, M.: PACSIN 3 is a novel SH3 domain cytoplasmic adapter protein of the pacsin-syndapin-FAP52 gene family. Gene 262: 199-205, 2001.

Further studies establishing the function and utilities of PACSIN1 are found in John Hopkins OMIM database record ID 606512, and in references numbered 1067-1068 listed hereinbelow.

Reference is now made to PAPOLA BINDING SITE. poly(A) polymerase alpha (PAPOLA) is a target gene of GAM26, corresponding to GAM26-TARGET GENE of FIG. 26A. PAPOLA BINDING SITE is a binding site found in an untranslated region of PAPOLA, corresponding to BINDING SITE of FIG. 26A. FIG. 26D illustrates the complementarity of the nucleotide sequence of PAPOLA BINDING SITE, designated SEQ ID:288993, to the nucleotide sequence of GAM26 RNA of FIG. 26A, designated SEQ ID:20604.

An additional function of GAM26 is therefore inhibition of poly(A) polymerase alpha (PAPOLA), a gene which encodes an enzyme that creates the 3' poly(a) tail of mRNA's. Accordingly, utilities of GAM26 include diagnosis and treatment of the abovementioned diseases and clinical conditions.

The function of PAPOLA has been established by previous studies. Polyadenylation of the 3-prime ends of eukaryotic mRNAs is a key event that takes place in the nucleus during maturation of mRNA. The reaction occurs in 2 distinct steps: endoribonucleolytic cleavage of the pre-RNA at the poly(A) site, followed by synthesis of the poly(A) tail at the 3-prime end of the upstream cleavage product. The poly(A) polymerase (PAP) is required for the adenosine addition reaction. Using RT-PCR on cytoplasmic RNA from primary human fibroblasts, Thuresson et al. (1994) obtained a cDNA encoding PAP. The deduced 500-amino acid protein is 99% similar to the bovine sequence. Western blot analysis of HeLa cell extracts detected heat-resistant 100- and 106-kD proteins in both nuclear and cytoplasmic fractions, and a 90-kD heat-sensitive protein in nuclear fractions. The 106-kD protein is phosphorylated. Functional analysis of mutated peptides showed that the N-terminal region of PAP is required for nonspecific polymerase activity while the N and C termini are required for specific polymerase activity.

Full details of the abovementioned studies are described in the following publications, the disclosure of which are hereby incorporated by reference:

Thuresson, A. -C.; Astrom, J.; Astrom, A.; Gronvik, K. -O.; Virtanen, A.: Multiple forms of poly(A) polymerases in human cells. Proc. Nat. Acad. Sci. 91: 979-983, 1994. PubMed ID: 8302877 2. Yamauchi, T.; Sugimoto J.; Hatakeyama, T.; Asakawa, S.; Shimizu, N.; Isobe, M.: Assignment of the human poly(A) polymerase (PAP) gene to chromosome 14q32.1-q32.2 and isolation of a polymorphic CA repeat sequence. J. Hum. Genet. 14: 253-255, 1999.

Further studies establishing the function and utilities PAPOLA are found in John Hopkins OMIM database record ID 605553, and in references numbered 1069-1070 and 1070 listed here below.

Referring now to PEA15 BINDING SITE. Phosphoprotein enriched in astrocytes 15 (PEA15) is a target gene of GAM26, corresponding to GAM26-TARGET GENE of FIG. 26A. PEA15 BINDING SITE is a binding site found in an untranslated region of PEA15, corresponding to BINDING SITE FIG. 26A. FIG. 26D illustrates the complementarity of the nucleotide sequence of PEA15 BINDING SITE, designated SEQ ID:301501, to the nucleotide sequence of GAM26 RNA of FIG. 26A, designated SEQ ID:20604.

A further function of GAM26 is therefore inhibition of phosphoprotein enriched in astrocytes 15 (PEA15), a gene which encodes a protein that is a phosphoprotein and involved in glucose uptake. Accordingly, utilities of GAM26 include diagnosis and treatment of the abovementioned diseases and clinical conditions. The function and utilities of PEA15 have been established by previous studies, as described hereinabove with reference to FIG. 26D.

Referring now to PEA15 BINDING SITE. Phosphoprotein enriched in astrocytes 15 (PEA15) is a target gene of GAM26, corresponding to GAM26 TARGET GENE of FIG. 26A. PEA15 BINDING SITE is a binding site found in an untranslated region of PEA15, corresponding to BINDING SITE of FIG. 26A. FIG. 26D illustrates the complementarity of the nucleotide sequence of PEA15 BINDING SITE, designated SEQ ID:301508, to the nucleotide sequence of GAM26 RNA of FIG. 26A, designated SEQ ID:20604.

Yet a further function of GAM26 is therefore inhibition of phosphoprotein enriched in astrocytes 15 (PEA15), a gene which encodes a protein that is a phosphoprotein and involved in glucose uptake. Accordingly, utilities of GAM26 include diagnosis and treatment of the abovementioned diseases and clinical conditions. The function and utilities of PEA15 have been established by previous studies, as described hereinabove with reference to FIG. 26D.

Referring now to PEA15 BINDING SITE. Phosphoprotein enriched in astrocytes 15 (PEA 15) is a target gene of GAM26, corresponding to GAM26-TARGET GENE of FIG. 26A. PEA15 BINDING SITE is a binding site found in an untranslated region of PEA15, corresponding to BINDING SITE of FIG. 26A. FIG. 26D illustrates the complementarity of the nucleotide sequence of PEA15 BINDING SITE, designated SEQ ID:301547, to the nucleotide sequence of GAM26 RNA of FIG. 26A, designated SEQ ID:20604.

Another function of GAM26 is therefore inhibition of phosphoprotein enriched in astrocytes 15 (PEA15), a gene which encodes a protein that is a phosphoprotein and involved in glucose uptake. Accordingly, utilities of GAM26 include diagnosis and treatment of the abovementioned diseases and clinical conditions. The function and utilities of PEA15 have been established by previous studies, as described hereinabove with reference to FIG. 26D.

Referring now to PEA15 BINDING SITE. Phosphoprotein enriched in astrocytes 15 (PEA15) is a target gene of GAM26, corresponding to GAM26-TARGET GENE of FIG. 26A. PEA15 BINDING SITE is a binding site found in an untranslated region of PEA15, corresponding to BINDING SITE of FIG. 26A. FIG. 26D illustrates the complementarity of the nucleotide sequence of PEA15 BINDING SITE, designated SEQ ID:301572, to the nucleotide sequence of GAM26 RNA of FIG. 26A, designated SEQ ID:20604.

Yet another function of GAM26 is therefore inhibition of phosphoprotein enriched in astrocytes 15 (PEA15), a gene which encodes a protein that is a phosphoprotein and involve in glucose uptake. Accordingly, utilities of GAM26 include diagnosis and treatment of the abovementioned diseases and clinical conditions. The function and utilities of PEA15 have been established by previous studies, as described hereinabove with reference to FIG. 26D.

Reference is now made to PIM1 BINDING SITE. pim-1 oncogene (PIM1) is a target gene of GAM26, corresponding to GAM26-TARGET SITE GENE of FIG. 26A. PIM1 BINDING SITE is a binding site found in an untranslated region of PIM1, corresponding to BINDING SITE of FIG. 26A. FIG. 26D illustrates the complementarity of the nucleotide sequence of PIM1 BINDING SITE, designated SEQ ID:305922, to the nucleotide sequence of GAM26 RNA of FIG. 26A, designated SEQ ID:20604.

An additional function of GAM26 is therefore inhibition of pim-1 oncogene (PIM1), a gene which encodes an enzyme that is a protooncogene and is associated with prostate cancer. Accordingly, utilities of GAM26 include diagnosis and treatment of the abovementioned diseases and clinical conditions.

The function of PIM1 has been established by previous studies. Amson et al. (1989) showed that the 33-kD product of the PIM gene is highly expressed in the liver and spleen during fetal hematopoiesis. In contrast, it is only slightly expressed in circulating granulocytes in adults. It was overexpressed in hematopoietic malignancies, particularly in myeloid and lymphoid acute leukemias. The results implied a physiologic role of the PIM1 oncogene during hematopoietic development and a deregulation of the gene in various leukemias Animal model experiments lend further support to the function of PIM1. To understand the function of Pim1 and its role in hematopoietic development, Laird et al. (1993) generated mice deficient in Pim1 function. Pim1-deficient mice were ostensibly normal, healthy, and fertile; however, detailed analysis demonstrated a correlation of Pim1 deficiency with erythrocyte microcytosis, whereas overexpression of Pim1 in transgenic mice resulted in erythrocyte macrocytosis It is appreciated that the abovementioned animal model for PIM1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Laird, P. W.; van der Lugt, N. M. T.; Clarke, A.; Domen, J.; Linders, K.; McWhir, J.; Berns, A.; Hooper, M.: In vivo analysis of Pim-1 deficiency. Nucleic Acids Res. 21: 4750-4755, 1993. PubMed ID: 8233823 Amson, R.; Sigaux, F.; Przedborski, S.; Flandrin, G.; Givol, D.; Telerman, A.: The human protooncogene product p33pim is expressed during fetal hematopoiesis and in diverse leukemias. Proc. Nat. Acad. Sci. 86: 8857-8861, 1989.

Further studies establishing the function and utilities of PIM1 are found in John Hopkins OMIM database record ID 164960, and in references numbered 1071-1082 listed hereinbelow.

Referring now to PIM1 BINDING SITE. Pim-1 oncogene (PIM1) is a target gene of GAM26, corresponding to GAM26-TARGET GENE of FIG. 26A. PIM1 nucleotide sequence of PIM1 BINDING SITE, designated SEQ ID:305956, to the nucleotide sequence of GAM26 RNA of FIG. 26A, designated SEQ ID:20604.

A further function of GAM26 is therefore inhibition of pim-1 oncogene (PIM1), a gene which encodes an enzyme that is a protooncogene and is associated with prostate cancer. Accordingly, utilities of GAM26 include diagnosis and treatment of the abovementioned diseases and clinical conditions. The function and utilities of PIM1 have been established by previous studies, as described hereinabove with reference to FIG. 26D.

Reference is now made to PITPN BINDING SITE. Phosphotidylinositol transfer protein (PITPN) is a target gene of GAM26, corresponding to GAM26-TARGET GENE of FIG. 26. PITPN BINDING SITE is a binding site found in an untranslated region of PITPN, corresponding to BINDING SITE of FIG. 26A. FIG. 26D illustrates the complementarity of the nucleotide sequence of PITPN BIN DING SITE, designated SEQ ID:306515, to the nucleotide sequence of GAM26 RNA, of FIG. 26A, designated SEQ ID:20604.

Yet a further function of GAM26 is therefore inhibition of phosphotidylinositol transfer protein (PITPN), a gene which encodes a protein that catalyzes the transfer of ptdins and phosphatidylcholine between membranes. Accordingly, utilities of GAM26 include diagnosis and treatment of the abovementioned diseases and clinical conditions.

The function of PITPN has been established by previous studies. Phosphatidylinositol transfer protein is a member of a diverse set of cytosolic phospholipid transfer proteins that are distinguished by their ability to transfer phospholipids between membranes in vitro (Wirtz, 1991). The rat PITPN gene encodes a polypeptide of 271 amino acids and is expressed in a wide range of tissues (Dickeson et al., 1989). The protein predicted by the human PITPN gene cloned and sequenced by Dickeson et al. (1994) showed only 3 amino acid sequence differences from the rat protein, 2 of which represented conservative substitutions. Hay and Martin (1993) reported studies suggesting that PITPN is identical to priming-specific factor-3, one of the 3 priming factors involved in the ATP-dependent priming of Ca(2+)-activated secretion. Rat PITPN shares 40% amino acid homology over its entire length with the *Drosophila* retinal degeneration B (rdgB) protein (Vihtelic et al., 1993). Flies carrying the rdgB mutation undergo light-enhanced retinal degeneration.

Animal model experiments lend further support to the function of PITPN. The mouse 'vibrator' (vb) mutation causes an early-onset progressive action tremor, degeneration of brain stem and spinal cord neurons, and juvenile death. Hamilton et al. (1997) cloned the vb mutation using an in vivo positional complementation approach followed by complete resequencing of the resulting 76-kb critical region in vb and its progenitor strain. The authors showed that the vb mutation is an intracisternal. A particle retroposon insertion in intron 4 of the Pitpn gene, causing a 5-fold reduction in Pitpn RNA and protein levels. Expression of neurofilament light chain (NEFL; 162280) was also reduced in vb mice, suggesting 1 signaling pathway that may underlie vb pathology. The vb phenotype was suppressed in 1 intercross. By a complete genome scan, they mapped a major suppressor locus (Mvbl) to proximal mouse chromosome 19

It is appreciated that the abovementioned animal model for PITPN is acknowledged by those skilled in the art as a scientifically valid animal model, as can be further appreciated from the publications sited hereinbelow.

Full details of the abovementioned studies are described in the following publications, the disclosure of which are hereby incorporated by reference:

Hamilton, B. A.; Smith, D. J.; Mueller, K. L.; Kerrebrock, A. W.; Bronson, R. T.; van Berkel, V.; Daly, M. J.; Kruglyak, L.; Reeve, M. P.; Nemhauser, J. L.; Hawkins, T. L.; Rubin, E. M.; Lander, E. S.: The vibrator mutation causes neurodegeneration via reduced expression of PITP-alpha: positional complementation cloning and extragenic suppression. Neuron 18: 711-722, 1997. PubMed ID:9182797. Wirtz, K. W. A.: Phospholipid transfer proteins. Annu. Rev. Biochem. 60: 73-99, 1991. PubMed ID:1883207. Dickeson, S. K.; Lim, C. N.; Schuyler, G. T.; Dalton, T. P.; Helmkamp, G. M., Jr.; Yarbrough, L. R.: Isolation and sequence of cDNA clones encoding rat phosphatidylinositol transfer protein. Biol. Chem. 264: 16557-16564, 1989.

Further studies establishing the function and utilities PITPN are found in John Hopkins OMIM database record ID 600174, and in references numbered 1083-1089 listed hereinbelow.

Reference is now made to POLI BINDING SITE. Polymerase (DNA directed) iota (POLI) is a target gene of GAM26, corresponding to GAM26-TARGET GENE of FIG. 26A. POLI BINDING SITE is a binding site found in an untranslated region of POLI, corresponding to BINDING SITE of FIG. 26A. FIG. 26D illustrates the complementarity of the nucleotide sequence of POLI BINDING SITE, designated SEQ ID:312045, to the nucleotide sequence of GAM2 RNA of FIG. 26A, designated SEQ ID:20604.

Another function of GAM26 is therefore inhibition of polymerase (DNA directed) iota (POLI), a gene which encodes an enzyme that incorporates deoxynucleotides opposite DNA lesions. Accordingly, utilities of GAM26 include diagnosis and treatment of the abovementioned diseases and clinical conditions.

The function of POLI has been established by previous studies. The *S. cerevisiae* RAD30 and ha RAD30A genes encode Pol-eta, which bypasses a cis-syn thymine-thymine dimer efficiently and accurately. Johnson et al. (2000) showed that the related human gene RAD30B encodes the DNA polymerase Pol-iota, which misincorporates deoxynucleotides at a high rate. To bypass damage, Pol-iota specifically incorporates deoxynucleotides opposite highly distorting or noninstructional DNA lesions. This action is combined with that of DNA Pol-zeta (602776) which is essential for damaged-induced mutagenesis, to complete the lesion bypass. Pol-zeta is very inefficient in inserting deoxynucleotides opposite DNA lesions, but readily extends from such deoxynucleotides once they have been inserted. Thus, in a new model for mutagenic bypass of DNA lesions in eukaryotes, the 2 DNA polymerases act sequentially. Pol-iota incorporates deoxynucleotides opposite DNA lesions, and Pol-zeta functions as a mispair extender. Bebenek et al. (2001) reported that human Pol-iota has an intrinsic 5-prime-deoxyribose phosphate (dRP) lyase activity. In reactions reconstituted with uracil-DNA glycosylase (191525), apurinic/apyrimidinic (AP) endonuclease (107748), and DNA ligase I (126391), Pol-iota can use its dRP lyase and polymerase activities to repair G-U and A-U pairs in DNA. These data and 3 distinct catalytic properties of Pol-iota implicate it in specialized forms of base excision repair.

Full details of the abovementioned studies are described in the following publications, the disclosure which are hereby incorporated by reference:

Johnson, R. E.; Washington, M. T.; Haracska, L.; Prakash, S.; Prakash, L.: Eukaryotic polymerases iota and zeta act sequentially to bypass DNA lesions. Nature 406: 1015-1019, 2000. PubMed ID: 10984059 Bebenek, K.; Tissier, A.; Frank, E. G.; McDonald, J. P.; Prasad, R.; Wilson, S. R.; Woodgate, R.; Kunkel, T. A.: 5-prime-deoxyribose phosphate lyase activity of human DNA polymerase iota in vitro. Science 291: 2156-2159, 2001.

Further studies establishing the function and utilities of POLI are found in John Hopkins OMIM database record ID 605252, and in references numbered 1090-1092 listed hereinbelow.

Reference is now made to POLRMT BINDING SITE. Polymerase (RNA) mitochondrial (DNA directed) (POL-RMT) is a target gene of GAM26, corresponding to GAM26-TARGET GENE of FIG. 26A. POLRMT BINDING SITE is a binding site found in an untranslated region of POLRMT, corresponding to BINDING SITE of FIG. 26A. FIG. 26D illustrates the complementarity of the nucleotide sequence of POLRMT BINDING SITE, designated SEQ ID:312593, to the nucleotide sequence of GAM26 RNA of FIG. 26A, designated SEQ ID:20604.

Yet another function of GAM26 is therefore inhibition of polymerase (RNA) mitochondrial (DNA directed) (POL-RMT), a gene which encodes an enzyme that is a mitochondrial DNA-directed RNA polymerase. Accordingly, utilities of GAM26 include diagnosis and treatment of the abovementioned diseases and clinical conditions.

The function of POLRMT has been established by previous studies. Mitochondria of all organisms contain a genome that is distinct from that of the nucleus. The circular mitochondrial chromosome contains 37 genes that encode the RNA components of the mitochondrial translational apparatus, i.e., 22 transfer RNAs and 2 ribosomal RNA genes, as well as 13 polypeptide-encoding genes. All 13 polypeptides are essential components of 4 of the 5 complexes that form the mitochondrial oxidative phosphorylation (OXPHOS) pathway (complexes I, III, IV, and V). However, gene expression in mitochondria relies upon numerous nuclear genes that encode protein components required for transcription and translation of the mtDNA-encoded genes, as well as protein and RNA components required for replication of mtDNA. In addition, nuclear genes encode factors controlling the import, assembly, and turnover of OXPHOS complexes, and proteins acting as general regulators of mitochondrial function. Nuclear-encoded mitochondrial proteins are synthesized by cytoplasmic ribosomes, usually as precursors containing an N-terminal extension. Import into mitochondria is carried out by a complex, ATP-dependent transport system, followed by cleavage of the leader peptide, which eventually produce a mature, functional protein. Tiranti et al. (1997) noted that abnormalities in the nuclear genome repertoire controlling mitochondrial biogenesis were proposed as the cause of some human disorders characterized by the presence of mtDNA abnormalities and Mendelian transmission. Both autosomal dominant (157640) and autosomal recessive (601779) forms of chronic progressive external ophthalmoplegia are associated with the accumulation of multiple deletions of mtDNA in stable tissues. Another example is tissue-specific mtDNA depletion (251880), autosomal recessive disorder causing severe organ-specific syndromes in early infancy. Mendelian inheritance indicates the presence of transmissible mutations in nuclear genes that can ultimately damage the structural integrity of the mtDNA molecule or its copy number. Genes involved in the control of mtDNA replication and expression are considered attractive candidates for these disorders. The characterization of the collection of human proteins related to mitochondria, the so-called human mitochondrial proteome, is important in the elucidation of fundamental mechanisms of nucleo-mitochondrial intergenomic signaling, as well as to clinical researchers interested in mitochondrial disorders. Tiranti et al. (1997) used a gene cloning strategy based on the screening of the expressed sequence tags database (dbEST), using sequences of mitochondrial housekeeping proteins of yeast, to identify the cDNA encoding the precursor of the human mitochondrial RNA polymerase. They identified a 3,831-bp human cDNA predicted to encode a protein of 1,230 amino acid residues. The protein sequence showed significant homology with sequences corresponding to mitochondrial. RNA polymerases from lower eukaryotes and to RNA polymerases from several bacteriophages. Mitochondrial RNA polymerase carries out the central activity of mitochondrial gene expression and, by providing the RNA primers for initiation of replication, is also implicated in the maintenance and propagation of the mitochondrial genome. Thus, it is an attractive candidate for disorders of nucleo-mitochondrial intergenomic signaling.

Full details of the abovementioned studies are described in the following publications, the disclosure of which are hereby incorporated by reference:

Tiranti, V.; Savoia, A.; Forti, F.; D'Apolito, M. -F.; Centra, M.; Rocchi, M.; Zeviani, M.: Identification of the gene encoding the human mitochondrial RNA polymerase (h-mtRPOL) by cyberscreening of the Expressed Sequence Tags database. Hum. Molec. Genet. 6: 615-625, 1997. PubMed ID: 9097968 Tiranti, V.; Savoia, A.; Forti, F.; D'Apolito, M. -F.; Centra, M.; Rocchi, M.; Zeviani, M.: Identification of the gene encoding the human mitochondrial RNA polymerase (h-mtRPOL) by cyberscreening of the Expressed Sequence Tags database. Hum. Molec. Genet 6: 615-625, 1997.

Further studies establishing the function and utilities of POLRMT are found in John Hopkins OMIM database record ID 601778, and in references numbered 1093-1095 listed hereinbelow.

Reference is now made to PP BINDING SITE. Pyrophosphatase (inorganic) (PP) is a target of GAM26, corresponding to GAM26-TARGET GENE of FIG. 26A. PP BINDING SITE is a binding site found in an untranslated region of PP, corresponding to BINDING SITE of FIG. 26A. FIG. 26D illustrates the complementarity of the nucleotide sequence of PP BINDING SITE, designated SEQ ID:313812, to the nucleotide sequence of GAM26 RNA of FIG. 26A, designated SEQ ID:20604.

An additional function of GAM26 is therefore inhibition of pyrophosphatase (inorganic) (PP), a gene which encodes an enzyme that catalyzes the hydrolysis of pyrophosphate to inorganic phosphate. Accordingly, utilities of GAM26 include diagnosis and treatment of the abovementioned diseases and clinical conditions.

The function of PP has been established by previous studies. Among 3000 unrelated persons, Fisher et al. (1974) found no genetically determined variants of the enzyme in red cells. Assignment of the structural gene locus for inorganic pyrophosphatase to chromosome 10 was first reported by Van Cong et al. (1975) and confirmed by somatic cell hybrid studies in two other laboratories (McAlpine et al., 1976; Chem, 1976). From dosage studies in a patient trisomic for 10pter-10q11.1, Snyder et al. (1984) showed that PP is not on the short arm; red cell PP levels were normal.

Full details of the abovementioned studies are described in the following publications, the disclosure of which are hereby incorporated by reference:

Van Cong, N.; Rebourcet, R.; Weil, D.; Pangalos, C.; Frezal, J.: Localisation d'un locus de structure de la pyrophosphatase inorganique 'erythrocytaire' sur le chromosome 10 chez l'homme par la methode d'hypridation cellulaire homme-hamster. Comp. Rend. Acad. Sci. (Paris) 281: 435-438, 1975.

Further studies establishing the function and utilities of PP are found in John Hopkins OMIM data base record ID 179030, and in references numbered 1096-1102 listed hereinbelow.

Referring now to CACNA1A BINDING SITE. Calcium channel, voltage-dependent, P/Q type, alpha 1A subunit (CACNA1A) is a target gene of GAM26, corresponding to GAM26-TARGET GENE of FIG. 26A. CACNA1A BINDING SITE is a binding site found in an untranslated region of CACNA1A, corresponding to BINDING SITE of FIG. 26A. FIG. 26D illustrates the complementarity of the nucleotide sequence of CACNA1A BINDING SITE, designated SEQ ID:317209, to the nucleotide sequence of GAM26 RNA of FIG. 26A, designated SEQ ID:20604.

A further function of GAM26 is therefore inhibition of calcium channel, voltage-dependent, P/Q type, alpha 1A subunit (CACNA1A), a gene which encodes a protein that is associated with episodic ataxia type 2, familial hemiplegic migraine, spinocerebellar ataxia type 6, and idiopathic generalized epilepsy. Accordingly, utilities of GAM26 include diagnosis and treatment of the abovementioned diseases and clinical conditions. The function and utilities of CACNA1A have been established by previous studies, as described hereinabove with reference to FIG. 26D.

Referring now to CACNA1A BINDING SITE. Calcium channel, voltage-dependent, P/Q type, alpha 1A subunit (CACNA1A) is a target gene of GAM26, corresponding to GAM26-TARGET GENE of FIG. 26A. CACNA1A BINDING SITE is a binding site found in an untranslated region of CACNA1A, corresponding to BINDING SITE of FIG. 26A. FIG. 26D illustrates the complementarity of the nucleotide sequence of CACNA1A BINDING SITE, designated SEQ ID:317209, to the nucleotide sequence of GAM26 RNA of FIG. 26A, designated SEQ ID:20604.

Yet a further function of GAM26 is therefore inhibition of calcium channel, voltage-dependent, P/Q type, alpha 1A subunit (CACNA1A), a gene which encodes a protein that is associated with episodic ataxia type 2, familial hemiplegic migraine, spinocerebellar ataxia type 6, and idiopathic generalized epilepsy. Accordingly, utilities of GAM26 include diagnosis and treatment of the abovementioned diseases and clinical conditions. The function utilities of CACNA1A have been established by previous studies, as described hereinabove with reference to FIG. 26D.

Referring now to PPP3CA BINDING SITE. Protein phosphatase 3 (formerly 2B), catalytic subunit, alpha isoform (PPP3CA) is a target gene of GAM26, corresponding to GAM26-TARGET GENE of FIG. 26A. PPP3CA BINDING SITE is a binding site found in an untranslated region of PPP3CA, corresponding to BINDING SITE of FIG. 26A. FIG. 26D illustrates the complementarity of the nucleotide sequence of PPP3CA BINDING SITE, designated SEQ ID:317209, to the nucleotide sequence of GAM26 RNA of FIG. 26A, designated SEQ ID:20604.

Another function of GAM26 is therefore inhibition of protein phosphatase 3 (formerly 2B), catalytic subunit, alpha isoform (PPP3CA), a gene which encodes a Enzyme that is the catalytic subunit of calcium-dependent, calmodulin-stimulated protein phosphatase. Accordingly utilities of GAM26 include diagnosis and treatment of the abovementioned diseases and clinical conditions. The function an utilities of PPP3 CA have been established by previous studies, as described hereinabove with reference to FIG. 26D.

Referring now to GABRB3 BINDING SITE. Gamma-aminobutyric acid (GABA) A receptor, beta 3 (GABRB3) is a target gene of GAM26, corresponding to GAM26-TARGET GENE of FIG. 26A. GABRB3 BINDING SITE is a binding site found in an untranslated of GABRB3, corresponding to BINDING SITE of FIG. 26A. FIG. 26D illustrates the complementarity of the nucleotide sequence of GABRB3 BINDING SITE, designated SEQ ID:317210, to the nucleotide sequence of GAM26 RNA of FIG. 26A, designated SEQ ID:20604.

Yet another function of GAM26 is therefore inhibition of gamma-aminobutyric acid (GABA) A receptor, beta 3 (GABRB3), a gene which encodes a receptor that mediates neuronal inhibition by binding to the gaba/benzodiazepine receptor and opening an integral chloride channel and is associated with Angelman syndrome and Prader-Willi syndrome. Accordingly, utilities of GAM26 include diagnosis and treatment of the abovementioned diseases and clinical conditions. The fun ion and utilities of GABRB3 have been established by previous studies, as described hereinabove with reference to FIG. 26D.

Referring now to PPP3CA BINDING SITE. Protein phosphatase 3 (formerly 2B), catalytic subunit, alpha isoform (PPP3CA) is a target gene of GAM26, corresponding to GAM26-TARGET GENE of FIG. 26A. PPP3CA BINDING SITE is a binding site found in an untranslated region of PPP3CA, corresponding to BINDING SITE of FIG. 26A. FIG. 26D illustrates the complementarity of the nucleotide sequence of PPP3CA BINDING SITE, designated SEQ ID:317210, to the nucleotide sequence of GAM26 RNA of FIG. 26A, designated SEQ ID:20604.

An additional function of GAM26 is therefore inhibition of protein phosphatase 3 (formerly 2B), catalytic subunit, alpha isoform (PPP3CA), a gene which encodes a Enzyme that is the catalytic subunit of calcium-dependent, calmodulin-stimulated protein phosphatase. Accordingly, utilities of GAM26 include diagnosis and treatment of the abovementioned diseases and clinical conditions. The function and utilities of PPP3CA have been established by previous studies, as described hereinabove with reference to FIG. 26D.

Referring now to PPP3CA BINDING SITE. Protein phosphatase 3 (formerly 2B), catalytic subunit, alpha isoform (PPP3CA) is a target gene of GAM26, corresponding to GAM26-TARGET GENE of FIG. 26A. PPP3CA BINDING SITE is a binding site found in an untranslated region of PPP3CA, corresponding to BINDING SITE of FIG. 26A. FIG. 26D illustrates the complementarity of the nucleotide sequence of PPP3CA BINDING SITE, designated SEQ ID:317246, to the nucleotide sequence of GAM26 RNA of FIG. 26A, designated SEQ ID:20604.

A further function of GAM26 is therefore inhibition of protein phosphatase 3 (formerly 2B), catalytic subunit, alpha isoform (PPP3CA), a gene which encodes an enzyme that is the catalytic subunit of calcium-dependent, calmodulin-stimulated protein phosphatase. Accordingly, utilities of GAM26 include diagnosis and treatment of the abovementioned diseases and clinical conditions. The function and utilities of PPP3CA have been established by previous studies, as described hereinabove with reference to FIG. 26D.

Reference is now made to PRKAA2 BINDING SITE. Protein kinase, AMP-activated, alpha 2 catalytic subunit (PRKAA2) is a target gene of GAM26, corresponding to GAM26-TARGET GENE of FIG. 26A. PRKAA2 BINDING SITE is a binding site found in an untranslated region of PRKAA2, corresponding to BINDING SITE of FIG. 26A. FIG. 26D illustrates the complementarity of the nucleotide sequence of PRKAA2 BINDING SITE, designated SEQ ID:318787, to the nucleotide sequence of GAM26 RNA of FIG. 26A, designated SEQ ID:20604.

Yet a further function of GAM26 is therefore inhibition of protein kinase, AMP-activated, alpha 2 catalytic subunit (PRKAA2), a gene which encodes a protein that are responsible for the regulation of fatty acid synthesis by phosphorylation of acetyl-coa carboxylase. Accordingly, utilities of GAM26 include diagnosis and treatment of the abovementioned diseases and clinical conditions.

The function of PRKAA2 has been established by previous studies. AMP-activated protein kinase plays a key role in the regulation of fatty acid and cholesterol metabolism (Hardie, 1992 Hardie and MacKintosh, 1992). In vitro, it phosphorylates and inactivates 3-hydroxy-3-methylglutaryl-CoA reductase (HMGCR; 142910) and acetyl-CoA carboxylase (ACC; 200350), key enzymes involved in regulating de novo biosynthesis of cholesterol and fatty acids, respectively. See PRKAA1 (602739) for additional background. Beri et al. (1994) used a cDNA encoding rat liver AMPK to isolate human skeletal muscle AMPK cDNA clones. The human cDNA was more than 90% homologous to the rat sequence and predicted a protein of 62.3 kD that closely agreed with the mass of human AMPK observed in Western blots of human tissue extracts. A cDNA probe was used to identify a 9.5-kb transcript in several human tissues and to isolate human genomic clones. Stapleton et al. (1997) showed that rat liver Ampk-alpha-2 is associated with Ampk-beta-1 (PRKAB1; 602740) and Ampk-gamma-1 (PRKAG1; 602742). They noted that Ampk-alpha-1 (PRKAA1) is also associated with these beta and gamma isoforms. Beri et al. (1994) used PCR mapping of rodent/human hybrid cell lines to localize the human AMPK gene to chromosome 1, and they sublocalized the AMPK gene to 1p31 by fluorescence in situ hybridization with a human genomic clone. (The cDNA referred to as AMPK by Beri et al. (1994) encodes the alpha-2 subunit of AMPK) Tsujikawa et al. (1998) determined that PRKAA2 and the CDC-like kinase-2 gene (CLK2; 60,989) are located in the same interval of approximately 2.6 cM between D1S2890 and D1S2801. They suggested that CLK2 and PRKAA2 are possible candidate genes for gelatinous drop-like corneal dystrophy (204870). Mu et al. (2001) investigated the role of the metabolic sensor AMPK in the regulation of glucose transport in skeletal muscle. Expression in mouse muscle of a dominant inhibitory mutant of Ampk-alpha-2 completely blocked the ability of hypoxia and 5-aminoimidazole-4-carboxamide ribonucleoside (AICAR) to activate hexose uptake, while only partially reducing contraction-stimulated hexose uptake. These data indicated that AMPK transmits a portion of the signal by which muscle contraction increases glucose uptake, but other AMPK-independent pathways also contribute to the response. Minokoshi et al. (2002) demonstrated that leptin (164160) selectively stimulates phosphorylation and activation of AMPK-alpha-2 in skeletal muscle, thus establishing an additional signaling pathway for leptin. Early activation of AMPK occurs by leptin acting directly on muscle, whereas later activation depends on leptin functioning through the hypothalamic-sympathetic nervous system axis. In parallel with its activation of AMPK, leptin suppresses the activity of ACC (200350, 601557), thereby stimulating the oxidation of fatty acids in muscle. Blocking AMPK activation inhibits the phosphorylation of ACC stimulated by leptin. Minokoshi et al. (2002) concluded that their data identify AMPK as a principal mediator of the effects of leptin on fatty acid metabolism in muscle.

Full details of the abovementioned studies are described in the following publications, the disclosure of which are hereby incorporated by reference:

Minokoshi, Y.; Kim, Y. -B.; Peroni, O. D.; Fryer, L. G. D.; Muller, C.; Carling, D.; Kahn, B. B.: Leptin stimulates fatty-acid oxidation by activating AMP-activated protein kinase. Nature 415: 339-343, 2002. PubMed ID: 11797013 5. Mu, J.; Brozinick, J. T., Jr.; Valladares, O.; Bucan, M.; Birnbaum, M. J.: A role for AMP-activated protein kinase in contraction- and hypoxia-regulated glucose transport in skeletal muscle. Molec. Cell 7: 1085-1094, 2001.

Further studies establishing the function and utilities of PRKAA2 are found in John Hopkins OMIM database record ID 600497, and in references numbered 1103-1109 listed hereinbelow.

Referring now to PRKAA2 BINDING SITE. Protein kinase, AMP-activated, alpha 2 catalytic subunit (PRKAA2) is a target gene of GAM26, corresponding to GAM26-TARGET GENE of FIG. 26A. PRKAA2 BINDING SITE is a binding site found in an untranslated region of PRKAA2, corresponding to BINDING SITE of FIG. 26A. FIG. 26D illustrates the complementarity of the nucleotide sequence of PRKAA2 BINDING SITE, designated SEQ ID:318794, to the nucleotide sequence of GAM26 RNA of FIG. 26A, designated SEQ ID:20604.

Another function of GAM26 is therefore inhibition of protein kinase, AMP-activated, alpha 2 catalytic subunit (PRKAA2), a gene which encodes a protein that are responsible for the regulation of fatty acid synthesis by phosphorylation of acetyl-coa carboxylase. Accordingly utilities of GAM26 include diagnosis and treatment of the abovementioned diseases and clinical conditions. The function and utilities of PRKAA2 have been established by previous studies, as described hereinabove with reference to FIG. 26D.

Reference is now made to PSEN1 BINDING SITE. Presenilin 1 (Alzheimer disease 3) (PSEN1) is a target gene of GAM26, corresponding to GAM26-TARGET GENE of FIG. 26A. PSEN1 BINDING SITE is a binding site found in an untranslated region of PSEN1, corresponding to BINDING SITE of FIG. 26A. FIG. 26D illustrates the complementarity of the nucleotide sequence of PSEN1 BINDING SITE, designated SEQ ID:322696, to the nucleotide sequence of GAM26 RNA of FIG. 26A, designated SEQ ID:20604.

Yet another function of GAM26 is therefore inhibition of presenilin 1 (Alzheimer disease 3) (PSEN1), a gene which encodes a protein that is associated with ALZHEIMER DISEASE, FAMILIAL, TYPE 3. Accordingly, utilities of GAM26 include diagnosis and treatment of the abovementioned diseases and clinical diseases.

The function of PSEN1 has been established by previous studies. St. George-Hyslop et al. (1992), Van Broeckhoven et al. (1992), and Mullan et al. (1992) presented evidence of location of a mutation responsible for early-onset familial Alzheimer disease on 14q. Mullan et al. (1992) placed the gene proximal to that for alpha-1-antichymotrypsin (107280), thus excluding AACT, which is a component of plaque cores and a protease inhibitor, as a possible candidate gene or AD. In a subset of early-onset familial Alzheimer disease (FAD), mutations in the amyloid precursor protein (APP; 104760) have been identified; for example, 3 have been found in codon 717. However, the majority of early-onset FAD families do not show linkage to, or appear to have mutations in, the amyloid precursor protein gene. There may be an additional FAD locus on chromosome 21 separate from the APP locus (St. George-Hyslop et al., 1987; St. George-Hyslop et al., 1990; Tanzi et al., 1991), and a locus on chromosome 19 seemed quite definite (Pericak-Vance et al., 1991; Schellenberg et al., 1992). Schellenberg et al. (1992) indicated the existence of yet another locus for early-onset Alzheimer disease on chromosome 14; a total lod score of 9.15 at theta=0.01 was obtained with the marker D14S43 located at 14q24.3. A single early-onset family yielded a lod score of 4.89 (theta=0.0). When no assumptions were made about age-dependent penetrance, significant results were still obtained (maximum lod=5.94 at theta=0.0) despite the loss of power. Kamal et al. (2000) demonstrated that the axonal transport of APP in neurons is mediated by the direct binding of APP to the kinesin light chain (600025) subunit of kinesin-I. Kamal et al. (2001) identified an axonal membrane compartment that contains APP, beta-secretase (604252), and presenilin-1. The fast anterograde axonal transport of this compartment is mediated APP and kinesin-1. Proteolytic processing of APP can occur in the compartment in vitro and in vivo in axons. This proteolysis generates amyloid-beta and a carboxy-terminal fragment of APP, and liberates kinesin-I from the membrane. Kamal et al. (2001) concluded that APP functions as a kinesin-I membrane receptor, mediating the axonal transport of beta-secretase and presenilin-1, and that processing of APP to amyloid-beta by secretases can occur in an axonal membrane compartment transported by kinesin-I. Lambert et al. (2001) studied 287 individuals with Alzheimer disease. In addition, brain samples from a further 99 cases were studied. They carried out genotype analysis at the polymorphic site at position −48 in the PS1 gene promoter. Lambert et al. (2001) found an increased risk of developing Alzheimer disease associated with the −48 CC genotype (odds ratio=1.55; 95% CI 1.03 to 2.35). This appeared to be present in both familial and sporadic cases and independent of the APOE4 (see 107741) allele genotype. They also that the A-beta load in the brains of individuals with the −48 CC genotype was significantly increased (p less than 0.003). PS1 and PS2 have been suggested to be gamma-secretases responsible for the proteolytic cleavage of amyloid precursor protein (104760) to form amyloid beta. Wilson et al. (2002) examined whether these presenilins are required for the generation of multiple amyloid beta species by analyzing the production of secreted and intracellular amyloid beta in mouse cells lacking PS1, PS2 or both proteins. Although most amyloid beta species were abolished in PS1/PS2 −/− cells, the production of intracellular A-beta-42 generated in the endoplasmic reticulum/intermediate compartment was unaffected by the absence of these proteins, either singly or in combination. Wilson et al. (2002) concluded that production of this pool of amyloid beta occurs independently of PS1/PS2 and, therefore, another gamma-secretase activity must be responsible for cleavage of APP within the early secretory compartments Animal model experiments lend further support to the function of PSEN1. Handler et al. (2000) analyzed Psen1-deficient mouse embryos and observed that lack of Psen1 leads to premature differentiation of neural progenitor cells. They concluded that Psen1 has a role in a cell fate decision between postmitotic neurons and neural progenitor cells. Handler et al. (2000) also detected changes in expression of genes involved in Notch signaling. They concluded that Psen1 controls neuronal differentiation in association with the downregulation of Notch signaling during neurogenesis. Due to the perinatal lethality of Psen1 knockout mice, Yu et al. (2001) developed a conditional knockout mouse (cKO), in which Psen1 inactivation was restricted to the postnatal forebrain. The cKO mice were viable with no gross abnormalities, allowing Yu et al. (2001) to investigate the effects of Psen1 inactivation on amyloid precursor protein processing the Notch signaling pathway, and synaptic and cognitive function in the adult brain. They concluded from their studies that inactivation of Psen1 function in the adult cerebral cortex leads to reduced beta-amyloid generation and subtle cognitive deficits without affecting expression of Notch downstream target genes. Using 3 groups of transgenic mice carrying the presenilin A246E mutation (104311.0003), the amyloid precursor protein K670/M671L mutation (APP; 104760.0008), or both mutations, Dineley et al. (2002) showed that coexpression of both mutant transgenes resulted in accelerated beta-amyloid accumulation, first detected at 7 months in the cortex and hippocampus, compared to the APP or PS1 transgene alone. Contextual fear learning, a hippocampus-dependent associative learning task, but not cued fear learning, was impaired in mice carrying both mutations or the APP mutation, but not the PS1 mutation alone. The impairment manifested at 5 months of age, preceding detectable plaque deposition, and worsened with age. Dineley et al. (2002) also found increased levels of alpha-7 nicotinic acetylcholine receptor protein in the hippocampus, which they hypothesized contributes to disease progression via chronic activation of the ERK MAPK cascade.

It is appreciated that the abovementioned animal model for PSEN1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Dineley, K. T.; Xia, X.; Bui, D.; Sweatt, J. D.; Zhang, H.: Accelerated plaque accumulation, associative learning deficits, and up-regulation of alpha-7 nicotinic receptor protein in transgenic mice co-expressing mutant human presenilin 1 and amyloid precursor proteins. J. Biol. Chem. 277: 22768-22780, 2002. PubMed ID: 11912199

93. Yu, H.; Saura, C. A.; Choi, S. -Y.; Sun, L. D.; Yang, X.; Handler, M.; Kawarabayashi, T.; Younkin, L.; Fedeles, B.; Wilson, M. A.; Younkin, S.; Kandel, E. R.; Kirkwood, A.; Shen, J.: APP processing and synaptic plasticity in presenilin-1 conditional knockout mice. Neuron 31: 713-726, 2001.

Further studies establishing the function and utilities of PSEN1 are found in John Hopkins OMIM database record ID 104311, and in references numbered 1110-1114, 67, 1115-1124, 75, 1125, 1126-1133, 90, 1134, 1135, 1136-1152, 117 and 1153-1196 listed hereinbelow.

Reference is now made to PTEN BINDING SITE. Phosphatase and tensin homolog (mutated in multiple advanced cancers 1 (PTEN) is a target gene of GAM26, corresponding to GAM26-TARGET GENE of FIG. 26A. PTEN BINDING SITE is a binding site found in an untranslated region of PTEN, corresponding to BINDING SITE of FIG. 26A. FIG. 26D illustrates the complementarity of the nucleotide sequence of PTEN BINDING SITE, designated SEQ ID:324380, to the nucleotide sequence of GAM26 RNA of FIG. 26A, designated SEQ ID:20604.

An additional function of GAM26 is therefore inhibition of phosphatase and tensin homolog (mutated in multiple advanced cancers 1 (PTEN), a gene which encodes an enzyme that is associated with Cowden disease. Accordingly, utilities of GAM26 include diagnosis and treatment of the abovementioned diseases and clinical conditions.

The function of PTEN has been established by previous studies. As tumors progress to more advanced stages, they acquire an increasing of genetic alterations. Li et al. (1997) noted that one alteration which occurs at high frequency in a variety of human tumors is loss of heterozygosity (LOH) at 10q23. Although rarely seen in low-grade glial tumors and early-stage prostate cancers, LOH at 10q23 occurs in approximately 70% of glioblastomas (the most advanced form of glial tumor) and approximately 60% of advanced prostate cancers. This pattern of LOH and the finding that wildtype chromosome 10 suppresses the tumorigenicity of glioblastoma cells in mice suggested to Li et al. (1997) that 10q23 encodes a tumor suppressor gene. By mapping of homozygous deletions on 10q23, they isolated a candidate tumor suppressor gene that they called PTEN for 'phosphatase and tensin homolog deleted on chromosome ten.' Sequence analysis of the predicted 403-amino acid open reading frame (ORF) revealed a protein tyrosine phosphatase domain and a large region of homology (approximately 175 amino acids) to chicken tensin (600076; a protein that interacts with actin filaments at focal adhesions) and bovine auxilin. In preliminary screens, Li et al. (1997) detected mutations of PTEN in 31% (13 of 42) of glioblastoma cell lines and xenografts, 100% (4 of 4) of prostate cancer cell lines, 6% (4 of 65) of breast cancer cell lines and xenografts, and 17% (3 of 18) of primary glioblastomas. The homologies displayed by the structure of PTEN suggested to the investigators that it may suppress tumor cell growth by antagonizing protein tyrosine kinases and may regulate tumor cell invasion and metastasis through interactions at focal adhesions.

Animal model experiments lend further support to the function of PTEN. To examine the role of the dual-specificity phosphatase PTEN in ontogenesis and tumor suppression, Di Cristofano et al. (1998) disrupted mouse Pten by homologous recombination. Pten inactivation resulted in early embryonic lethality. Homozygous deficient ES (embryonic stem) cells formed aberrant embryoid bodies and displayed an altered ability to differentiate into endodermal, ectodermal, and mesodermal derivatives. Heterozygous knockout mice and chimeric mice derived from heterozygous ES cells showed hyperplastic/dysplastic changes in the prostate, skin, and colon, which are characteristic of Cowden disease, Lhermitte-Duclos disease, and Bannayan-Zonana syndrome. They also spontaneously developed germ cell, gonadostromal, thyroid, and colon tumors. In addition, Pten inactivation enhanced the ability of ES cells to generate tumors in nude and syngeneic mice, due to increased anchorage-independent growth and aberrant differentiation. These results supported the notion that PTEN haploinsufficiency plays a causal role in the 3 disorders in which mutations had been found, and demonstrated that Pten is a tumor suppressor essential for embryonic development.

It is appreciated that the abovementioned animal model for PTEN is acknowledged by those skilled in the art as a scientifically valid animal model as can be further appreciated from the publications sited hereinbelow.

Full details of the abovementioned studies are described in the following publications, the disclosure of which are hereby incorporated by reference:

Di Cristofano, A.; Pesce, B.; Cordon-Cardo, C.; Pandolfi, P. P.: Pten is essential for embryonic development and tumour suppression. Nature Genet. 19: 348-355, 1998. PubMed ID: 9697695 35. Li, J.; Yen, C.; Liaw, D.; Podsypanina, K.; Bose, S.; Wang, S. I.; Puc, J.; Miliaresis, C.; Rodgers, L.; McCombie, R.; Bigner, S. H.; Giovanella, B. C.; Ittmann, M.; Tycko, B.; Hibshoosh, H.; Wigler, M. H.; Parsons, R.: PTEN, a putative protein tyrosine phosphatase gene mutated in human brain, breast, and prostate cancer. Science 275: 1943-1946, 1997.

Further studies establishing the function and utilities of PTEN are found in John Hopkins OMIM database record ID 601728, and in references numbered 1197-1267 listed hereinbelow.

Referring now to PTEN BINDING SITE. Phosphatase and tensin homolog (mutated in multiple advanced cancers 1 (PTEN) is a target gene of GAM26, corresponding to GAM26-TARGET GENE of FIG. 26A. PTEN BINDING SITE is a binding site found in an untranslated region of PTEN, corresponding to BINDING SITE of FIG. 26A. FIG. 26D illustrates the complementarity of the nucleotide sequence of PTEN BINDING SITE, designated SEQ ID:324398, to the nucleotide sequence of GAM26 RNA of FIG. 26A, designated SEQ ID:20604.

A further function of GAM26 is therefore inhibition of phosphatase and tensin homolog (mutated in multiple advanced cancers 1 (PTEN), a gene which encodes a Enzyme that is associated with Cowden disease. Accordingly, utilities of GAM26 include diagnosis and treatment of the abovementioned diseases and clinical conditions. The function and utilities of PTEN have been established by previous studies, as described hereinabove with reference to FIG. 26D.

Referring now to PTEN BINDING SITE. Phosphatase and tensin homolog (mutated in multiple advanced cancers 1 (PTEN) is a target gene of GAM26, corresponding to GAM26-TARGET GENE of FIG. 26A. PTEN BINDING SITE is a binding site found in an untranslated region of PTEN, corresponding to BINDING SITE of FIG. 26A. FIG. 26D illustrates the complementarity of the nucleotide sequence of PTEN BINDING SITE, designated SEQ ID:324399, to the nucleotide sequence of GAM26 RNA of FIG. 26A, designated SEQ ID:20604.

Yet a further function of GAM26 is therefore inhibition of phosphatase and tensin homolog (mutated in multiple advanced cancers 1 (PTEN), a gene which encodes a Enzyme that is associated with Cowden disease. Accordingly, utilities of GAM26 include diagnosis and treatment of the abovementioned diseases and clinical conditions. The function and utilities of PTEN have been established by previous studies, as described hereinabove with reference to FIG. 26D.

Referring now to PTEN BINDING SITE. Phosphatase and tensin homolog (mutated in multiple advanced cancers 1 (PTEN) is a target gene of GAM26, corresponding to GAM26-TARGET GENE of FIG. 26A. PTEN BINDING SITE is a binding site found in an untranslated region of PTEN, corresponding to BINDING SITE of FIG. 26A. FIG. 26D illustrates the complementarity of the nucleotide sequence of PTEN BINDING SITE, designated SEQ ID:324417, to the nucleotide sequence of GAM26 RNA of FIG. 26A, designated SEQ ID:20604.

Another function of GAM26 is therefore inhibition of phosphatase and tensin homolog (mutated in multiple advanced cancers 1 (PTEN), a gene which encodes a Enzyme that is associated with Cowden disease. Accordingly, utilities of GAM26 include diagnosis and treatment of the abovementioned diseases and clinical conditions. The function and utilities of PTEN have been established by previous studies, as described hereinabove with reference to FIG. 26D.

Referring now to PTEN BINDING SITE. Phosphatase and tensin homolog (mutated in multiple advanced cancers 1 (PTEN is a target gene of GAM26, corresponding to GAM26-TARGET GENE of FIG. 26A. PTEN BINDING SITE is a binding site found in an untranslated region of PTEN, corresponding to BINDING SITE of FIG. 26A. FIG. 26D illustrates the complementarity of the nucleotide sequence of PTEN BINDING SITE, designated SEQ ID:324417, to the nucleotide sequence of GAM26 RNA of FIG. 26A, designated SEQ ID:20604.

Yet another function of GAM26 is therefore inhibition of phosphatase and tensin homolog (mutated in multiple advanced cancers 1 (PTEN), a gene which encodes an enzyme that associated with Cowden disease. Accordingly, utilities of GAM26 include diagnosis and treatment of the abovementioned diseases and clinical conditions. The function and utilities of PTEN have been established by previous studies, as described hereinabove with reference to FIG. 26D.

Referring now to PTEN BINDING SITE. Phosphatase and tensin homolog (mutated in multiple advanced cancers 1 (PTEN) is a target gene of GAM26, corresponding to GAM26-TARGET GENE of FIG. 26A. PTEN BINDING SITE is a binding site found in an untranslated region of PTEN, corresponding to BINDING SITE of FIG. 26A. FIG. 26D illustrates the complementarity of the nucleotide sequence of PTEN BINDING SITE, designated SEQ ID:324452, to the nucleotide sequence of GAM26 RNA of FIG. 26A, designated SEQ ID:20604.

An additional function of GAM26 is therefore inhibition of phosphatase and tensin homolog (mutated in multiple advanced cancers 1 (PTEN), a gene which encodes an enzyme that is associated with Cowden disease. Accordingly, utilities of GAM26 include diagnosis and treatment of the abovementioned diseases and clinical conditions. The function and utilities of PTEN have been established by previous studies, as described hereinabove with reference to FIG. 26D.

Reference is now made to PTP4A2 BINDING SITE. Protein tyrosine phosphatase type IVA, member 2 (PTP4A2) is a target gene of GAM26, corresponding to GAM26-TARGET GENE of FIG. 26A. PTP4A2 BINDING SITE is a binding site found in an untranslated region of PTP4A2, corresponding to BINDING SITE of FIG. 26A. FIG. 26D illustrates the complementarity of the nucleotide sequence of PTP4A2 BINDING SITE, designated SEQ ID:326495, to the nucleotide sequence of GAM26 RNA of FIG. 26A, designated SEQ ID:20604.

A further function of GAM26 is therefore inhibition of protein tyrosine phosphatase type IVA, member 2 (PTP4A2), a gene which encodes an enzyme that is a protein tyrosine phosphatase which has a C-terminal prenylation site. Accordingly, utilities of GAM26 include diagnosis and treatment of the abovementioned diseases and clinical conditions.

The function of PTP4A2 has been established by previous studies. The rat Prl1 (phosphatase of regenerating liver-1; 601585) protein is a 20-kD nuclear protein tyrosine phosphatase (PTPase) that is not homologous to previously characterized dual-specificity PTPases or the monospecific PTPases. Montagna et al., (1995) identified a cDNA encoding a human PRL1-like protein, which they designated OV1. By using an in vitro prenylation screen, Cates et al. (1996) found that human PRL1 and OV1, which they referred to as PTP(CAAX1) and PTP(CAAX2), respectively, are farnesylated in vitro by mammalian farnesyl:protein transferase. Overexpression of these PTPs in epithelial cells caused a transformed phenotype in cultured cells and tumor growth in nude mice. Cates et al. (1996) concluded that PTP(CAAX1) and PTP(CAAX2) represent a novel class of isoprenylated, oncogenic PTPs. Zhao et al. (1996) isolated both cDNA and genomic clones as part of a screen for genes with CTG repeats. Among these were 2 cDNAs, HH13 and HH7-2, that were identical in their coding regions but differed primarily in their 5-prime untranslated regions (UTRs). The predicted 167-amino acid sequence from each was 89% identical to rat Prl1 but was unrelated to other PTPs except for the active site. The protein contains a large number of basic residues and has a predicted isoelectric point of 8.33. Northern blot analysis using a probe from the common 3-prime UTR of HH13 and HH7-2 identified transcripts of 2 and 4 kb in all human tissues examined. Zeng et al. (1998) identified cDNAs encoding the mouse homolog of human PTP (CAAX2), or PRL2. The predicted human and mouse PRL2 proteins are identical. Zhao et al. (1996) used the HH13 cDNA to identify a YAC that was mapped to 1p35 by fluorescence in situ hybridization. They found a third cDNA (designated HH18) which contains a large deletion in the reading frame and may be a splice variant of either HH13 or HH7-2. Furthermore, a processed pseudogene with 96% sequence identity was found in the BRCA1 (113705) region of 17q21.

Full details of the abovementioned studies are described in the following publications, the disclosure of which are hereby incorporated by reference:

ates, C. A.; Michael, R. L.; Stayrook, K. R.; Harvey K. A.; Burke, Y. D.; Randall, S. K.; Crowell, P. L.; Crowell, D. N.: Prenylation of oncogenic human PTP(CAAX) protein tyrosine phosphatases. Cancer Lett. 110: 49-55, 1996. PubMed ID: 9018080 4. Zhao, Z.; Lee, C. -C.; Monckton, D. G.; Yazdani, A.; Coolbaugh, M. I.; Li, X.; Bailey, J.; Shen, Y.; Caskey, C. T.: Characterization and genomic mapping of genes and pseudogenes of a new human protein tyrosine phosphatase. Genomics 35: 172-181, 1996.

Further studies establishing the function and utilities of PTP4A2 are found in John Hopkins OMIM database record ID 601584, and in references numbered 1268-1269, 1271 and 1273 listed hereinbelow.

Referring now to PTP4A2 BINDING SITE. Protein tyrosine phosphatase type IVA, member 2 (PTP4A2) is a target gene of GAM26, corresponding to GAM26-TARGET GENE of FIG. 26A. PTP4A2 BINDING SITE is a binding site found in an untranslated region of PTP4A2, corresponding to BINDING SITE of FIG. 26A. FIG. 26D illustrates the complementarity of the nucleotide sequence of PTP4A2 BINDING SITE, designated SEQ ID:326499, to the nucleotide sequence of GAM26 RNA of FIG. 26A, designated SEQ ID:20604.

Yet a further function of GAM26 is therefore inhibition of protein tyrosine phosphatase type IVA, member 2 (PTP4A2), a gene which encodes an enzyme that is a protein tyrosine phosphatase which has a C-terminal prenylation site. Accordingly, utilities of GAM26 include diagnosis and treatment of the abovementioned diseases and clinical conditions. The function and utilities of PTP4A2 have been established by previous studies, as described hereinabove with reference to FIG. 26D.

Referring now to PTP4A2 BINDING SITE. Protein tyrosine phosphatase type IVA, member 2 (PTP4A2) is a target gene of GAM26, corresponding to GAM26-TARGET GENE of FIG. 26A. PTP4A2 BINDING SITE is a binding site found in an untranslated region of PTP4A2, corresponding to BINDING SITE of FIG. 26A. FIG. 26D illustrates the complementarity of the nucleotide sequence of PTP4A2 BINDING SITE, designated SEQ ID:326500, to the nucleotide sequence of GAM26 RNA of FIG. 26A, designated SEQ ID:20604.

Another function of GAM26 is therefore inhibition of protein tyrosine phosphatase type IVA, member 2 (PTP4A2), a gene which encode an enzyme that is a protein tyrosine phosphatase which has a C-terminal prenylation site. Accordingly, utilities of GAM26 include diagnosis and treatment of the abovementioned diseases and clinical conditions. The function and utilities of PTP4A2 have been established by previous studies, as described hereinabove with reference to FIG. 26D.

Referring now to PTP4A2 BINDING SITE. Protein tyrosine phosphatase type IVA, member 2 (PTP4A2) is a target gene of GAM26, corresponding to GAM26-TARGET GENE of FIG. 26A. PTP4A2 BINDING SITE is a binding site found in an untranslated region of PTP4A2, corresponding to BINDING SITE of FIG. 26A. FIG. 26D illustrates the complementarity of the nucleotide sequence of PTP 4A2 BINDING SITE, designated SEQ ID:326502, to the nucleotide sequence of GAM26 RNA of FIG. 26A, designated SEQ ID:20604.

Yet another function of GAM26 is therefore inhibition of protein tyrosine phosphatase type IVA, member 2 (PTP4A2), a gene which encodes an enzyme that is a protein tyrosine phosphatase which has a C-terminal prenylation site. Accordingly, utilities of GAM26 include diagnosis and treatment of the abovementioned diseases and clinical conditions. The function and utilities of PTP4A2 have been established by previous studies, as described hereinabove with reference to FIG. 26D.

Referring now to PTP4A2 BINDING SITE. Protein tyrosine phosphatase type IVA, member 2 (PTP4A2) is a target gene of GAM26, corresponding to GAM26-TARGET GENE of FIG. 26A. PTP4A2 BINDING SITE is a binding site found in an untranslated region of PTP4A2, corresponding to BINDING SITE of FIG. 26A. FIG. 26D illustrates the complementarity of the nucleotide sequence of PTP4A2 BINDING SITE, designated SEQ ID:326511, to the nucleotide sequence of GAM26 RNA of FIG. 26A, designated SEQ ID:20604.

An additional function of GAM26 is therefore inhibition of protein tyrosine phosphatase type IVA, member 2 (PTP4A2), a gene which encode an enzyme that is a protein tyrosine phosphatase which has a C-terminal prenylation site. Accordingly, utilities of GAM26 include diagnosis and treatment of the abovementioned diseases and clinical conditions. The function and utilities of PTP4A2 have been established by previous studies, as described hereinabove with reference to FIG. 26D.

Referring now to PTP4A2 BINDING SITE. Protein tyrosine phosphatase type IVA, member 2 (PTP4A2) is a target gene of GAM26, corresponding to GAM26-TARGET GENE of FIG. 26A. PTP4A2 BINDING SITE is a binding site found in an untranslated region of PTP4A2, corresponding to BINDING SITE of FIG. 26A. FIG. 26D illustrates the complementarity of the nucleotide sequence of PTP4A2 BINDING SITE, designated SEQ ID:326515, to the nucleotide sequence of GAM26 RNA of FIG. 26A, designated SEQ ID:20604.

A further function of GAM26 is therefore inhibition of protein tyrosine phosphatase type IVA, member 2 (PTP4A2), a gene which encodes an enzyme that is a protein tyrosine phosphatase which has a C-terminal prenylation site. Accordingly, utilities of GAM26 include diagnosis and treatment of the above-mentioned diseases and clinical conditions. The function and utilities of PTP4A2 have been established by previous studies, as described hereinabove with reference to FIG. 26D.

Reference is now made to PTPN1 BINDING SITE. Protein tyrosine phosphatase, non-receptor type 1 (PTPN1) is a target gene of GAM26, corresponding to GAM26-TARGET GENE of FIG. 26A. PTPN1 BINDING SITE is a binding site found in an untranslated region of PTPN1, corresponding to BINDING SITE of FIG. 26A. FIG. 26D illustrates the complementarity of the nucleotide sequence of PTPN1 BINDING SITE, designated SEQ ID:326697, to the nucleotide sequence of GAM26 RNA of FIG. 26A, designated SEQ ID:20604.

Yet a further function of GAM26 is therefore inhibition of protein tyrosine phosphatase, non-receptor type 1 (PTPN1), a gene which encodes an enzyme that is a non-receptor type 1 protein tyrosine phosphatase and inhibits insulin signaling. Accordingly, utilities of GAM26 include diagnosis and treatment of the abovementioned diseases and clinical conditions.

The function of PTPN1 has been established by previous studies. PTP1B inhibits insulin signaling and, when overexpressed, plays a role in insulin resistance (Ahmad et al., 1997). In the 3-prime untranslated region of the PTP1B gene, Di Paola et al. (2002) identified a 1484insG variation (176885.0001) that, in 2 different populations, was associated with several features of insulin resistance. Similar data were obtained in a family-based association study by use of sib pairs discordant for genotype (Gu et al., 2000). Subjects carrying the 1484insG variant showed PTP1B mRNA overexpression in skeletal muscle. PTP1B mRNA stability was significantly higher in human embryonic kidney cells transfected with 1484insG PTP1B as compared with those transfected with wildtype PTP1B. The data indicated that the 1484insG allele causes PTP1B overexpression and plays a role in insulin resistance. Therefore, individuals carrying the 1484insG variant might particularly benefit from PTP1B inhibitors in the treatment of insulin resistance (Kennedy and Ramachandran, 2000).

Animal model experiments lend further support to the function of PTPN1. Elchebly et al. (1999) generated PTP1B-deficient mice by targeted disruption of the mouse homolog of the PTP1B gene. Mice were phenotypically and pathologically normal and had normal life span. In the fed state, homozygous mutant mice had slightly lower blood glucose concentrations, and half the circulating insulin concentrations, of wildtype littermates. The enhanced insulin sensitivity of PTP1B-deficient mice was also evident in glucose- and insulin-tolerance tests. After insulin injection, deficient mice showed increased phosphorylation of the insulin receptor in liver and muscle tissue compared to wildtype mice. On a high-fat diet, PTP1B-deficient mice were resistant to weight gain and remained insulin sensitive, while wildtype mice rapidly gained weight and became insulin resistant. These results suggested a major role for PTP1B in modulation of insulin sensitivity and fuel metabolism. The authors proposed PTP1B as a potential therapeutic target for the treatment of type 2 diabetes and obesity.

It is appreciated that the abovementioned animal model for PTPN1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Elchebly, M.; Payette, P.; Michaliszyn, E.; Cromlish, W.; Collins, S.; Loy, A. L.; Normandin, D.; Cheng, A.; Himms-Hagen, J.; Chan, C.; Ramachandran, C.; Gresser, M. J.; Tremblay, M. L.; Kennedy, B. P.: Increased insulin sensitivity and obesity resistance in mice lacking the protein tyrosine phosphatase-1B gene. Science 283: 1544-1548, 1999. PubMed ID: 10066179 5. Di Paola, R.; Frittitta, L.; Miscio, G.; Bozzali, M.; Baratta, R.; Centra, M.; Spampinato, D.; Santagati, M. G.; Ercolino, T.; Cisternino, C.; Soccio, T. Mastroianno, S.; Tassi, V.; Almgren, P.; Pizzuti, A.; Vigneri, R.; Trischitta, V.: A variation in 3-prime UTR of hPTP1B increases specific gene expression and associates with insulin resistance. Am. J. Hum. Genet. 70: 806-812, 2002.

Further studies establishing the function and utilities of PTPN1 are found in John Hopkins OMIM data base record ID 176885, and in references numbered 1274-1288 listed hereinbelow.

Reference is now made to PTPRF BINDING SITE. Protein tyrosine phosphatase, receptor type, F (PTPRF) is a target gene of GAM26, corresponding to GAM26-TARGET GENE of FIG. 26A. PTPRF BINDING SITE is a binding site found in an untranslated region of PTPRF, corresponding to BINDING SITE of FIG. 26A. FIG. 26D illustrates the complementarity of the nucleotide sequence of PTPRF BINDING SITE, designated SEQ ID:327695, to the nucleotide sequence of GAM26 RNA of FIG. 26A, designated SEQ ID:20604.

Another function of GAM26 is therefore inhibition of protein tyrosine phosphatase, receptor type, F (PTPRF), a gene which encodes an enzyme that negatively regulates the insulin signaling pathway. Accordingly, utilities of GAM26 include diagnosis and treatment of the abovementioned diseases and clinical conditions.

The function of PTPRF has been established by previous studies. The LAR gene (symbolized PTPRF) encodes a membrane protein that has a cytoplasmic domain with homology to protein-tyrosine phosphatase 1B (176885) and an extracellular domain homologous to the neural cellular adhesion molecule NCAM (116930). The human LAR molecule closely resembles cell adhesion molecules, which suggests that it may be involved in the regulation of phosphotyrosine levels through cell-cell or cell-matrix interactions. As a first stop toward site-directed mutagenesis studies of LAR function, Schaapveld et al. (1995) characterized the mouse Ptprf gene. They found that its cytoplasmic region is encoded by 11 exons that span only 4.5 kb of genomic DNA. Compared to the known exon-intron structures of other mammalia receptor-like protein tyrosine phosphatase genes such as Ptpra (encoding LRP; 176884) and Ptprc (coding for Ly-5; 151460), the portion of the Ptprf gene encoding the cytoplasmic region of murine LAR contained not only smaller, but also fewer introns. O'Grady et al. (1994) demonstrated that the human LAR gene is composed of 33 exons spanning over 85 kb. Exon 2 encodes the signal sequence and the first 4 amino acids in the mature LAR protein. The 3 immunoglobulin-like domains are encoded by exons 3 to 7, and the 8 fibronectin type III (FN-III) domains by exons 8 to 17. Exons 18 to 22 encode the juxtamembrane and transmembrane domains, and exons 23 to 33 encode the 2 conserved tyrosine phosphatase domains and the entire 3-prime untranslated region. Alternative splicing of LAR mRNA was revealed by RT-PCR analysis.

Full details of the abovementioned studies are described in the following publications, the disclosure of which are hereby incorporated by reference:

Schaapveld, R. Q. J.; van den Maagdenberg, A. M. J. M.; Schepens, J. T. G.; Olde Weghuis, D.; Geurts van Kessel, A.; Wieringa, B.; Hendriks, W. J. A. J.: The mouse gene Ptprf encoding the leukocyte common antigen-related molecule LAR: cloning, characterization, and chromosomal localization. Genomics 27: 124-130, 1995. PubMed ID: 7665159 6. O'Grady, P.; Krueger, N. X.; Streuli, M.; Saito, H.: Genomic organization of the human LAR protein tyrosine phosphatase gene and alternative splicing in the extracellular fibronectin type-III domains. J. Biol. Chem. 269: 25193-25199, 1994. PubMed ID: 7929208 9. Tsujikawa, K.; Kawakami, N.; Uchino, Y.; Ichijo, T.; Furukawa, T.; Saito, H.; Yamamoto, H.: Distinct functions of two protein tyrosine phosphatase domains of LAR (leukocyte common antigen-related) on tyrosine dephosphorylation of insulin receptor. Molec. Endocr. 15: 271-280, 2001.

Further studies establishing the function and utilities of PTPRF are found in John Hopkins OMIM database record ID 179590, and in references numbered 1289-1297 listed hereinbelow.

Reference is now made to PURA BINDING SITE. Purine-rich element binding protein A (PURA) is a target gene of GAM26, corresponding to GAM26-TARGET GENE of FIG. 26A. PURA BINDING SITE is a binding site found in an untranslated region of PURA, corresponding to BINDING SITE of FIG. 26A. FIG. 26D illustrates the complementarity of the nucleotide sequence of PURA BINDING SITE, designated SEQ ID:328884, to the nucleotide sequence of GAM26 RNA of FIG. 26A, designated SEQ ID:20604.

Yet another function of GAM26 is therefore inhibition of purine-rich element binding protein A (PURA), a gene which encodes a protein that is a probable transcription activator. Accordingly, utilities of GAM26 include diagnosis and treatment of the abovementioned diseases and clinical conditions.

The function of PURA has been established by previous studies. Kennedy and Rutter (1992) identified a transcription factor, which they referred to as Pur-1 because of its ability to bind to purine-rich sequences. Such purine-rich stretches of nucleotides (GAGA boxes) are often found just upstream of transcription start sites in many genes, including insulin (INS; 176730). Mutational analysis suggested that the GAGA box plays an important role in transcription of the rat insulin I gene. Kennedy and Rutter (1992) identified at least 4 different proteins that bind specifically to the insulin GAGA box. Using a GAGA oligonucleotide, they isolated a cDNA encoding a sequence-specific protein from a lambda-gt11 expression library made from a hamster insulinoma cell line. This was the protein that they designated Pur-1. They found that it binds to the GAGA boxes of the rat insulin I and II genes and the human islet amyloid polypeptide gene. Pur-1 is a potent transactivator in both pancreatic and nonpancreatic cells. Furthermore, Pur-1 is able to activate an intact insulin promoter in HeLa cells, where it is normally inactive. Pur-alpha is a single-stranded DNA-binding protein with specific affinity for a purine-rich element of the configuration (GGN)n present in several initiation zones of eukaryotic DNA replication. It interacts with large T-antigen and cellular protein YB-1 (154030) to activate JC viral DNA transcription in human cells (Chen et al., 1995). The functional activities of Pur-alpha, together with its evolutionary conservation, suggested it may represent an important link between DNA replication and differential gene expression. Using a 16-kb genomic probe together with hybridization of a cDNA probe to blots of DNA from human/hamster cell lines, Ma et al. (1995) mapped the PURA gene to 5q31. This region is frequently deleted in myelogenous leukemias in hematologic malignancies and other cancers. Sequences with homology to the PURA gene were also present at 6q14.

Full details of the abovementioned studies are described in the following publications, the disclosure of which are hereby incorporated by reference:

Gallia, G. L.; Johnson, E. M.; Khalili, K.: Pur-alpha: a multifunctional single-stranded DNA- and RNA-binding protein. Nucleic Acids Res. 28: 3197-3205, 2000. PubMed ID: 10954586 3. Kennedy, G. C.; Rutter, W. J.: Pur-1, a zinc-finger protein that binds to purine-rich sequences, transactivates an insulin promoter in heterologous cells. Proc. Nat. Acad. Sci. 89: 11498-11502, 1992. PubMed ID: 1454839 4. Ma, Z. -W.; Pejovic, T.; Najfeld, V.; Ward, D. C.; Johnson, M.: Localization of PURA, the gene encoding the sequence-specific single-stranded-DNA-binding protein Pur-alpha, to chromosome band 5q31. Cytogenet. Cell Genet, 71: 64-67, 1995.

Further studies establishing the function and utilities of PURA are found in John Hopkins OMIM database record ID 600473, and in references numbered 1298-1301 listed hereinbelow.

Referring now to PURA BINDING SITE. Purine-rich element binding protein A (PURA) is a target gene of GAM26, corresponding to GAM26-TARGET GENE of FIG. 26A. PURA BINDING SITE is a binding site found in an untranslated region of PURA, corresponding to BINDING SITE of FIG. 26A. FIG. 26D illustrates the complementarity of the nucleotide sequence of PURA BINDING SITE, designated SEQ ID:328886, to the nucleotide sequence of GAM26 RNA of FIG. 26A, designated SEQ ID:20604.

An additional function of GAM26 is therefore inhibition of purine-rich element binding protein A (PURA), a gene which encodes a protein that is a probable transcription activator. Accordingly, utilities of GAM26 include diagnosis and treatment of the abovementioned diseases and clinical condition. The function and utilities of PURA have been established by previous studies, as described hereinabove with reference to FIG. 26D.

Reference is now made to PX19 BINDING SITE. (PX19) is a target gene of GAM26, corresponding to GAM26-TARGET GENE of FIG. 26A. PX19 BINDING SITE is a binding site found in an untranslated region of PX19, corresponding to BINDING SITE of FIG. 26A. FIG. 26D illustrates the complementarity of the nucleotide sequence of PX19 BINDING SITE, designated SEQ ID:329171, to the nucleotide sequence of GAM26 RNA of FIG. 26A, designated SEQ ID:20604.

A further function of GAM26 is therefore inhibition of (PX9), a gene which encodes a protein that plays a role in hemopoiesis. Accordingly, utilities of GAM26 include diagnosis and treatment of the abovementioned diseases and clinical conditions.

The function of PX19 has been established by previous studies. The late embryogenesis abundant (LEA) motif is found in plant proteins that protect against desiccation and other type of stress affecting plant embryo development. In chicken, a LEA motif-containing protein termed Px19 plays a role in hemopoiesis. By gene motif-targeted RT-PCR differential display of tonsillar B-lymphocyte subpopulations purified and sorted by flow cytometry, Guzman-Rojas et al. (2000) isolated a cDNA encoding human PX19, which they termed PRELI for 'protein of relevant evolutionary and lymphoid interest.' Sequence analysis predicted that the 219-amino acid human protein is 85% identical to the avian protein. PX19 contains 2 alpha helices with amphipathic domains in opposite orientation, and the LEA motifs (A/TAEKAK) are clustered within this region. Northern blot analysis detected 1.0- and 1.2-kb transcripts predominantly in fetal liver, with much lower levels in other fetal tissues. Expression was significantly reduced in adult liver, but was higher in other adult organs. Expression was low in bone marrow and thymus, but high in adult spleen, lymph node, and peripheral blood leukocytes. Further analysis of B-cell lines indicated that expression is higher in mature B cells, predominantly from germinal centers, and absent in progenitor and precursor B-cell lines. Guzman-Rojas et al. (2000) inferred from these data that PX19 expression is more important in B- than in T-lymphocyte differentiation and early lymphopoiesis, and that PX19 may be more significant for mature B lymphocytes during secondary immune responses, a stage of stressful selection pressure.

Full details of the abovementioned studies are described in the following publications, the disclosure of which are hereby incorporated by reference:

Guzman-Rojas, L.; Sims, J. C.; Rangel, R.; Guret, C.; Sun, Y.; Alcocer, J. M.; Martinez-Valdez, H.: PRELI, the human homologue of the avian px19, is expressed by germinal center B lymphocytes. Int. Immun. 12: 607-612, 2000.

Further studies establishing the function and utilities of PX19 are found in John Hopkins OMIM database record ID 605733, and in references numbered 1302 listed hereinbelow.

Referring now to PX19 BINDING SITE. (PX19) is a target gene of GAM26, corresponding to GAM26-TARGET GENE of FIG. 26A. PX19 BINDING SITE is a binding site found in an untranslated region of PX19, corresponding to BINDING SITE of FIG. 26A. FIG. 26D illustrates the complementarity of the nucleotide sequence of PX19 BINDING SITE, designated SEQ ID:329172, to the nucleotide sequence of GAM26 RNA of FIG. 26D designated SEQ ID:20604.

Yet a further function of GAM26 is therefore inhibition of (PX19), a gene which encodes a protein that plays a role in hemopoiesis. Accordingly, utilities of GAM26 include diagnosis and treatment of the abovementioned diseases and clinical conditions. The function and utilities of PX19 have been established by previous studies, as described hereinabove with reference to FIG. 26D.

Referring now to PX19 BINDING SITE. (PX19) is a target gene of GAM26, corresponding to GAM26-TARGET GENE of FIG. 26A. PX19 BINDING SITE is a binding site found translated region of PX19, corresponding to BINDING SITE of FIG. 26A. FIG. 26D illustrates the complementarity of the nucleotide sequence of PX19 BINDING SITE, designated SEQ ID:329182, to the nucleotide sequence of GAM26 RNA of FIG. 26, designated SEQ ID:20604.

Another function of GAM26 is therefore inhibition of (PX19), a gene which encodes a protein that plays a role in hemopoiesis. Accordingly, utilities of GAM26 include diagnosis and treatment of the abovementioned diseases and clinical conditions. The function and utilities of PX19 have been established by previous studies, as described hereinabove with reference to FIG. 26D.

Reference is now made to RAB1A BINDING SITE. (RAB1A) is a target gene of GAM26, corresponding to GAM26-TARGET GENE of FIG. 26A. RAB1A BINDING SITE is a binding site found in an untranslated region of RAB1A, corresponding to BINDING SITE of FIG. 26A. FIG. 26D illustrates the complementarity of the nucleotide sequence of RAB1A BINDING SITE, designated SEQ ID:330375, to the nucleotide sequence of GAM26 RNA of FIG. 26A, designated SEQ ID:20604.

Yet another function of GAM26 is therefore inhibition of (RAB1A), a gene which encodes a protein that is involved in vesicle transport. Accordingly, utilities of GAM26 include diagnosis and treatment of the abovementioned diseases and clinical conditions.

The function of RAB1A has been established by previous studies. RAB proteins have been postulated to regulate the targeting and fusion of membranous vesicles during organelle assembly and transport. RAB proteins undergo regulated exchange of GTP for GDP, and they slowly hydrolyze the bound GTP in a reaction that is thought to regulate the timing and unidirectional nature of these assembly events. All of the known RAB proteins terminate in sequences such as cys-X-cys (e.g., RAB3A, 179490), cys-cys (e.g., RAB1A), or a closely related sequence, and all are believed to be geranylgeranylated. From a human pheochromocytoma cDNA library, Zahraoui et al. (1989) isolated 7 cDNA clones corresponding to genes encoding the Ras-associated GTP-binding proteins. See RAB5A (179512). The predicted 205-amino acid human and rat RAB1 proteins are identical and share 75% identity with YPT1, the *S. cerevisiae* homolog. Northern blot analysis revealed that the RAB1 gene was expressed as a major (2.7 kb) and a minor (1.7 kb) mRNA in a human fibroblast cell line. The 'wobbler' spinal muscular atrophy gene (wr) maps to proximal mouse chromosome 11, tightly linked to Rab1 and Glns-ps1, an intronless pseudogene of the glutamine synthetase gene (138290). Wedemeyer et al. (1996) used these markers to construct a 1.3-Mb YAC contig of the Rab1 region on mouse chromosome 11. Two overlapping YACS were identified that contained a 150-kb region of human chromosome 2p, comprising the RAB1 locus as well as a newly discovered STS (AHY1.1) and a trapped exon (ETG1.1). The region was mapped to 2p14-p13.4 using somatic cell hybrids and a radiation hybrid panel, thus extending a known region of conserved synteny between mouse chromosome 11 and human 2p. The gene for limb-girdle muscular dystrophy type 2B (LGMD2B; 253601) maps to 2p16-p13. The authors noted that conservation between the mouse Rab1 and human RAB1 regions will be helpful in identifying candidate genes for the 'wobbler' spinal muscular atrophy and in clarifying a possible relationship between wr and LGMD2B.

Full details of the abovementioned studies are described in the following publications, the disclosure of which are hereby incorporated by reference:

Allan, B. B.; Moyer, B. D.; Balch, W. E.: Rab1 recruitment of p115 into a cis-SNARE complex: programming budding COPII vesicles for fusion. Science 289: 444-448, 2000. PubMed ID: 10903204 2. Wedemeyer, N.; Lengeling, A.; Ronsiek, M.; Korthaus, D.; Baer, K.; Wuttke, M.; Jockusch, H.: YAC contigs of the Rab1 and wobbler (wr) spinal muscular atrophy gene region on proximal mouse chromosome 11 and of the homologous region on human chromosome 2p. Genomics 32: 447-454, 1996. PubMed ID: 8838809 3. Zahraoui, A.; Touchot, N.; Chardin, P.;

Tavitian, A.: The human Rab genes encode a family of GTP-binding proteins related to yeast YPT1 and SEC4 products involved in secretion. J. Biol. Chem. 264: 12399-12401, 1989.

Further studies establishing the function and utilities of RAB1A are found in John Hopkins OMIM database record ID 179508, and in references numbered 1303-1305 listed hereinbelow.

Referring now to RAB1A BINDING SITE. (RAB1A) is a target gene of GAM26, corresponding to GAM26-TARGET GENE of FIG. 26A. RAB1A BINDING SITE is a binding site found in an untranslated region of RAB1A, corresponding to BINDING SITE of FIG. 26A. FIG. 26D illustrates the complementarity of the nucleotide sequence of RAB1A BINDING SITE, designated SEQ ID:330388, to the nucleotide sequence of GAM26 RNA of FIG. 26A, designated SEQ ID:20604.

An additional function of GAM26 is therefore inhibition of (RAB1A), a gene which encodes a protein that is involved in vesicle transport. Accordingly, utilities of GAM26 include diagnosis and treatment of the abovementioned diseases and clinical conditions. The function and utilities of RAB1A have been established by previous studies, as described hereinabove with reference to FIG. 26D.

Referring now to RAB1A BINDING SITE. (RAB1A) is a target gene of GAM26, corresponding to GAM26-TARGET GENE of FIG. 26. RAB1A BINDING SITE is a binding site found in an untranslated region of RAB1A, corresponding to BINDING SITE of FIG. 26A. FIG. 26D illustrates the complementarity of the nucleotide sequence of RAB1A BINDING SITE, designated SEQ ID:330410, to the nucleotide sequence of GAM26 RNA of FIG. 26A, designated SEQ ID:20604.

A further function of GAM26 is therefore inhibition of (RAB1A), a gene which encodes a protein that is involved in vesicle transport. Accordingly, utilities of GAM26 include diagnosis and treatment of the abovementioned diseases and clinical conditions. The function and utilities of RAB1A have been established by previous studies, as described hereinabove with reference to FIG. 26D.

Reference is now made to RAB33A BINDING SITE. RAB33A, member RAS oncogene family (RAB33A) is a target gene of GAM26, corresponding to GAM26-TARGET GENE of FIG. 26A. RAB33A BINDING SITE is a binding site found in an untranslated region of RAB33A, corresponding to BINDING SITE of FIG. 26A. FIG. 26D illustrates the complementarity of the nucleotide sequence of RAB33A BINDING SITE, designated SEQ ID:330765, to the nucleotide sequence of GAM26 RNA of FIG. 26A, designated SEQ ID:20604.

Yet a further function of GAM26 is therefore inhibition of RAB33A, member RAS oncogene family (RAB33A), a gene which encodes a protein that is an GTP-binding protein. Accordingly, utilities of GAM26 include diagnosis and treatment of the abovementioned diseases and clinical conditions.

The function of RAB33A has been established by previous studies. Small GTP-binding proteins re involved in many cellular functions, including signal transduction, vesicular transport, and control of cytoskeleton and chromatin structure. These proteins all contain conserved regions, termed G1 through G5, that are involved in GTP/GDP binding and GTPase activity. By RT-PCR analysis using degenerate primers from conserved regions of small GTP-binding proteins and screening a Jurkat T-lymphocyte cDNA library, Koda and Kakinuma (1993) isolated a cDNA encoding RAB33A, which they called S10. The deduced 237-amino acid RAB33A protein belongs to the RAB subfamily of small GTPases (see RAB1; 179508), other members of which are involved in vesicular transport. Northern blot analysis showed that expression of RAB33A is restricted to lymphoid and monocytic lineage.

Full details of the abovementioned studies are described in the following publications, the disclosure of which are hereby incorporated by reference:

Koda, T.; Kakinuma, M.: Molecular cloning of a cDNA encoding a novel small GTP-binding protein. FEBS Lett. 328: 21-24, 1993. PubMed ID: 7688322 3. Zheng, J. Y.; Koda, T.; Arimura, Y.; Kishi, M.; Kakinuma, M.: Structure and expression of the mouse S10 gene. Biochim. Biophys. Acta 1351: 47-50, 1997.

Further studies establishing the function and utilities of RAB33A are found in John Hopkins OMIM database record ID 300333, and in references numbered 1306-1308 listed hereinbelow.

Reference is now made to RAD21 BINDING SITE. RAD21 (*S. pombe*) homolog (RAD21) is a target gene of GAM26, corresponding to GAM26-TARGET GENE of FIG. 26A. RAD21 BINDING SITE is a binding site found in an untranslated region of RAD21, corresponding to BINDING SITE of FIG. 26A. FIG. 26D illustrates the complementarity of the nucleotide sequence of RAD21 BINDING SITE, designated SEQ ID:333078, to the nucleotide sequence of GAM26 RNA of FIG. 26A, designated SEQ ID:20604.

Another function of GAM26 is therefore inhibition of RAD21 (*S. pombe*) homolog (RAD21), a gene which encodes a protein that may act in double strand break repair. Accordingly, utilities of GAM26 include diagnosis and treatment of the abovementioned diseases and clinical conditions.

The function of RAD21 has been established by previous studies. Eukaryotic sister chromatids remain connected from the time of synthesis until they are separated in anaphase. This cohesion depends on a complex of proteins known as cohesins. In vertebrates, unlike in yeast, the cohesins dissociate from chromosome arms earlier in M phase, during prophase. Small amounts of cohesin remain near the centromere until metaphase, with complete removal at the beginning of anaphase. Cohesin complexes contain SMC1 (300040), SMC3 (CSPG6; 60602), SCC1 (RAD21), and either SA1 (STAG1; 604358) or SA2 (STAG2; 604359). The complexes, in turn, interact with PDS5, a protein implicated in chromosome cohesion, condensation, and recombination in yeast (Sumara et al., 2000). By sequencing cDNAs randomly selected from a cDNA library derived from a human immature myeloid cell line, Nomura et al. (1994) identified a cDNA encoding a homolog of *S. pombe* Rad21 that they termed KIAA0078. The deduced KIAA0078 protein has 631 amino acids. Northern blot analysis detected equivalent expression of KIAA0078 in all tissues tested.

Full details of the abovementioned studies are described in the following publications, the disclosure of which are hereby incorporated by reference:

Sumara, I.; Vorlaufer, E.; Gieffers, C.; Peters, B. H.; Peters, J. -M.: Characterization of vertebrate cohesin complexes and their regulation in prophase. J. Cell Biol. 151: 749-761, 2000. PubMed ID: 11076961 5. Nomura, N.; Nagase, T.; Miyajima, N.; Sazuka, T.; Tanaka, A.; Sato, S.; Seki, N.; Kawarabayasi, Y.; Ishikawa, K.; Tabata, S.: Prediction of the coding sequences of unidentified human genes. II. The coding sequences of 40 new genes (KIAA0041-KIAA0080) deduced by analysis of cDNA clones from human cell line KG-1. DNA Res. 1: 223-229, 1994.

Further studies establishing the function and utilities of RAD21 are found in John Hopkins OMIM database record ID 606462, and in references numbered 1309-1315 listed hereinbelow.

Reference is now made to RASGRP1 BINDING SITE. RAS guanyl releasing protein 1 (calcium and DAG-regulated) (RASGRP1) is a target gene of GAM26, corresponding to GAM26-TARGET GENE of FIG. 26A. RASGRP1 BINDING SITE is a binding site found in an untranslated region of RASGRP1, corresponding to BINDING SITE of FIG. 26A. FIG. 26D illustrates the complementarity of the nucleotide sequence of RASGRP1 BINDING SITE, designated SEQ ID:336440, to the nucleotide sequence of GAM26 RNA of FIG. 26A, designated SEQ ID:20604.

Yet another function of GAM26 is therefore inhibition of RAS guanyl releasing protein 1 (calcium and DAG-regulated) (RASGRP1), a gene which encodes a protein that is a RAS guanyl releasing protein. Accordingly, utilities of GAM26 include diagnosis and treatment of the abovementioned diseases and clinical conditions.

The function of RASGRP1 has been established by previous studies. The basal ganglia are implicated in the central control of movement and in forms of procedural learning related to habit formation. The basal ganglia have a unique double-inhibitory pathway design combined with abundant expression of neuromodulators in striatal neurons. Genes with differentially high expression in the striatum include genes encoding proteins with signaling functions, such as adenylate cyclase-5 (ADCY5; 600293). In a search for striatum-enriched transcripts by a differential display method, Kawasaki et al. (1998) found a family of genes characterized by the presence of a Ras superfamily guanine nucleotide exchange factor (GEF) domain. Kawasaki et al. (1998) characterized the calcium- and diacylglycerol (DAG)-regulated GEFI. They showed that the calcium- and DAG-regulated GEFII, which was cloned by Ebinu et al. (1998), exhibited a different brain expression pattern. Bottorff et al. (1999) proposed that the Ras activator GEFII represented a 5-prime and 3-prime truncated version of a larger normal transcript that encodes a predicted 90-kD protein, which they called RAS guanyl nucleotide-releasing protein (RASGRP). Bottorff et al. (1999) studied the structure of the mouse and human sequences and confirmed their conclusions about the nature of the 5-prime truncation. They localized the human RASGRP1 gene to 15q15 by in situ hybridization, and positioned the mouse gene on chromosome 2 near thrombospondin by linkage analysis.

Full details of the abovementioned studies are described in the following publications, the disclosure of which are hereby incorporated by reference:

Further studies establishing the function and utilities of RASGRP1 are found in John Hopkins OMIM database record ID 603962, and in references numbered 1316-1318 listed hereinbelow.

Reference is now made to LAF4 BINDING SITE. Lymphoid nuclear protein related to AF4 (LAF4) is a target gene of GAM26, corresponding to GAM26-TARGET GENE of FIG. 26A. LAF4 BINDING SITE is a binding site found in an untranslated region of LAF4, corresponding to BINDING SITE of FIG. 26A. FIG. 26D illustrates the complementarity of the nucleotide sequence of LAF4 BINDING SITE, designated SEQ ID:338574, to the nucleotide sequence of GAM26 RNA of FIG. 26A, designated SEQ ID:20604.

An additional function of GAM26 is therefore inhibition of lymphoid nuclear protein related to AF4 (LAF4), a gene which encodes a protein that may function in lymphoid development and oncogenesis, and is associated with leukemias. Accordingly, utilities of GAM26 include diagnosis and treatment of the abovementioned diseases and clinical conditions.

The function of LAF4 has been established by previous studies. The translocation t(4;11)(q21;q23) is present in approximately 50% of children under 1 year of age suffering from acute lymphoblastic leukemia (ALL). Lymphoid nuclear protein related to AF4 (LAF4) is related to MLLT2 (159557), also referred to as AF4, which is the gene that is fused to the MLL gene (159555), also termed ALL1, HRX, and HTRX, in t(4;11)(q21;q23). Ma and Staudt (1996) isolated a human cDNA encoding LAF4 from a subtracted cDNA library enriched for genes expressed in the Raji Burkitt's lymphoma cell line and not in the K562 erythroleukemia cell line. LAF4 is a 1,227-amino acid protein with a mass of 135 kD in B-cell lines. It is similar to MLLT2 throughout its length, with the greatest similarity in the N-terminal and C-terminal regions. LAF4 is a tissue-restricted nuclear transcriptional activator that is preferentially expressed in lymphoid tissue. Northern blot analysis detected a major 8.5-kb transcript in lymphoid cell lines. By interspecific backcross lysis, Liao et al. (1996) determined that the mouse Laf4 gene is located on chromosome 1. By fluorescence in situ hybridization, they assigned the human LAF4 gene to 2q11.2-q12. Liao et al. (1996) stated that the isolation of LAF4 has defined a highly conserved LAF4/MLLT2 gene family of nuclear transcription factors that may function in lymphoid development and oncogenesis.

Full details of the abovementioned studies are described in the following publications, the disclosure of which are hereby incorporated by reference:
Liao, X.; Ma, C.; Trask, B.; Massa, H.; Gilbert, D. J.; Staudt, L. M.; Jenkins, N. A.; Copeland, N. G.: LAF4 maps to mouse chromosome 1 and human chromosome 2q11.2-q12. Mammalian Genome 7: 467-468, 1996. PubMed ID: 8662235 2. Ma, C.; Staudt, L. M.: LAF-4 encodes a lymphoid nuclear protein with transactivation potential that is homologous to AF-4, the gene fused to MLL in t(4;11) leukemias. Blood 87: 734-745, 1996.

Further studies establishing the function and utilities of LAF4 are found in John Hopkins OMIM database record ID 601464, and in references numbered 1319-1320 listed hereinbelow.

Reference is now made to RECK BINDING SITE. Reversion-inducing-cysteine-rich protein with kazal motifs (RECK) is a target gene of GAM26, corresponding to GAM26-TARGET GENE of FIG. 26A. RECK BINDING SITE is a binding site found in an untranslated region of RECK, corresponding to BINDING SITE of FIG. 26A. FIG. 26D illustrates the complementarity of the nucleotide sequence of RECK BINDING SITE, designated SEQ ID:338574, to the nucleotide sequence of GAM26 RNA of FIG. 26A, designated SEQ ID:20604.

A further function of GAM26 is therefore inhibition of reversion-inducing-cysteine-rich protein with kazal motifs (RECK), a gene which encodes a protein that plays a role in regulation of cancer progression and tumor angiogenesis and is associated with cancerous tumors. Accordingly, utilities of GAM26 include diagnosis and treatment of the abovementioned diseases and clinical conditions.

The function of RECK has been established by previous studies. Transformed malignant cell lines frequently lose a flat morphology and acquire a round morphology. Genes that induce flat reversion may be useful in the control of cancer. By screening a fibroblast expression library for reversion inducing cDNAs, Takahashi et al. (1998) isolated a cDNA encoding RECK (reversion-inducing, cysteine-rich protein with Kazal motifs). Sequence analysis predicted that the 971-amino acid RECK protein, which shares 93% amino acid identity with mouse Reck, is 9% cysteine and contains an N-terminal signal sequence; 5 putative cysteine knot motifs; 5 potential N-glycosylation sites; 3 central serine protease inhibitor domains with either complete or incomplete Kazal-type, 4-cys motifs; 2 regions with weak homology to EGF-like repeats; and a C-terminal hydrophobic glycosylphosphatidylinositol-anchoring signal. Immunoblot analysis showed that RECK is expressed as a 110-kD protein that is reduced to approximately 100 kD after deglycosylation. Northern blot analysis detected a 4.6-kb RECK transcript in a wide variety of tissues and normal cell lines, but no expression was detected in tumor cell lines. Restoration of RECK expression in tumor cell lines did not affect growth but did significantly suppress matrix invasion and metastatic activity. SDS-PAGE and gelatin zymography analysis demonstrated that due to a posttranscriptional event(s), secretion of MMP9 (120361), a key enzyme in tumor invasion and metastasis, is decreased in cells expressing RECK. An RECK mutant lack in the C-terminal 23 residues retained the ability to suppress tumor cell invasion and MMP9 proteolytic activity but lost the ability to inhibit MMP9 release.

Animal model experiments lend further support to the function of RECK. Oh et al. (2001) showed that in addition to MMP9, RECK also regulates MMP2 (120360) and MT1-MMP (MMP14; 600754), which are known to be involved in cancer progression. Mice lacking a functional Reck gene died around embryonic day 10.5 with defects in collagen fibrils, the basal lamina, and vascular development; this phenotype could be partially suppressed by Mmp2 null mutation. Vascular sprouting was dramatically suppressed in tumors derived from Reck-expressing fibrosarcoma cells grown in nude mice. These results supported a role for RECK in the regulation of MMP2 in vivo and implicated RECK downregulation in tumor angiogenesis.

It is appreciated that the abovementioned anima model for RECK is acknowledged by those skilled in the art as a scientifically valid animal model, as can be further appreciated from the publications sited hereinbelow.

Full details of the abovementioned studies are described in the following publications, the disclosure of which are hereby incorporated by reference:
Takahashi, C.; Sheng, Z.; Horan, T. P.; Kitayama, H.; Maki, M.; Hitomi, K.; Kitaura, Y.; Takai, S.; Sasahara, R. M.; Horimoto, A.; Ikawa, Y.; Ratzkin, B. J.; Arakawa, T.; Noda, M.: Regulation of matrix metalloproteinase-9 and inhibition of tumor invasion by the membrane-anchored glycoprotein RECK. Proc. Nat. Acad. Sci. 95: 13221-13226, 1998. PubMed ID: 9789069 1. Oh, J.; Takahashi, R.; Kondo, S.; Mizoguchi, A.; Adachi, E.; Sasahara, R. M.; Nishimura, S.; Imamura, Y.; Kitayama, H.; Alexander, D. B.; Ide, C.; Horan, T. P.; Arakawa, T.; Yoshida, H.; Nishikawa, S.; Itoh, Y.; Seiki, M.; Itohara, S.; Takahashi, C.; Noda, M.: The membrane-anchored MMP inhibitor RECK is a key regulator of extracellular matrix integrity and angiogenesis. Cell 107: 789-800, 2001.

Further studies establishing the function and utilities of RECK are found in John Hopkins OMIM database record ID 605227, and in references numbered 1321-1322 listed hereinbelow.

Referring now to RECK BINDING SITE. Reversion-inducing-cysteine-rich protein with kazal motifs (RECK) is a target gene of GAM26, corresponding to GAM26-TARGET GENE of FIG. 26A. RECK BINDING SITE is a binding site found in an untranslated region of RECK, corresponding to BINDING SITE of FIG. 26A. FIG. 26D illustrates the complementarity of the nucleotide sequence of RECK BINDING SITE, designated SEQ ID:338574, to the nucleotide sequence of GAM26 RNA of FIG. 26A, designated SEQ ID:20604.

Yet a further function of GAM26 is therefore inhibition of reversion-inducing-cysteine-rich protein with kazal motifs (RECK), a gene which encodes a protein that plays a role in regulation of cancer progression and tumor angiogenesis and is associated with cancerous tumors. Accordingly, utilities of GAM26 include diagnosis and treatment of the abovementioned diseases and clinical conditions. The function and utilities of RECK have been established by previous studies, as described hereinabove with reference to FIG. 26D.

Referring now to RECK BINDING SITE. Reversion-inducing-cysteine-rich protein with kazal motifs (RECK) is a target gene of GAM26, corresponding to GAM26-TARGET GENE of FIG. 26A. RECK BINDING SITE is a binding site found in an untranslated region of RECK, corresponding to BINDING SITE of FIG. 26A. FIG. 26D illustrates the complementarity of the nucleotide sequence of RECK BINDING SITE, designated SEQ ID:338585, to the nucleotide sequence of GAM26 RNA of FIG. 26A, designated SEQ ID:20604.

Another function of GAM26 is therefore inhibition of reversion-inducing-cysteine-rich protein with kazal motifs (RECK), a gene which encodes a protein that plays a role in regulation of cancer progression and tumor angiogenesis, and is associated with cancerous tumors. Accordingly, utilities of GAM26 include diagnosis and treatment of the abovementioned diseases and clinical conditions. The function and utilities of RECK have been established by previous studies, as described hereinabove with reference to FIG. 26D.

Reference is now made to RENT1 BINDING SITE. Regulator of nonsense transcripts 1 (RENT1) is a target gene of GAM26, corresponding to GAM26-TARGET GENE of FIG. 26A. RENT1 BINDING SITE is a binding site found in an untranslated region of RENT1, corresponding to BINDING SITE of FIG. 26A. FIG. 26D illustrates the complementarity of the nucleotide sequence of RENT1 BINDING SITE, designated SEQ ID:339175, to the nucleotide sequence of GAM26 RNA of FIG. 26A, designated SEQ ID:20604.

Yet another function of GAM26 is therefore inhibition of regulator of nonsense transcripts 1 (RENT1), a gene which encodes a protein that eliminates the production of nonsense-containing RNAs in mammalian cells. Accordingly, utilities of GAM26 include diagnosis and treatment of the abovementioned diseases and clinical conditions.

The function of RENT1 has been established by previous studies. Sun et al. (1998) provided evidence for a factor that functions to eliminate production of nonsense-containing RNAs in mammalian cells. They identified the factor, variously referred to as RENT1 and HUPF1, by isolating cDNA for a human homolog of S. cerevisiae Upf1p, which is a group I RNA helicase that functions in the nonsense-mediated decay of mRNA in yeast. Using monkey COS cells and human HeLa cells, Sun et al. (1998) demonstrated that expression of human Upf1 protein harboring an arginine-to-cysteine mutation at residue 844 within the RNA helicase domain acts in a dominant-negative fashion to abrogate the decay of nonsense-containing mRNA that takes place in association with nuclei or in the cytoplasm. These findings provided evidence that nonsense-mediated mRNA decay is related mechanistically in yeast and in mammalian cells, regardless of the cellular site of decay.

Animal model experiments lend further support to the function of RENT1. Medghalchi et al. (2001) explored the consequences of loss of NMRD function in vertebrates through targeted disruption of the Rent1 gene, which encodes a mammalian ortholog of Upf1p, in murine embryonic stem cells. Mice heterozygous for the targeted allele showed no apparent phenotypic abnormalities but homozygosity was never observed, demonstrating that Rent1 is essential for embryonic ability. Homozygous targeted embryos showed complete loss of NMRD and were viable in the preimplantation period, but resorbed shortly after implantation. Furthermore, Rent1 −/− blastocysts isolated at 3.5 days postcoitum underwent apoptosis in culture following a brief phase of cellular expansion. The authors hypothesized that NMRD is essential for mammalian cellular viability and supports a critical role for the pathway in the regulated expression of selected physiologic transcripts.

It is appreciated that the abovementioned animal model for RENT1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Sun, X.; Perlick, H. A.; Dietz, H. C.; Maquat, L. E.: A mutated human homologue to yeast Upf1 protein has a dominant-negative effect on the decay of nonsense-containing mRNAs in mammalian cells. Proc. Nat. Acad. Sci. 95: 10009-10014, 1998. PubMed ID: 9707591 2. Medghalchi, S. M.; Frischmeyer, P. A.; Mendell, J. T.; Kelly, A. G.; Lawler, A. M.; Dietz, H. C.: Rent1, a trans-effector of nonsense-mediated mRNA decay, is essential for mammalian embryonic viability. Hum. Molec. Genet. 10: 99-105, 2001.

Further studies establishing the function and utilities of RENT1 are found in John Hopkins OMIM database record ID 601430, and in references numbered 1323-1328 listed hereinbelow.

Referring now to REPS2 BINDING SITE. RALBP1 associated Eps domain containing 2 (REPS2) is a target gene of GAM26, corresponding to GAM26-TARGET GENE of FIG. 26A. REPS2 BINDING SITE is a binding site found in an untranslated region of REPS2, corresponding to BINDING SITE of FIG. 26A. FIG. 26D illustrates the complementarity of the nucleotide sequence of REPS2 BINDING SITE, designated SEQ ID:339240, to the nucleotide sequence of GAM26 RNA of FIG. 26A, designated SEQ ID:20604.

An additional function of GAM26 is therefore inhibition of RALBP1 associated Eps domain containing 2 (REPS2), a gene which encodes a protein that interacts with the active form of RAS with adaptor protein GRB2 and binds calcium. Accordingly, utilities of GAM26 include diagnosis and treatment of the abovementioned diseases and clinical conditions. The function and utilities of REPS2 have been established by previous studies, as described hereinabove with reference to FIG. 26D.

Referring now to REPS2 BINDING SITE. RALBP1 associated Eps domain containing 2 (REPS2) is a target gene of GAM26, corresponding to GAM26-TARGET GENE of FIG. 26A. REPS2 BINDING SITE is a binding site found in an untranslated region of REPS2, corresponding to BINDING SITE of FIG. 26A. FIG. 26D illustrates the complementarity of the nucleotide sequence of REPS2 BINDING SITE, designated SEQ ID:339246, to the nucleotide sequence of GAM26 RNA of FIG. 26A, designated SEQ ID:20604.

A further function of GAM26 is therefore inhibition of RALBP1 associated Eps domain containing 2 (REPS2), a gene which encodes a protein that interacts with the active form of RAS with adaptor protein GRB2 and binds calcium. Accordingly, utilities of GAM26 include diagnosis and treatment of the abovementioned diseases and clinical conditions. The function and utilities of REPS2 have been established by previous studies, as described hereinabove with reference to FIG. 26D.

Referring now to REPS2 BINDING SITE. RALBP1 associated Eps domain containing 2 (REPS2) is a target gene of GAM26, corresponding to GAM26-TARGET GENE of FIG. 26A. REPS2 BINDING SITE is a binding site found in an untranslated region of REPS2, corresponding to BINDING SITE of FIG. 26A. FIG. 26D illustrates the complementarity of the nucleotide sequence of REPS2 BINDING SITE, designated SEQ ID:339265, to the nucleotide sequence of GAM26 RNA of FIG. 26A, designated SEQ ID:20604.

Yet a further function of GAM26 is therefore inhibition of RALBP1 associated Eps domain containing 2 (REPS2), a gene which encodes a protein that interacts with the active form of RAS with adaptor protein GRB2 and binds calcium. Accordingly, utilities of GAM26 include diagnosis and treatment of the abovementioned diseases and clinical conditions. The function and utilities of REPS2 have been established by previous studies, as described hereinabove with reference to FIG. 26D.

Referring now to REPS2 BINDING SITE. RALBP1 associated Eps domain containing 2 (REPS2) is a target gene of GAM26, corresponding to GAM26-TARGET GENE of FIG. 26A. REPS2 BINDING SITE is a binding site found in an untranslated region of REPS2, corresponding to BINDING SITE of FIG. 26A. FIG. 26D illustrates the complementarity of the nucleotide sequence of REPS2 BINDING SITE, designated SEQ ID:339278, to the nucleotide sequence of GAM26 RNA of FIG. 26A, designated SEQ ID:20604.

Another function of GAM26 is therefore inhibition of RALBP1 associated Eps domain containing 2 (REPS2), a gene which encodes a protein that interacts with the active form of RAS with adaptor protein GRB2 and binds calcium. Accordingly, utilities of GAM26 include diagnosis and treatment of the abovementioned diseases and clinical conditions. The function and utilities of REPS2 have been established by previous studies, as described hereinabove with reference to FIG. 26D.

Referring now to REPS2 BINDING SITE. RALBP1 associated Eps domain containing 2 (REPS2) is a target gene of GAM26, corresponding to GAM26-TARGET GENE of FIG. 26A. REPS2 BINDING SITE is a binding site found in an untranslated region of REPS2, corresponding to BINDING SITE of FIG. 26A. FIG. 26D illustrates the complementarity of the nucleotide sequence of REPS2 BINDING SITE, designated SEQ ID:339279, to the nucleotide sequence of GAM26 RNA of FIG. 26A, designated SEQ ID:20604.

Yet another function of GAM26 is therefore inhibition of RALBP1 associated Eps domain containing 2 (REPS2), a gene which encodes a protein that interacts with the active form of RAS with adaptor protein GRB2 and binds calcium. Accordingly, utilities of GAM26 include diagnosis and treatment of the abovementioned diseases and clinical conditions. The function and utilities of REPS2 have been established by previous studies, as described hereinabove with reference to FIG. 26D.

Reference is now made to REV3L BINDING SITE. REV3 (yeast homolog)-like, catalytic subunit of DNA polymerase zeta (REV3L) is a target gene of GAM26, corresponding to GAM26-TARGET GENE of FIG. 26A. REV3L BINDING SITE is a binding site found in an untranslated region of REV3L, corresponding to BINDING SITE of FIG. 26A. FIG. 26D illustrates the complementarity of the nucleotide sequence of REV3L BINDING SITE, designated SEQ ID:339991, to the nucleotide sequence of GAM26 RNA of FIG. 26A, designated SEQ ID:20604.

An additional function of GAM26 is therefore inhibition of REV3 (yeast homolog)-like, catalytic subunit of DNA polymerase zeta (REV3L), a gene which encodes an enzyme that is a catalytic subunit of DNA polymerase zeta and acts in translation replication and mutagenesis. Accordingly, utilities of GAM26 include diagnosis and treatment of the abovementioned diseases and clinical conditions.

The function of REV3L has been established by previous studies. To get a better understanding of mutagenic mechanisms in humans, Gibbs et al. (1998) cloned and sequenced the human homolog of the *Saccharomyces cerevisiae* REV3 gene. The yeast gene encodes the catalytic subunit DNA polymerase zeta, a nonessential enzyme that is thought to carry out translation replication and is responsible for virtually all DNA damage-induced mutagenisis and the majority of spontaneous mutagenesis. The human gene encodes an expected protein of 3,130 residues, about twice the size of the yeast protein, which has 1,504 amino acids. The 2 proteins are 29% identical in an amino-terminal region of approximately 340 residues, 39% identical in a carboxy-terminal region of approximately 850 residues, and 29% identical in a 55-residue region in the middle of the 2 genes. The sequence of the expected protein strongly predicted that it is the catalytic subunit of DNA polymerase of the polymerase-zeta type; the carboxy-terminal domain possesses, in the right order, the 6 motifs characteristic of eukaryotic DNA polymerases, most closely resembles yeast polymerase-zeta among all polymerases in the GenBank database, and is different from the human alpha (POLA; 312040), delta (POLD1; 174761), and epsilon (POLE; 174762) enzymes. Human cells expressing high levels of an REV3 antisense RNA fragment grow normally, but show little or no UV-induced mutagenesis and re slightly more sensitive to killing by UV. The human gene therefore appears to carry out a function similar to that of its yeast counterpart. Xiao et al. (1998) identified human cDNA clones from 3 different libraries whose deduced amino acid sequences bore remarkable homology to yeast REV3. By in situ hybridization, they mapped the human REV3 gene to 1p33-p32. The gene encodes an mRNA of more than 10 kb. Its expression varies in different tissues and appeared to be elevated in some but not all of the tumor cell lines examined. In a study of genes involved in tumor suppression from 6q21, Morelli et al. (1998) identified the same sequence as that reported by Gibbs et al. (1998). The REV3L gene contains 33 exons (3 noncoding at the 5-prime end) and spans approximately 200 kb of genomic DNA. The chromosome 6 assignment is the more likely (AFS).

Full details of the abovementioned studies are described in the following publications, the disclosure of which are hereby incorporated by reference:

Gibbs, P. E. M.; McGregor, W. G.; Maher, V. M.; Nisson. P.; Lawrence, C. W.: A human homolog of the *Saccharomyces cerevisiae* REV3 gene, which encodes the catalytic subunit of DNA polymerase zeta. Proc. Nat. Acad. Sci. 195: 6876-6880, 1998. PubMed ID: 9618506 3. Xiao, W.; Lechler, T.; Chow, B. L.; Fontanie, T.; Agustus, M.;

Carter, K. C.; Wei, Y. -F.: Identification, chromosomal mapping and tissue-specific expression of hREV3 encoding a putative human DNA polymerase zeta. Carcinogenesis 19: 945-949, 1998.

Further studies establishing the function and utilities of REV3L are found in John Hopkins OMIM database record ID 602776, and in references numbered 1329-1331 listed hereinbelow.

Referring now to RGS19IP1 BINDING SITE. (RGS19IP1) is a target gene of GAM26, corresponding to GAM26-TARGET GENE of FIG. 26A. RGS19IP1 BINDING SITE is a binding site found in an untranslated region of RGS19IP1, corresponding to BINDING SITE of FIG. 26A. FIG. 26D illustrates the complementarity of the nucleotide sequence of RGS19IP1 BINDING SITE, designated SEQ ID:341338, to the nucleotide sequence of GAM26 RNA of FIG. 26A, designated SEQ ID:20604.

A further function of GAM26 is therefore inhibition of (RGS19IP1), a gene which encodes a protein that is involved in g protein-linked signaling. Accordingly, utilities of GAM26 include diagnosis and treatment of the abovementioned diseases and clinical conditions. The function and utilities of RGS19IP1 have been established by previous studies, as described hereinabove with reference to FIG. 26D.

Referring now to RGS19IP1 BINDING SITE. (RGS19IP1) is a target gene of GAM26, corresponding to GAM26-TARGET GENE of FIG. 26A. RGS19IP1 BINDING SITE is a binding site found in an untranslated region of RGS19IP1, corresponding to BINDING SITE of FIG. 26A. FIG. 26D illustrates the complementarity of the nucleotide sequence of RGS19IP1 BINDING SITE, designed SEQ ID:341352, to the nucleotide sequence of GAM26 RNA of FIG. 26A, designated SEQ ID:20604.

Yet a further function of GAM26 is therefore inhibition of (RGS19IP1), a gene which encodes a protein that is involved in g protein-linked signaling. Accordingly, utilities of GAM26 include diagnosis and treatment the abovementioned diseases and clinical conditions. The function and utilities of RGS19IP1 have been established by previous studies, as described hereinabove with reference to FIG. 26D.

Reference is now made to RNF14 BINDING SITE. Ring finger protein 14 (RNF14) is a target gene of GAM26, corresponding to GAM26-TARGET GENE of FIG. 26A. RNF14 BINDING SITE is a binding site found in an untranslated region of RNF14, corresponding to BINDING SITE of FIG. 26A. FIG. 26D illustrates the complementarity of the nucleotide sequence of RNF14 BINDING SITE, designated SEQ ID:342895, to the nucleotide sequence of GAM26 RNA of FIG. 26A, designated SEQ ID:20604.

Another function of GAM26 is therefore inhibition of ring finger protein 14 (RNF14), a gene which encodes a transcription factor that associates with the androgen receptor (AR); functions as a transcriptional coactivator. Accordingly, utilities of GAM26 include diagnosis and treatment of the abovementioned diseases and clinical conditions.

The function of RNF14 has been established by previous studies. The RING finger motif is a unique zinc-chelating domain involved in mediating protein-DNA and protein-protein interactions. Using the sequence of the partial cDNA clone HFB30 isolated by Ueki et al. (1998) to screen a human fetal brain cDNA library, Ueki et al. (1999) cloned the full-length cDNA, which encoded a novel ring finger protein, RNF14. The deduced 474-amino acid protein has a calculated molecular mass of approximately 53 kD. RT-PCR analysis revealed ubiquitous expression of RNF14 in a wide variety of human tissues. Kang et al. (1999) independently cloned RNF14, which they called ARA54 (androgen receptor-associated protein-54), by a yeast 2-hybrid screen of a prostate cDNA library. Northern blot analysis detected a major 3-kb transcript, with highest expression in testis, followed by thymus, spleen, colon, prostate, and uterus. Low expression was detected in small intestine and blood leukocytes. The RNF14 transcript was also strongly detected in 2 other prostate cell lines. A second transcript of 2 kb was detected in testis only. Kang et al. (1999) demonstrated that RNF14 can function as a coactivator for androgen-dependent transcription on both wildtype and mutant androgen receptor (313700). They also showed that in the presence of a certain amount of 17-beta-estradiol or hydroxyflutamide, the transcriptional activity of a specific AR mutant was significantly enhanced, whereas that of wildtype and another AR mutant was not. The authors suggested that both RNF14 and the positions of the AR mutation might contribute to the specificity of AR-mediated transactivation. Ueki et al. (1999) determined that the RNF14 gene contains 9 exons and spans approximately 20 kb of genomic DNA. By somatic cell hybrid and radiation hybrid analyses, Ueki et al. (1999) mapped the RNF14 gene to chromosome 5q23.3-q31.1.

Full details the abovementioned studies are described in the following publications, the disclosure of which are hereby incorporated by reference:

Ueki, N.; Seki, N.; Yano, K.; Masuho, Y.; Saito T.; Muramatsu, M.: Isolation and characterization of a novel human gene (HFB30) which encodes a protein with a RING finger motif. Biochim. Biophys. Acta 232-236, 1999. PubMed ID: 10320776. Kan, H. -Y.; Yeh, S.; Fujimoto, N.; Chang, C.: Cloning and characterization of human prostate coactivator ARA54, a novel protein that associates with the androgen receptor. J. Biol. Chem. 274: 8570-8576, 1999.

Further studies establishing the function and utilities of RNF14 are found in John Hopkins OMIM database record ID 605675, and in references numbered 1332-1334 listed hereinbelow.

Reference is now made to ROCK2 BINDING SITE. Rho-associated, coiled-coil containing protein kinase 2 (ROCK2) is a target gene of GAM26, corresponding to GAM26-TARGET GENE of FIG. 26A. ROCK2 BINDING SITE is a binding site found in an untranslated region of ROCK2, corresponding to BINDING SITE of FIG. 26A. FIG. 26D illustrates the complementarity of the nucleotide sequence of ROCK2 BINDING SITE, designated SEQ ID:344223, to the nucleotide sequence of GAM26 RNA of FIG. 26A, designated SEQ ID:20604.

Yet another function of GAM26 is therefore inhibition of Rho-associated, coiled-coil containing protein kinase 2 (ROCK2), a gene which encodes an enzyme that regulates cytokinesis, smooth muscle contraction, the formation of actin stress fibers and focal adhesions. Accordingly, utilities of GAM26 include diagnosis and treatment of the abovementioned diseases and clinical conditions.

The function of ROCK2 has been established by previous studies. ROCK2 is a serine/threonine kinase that regulates cytokinesis, smooth muscle contraction, the formation of actin stress fibers and focal adhesions, and the activation of the c-fos (164810) serum response element ROCK2, which is an isozyme of ROCK1 (601702), is a target for the small GTPase Rho (e.g., 165390). Nakamura et al. (2001) studied the role of Rho in the migration of corneal epithelial cells in rabbit. They detected both ROCK1 (601702) and ROCK2 in the corneal epithelium at protein and mRNA levels. They found that exoenzyme C3, a Rho inhibitor, inhibits corneal epithelial migration in a dose-dependent manner and prevents the stimulatory effect of the Rho activator lysophosphatidic acid (LPA). Both cytochalasin B, an inhibitor of actin filament assembly, and ML7, an inhibitor of myosin light chain kinase, also prevent LPA stimulation of epithelial migration. The authors suggested that Rho mediates corneal epithelial migration in response to external stimuli by regulating the organization of the actin cytoskeleton. Rao et al. (2001) investigated the role of Rho kinase in the modulation of aqueous humor outflow facility. The treatment of human trabecular meshwork and canal of Schlemm cells with a Rho kinase-specific inhibitor led to significant but reversible changes in cell shape and decreased actin stress fibers, focal adhesions, and protein phosphotyrosine staining. Based on the Rho kinase inhibitor-induced changes in myosin light chain phosphorylation and actomyosin organization, the authors suggested that cellular relaxation and loss of cell-substratum adhesions in the human trabecular meshwork and canal of Schlemm cells could result in either increased paracellular fluid flow across the canal of Schlemm or altered flow pathway through the juxtacanalicular tissue, thereby lowering resistance to outflow. They suggested Rho kinase as a potential target for the development of drugs to modulate intraocular pressure in glaucoma patients.

Full details of the abovementioned studies are described in the following publications, the disclosure of which are hereby incorporated by reference:

Nakamura, M.; Nagano, T.; Chikama, T.; Nishida, T.: Role of the small GTP-binding protein Rho in epithelial cell migration in the rabbit cornea. Invest. Ophthal. Vis. Sci. 42: 941-947, 2001. PubMed ID:11274070. Rao, P. V.; Deng, P. -F.; Kumar, J.; Epstein, D. L.: Modulation of aqueous humor outflow facility by the Rho kinase-specific inhibitor Y-27632. Invest. Ophthal. Vis. Sci. 42: 1029-1037, 2001.

Further studies establishing the function and utilities of ROCK2 are found in John Hopkins OMIM database record ID 604002, and in references numbered 1335-1338 listed hereinbelow.

Referring now to ROCK2 BINDING SITE. Rho-associated, coiled-coil containing protein kinase 2 (ROCK2) is a target gene of GAM26, corresponding to GAM26-TARGET GENE of FIG. 26A. ROCK2 BINDING SITE is a binding site found in an untranslated region of ROCK2, corresponding to BINDING SITE of FIG. 26A. FIG. 26D illustrates the complementarity of the nucleotide sequence of ROCK2 BINDING SITE, designated SEQ ID:344231, to the nucleotide sequence of GAM26 RNA of FIG. 26A, designated SEQ ID:20604.

An additional function of GAM26 is therefore inhibition of Rh-associated, coiled-coil containing protein kinase 2 (ROCK2), a gene which encodes an enzyme that regulates cytokinesis, smooth muscle contraction, the formation of actin stress fibers and focal adhesions. Accordingly, utilities of GAM26 include diagnosis and treatment of the abovementioned diseases and clinical conditions. The function and utilities of ROCK2 have been established by previous studies, as described hereinabove with reference to FIG. 26D.

Reference is now made to RORA BINDING SITE. RAR-related orphan receptor A (RORA) is a target gene of GAM26, corresponding to GAM26-TARGET GENE of FIG. 26A. RORA BINDING SITE is a binding site found in an untranslated region of RORA, corresponding to BINDING SITE of FIG. 26A. FIG. 26D illustrates the complementarity of the nucleotide sequence of RORA BINDING SITE, designated SEQ ID:344515, to the nucleotide sequence of GAM26 RNA of FIG. 26A, designated SEQ ID:20604.

A further function of GAM26 is therefore inhibition of RAR-related orphan receptor A (RORA), a gene which encodes a receptor that binds DNA as a monomer to hormone response elements (hre) containing a single core motif half-site preceded by a short a-t rich sequences. Accordingly, utilities of GAM26 include diagnosis and treatment of the abovementioned diseases and clinical conditions.

The function of RORA has been established by previous studies. Meyer et al. (2000) showed that the RORA gene and the RORC (602943) gene, but not the RORB gene, are expressed in mesenchymal stem cells derived from bone marrow. Cells undergoing osteogenic differentiation showed increased messenger signal expression. They found that homozygous 'staggerer' mutants have thin long bones compared with heterozygous animals and wildtype littermates and that the bones of sg/sg animals are osteopenic. They concluded that the product of the Rora gene most likely acts by direct modulation of a bone matrix component Animal model experiments lend further support to the function of RORA. The recessive mouse mutation 'staggerer' (sg) is associated with severe cerebellar ataxia due to a cell-autonomous defect in the development of Purkinje cells. These cells are reduced in numbers and show immature morphology, synaptic arrangement, biochemical properties, and gene expression. In addition, sg heterozygotes show accelerated dendritic atrophy and cell loss, suggesting that sg has a role in mature Purkinje cells. Certain functions of the immune system are also affected. Hamilton et al. (1996) mapped sg to a 160-kb interval on mouse chromosome 9 that was found to contain the gene encoding Rora, a member of the nuclear hormone receptor superfamily. Furthermore, sg mice were found to carry a deletion within the Rora gene that prevents translation of the ligand-binding homology domain. Based on these results, they proposed a model in which Rora interacts with the thyroid hormone signaling pathway to induce Purkinje cell maturation. Of the 4 different isoforms of the Rora gene that are generated by a combination of alternative promoter usage and exon splicing and that differ in their DNA-binding properties, Matysiak-Scholze and Nehls (1997) found that isoforms Rora1 and Rora4 are specifically coexpressed in the murine cerebellum and human cerebellum. Thus, at least isoforms of the murine Rora gene are affected by the genomic deletion associated with the sg phenotype. The finding of cerebellum-specific coregulation of Rora1 and Rora4 suggested that distinct sets of target genes regulated by the Rora1 and Rora4 isoforms are required for Purkinje cell development It is appreciated that the abovementioned animal model for RORA is acknowledged by those skilled in the art as a scientifically valid animal model, as can be further appreciated from the publications sited hereinbelow.

Full detail of the abovementioned studies are described in the following publications, the disclosure of which are hereby incorporated by reference:

Meyer, T.; Kneissel, M.; Mariani, J.; Fournier, B.: In vitro and in vivo evidence for orphan nuclear receptor ROR-alpha function in bone metabolism. Proc. Nat. Acad. Sci. 97: 9197-9202, 2000. PubMed ID: 10900268 Matysiak-Scholze, U.; Nehls, M.: The structural integrity of ROR-alpha isoforms is mutated in staggerer mice: cerebellar coexpression of ROR-alpha-1 and ROR-alpha-4. Genomics 43: 78-84, 1997.

Further studies establishing the function and utilities of RORA are found in John Hopkins OMIM record ID 600825, and in references numbered 1339-1348 listed hereinbelow.

Reference is now made to RPS6KA1 BINDING SITE. Ribosomal protein S6 kinase, 90 kD, polypeptide 1 (RPS6KA1) is a target gene of GAM26, corresponding to GAM26-TARGET GENE of FIG. 26A. RPS6KA1 BINDING SITE is a binding site found in an untranslated region of RPS6KA1, corresponding to BINDING SITE of FIG. 26A. FIG. 26D illustrates the complementarity of the nucleotide sequence of RPS6KA1 BINDING SITE, designated SEQ ID:346249, to the nucleotide sequence of GAM26 RNA of FIG. 26A, designated SEQ ID:20604.

Yet a further function of GAM26 is therefore inhibition of ribosomal protein S6 kinase, 90 kD, polypeptide 1 (RPS6KA1), a gene which encodes an enzyme that is an effector of the phosphatidylinositide-3-OH kinase signaling pathway and is associated with type II diabetes mellitus. Accordingly, utilities of GAM26 include diagnosis and treatment of the abovementioned diseases and clinical conditions.

The function of RPS6KA1 has been established by previous studies. Moller et al. (1994) described the cloning and characterization of 3 genes encoding 3 isoforms of ribosomal protein S6 kinase (RSK), which they called HU1 (RPS6KA1), HU2 (RPS6KA2; 601685), and HU3 (RPS6KA3; 300075). The HU1 cDNA (GenBank L07597) encodes a predicted 735-amino acid protein containing 2 distinct consensus ATP-binding site sequences. Northern blot and RNase protection analyses detected an approximately 3.5-kb HU1 transcript in lymphocytes, skeletal muscle, liver, and adipose tissue.

Animal model experiments lend further support to the function of RPS6KA1. Shima et al. (1998) generated mice deficient in S6 kinase-1 by targeted disruption. These mice are viable and fertile, but exhibit a conspicuous reduction in body size during embryogenesis, an effect that was mostly overcome by adulthood. Shima et al. (1998) hypothesized that the weak penetrance of the phenotype may arise from increased expression in S6k1-deficient mice of the highly homologous gene S6K2 (601685). Pende et al. (2000) showed that mice deficient for S6 kinase-1, a known effector of the phosphatidylinositide-3-OH kinase signaling pathway, are hypoinsulinemic and glucose intolerant. Whereas insulin resistance was not observed in isolated muscle, such mice exhibit a sharp reduction in glucose-induced insulin secretion and in pancreatic insulin content. This is not due a lesion in glucose sensing or insulin production, but to a reduction in pancreatic endocrine mass, which is accounted for by a selective decrease in beta-cell size. Pende et al. (2000) concluded that the observed phenotype closely parallels those of preclinical type II diabetes mellitus, in which malnutrition-induced hypoinsulinemia prediposes individuals to glucose intolerance.

It is appreciated that the abovementioned animal model for RPS6KA1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Moller, D. E.; Xia, C. H.; Tang, W.; Zhu, A. X.; Jakubowski, M.: Human rsk isoforms: cloning and characterization of tissue-specific expression. Am. J. Physiol. 266: C351-C359, 1994.

Further studies establishing the function and utilities of RPS6KA1 are found in John Hopkins OMIM database record ID 601684, and references numbered 1349-1355 listed hereinbelow.

Reference is now made to RRAS BINDING SITE. Related RAS viral (r-ras) oncogene homolog (RRAS) is a target gene of GAM26, corresponding to GAM26-TARGET GENE of FIG. 26A. RRAS BINDING SITE is a binding site found in an untranslated region of RRAS, corresponding to BINDING SITE of FIG. 26A. FIG. 26D illustrates the complementarity of the nucleotide sequence of RRAS BINDING SITE, designated SEQ ID:346568, to the nucleotide sequence of GAM26 RNA of FIG. 26A, designated SEQ ID:20604.

Another function of GAM26 is therefore inhibition of related RAS viral (r-ras) oncogene homolog (RRAS), a gene which encodes an enzyme that is a member of the ras family of GTP binding proteins. Accordingly, utilities of GAM26 include diagnosis and treatment of the abovementioned diseases and clinical conditions.

The function of RRAS has been established by previous studies. Lowe et al. (1987) isolated the human RRAS gene by low-stringency hybridization with a Harvey-ras probe. They found that the predicted 218-amino acid RRAS protein has an amino-terminal extension of 26 residues compared with HRAS p21 (190020) and shares 55% sequence identity with it. The cloned mouse Rras cDNA encode a predicted protein sharing 94.5% sequence identity with the human protein. Lowe et al. (1987) determined that the RRAS gene has at least 6 exons.

Full details of the abovementioned studies are described in the following publications, the disclosure of which are hereby incorporated by reference:

Lowe, D. G.; Capon, D. J.; Delwart, E.; Sakaguchi, A. Y.; Naylor, S. L.; Goeddel, D. V.: Structure of the human and murine R-ras genes, novel genes closely related to ras proto-oncogenes. Cell 48: 137-146, 1987.

Further studies establishing the function and utilities of RRAS are found in John Hopkins OMIM database record ID 165090, and in references numbered 1356 listed hereinbelow.

Reference is now made to RRAS2 BINDING SITE. RELATED RAS VIRAL ONCOGENE HOMOLOG 2 (RRAS2) is a target gene of GAM26, corresponding to GAM26-TARGET GENE of FIG. 26A. RRAS2 BINDING SITE is a binding site found in an untranslated region of RRAS2, corresponding to BINDING SITE of FIG. 26A. FIG. 26D illustrates the complementarity of the nucleotide sequence of RRAS2 BINDING SITE, designated SEQ ID:346598, to the nucleotide sequence of GAM26 RNA of FIG. 26A, designated SEQ ID:20604.

Yet another function of GAM26 is therefore inhibition of RELATED RAS VIRAL ONCOGENE HOMOLOG 2 (RRAS2), a gene which encodes an enzyme that is a member the ras family of GTP binding proteins and is associated with OVARIAN CARCINOMA. Accordingly, utilities of GAM26 include diagnosis and treatment of the abovementioned diseases and clinical conditions.

The function of RRAS2 has been established by previous studies. The TC21 oncogene, a member of the RAS superfamily, was initially cloned from a human teratocarcinoma cDNA library by PCR methods using degenerate oligonucleotides corresponding to the conserved region of the RAS genes (Drivas et al., 1990). Chan et al. (1994) found the same oncogene when they generated an expression cDNA library from an ovarian carcinoma line. They found, furthermore, that a single point mutation substituting glutamine for leucine at position 72 was responsible for activation of transforming properties. While the cDNA clone possessed high transforming activity, the ovarian tumor genomic DNA, which contained the mutated TC21 allele, failed to induce transformed foci. Thus, expression cDNA cloning made it possible identify and isolate a human oncogene that had evaded detection by conventional approaches. The International Radiation Hybrid Mapping Consortium mapped the RRAS2 gene to chromosome 11pter-p15.5 (RH40056).

Full details of the abovementioned studies are described in the following publications, the disclosure of which are hereby incorporated by reference:

Chan, A. M. -L.; Miki, T.; Meyers, K. A.; Aaronson, S. A.: A human oncogene of the RAS superfamily unmasked by expression cDNA cloning. Proc. Nat. Acad. Sci. 91: 7558-7562, 1994.

Further studies establishing the function and utilities of RRAS2 are found in John Hopkins OMIM database record ID 600098, and in references numbered 1357-1358 listed hereinbelow.

Reference is now made to RTN4 BINDING SITE. Reticulon 4 (RTN4) is a target gene of GAM26, corresponding to GAM26-TARGET GENE of FIG. 26A. RTN4 BINDING SITE is a binding site found in an untranslated region of RTN4, corresponding to BINDING SITE of FIG. 26A. FIG. 26D illustrates the complementarity of the nucleotide sequence of RTN4 BINDING SITE, designated SEQ ID:347317, to the nucleotide sequence of GAM26 RNA of FIG. 26A, designated SEQ ID:20604.

An additional function of GAM26 is therefore inhibition of reticulon 4 (RTN4), a gene which encodes a protein that plays a central role in limiting axonal regeneration after central nervous system injury. Accordingly, utilities of GAM26 include diagnosis and treatment of the abovementioned diseases and clinical conditions.

The function of RTN4 has been established by previous studies. NOGO has been identified as a component of the central nervous system myelin that prevents axonal regeneration in the adult vertebrate central nervous system. Analysis of NOGOA has shown that an axon-inhibiting domain of 66 amino acids is expressed at the extracellular surface and at the endoplasmic reticulum lumen of transfected cells and oligodendrocytes. The acidic amino terminus of NOGOA is detected at the cytosolic face of cellular membranes and may contribute to inhibition of axon regeneration at sites of oligodendrocyte injury. Fournier et al. (2001) showed that the extracellular domain of NOGO (NOGO-66) inhibits axonal extension but does not alter nonneuronal cell morphology. In contrast, a multivalent form of the N terminus NOGOA affects the morphology of both neurons and other cell types. Fournier et al. (2001) identified a brain-specific, leucine-rich-repeat protein with high affinity for soluble NOGO-66. Cleavage of the NOGO-66 receptor (605566) and other glycosylphosphatidylinositol-linked proteins from axonal surfaces renders neurons insensitive to NOGO-66. NOGO-66 receptor expression is sufficient to impart NOGO-66 axonal inhibition to unresponsive neurons. Disruption of the interaction between NOGO-66 and its receptor provides the potential for enhanced recovery after human central nervous system injury. GrandPre et al. (2002) identified competitive antagonists of the NOGO receptor derived from amino-terminal peptide fragments of NOGO-66. The NOGO-66(1-40) antagonist peptide blocks NOGO-66 or central nervous system myelin inhibition of axonal outgrowth in vitro, demonstrating that the NOGO receptor mediates a significant portion of axonal outgrowth inhibition by myelin. Intrathecal administration of the amino-terminal antagonist peptide to rats with midthoracic spinal cord hemisection resulted in significant axon outgrowth of the corticospinal tract, a improved functional recovery. Thus, GrandPre et al. (2002) concluded that NOGO-66 and the NOGO receptor have central roles in limiting axonal regeneration after central nervous system injury. Axonal regeneration in the adult central nervous system (CNS) is limited by 2 proteins in myelin, NOGO and myelin-associated glycoprotein (MAG; 159640). The receptor for Nogo (NgR) had been identified as an axonal glycosylphosphatidylinositol (GPI)-anchored protein, whereas the MAG receptor had remained elusive. Liu et al (2002) demonstrated that MAG binds directly, with high affinity, to NgR Cleavage of GPI-linked proteins from axons protects growth cones from MAG-induced collapse, and dominant-negative NgR eliminate MAG inhibition of neurite outgrowth. MAG resistant embryonic neurons were rendered MAG-sensitive by expression of NgR. MAG and NOGO-66 activate NgR independently and serve as redundant NgR ligands that may limit axonal regeneration after CNS injury.

Full details of the abovementioned studies are described in the following publications, the disclosure of which are hereby incorporated by reference:

Fournier, A. E.; GrandPre, T.; Strittmatter, S. M.: Identification of a receptor mediating Nogo-66 inhibition of axonal regeneration. Nature 409: 341-346, 2001. PubMed ID: 11201742 3. GrandPre, T.; Li, S.; Strittmatter, S. M.: Nogo-66 receptor antagonist peptide promotes axonal regeneration. Nature 417: 547-551, 2002.

Further studies establishing the function and utilities RTN4 are found in John Hopkins OMIM database record ID 604475, and in reference numbered 1359-1367 listed hereinbelow.

Referring now to RTN4 BINDING SITE. Reticulon 4 (RTN4) is a target gene of GAM26, corresponding to GAM26-TARGET GENE of FIG. 26A. RTN4 BINDING SITE is a binding site found in an untranslated region of RTN4, corresponding to BINDING SITE of FIG. 26A. FIG. 26D illustrates the complementarity of the nucleotide sequence of RTN4 BINDING SITE, designated SEQ ID:347318, to the nucleotide sequence of GAM26 RNA of FIG. 26A, designated SEQ ID:20604.

A further function of GAM26 is therefore inhibition of reticulon 4 (RTN4), a gene which encodes a protein that plays a central role in limiting axonal regeneration after central nervous system injury. Accordingly, utilities of GAM26 include diagnosis and treatment the abovementioned diseases and clinical conditions. The function and utilities of RTN4 have been established by previous studies, as described hereinabove with reference to FIG. 26D.

Reference is now made to SAS BINDING SITE. Sarcoma amplified sequence (SAS) is a target gene of GAM26, corresponding to GAM26-TARGET GENE of FIG. 26A. SAS BINDING SITE is a binding site found in an untranslated region of SAS, corresponding to BINDING SITE of FIG. 26A. FIG. 26D illustrates the complementarity of the nucleotide sequence of SAS BINDING SITE, designated SEQ ID:349188, to the nucleotide sequence of GAM26 RNA of FIG. 26A, designated SEQ ID:20604.

Yet a further function of GAM26 is therefore inhibition of sarcoma amplified sequence (SAS), a gene which encodes a protein that is a member of the transmembrane 4 superfamily (TM4SF) and may be involved in growth-related cellular processes T. Accordingly, utilities of GAM26 include diagnosis treatment of the abovementioned disease and clinical conditions.

The function of SAS has been established by previous studies. SAS is a member of the transmembrane 4 superfamily, all members of which have 4 hydrophobic domains. This family includes various tumor-associated antigens such as CO-029 (600769), L6 (M3S1; 191155), and ME491 (CD63; 155740), hematopoietic cell antigens such as CD9 (143030), CD53 (151525), CD37 (151523), and TAPA1 (186845), as well as the parasitic trematode surface proteins Sm23 and Sj23. Meltzer et al. (1991) identified and partially cloned a gene that is amplified in human malignant fibrous histiocytoma. They demonstrated that the gene, designated sarcoma amplified sequence, is located on chromosome 12 by hybridization to a rodent/human somatic cell hybrid mapping panel. They further regionalized the assignment to 12q13-q14 by fluorescence in situ hybridization. This chromosomal region is commonly involved in rearrangements in myxoid liposarcoma, benign lipoma, and uterine leiomyoma. Meltzer et al. (1991) identified SAS amplification in 5 of 29 malignant fibrous histiocytoma biopsies, 4 of 12 liposarcoma biopsies, and 1 osteogenic sarcoma cell line. Since amplification of cellular oncogenes occurs frequently in human cancers, identification of amplified genes in tumor cells is a useful approach for understanding genetic alterations. Jankowski et al. (1995) characterized the genomic structure of SAS and showed that it has 6 exons spanning approximately 3.2 kb.

Full details of the abovementioned studies are described in the following publications, the disclosure of which are hereby incorporated by reference:

Jankowski, S. A.; De Jong, P.; Meltzer, P. S.: Genomic structure of SAS, a member of the transmembrane 4 superfamily amplified in human sarcomas. Genomics 25: 501-506, 1995. PubMed ID: 7789984 2. Meltzer, P. S.; Jankowski, S. A.; Dal Cin, P.; Sandberg, A. A.; Paz, I. B.; Coccia, M. A.; Smith, S. H.: Identification and cloning of a novel amplified DNA sequence in human malignant fibrous histiocytoma derived from a region of chromosome 12 frequently rearranged in soft tissue tumors. (Abstract) Cytogenet. Cell Genet. 58: 1979 only, 1991.

Further studies establishing the function and utilities of SAS are found in John Hopkins OMIM database record ID 181035, and in reference numbered 1368-1369 listed hereinbelow.

Referring now to SERPINB8 BINDING SITE. Serine (or cysteine) proteinase inhibitor, clade B (ovalbumin), member (SERPINB8) is a target gene of GAM26, corresponding to GAM26-TARGET GENE of FIG. 26A. SERPINB8 BINDING SITE is a binding site found in an untranslated region of SERPINB8, corresponding to BINDING SITE of FIG. 26A, FIG. 26D illustrates the complementarity of the nucleotide sequence of SERPINB8 BINDING SITE, designated SEQ ID:353985, to the nucleotide sequence of GAM26 RNA of FIG. 26A, designated SEQ ID:20604.

Another function of GAM26 is therefore inhibition of serine (or cysteine) proteinase inhibitor, clade B (ovalbumin), member (SERPINB8), a gene which encodes a protein that protease inhibitors; may be a serpin serine protease inhibitor that binds thrombin. Accordingly, utilities of GAM26 include diagnosis and treatment of the abovementioned diseases and clinical conditions. The function and utilities of SERPINB8 have been established by previous studies, as described hereinabove with reference to FIG. 26D.

Referring now to REPS2 BINDING SITE. RALBP1 associated Eps domain containing 2 (REPS2) is a target gene of GAM26, corresponding to GAM26-TARGET GENE of FIG. 26A. REPS2 BINDING SITE is a binding site found in an untranslated region of REPS2, corresponding to BINDING SITE of FIG. 26A. FIG. 26D illustrates the complementarity of the nucleotide sequence of REPS2 BINDING SITE, designated SEQ ID:353987, to the nucleotide sequence of GAM26 RNA of FIG. 26A, designated SEQ ID:20604.

Yet another function of GAM26 is therefore inhibition of RALBP1 associated Eps domain containing 2 (REPS2), a gene which encodes a protein that interacts with the active form of RAS with adaptor protein GRB2 and binds calcium. Accordingly, utilities of GAM26 include diagnosis and treatment of the abovementioned diseases and clinical conditions. The function and utilities of REPS2 have been established by previous studies, as described hereinabove with reference to FIG. 26D.

Referring now to SERPINB8 BINDING SITE. Serine (or cysteine) proteinase inhibitor, clade B (ovalbumin), member (SERPINB8) is a target gene of GAM26, corresponding to GAM26-TARGET GENE of FIG. 26A. SERPINB8 BINDING SITE is a binding site found in an untranslated region of SERPINB8, corresponding to BINDING SITE of FIG. 26A. FIG. 26D illustrates the complementarity of the nucleotide sequence of SERPINB8 BINDING SITE, designated SEQ ID:353987, to the nucleotide sequence of GAM26 RNA of FIG. 26A, designated SEQ ID:20604.

An additional function of GAM26 is therefore inhibition of serine (or cysteine) proteinase inhibitor, clade B (ovalbumin), member (SERPINB8), a gene which encodes a protein that protease inhibitors; may be a serpin serine protease inhibitor that binds thrombin. Accordingly, utilities of GAM26 include diagnosis and treatment of the abovementioned diseases and clinical conditions. The function and utilities of SERPINB8 have been established by previous studies, as described hereinabove with reference to FIG. 26D.

Referring now to GABRB3 BINDING SITE. Gamma-aminobutyric acid (GABA) A receptor, beta 3 (GABRB3) is a target gene of GAM26, corresponding to GAM26-TARGET GENE of FIG. 26A. GABRB3 BINDING SITE is a binding site found in an untranslated region of GABRB3, corresponding to BINDING SITE of FIG. 26A. FIG. 26D illustrates the complementarity of the nucleotide sequence of GABRB3 BINDING SITE, designated SEQ ID:353989, to the nucleotide sequence of GAM26 RNA of FIG. 26A, designated SEQ ID:20604.

A further function of GAM26 is therefore inhibition of gamma-aminobutyric acid (GABA) A receptor, beta 3 (GABRB3), a gene which encodes a receptor that mediates neuronal inhibition by binding to the gaba/benzodiazepine receptor and opening an integral chloride channel, and is associated with Angelman syndrome and Prader-Willi syndrome. Accordingly, utilities of GAM26 include diagnosis and treatment of the abovementioned diseases and clinical conditions. The function and utilities of GABRB3 have been established by previous studies, as described hereinabove with reference to FIG. 26D.

Referring now to SERPINB8 BINDING SITE. Serine (or cysteine) proteinase inhibitor, clade B (ovalbumin), member (SERPINB8) is a target gene of GAM26, corresponding to GAM26-TARGET GENE of FIG. 26A. SERPINB8 BINDING SITE is a binding site found in an untranslated region of SERPINB8, corresponding to BINDING SITE of FIG. 26A. FIG. 26D illustrates the complementarity of the nucleotide sequence of SERPINB8 BINDING SITE, designated SEQ ID:353989, to the nucleotide sequence of GAM26 RNA of FIG. 26A, designated SEQ ID:20604.

Yet a further function of GAM26 is therefore inhibition of serine (or cysteine) proteinase inhibitor, clade B (ovalbumin), member (SERPINB8), a gene which encodes a protein that protease inhibitors; may be a serpin serine protease inhibitor that binds thrombin. Accordingly, utilities of GAM26 include diagnosis and treatment of the abovementioned diseases and clinical conditions. The function and utilities of SERPINB8 have been established by previous studies, as described hereinabove with reference to FIG. 26D.

Reference is now made to SFRP5 BINDING SITE. Secreted frizzled-related protein 5 (SFRP5) is a target gene of GAM26, corresponding to GAM26-TARGET GENE of FIG. 26A. SFRP5 BINDING SITE is a binding site found in an untranslated region of SFRP5, corresponding to BINDING SITE of FIG. 26A. FIG. 26D illustrates the complementarity of the nucleotide sequence of SFRP5 BINDING SITE, designated SEQ ID:355430, to the nucleotide sequence of GAM26 RNA of FIG. 26A, designated SEQ ID:20604.

Another function of GAM26 is therefore inhibition of secreted frizzled-related protein 5 (SFRP5), a gene which encodes a protein that receptor for wnt proteins that may modulate Wnt protein function and retinal cell polarization. Accordingly, utilities of GAM26 include diagnosis and treatment of the abovementioned diseases and clinical conditions.

The function of SFRP5 has been established by previous studies. Members of the 'frizzled' (FZ) transmembrane protein family (see 600667) are receptors for Wnt family members, cysteine-rich glycosylated ligands implicated in a variety of cellular processes, including control of cell polarity in a number of systems, including the *Drosophila* retina. See 16975. The secreted frizzled-related proteins (SFRPs) appear to act as soluble modulators of Wnt signaling by competing with membrane-bound frizzled receptors for the binding of secreted Wnt ligands. Chang et al. (1999) isolated bovine cDNAs encoding SFRP5, an SFRP highly expressed in the retinal pigment epithelium (RPE). By screening human genomic and RPE/retina libraries, they identified human SFRP5 genomic and cDNA clones. The SFRP5 gene contains 3 coding exons. The predicted 317-amino acid human protein shares 98% and 95% sequence identity with bovine and mouse Sfrp5, respectively. Like other SFRPs, SFRP5 contains an N-terminal signal peptide followed by a region homologous to the frizzled cysteine-rich domain (CRD). In an assay based on Wnt8 (see 601396)-induced axis duplication in *Xenopus* embryos, SFRP5 inhibited Wnt signaling. Chang et al. (1999) reported that although human SFRP5 is expressed in the RPE, SFRP2 (604157) is highly and preferentially expressed in bovine retina throughout the inner nuclear layer. Thus, photoreceptors appear to be bathed by complementary gradients of SFRP signaling molecules/modulators. The authors speculated that these putative inverse gradients of SFRP2 and SFRP5 might be involved in determining the polarity of photoreceptors and perhaps other cells in the retina.

Full details of the abovementioned studies are described in the following publications, the disclosure of which are hereby incorporated by reference:

Chang, J. T.; Esumi, N.; Moore, K.; Li, Y.; Zhang, S.; Chew, C.; Goodman, B.; Rattner, A.; Moody, S.; Stetten, G.; Campochiaro, P. A.; Zack, D. J.: Cloning and characterization of a secreted fizzled-related protein that is expressed by the retinal pigment epithelium. Hum. Molec. Genet. 8: 575-583, 1999.

Further studies establishing the function and utilities of SFRP5 are found in John Hopkins OMIM database record ID 604158, and in references numbered 1370-1371 listed hereinbelow.

Reference is now made to SGCB BINDING SITE. sarcoglycan, beta (43 kD dystrophin-associated glycoprotein) (SGCB) is a target gene of GAM26, corresponding to GAM26-TARGET GENE of FIG. 26A. SGCB BINDING SITE is a binding site found in an untranslated region of SGCB, corresponding to BINDING SITE of FIG. 26A. FIG. 26D illustrates the complementarity of the nucleotide sequence of SGCB BINDING SITE, designated SEQ ID:356034, to the nucleotide sequence of GAM26 RNA of FIG. 26A, designated SEQ ID:20604.

Yet another function of GAM26 is therefore inhibition of sarcoglycan, beta (43 kD dystrophin-associated glycoprotein) (SGCB), a gene which encodes a protein that is associated with limb-girdle muscular dystrophy type 2e. Accordingly, utilities of GAM26 include diagnosis and treatment of the abovementioned diseases and clinical conditions.

The function of SGCB has been established by previous studies. The dystrophin-glycoprotein complex (DGC) is a large oligomeric complex of sarcolemmal proteins and glycoproteins that acts as a structural link between the cytoskeleton of muscle and the extracellular matrix, and is believed to confer stability to the sarcolemma and protect muscle cells from contraction-induced damage. Lim et al. (1995) cloned and characterized human beta-sarcoglycan, a 43-kD component of the dystrophin-glycoprotein complex, and demonstrated its involvement in a form of muscular dystrophy, designated LGMD2E (604286). They showed that beta-sarcoglycan colocalizes with the DGC at the sarcolemma and is expressed ubiquitously, although predominantly in muscle. By PCR analysis of DNA from a panel of human/rodent somatic cell hybrids, they assigned the gene to chromosome 4 and then further narrowed the localization by study of DNA from somatic cell hybrids containing various fragments of chromosome 4. This involved assignment to the region 4p14-q21.2, which overlaps the centromere. By fluorescence in situ hybridization, they further narrowed the assignment to 4q12. Using pericentromeric markers and an intragenic polymorphic CA repeat, they demonstrated perfect cosegregation with autosomal recessive limb-girdle muscular dystrophy in Amish families from southern Indiana. A thr151-to-arg missense mutation (600900.0001) was identified in the beta-sarcoglycan gene that led to a dramatically reduced expression of beta-sarcoglycan in the sarcolemma and a concomitant loss of adhalin (600119) and 35-DAG (SGCD; 601411), which was interpreted as representing a disruption of a functional subcomplex within the dystrophin-glycoprotein complex. Durbeej et al. (2000) engineered Sgcb-null mice to analyze the biologic role of beta-sarcoglycan in the pathogenesis of LGMD2E. These mice developed severe muscular dystrophy and cardiomyopathy with focal areas of necrosis. The sarcoglycan-sarcospan and dystroglycan complexes were disrupted in skeletal, cardiac, and smooth muscle membranes. Epsilon-sarcoglycan (SGCE; 604149) was also reduced in membrane preparations of striated and smooth muscle. Loss of the sarcoglycan-sarcospan complex in vascular smooth muscle resulted in vascular irregularities in heart, diaphragm, and kidneys. Further biochemical characterization suggested the presence of a distinct epsilon-sarcoglycan complex in skeletal muscle that was disrupted in Sgcb-null mice. Thus, the authors concluded that perturbation of vascular function together with disruption of the epsilon-sarcoglycan-containing complex contribute to the pathogenesis of LGMD2E.

Full details of the abovementioned studies are described in the following publications, the disclosure of which are hereby incorporated by reference:

Lim, L. E.; Duclos, F.; Broux, O.; Bourg, N.; Sunada, Y.; Allamand, V.; Meyer, J.; Richard, I.; Moomaw, C.; Slaughter, C.; Tome, F. M. S.; Fardeau, M.; Jackson, C. E.; Beckmann, J. S.; Campbell, K. P.: Beta-sarcoglycan: characterization and role in limb-girdle muscular dystrophy linked to 4q12. Nature Genet 11: 257-265, 1995. PubMed ID: 7581448 Durbeej, M.; Cohn, R. D.; Hrstka, R. F.; Moore, S. A.; Allamand, V.; Davidson, B. L.; Williamson, R. A.; Campbell, K. P.: Disruption of the beta-sarcoglycan gene reveals pathogenetic complexity of limb-girdle muscular dystrophy type 2E. Molec. Cell 5: 141-151, 2000.

Further studies establishing the function and utilities of SGCB are found in John Hopkins OMIM database record ID 600900, and in reference numbered 1372-1378 listed hereinbelow.

Reference is now made to SLC1A1 BINDING SITE. solute carrier family 1 (neuronal/epithelial high affinity glutamate t (SLC1A1) is a target gene of GAM26, corresponding to GAM26-TARGET GENE of FIG. 26A. SLC1A1 BINDING SITE is a binding site found in an untranslated region of SLC1A1, corresponding to BINDING SITE of FIG. 26A. FIG. 26D illustrates the complementarity of the nucleotide sequence of SLC1A1 BINDING SITE, designated SEQ ID:362965, to the nucleotide sequence of GAM26 RNA of FIG. 26A, designated SEQ ID:20604.

An additional function of GAM26 is therefore inhibition of solute carrier family 1 (neuronal/epithelial high affinity glutamate t (SLC1A1), a gene which encodes a protein that is a glutamate transporter, essential for terminating the postsynaptic action of glutamate by rapidly removing it from the synaptic cleft and is associated with amyotrophic lateral sclerosis; dicarboxylicaminoaciduria; familial ALS; neurodegenerative disorders. Accordingly, utilities of GAM26 include diagnosis and treatment of the abovementioned diseases and clinical conditions.

The function of SLC1A1 has been established by previous studies. High-affinity glutamate transporters play an essential role in transporting glutamate across plasma membranes. In brain, these transporters are crucial in terminating the action of the excitatory neurotransmitter glutamate and in maintaining extracellular glutamate concentrations below neurotoxic levels. Functional defects of high-affinity glutamate transporters have been suggested to be involved in the pathophysiology of amyotrophic lateral sclerosis (105400). In small intestine and kidney, in which the high-affinity glutamate transporter mediates net absorption of glutamate and aspartate across epithelial cells, an inborn error of glutamate transport is thought to cause dicarboxylicaminoaciduria (222730). Kanai and Hediger (1992) isolated a cDNA encoding a high-affinity glutamate transporter, designated EAAC1, that also transports aspartate but not other amino acids. EAAC1 was found to be uniquely expressed throughout the body, particularly in brain (neurons), intestine, and kidney. By Southern analysis of a panel of human/rodent somatic cell hybrids and by fluorescence in situ hybridization (FISH), Smith et al. (1994) mapped the EAAC1 gene to 9p24. They suggested that mutations in this gene may be responsible for dicarboxylicaminoaciduria or for a form of familial ALS separate from the form due to mutation in the SOD1 gene (147450) on chromosome 21.

Lin et al. (2001) used a yeast 2-hybrid assay to identify a protein that interacts with EAAC1. This protein, termed GTRAP3-18 (605709), is expressed in numerous tissues, localizes the cell membrane and cytoplasm, and specifically interacts with the carboxy-terminal intracellular domain of EAAC1. Increasing the expression of GTRAP3-18 in cells reduces EAAC1-mediated glutamate transport by lowering substrate affinity. The expression of GTRAP3-18 can be upregulated by retinoic acid, which results in a specific reduction of EAAC1-mediated glutamate transport. Lin et al. (2001) concluded that glutamate transport proteins can be regulated potently and that GTRAP can modulate the transport functions ascribed to EAAC1. GTRAP3-18 may be important in regulating the metabolic functions of EAAC1.

Full detail of the abovementioned studies are described in the following publications, the disclosure of which are hereby incorporated by reference:

Kanai, Y. Hediger, M. A.: Primary structure and functional characterization of a high-affinity glutamate transporter. Nature 360: 467-471, 1992. PubMed ID: 1280334 3. Smith, C. P.; Weremowicz, S.; Kanai, Y.; Stelzner, M.; Morton, C. C.; Hediger, M. A.: Assignment of the gene coding for the human high-affinity glutamate transporter EAAC1 to 9p24: potential role in dicarboxylic aminoaciduria and neurodegenerative disorders. Genomics 20: 335-336, 1994. PubMed ID: 8020993 2. Lin, C. G.; Orlov, I.; Ruggiero, A. M.; Dykes-Hoberg, M.; Lee, A.; Jackson, M.; Rothstein, J. D.: Modulation of the neuronal glutamate transporter EAAC1 by the interacting protein GTRAP3-18. Nature 410: 84-88, 2001.

Further studies establishing the function and utilities of SLC1A1 are found in John Hopkins OMIM database record ID 133550, and in references numbered 1379-1381 listed hereinbelow.

Referring now to SLC1A1 BINDING SITE. Solute carrier family 1 (neuronal/epithelial high affinity glutamate t (SLC1A1) is a tar et gene of GAM26, corresponding to GAM26-TARGET GENE of FIG. 26A. SLC1A1 BINDING SITE is a binding site found in an untranslated region of SLC1A1, corresponding to BINDING SITE of FIG. 26A. FIG. 26D illustrates the complementarity of the nucleotide sequence of SLC1A1 BINDING SITE, designated SEQ ID:362996, to the nucleotide sequence of GAM26 RNA of FIG. 26A, designated SEQ ID:20604.

A further function of GAM26 is therefore inhibition of solute carrier family 1 (neuronal/epithelial high affinity glutamate t (SLC1A1), a gene which encodes a protein that is a glutamate transporter, essential for terminating the postsynaptic action of glutamate by rapidly removing it from the synaptic cleft and is associated with amyotrophic lateral sclerosis; dicarboxylicaminoaciduria; familial ALS; neurodegenerative disorders. Accordingly, utilities of GAM26 include diagnosis and treatment of the abovementioned diseases and clinical conditions. The function and utilities of SLC1A1 have been established by previous studies, as described hereinabove with reference to FIG. 26D.

Reference is now made to SMARCB1 BINDING SITE. SWI/SNF related, matrix associated, actin dependent regulator of chrom (SMARCB1) is a target gene of GAM26, corresponding to GAM26-TARGET GENE of FIG. 26A. SMARCB1 BINDING SITE is a binding site found in an untranslated region of SMARCB1, corresponding to BINDING SITE of FIG. 26A. FIG. 26D illustrates the complementarity of the nucleotide sequence of SMARCB1 BINDING SITE, designated SEQ ID:370333, to the nucleotide sequence of GAM26 RNA of FIG. 26A, designated SEQ ID:20604.

Yet a further function of GAM26 is therefore inhibition of SWI/SNF related, matrix associated actin dependent regulator of chrom (SMARCB1), a gene which encodes a protein that is associated with malignant rhabdoid tumors (mrt). Accordingly, utilities of GAM26 include diagnosis and treatment of the abovementioned diseases and clinical conditions.

The function of SMARCB1 has been established by previous studies. Versteege et al. (1998) found that the SNF5/INI1 gene contains 9 exons and spans approximately 50 kb. They concluded that biallelic, somatic alteration of SNF5/INI1, arising through a combination of complete deletions of the gene, frameshift alterations, and nonsense mutations, is a frequent, if not constant, feature of MRTs. This was considered fully consistent with the paradigm of the 2-hit recessive model of oncogenesis and supported the hypothesis that SNF5/INI1 is the MRT tumor suppressor gene. Although constitutional mutations were not detected in this study, which was based on sporadic tumors, previous reports of multifocal and/or familial MRTs indicated that constitutional inactivation of 1 allele of SNF5/INI1 could be responsible for hereditary cases. Given the low incidence of MRT and its aggressive evolution, which frequently leads to death at a young age, familial cases, if existing, would be expected to be rare. Altered chromatin organization at specific DNA sites may be crucial in the process of oncogenesis. The SWI/SNF complexes, which have been identified in organisms from yeast to humans, are thought to be important in the remodeling of chromatin structure. Most samples and cell lines from malignant rhabdoid tumors show biallelic inactivating mutations of the SNF5 gene, suggesting that SNF5 may act as a tumor suppressor. Roberts et al. (2000) examined the role of Snf5 in development and cancer in a mouse model. They found that Snf5 is widely expressed during embryogenesis with focal areas of high-level expression in the mandibular portion of the first branchial arch and central nervous system. Homozygous knockout of Snf5 resulted in lethality by embryonic day 7, whereas heteroygous mice were born at the expected frequency and appeared normal. However, beginning as early as 5 weeks of age, heterozygous mice developed tumors consistent with malignant rhabdoid tumor. Most tumors arose in soft tissues derived from the first branchial arch. Most samples and cell lines from malignant rhabdoid tumors show biallelic inactivating mutations of the SNF5 gene, suggesting that SNF5 may act as a tumor suppressor. Roberts et al. (2000) examined the role of Snf5 in development and cancer in a mouse model. They found that Snf5 is widely expressed during embryogenesis with focal areas of high-level expression in the mandibular portion of the first branchial arch and central nervous system. Homozygous knockout of Snf5 resulted in lethality by embryonic day 7, whereas heterozygous mice were born at the expected frequency and appeared normal. However, beginning as early as 5 weeks of age, heterozygous mice developed tumors consistent with malignant rhabdoid tumor. Most tumors arose in soft tissues derived from the first branchial arch.

Full details of the abovementioned studies are described in the following publications, the disclosure of which are hereby incorporated by reference:

Versteege, I.; Sevenet, N.; Lange, J.; Rousseau-Merck, M. -F.; Ambros, P.; Handgretinger, R.; Aurias, A.; Delattre, O.: Truncating mutations of hSNF5/INI1 in aggressive paediatric cancer. Nature 394: 203-206, 1998. PubMed ID:9671307. Roberts, C. W. M.; Galusha, S. A.; McMenamin, M. E.; Fletcher, C. D. M.; Orkin, S. H.: Haploinsufficiency of Snf5 (integrase interactor 1) predisposes to malignant rhabdoid tumors in mice. Proc. Nat. Acad. Sci. 97: 13796-13800, 2000.

Further studies establishing the function and utilities of SMARCB1 are found in John Hopkins OMIM database record ID 601607, and in references numbered 1382-1397 listed hereinbelow.

Reference is now made to SMARCC1 BINDING SITE. SWI/SNF-RELATED, MATRIX-ASSOCIATED, ACTIN-DEPENDENT REGULATOR OF CHROMATIN, SUB-FAMILY C, MEMBER 1 (SMARCC1) is a target gene of GAM26, corresponding to GAM26-TARGET GENE of FIG. 26A. SMARCC1 BINDING SITE is a binding site found in an untranslated region of SMARCC1, corresponding to BINDING SITE of FIG. 26A. FIG. 26D illustrates the complementarity of the nucleotide sequence of SMARCC1 BINDING SITE designated SEQ ID:370474, to the nucleotide sequence of GAM26 RNA of FIG. 26A, designated SEQ ID:20604.

Another function of GAM26 is therefore inhibition of SWI/SNF-RELATED, MATRIX-ASSOCIATED, ACTIN-DEPENDENT REGULATOR OF CHROMATIN, SUB-FAMILY C, MEMBER 1 (SMARCC1), a gene which encodes a protein that is involved in chromatin remodeling. Accordingly, utilities of GAM26 include diagnosis and treatment of the abovementioned diseases and clinical conditions.

The function of SMARCC1 has been established by previous studies. Chromatin is actively remodeled during development. Chromatin remodeling of certain genes appears to precede their transcriptional activation. In yeast, the multisubunit SWI/SNF complex is thought to be responsible for chromatin remodeling. Wang et al. (1996) isolated an analogous SWI/SNF complex from human YT cells. They found that the resultant complexes are composed of 9 to 12 polypeptides, which they termed BAFs (for BRG1-associated factors). Wang et al. (1996) isolated BAF155 from a human Jurkat T-cell cDNA library. This gene encodes a polypeptide of 1,104 amino acids, and is homologous both to the yeast SWI3 gene and to BAF170, another of the proteins in this chromatin remodeling complex (601734). SWI3, BAF155, and BAF170 all contain a predicted leucine zipper region (a dimerization motif for a variety of transcription factors) and a myb-like tryptophan-repeat domain. Western blot analysis and EST database analysis revealed that BAF155 is expressed in many tissues Full details of the abovementioned studies are described in the following publications, the disclosure of which are hereby incorporated by reference:

Ring, H. Z.; Vameghi-Meyers, V.; Wang, W.; Crabtree, G. R.; Francke, U.: Five SWI/SNF-related, matrix-associated, actin-dependent regulator of chromatin (SMARC) genes are dispersed in the human genome. Genomics 51: 140-143, 1998. PubMed ID: 9693044 2. Wang, W.; Xue, Y.; Zhou, S.; Kuo, A.; Cairns, B. R.; Crabtree, G. R.: Diversity and specialization of mammalian SWI/SNF complexes. Genes Dev. 10: 2117-2130, 1996.

Further studies establishing the function and utilities of SMARCC1 are found in John Hopkins OMIM database record ID 601732, and in references numbered 1398-1399 listed hereinbelow.

Reference is now made to SNX3 BINDING SITE. sorting nexin 3 (SNX3) is a target gene of GAM26, corresponding to GAM26-TARGET GENE of FIG. 26A. SNX3 BINDING SITE is a binding site found in an untranslated region of SNX3, corresponding to BINDING SITE of FIG. 26A. FIG. 26D illustrates the complementarity of the nucleotide sequence of SNX3 BINDING SITE, designated SEQ ID:373083, to the nucleotide sequence of GAM26 RNA of FIG. 26A, designated SEQ ID:20604.

Yet another function of GAM26 is therefore inhibition of sorting nexin 3 (SNX3), a gene which encodes a protein that may associate with late-Golgi resident proteins rather than cell surface receptors. Accordingly, utilities of GAM26 include diagnosis and treatment of the abovementioned diseases and clinical conditions.

The function of SNX3 has been established by previous studies. By database searching with the sequence of sorting nexin-1 (SNX1; 601272), Haft et al. (1998) obtained several human EST clones, determined their nucleotide sequences, and constructed full-length cDNAS corresponding to an isoform of SNX1 (SNX1A), SNX2 (605929), SNX3, and SNX4 (605931). The SNX3 cDNA encode a deduced 162-amino acid protein. Northern blot analysis detected an approximately 1.9-kb SNX3 transcript in all tissues tested, with highest expression in peripheral leukocytes, spleen, heart, and skeletal muscle, and low expression in kidney. Western blot analysis showed that SNX3 is found mainly in the cytosol, whereas SNX1, SNX1A, SNX2, and SNX4 are associated predominantly with membranes. Coimmunoprecipitation studies detected no association of SNX3 with any receptors studied. Because SNX3 is the human ortholog of yeast Grd19p, Haft et al. (1998) suggested that SNX3 may associate with late-Golgi resident proteins rather than cell surface receptors. Based on the functions of their yeast homologs, Haft et al. (1998) suggested that mammalian sorting nexins function in intracellular trafficking of proteins to various organelles.

Full details of the abovementioned studies are described in the following publications, the disclosure of which are hereby incorporated by reference:

Haft, C. R.; de la Luz Sierra, M.; Barr, V. A.; Haft, D. H.; Taylor, S. I.: Identification of a family of sorting nexin molecules and characterization of their association with receptors. Molec. Cell. Biol. 18: 7278-7287, 1998.

Further studies establishing the function and utilities of SNX3 are found in John Hopkins OMIM database record ID 605930, and in references numbered 1400 listed hereinbelow.

Reference is now made to SOX10 BINDING SITE. SRY (sex determining region Y)-box 10 (SOX10) is a target gene of GAM26, corresponding to GAM26-TARGET GENE of FIG. 26A. SOX10 BINDING SITE is a binding site found in an untranslated region of SOX10, corresponding to BINDING SITE of FIG. 26A. FIG. 26D illustrates the complementarity of the nucleotide sequence of SOX10 BINDING SITE, designated SEQ ID:374793, to the nucleotide sequence of GAM26 RNA of FIG. 26A, designated SEQ ID:20604.

An additional function of GAM26 is therefore inhibition of SRY (sex determining region Y)-box 10 (SOX10), a gene which encodes a transcription factor that is associated with Waardenburg syndrome type 4. Accordingly, utilities of GAM26 include diagnosis and treatment of the abovementioned diseases and clinical conditions.

The function of SOX10 has been established by previous studies. Waardenburg syndrome combines deafness with pigmentary abnormalities and Hirschsprung disease (aganglionic megacolon). Both are congenital disorders caused by defective function of the embryonic neural crest. The disorders are associated in patients with Waardenburg-Shah syndrome (WS4; 277580) in which the manifestations are reminiscent of the white coat-spotting and aganglionic megacolon displayed by the mouse mutants Dom, piebald-lethal, and lethal spotting (ls). The last 2 phenotypes are caused by mutations in the genes encoding the endothelin-B receptor and its ligand, endothelin-3, respectively, in the mouse, and mutations in either of these 2 genes can result in the Waardenburg-Shah syndrome in humans. The identification of Sox10 as the gene mutated in Dom mice prompted Pingault et al. (1998) to analyze the role of its human homolog in neural crest defects. In 4 families with Waardenburg-Shah syndrome, they found mutations in the SOX10 gene (e.g., 602229.0001). These mutations probably result in haploinsufficiency of the SOX10 product.

Animal model experiments lend further support to the function of SOX10. Mouse model of Hirschsprung disease (HSCR; 142623), dominant megacolon (Dom), arose spontaneously at the Jackson Laboratory (Lane and Liu, 1984). Megacolon was associated with dominantly inherited spotting. While Dom/+ heterozygous mice displayed regional deficiencies of neural crest-derived enteric ganglia in the distal colon, Dom/Dom homozygous animals were embryonic lethal. Linkage analysis indicated that the Dom mutation is located in the mid-terminal region of mouse chromosome 15. Pingault et al. (1997) noted that, in mice, natural and in vitro-induced mutations affecting the Ret (164761), Ednrb (131242), and Edn3 (131244) genes generated phenotypes similar to human Hirschsprung disease. Using polymorphisms for conserved human/mouse genes, Pingault et al. (1997) established homology between the Dom locus and human chromosome 22q12-q13. Two genes, Smstr3 and Ads1 (103050), not previously mapped in the mouse genome, were also mapped to mouse chromosome 15. The investigators stated that 3 genes, Smstr3, Lgals1 (150570), and Pdgfb (190040), are possible Dom candidates, as they did not recombine with the Dom mutation in a backcross.

It is appreciated that the abovementioned animal model for SOX10 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Touraine, R. L.; Attie-Bitach, T.; Manceau, E.; Korsch, E.; Sarda, P.; Pingault, V.; Encha-Razai, F.; Pelet, A.; Auge, J.; Nivelon-Chevallier, A.; Holschneider, A. M.; Munnes, M.; Deer, W.; Goossens, M.; Munnich, A.; Vekemans, M.; Lyonnet, S.: Neurological phenotype in Waardenburg syndrome type 4 correlates with novel SOX10 truncating mutations and expression in developing brain. Am. J. Hum. Gene 66: 1496-1503, 2000. Note: Erratum: Am. J. Hum. Genet. 66: 2020 only 2000. PubMed ID: 10762540

Bondurand, N.; Kuhlbrodt, K.; Pingault, V.; Enderich J.; Sajus, M.; Tommerup, N.; Warburg, M.; Hennekam, R. C. M.; Read, A. P.; Wegner, M.; Goossens, M.: A molecular analysis of the Yemenite deaf-blind hypopigmentation syndrome: SOX10 dysfunction causes different neurocristopathies. Hum. Molec. Genet. 8: 1785-1789, 1999.

Further studies establishing the function and utilities of SOX10 are found in John Hopkins OMIM database record ID 602229, and in references numbered 1401-1422 listed hereinbelow.

Referring now to SOX10 BINDING SITE. SRY (sex determining region Y)-box 10 (SOX10) is a target gene of GAM26, corresponding to GAM26-TARGET GENE of FIG. 26A. SOX10 BINDING SITE is a binding site found in an untranslated region of SOX10, corresponding to BINDING SITE of FIG. 26A. FIG. 26D illustrates the complementarity of the nucleotide sequence of SOX10

BINDING SITE, designated SEQ ID:374849, to the nucleotide sequence of GAM26 RNA of FIG. 26A, designated SEQ ID:20604.

A further function of GAM26 is therefore inhibition of SRY (sex determining region Y)-box 10 (SOX10), a gene which encodes a transcription factor that is associated with Waardenburg syndrome type 4. Accordingly, utilities of GAM26 include diagnosis and treatment of the abovementioned diseases and clinical conditions. The function and utilities of SOX10 have been established by previous studies, as described hereinabove with reference to FIG. 26D.

Reference is now made to SOX11 BINDING SITE. SRY (sex determining region Y)-box 11 (SOX11) is a target gene of GAM26, corresponding to GAM26-TARGET GENE of FIG. 26A. SOX11 BINDING SITE is a binding site found in an untranslated region of SOX11, corresponding to BINDING SITE of FIG. 26A. FIG. 26D illustrates the complementarity of the nucleotide sequence of SOX11 BINDING SITE, designated SEQ ID:375242, to the nucleotide sequence of GAM26 RNA of FIG. 26A, designated SEQ ID:20604.

Yet a further function of GAM26 is therefore inhibition of SRY (sex determining region Y)-box 11 (SOX11), a gene which encodes a transcription factor that is probably important in the developing nervous system. Accordingly, utilities of GAM26 include diagnosis and treatment of the abovementioned diseases and clinical conditions.

The function of SOX11 has been established by previous studies. SRY (480000) is the testis-determining gene located on the Y chromosome of mammals. It encodes a protein whose most striking feature is a motif of 78 amino acids conserved with respect to the DNA binding domain of the high mobility group (HMG) proteins. Jay et al. (1995) noted that more than 100 HMG box-containing proteins had been reported at that time and are classified in 2 distinct subgroups according to the sequence-specificity of the binding, the number of DNA binding domains, and phylogenetic considerations (Laudet et al., 1993). An important subgroup of HMG box-containing proteins includes SRY and SRY box-related (SOX) sequences. They contain only 1 DNA-binding domain, and they bind to DNA in a sequence-specific manner. They are all potential transcription factors implicated in the developmental control of gene expression. Degenerate PCR-based methods enabled the cloning and sequencing of a great number of new SRY-related box sequences in both vertebrates and invertebrates. Only a few have been further characterized and, except for SOX4 (184430), which has been shown to be a transcriptional activator in lymphocytes, and for SOX9 (114290), which is the site of mutations causing campomelic dysplasia (a disorder of bone and sex determination), the functions of the SOX proteins were as yet unknown. Jay et al. (1995) cloned and characterized the human SOX11 gene using the partial clones of both human and mouse SOX11 genes and mapped the gene to 2p25 by fluorescence in situ hybridization. The SOX11 sequence is strongly conserved with the chicken homolog and is related to SOX4. It contains several putative transcriptional activator or repressor domains. The authors observed that the SOX11 expression pattern is consistent with the hypothesis that this gene is important in the developing nervous system.

Full details of the abovementioned studies are described in the following publications, the disclosure of which are hereby incorporated by reference:
Jay, P.; Goze, C.; Marsollier, C.; Taviaux, S.; Hardelin, J. -P.; Koopman, P.; Berta, P.: The human SOX11 gene: cloning, chromosomal assignment and tissue expression. Genomics 29: 541-545, 1995.

Further studies establishing the function and utilities of SOX11 are found in John Hopkins OMIM database record ID 600898, and in referent numbered 1423-1424 listed hereinbelow.

Reference is now made to SPG4 BINDING SITE spastic paraplegia 4 (autosomal dominant; spastin) (SPG4) is a target gene of GAM26, corresponding to GAM26-TARGET GENE of FIG. 26A. SPG4 BINDING SITE is a binding site found in an untranslated region of SPG4, corresponding to BINDING SITE of FIG. 26A. FIG. 26D illustrates the complementarity of the nucleotide sequence of BINDING SITE, designated SEQ ID:376880, to the nucleotide sequence of GAM26 RNA of FIG. 26A, designated SEQ ID:20604.

Another function of GAM26 is therefore inhibition of spastic paraplegia 4 (autosomal dominant; spastin) (SPG4), a gene which encodes a protein that is probably an ATPase involved in the assembly or function of nuclear protein complexes and is associated with spastic paraparesis. Accordingly, utilities of GAM26 include diagnosis and treatment of the abovementioned diseases and clinical conditions.

The function of SPG4 has been established by previous studies. SPG4 is ubiquitously expressed in human adult and fetal tissue, showing slightly higher expression in fetal brain. Hazan et al. (1999) cloned the mouse ortholog of SPG4, which between amino acids 113 and 616 has 96% identity with human SPG4. Spg4 transcripts are ubiquitously expressed in adult tissues and from embryonic day 7 to 17 in mouse. Interaction with the cytoskeleton was mediated by the N-terminal region of spastin and was regulated through the ATPase activity of the AAA domain. Expression of missense mutations (including 604277.0001, 604277.0002, and 604277.0004) into the AAA domain led to constitutive binding to microtubules in transfected cells and induced the disappearance of the aster and the formation of thick perinuclear bundles, suggesting a role of spastin in microtubule dynamics. Consistently, wildtype spastin promoted microtubule disassembly in transfected cells. The authors suggested that spastin may be involved in microtubule dynamics similarly to the highly homologous microtubule-severing protein katanin (606696). The authors hypothesized that impairment of fine regulation of the microtubule cytoskeleton in long axons, due to spastin mutations, may underlie the pathogenesis of hereditary spastic paraplegia Full details of the abovementioned studies are described in the following publications, the disclosure of which are hereby incorporated by reference:
Hazan, J.; Fonknechten, N.; Mavel, D.; Paternotte, C.; Samson, D.; Artiguenave, F.; Davoine, C. -S.; Cruaud, C.; Durr, A.; Wincker, P.; Brottier, P.; Cattolico, L.; Barbe, V.; Burgunder, J. -M.; Prud'homme, J. -F.; Brice, A.; Fontaine, B.; Heilig, R.; Weissenbach, J.: Spastin, a new AAA protein, is altered in the most frequent form of autosomal dominant spastic paraplegia. Nature Genet. 23: 296-303, 1999. PubMed ID: 10610178 Errico, A.; Ballabio, A.; Rugarli, E. I.: Spastin, the protein mutated in autosomal dominant hereditary spastic paraplegia, is involved in microtubule dynamics. Hum. Molec. Genet. 11: 153-163, 2002.

Further studies establishing the function and utilities SPG4 are found in John Hopkins OMIM database record ID 604277, and in references numbered 1425-1437 listed hereinbelow.

Reference is now made to ST7 BINDING SITE. Suppression of tumorigenicity 7 (ST7) is a target gene of GAM26, corresponding GAM26-TARGET GENE of FIG. 26A. ST7 BINDING SITE is a binding site found in an untranslated region of ST7, corresponding to BINDING SITE of FIG. 26A. FIG. 26D illustrates the complementarity of the nucleotide sequence of ST7 BINDING SITE, designated SEQ ID:380179, to the nucleotide sequence of GAM26 RNA of FIG. 26A, designated SEQ ID:20604.

Yet another function of GAM26 is therefore inhibition of suppression of tumorigenicity 7 (ST7), a gene which encodes a protein that has a role in regulating cell-environment or cell-cell interactions and is associated with a variety of human tumors. Accordingly, utilities of GAM26 include diagnosis and treatment of the abovementioned diseases and clinical conditions.

The function of S17 has been established by previous studies. A distinct tumor suppressor gene involved in primary ovarian carcinomas was suggested by the finding of Zenklusen et al. (1995) of allelic loss at 7q31.1 in such carcinomas. In 17 of 19 informative cases (73%), loss of heterozygosity (LOH) was detected in D7S522 at 7q31.1. The smallest common deleted region covered about 1 cM. Previous microcell fusion transfer of human chromosome 7 to a murine squamous cell carcinoma cell line indicated that the inserted chromosome can delay the onset of tumors and in some cases completely repress the tumorigenic potential. In situ hybridization showed that the clones that reverted to the malignant phenotype had expelled the inserted chromosome. The authors stated that LOH of 7q31.1 had frequently been found in squamous cell carcinomas of the head and neck and in colon and prostate carcinomas. Vincent et al. (2000) studied an individual with autism (209850) who carried the translocation t(7;13)(q31.3;q21). The chromosomal 7 breakpoint is located in the region of 7q in which a susceptibility locus for autism had been postulated. Using a combination of DNA sequence analysis and cDNA screening of human colon carcinoma and fetal brain cDNA libraries, Vincent et al. (2000) cloned the ST7 gene, which they designated RAY1 (or FAM4A1), which spanned the translocation breakpoint. The gene contains 16 exons and extends more than 220 kb at 7q31.3. Alternatively spliced transcripts differing at exon 7 and having 2 different exon 16s encode deduced proteins of 554 and 585 amino acids. Apparent homologs of RAY1 had been identified in mouse, rat, pig, chicken, fruit fly, and nematode. Vincent et al. (2000) determined that the human and mouse RAY1 genes share similar splicing patterns, and that their predicted protein products are 98% identical.

Full details of the abovementioned studies are described in the following publications, the disclosure of which are hereby incorporated by reference:

Vincent, J. B.; Herbrick, J. -A.; Gurling, H. M. D.; Bolton, P. F.; Roberts, W.; Scherer, S. W.: Identification of a novel gene chromosome 7q31 that is interrupted by a translocation breakpoint in an autistic individual. Am. J. Hum. Genet. 67: 510-514, 2000. PubMed ID: 10889047 6.

Zenklusen, J. C.; Weitzel, J. N.; Ball, H. G.; Conti, C. J.: Allelic loss at 7q31.1 in human primary ovarian carcinomas suggests the existence of a tumor suppressor gene. Oncogene 11: 359-363, 1995.

Further studies establishing the function and utilities of S17 are found in John Hopkins OMIM database record ID 600833, and in references numbered 1438-1443 listed hereinbelow.

Reference is now made to STAR BINDING SITE. Steroidogenic acute regulatory protein (STAR) is a target gene of GAM26, corresponding to GAM26-TARGET GENE of FIG. 26A. STAR BINDING SITE is a binding site found in an untranslated region of STAR, corresponding to BINDING SITE of FIG. 26A. FIG. 26D illustrates the complementarity of the nucleotide sequence of STAR BINDING SITE, designated SEQ ID:380380, to the nucleotide sequence of GAM26 RNA of FIG. 26A, designated SEQ ID:20604.

An additional function of GAM26 is therefore inhibition of steroidogenic acute regulatory protein (STAR), a gene which encodes a protein that is associated with congenital lipoid adrenal hyperplasia (clah). Accordingly, utilities of GAM26 include diagnosis and treatment of the abovementioned diseases and clinical conditions.

The function of STAR has been established by previous studies. Steroidogenic acute regulatory protein appears to mediate the rapid increase in pregnenolone synthesis stimulated by tropic hormones. Sugawara et al. (1995) isolated cDNAs encoding this protein from a human adrenal cortex library; the authors symbolized the protein STAR. When coexpressed in COS-1 cells with cytochrome P450scc (118485) and adrenodoxin (103260), STAR increased pregnenolone synthesis more than 4-fold. A major STAR transcript of 1.6 kb and less abundant transcripts of 4.4 and 7.5 kb were detected in ovary and testis. Kidney had a lower amount of the 1.6-kb message. STAR mRNA was not detected in other tissues, including placenta. Sugawara et al. (1995) concluded that STAR expression is restricted to tissues that carry out mitochondrial sterol oxidations subject to acute regulation by cAMP and that STAR mRNA levels are regulated by cAMP.

Animal model experiments lend further support to the function of STAR. Caron et al. (1997) used targeted gene disruption to produce STAR knockout mice. Initially, the knockout mice were indistinguishable from wildtype littermates, except that males and females had female external genitalia. After birth, they failed to grow normally and died from adrenocortical insufficiency. Hormone assays confirmed severe defects in adrenal steroids—with loss of negative feedback regulation at hypothalamic-pituitary levels—whereas hormone constituting the gonadal axis did not differ significantly from levels in wildtype littermates. Histologically, the adrenal cortex of STAR knockout mice contained florid lipid deposits, with lesser deposits in the steroidogenic compartment of the testis and none in the ovary. The sex-specific differences in gonadal involvement supported a 2-stage model of the pathogenesis of STAR deficiency, with trophic hormone stimulation inducing progressive accumulation of lipids within the steroidogenic cells and ultimately causing their death.

It is appreciated that the abovementioned animal model for STAR is acknowledged by those skilled in the art as a scientifically valid animal model, as can be further appreciated from the publications sited hereinbelow.

Full details of the abovementioned studies are described in the following publications, the disclosure of which are hereby incorporated by reference:

Caron, K. M.; Soo, S. -C.; Wetsel, W. C.; Stocco, D. M.; Clark, B. J.; Parker, K. L.: Targeted disruption of the mouse gene encoding steroidogenic acute regulatory protein provides insights into congenital lipoid adrenal hyperplasia. Proc. Nat. Acad. Sci. 94: 11540-11545, 1997. PubMed ID: 9326645 11. Sugawara, T.; Holt, J. A.; Driscoll, D.; Strauss, J. F., III; Lin, D.; Miller, W. L.; Patterson, D.; Clancy, K. P.; Hart, I. M.; Clark, B. J.; Stocco, I. M.: Human steroidogenic acute regulatory protein: functional activity in COS-1 cells, tissue-specific expression, and mapping of the structural gene to 8p11.2 and a pseudogene to chromosome 13. Proc. Nat. Acad. Sci. 2: 4778-4782, 1995.

Further studies establishing the function and utilities of STAR are found in John Hopkins OMIM database record ID 600617, and in references numbered 1444-1455 listed hereinbelow.

Referring now to STAR BINDING SITE. Steroidogenic acute regulatory protein (STAR) is a target gene of GAM26, corresponding to GAM26-TARGET GENE of FIG. 26A. STAR BINDING SITE is a binding site found in an untranslated region of STAR, corresponding to BINDING SITE of FIG. 26A, FIG. 26D illustrates the complementarity of the nucleotide sequence of STAR BINDING SITE, designated SEQ ID:380387, to the nucleotide sequence of GAM26 RNA of FIG. 26A, designated SEQ ID:20604.

A further function of GAM26 is therefore inhibition of steroidogenic acute regulatory protein (STAR), a gene which encodes a protein that is associated with congenital lipoid adrenal hyperplasia (clah). Accordingly, utilities of GAM26 include diagnosis and treatment of the abovementioned diseases and clinical conditions. The function and utilities of STAR have been established by previous studies, as described hereinabove with reference to FIG. 26D.

Reference is now made to STC1 BINDING SITE. Stanniocalcin 1 (STC1) is a target gene of GAM26, corresponding to GAM26-TARGET GENE of FIG. 26A. STC1 BINDING SITE is a binding site found in an untranslated region of STC1, corresponding to BINDING SITE of FIG. 26A. FIG. 26D illustrates the complementarity of the nucleotide sequence of STC1 BINDING SITE, designated SEQ ID:381482, to the nucleotide sequence of GAM26 RNA of FIG. 26A, designated SEQ ID:20604.

Yet a further function of GAM26 is therefore inhibition of stanniocalcin 1 (STC1), a gene which encodes a protein that stimulates renal phosphate reabsorption, and could therefore prevent hypercalcemia. Accordingly, utilities of GAM26 include diagnosis and treatment of the abovementioned diseases and clinical conditions.

The function of STC1 has been established by previous studies. Stanniocalcin (STC) is a calcium-regulated hormone in bony fishes. The hormone was so named because it is synthesized by the corpuscles of Stannius, endocrine glands that are associated with the kidneys of all fishes with a bony skeleton. The primary function of STC in fishes is the prevention of hypercalcemia; Olsen et al. (1996) noted that a rise in serum calcium levels is the primary stimulus for secretion. Upon release into the circulation, STC lowers calcium transport by the gills, thereby reducing its rate of influx from the environment into the extracellular compartment. A second equally important action of STC is stimulation of phosphate reabsorption by renal proximal tubules. The consequence of this renal effect is increased levels of plasma phosphate, which combines with excess calcium and promotes its disposal into bone and scales. Wagner et al. (1995) found evidence of STC immunoreactivity in human kidney and serum, suggesting the existence of the hormone in mammals. Olsen et al. (1996) isolated a human cDNA clone encoding the mammalian homolog of STC. Human STC was found to be 247 amino acids long and to share 73% amino acid sequence similarity with fish STC. Polyclonal antibodies to recombinant human STC localized to a distinct cell type in the nephron tubule, suggesting kidney as a possible site of synthesis. Recombinant human STC inhibited the gill transport of calcium when administered to fish and stimulated renal phosphate reabsorption in the rat.

Full details of the abovementioned studies are described in the following publications, the disclosure of which are hereby incorporated by reference:

Olsen H. S.; Cepeda, M. A.; Zhang, Q. -Q.; Rosen, C. A.; Vozzolo, B. L.; Wagner, G. F.: Human stanniocalcin: a possible hormonal regulator of mineral metabolism. Proc. Nat. Acad. Sci. 93: 1792-1796, 1996. PubMed ID: 8700837 6. Wagner, G. F.; Guiraudon, C. C.; Milliken, C.; Copp, D. H.: Immunological and biological evidence for a stanniocalcin-like hormone in human kidney. Proc. Nat. Acad. Sci. 92: 1871-1875, 1995.

Further studies establishing the function and utilities of STC1 are found in John Hopkins OMIM database record ID 601185, and in references numbered 1456-1463 listed hereinbelow.

Referring now to STC1 BINDING SITE. Stanniocalcin 1 (STC1) is a target gene GAM26, corresponding to GAM26-TARGET GENE of FIG. 26A. STC1 BINDING SITE is a binding site found in an untranslated region of STC1, corresponding to BINDING SITE of FIG. 26A. FIG. 26D illustrates the complementarity of the nucleotide sequence of STC1 BINDING SITE, designated SEQ ID:381506, to the nucleotide sequence of GAM26 RNA of FIG. 26A, designated SEQ ID:20604.

Another function of GAM26 is therefore inhibition of stanniocalcin 1 (STC1), a gene which encodes a protein that stimulates renal phosphate reabsorption, and could therefore prevent hypercalcemia. Accordingly, utilities of GAM26 include diagnosis and treatment of the abovementioned diseases and clinical conditions. The function and utilities of STC1 have been established by previous studies, as described hereinabove with reference to FIG. 26D.

Referring now to STC1 BINDING SITE. Stanniocalcin 1 (STC1) is a target gene of GAM26, corresponding to GAM26-TARGET GENE of FIG. 26A. STC1 BINDING SITE is a binding site found in an untranslated region of STC1, corresponding to BINDING SITE of FIG. 26A. FIG. 26D illustrate the complementarity of the nucleotide sequence of STC1 BINDING SITE, designated SEQ ID:381507, to the nucleotide sequence of GAM26 RNA of FIG. 26A, designated SEQ ID:20604.

Yet another function of GAM26 is therefore inhibition of stanniocalcin 1 (STC1), a gene which encodes a protein that stimulates renal phosphate reabsorption, and could therefore prevent hypercalcemia. Accordingly, utilities of GAM26 include diagnosis and treatment of the abovementioned diseases and clinical conditions. The function and utilities of STC1 have been established by previous studies, as described hereinabove with reference to FIG. 26D.

Referring now to STAR BINDING SITE. Steroidogenic acute regulatory protein (STAR) is a target gene of GAM26, corresponding to GAM26-TARGET GENE of FIG. 26A. STAR BINDING SITE is a binding site found in an untranslated region of STAR, corresponding to BINDING SITE of FIG. 26A. FIG. 26D illustrates the complementarity of the nucleotide sequence of STAR BINDING SITE, designated SEQ ID:381508, to the nucleotide sequence of GAM26 RNA of FIG. 26A, designated SEQ ID:20604.

An additional function of GAM26 is therefore inhibition of steroidogenic acute regulatory protein (STAR), a gene which encodes a protein that is associated with congenital lipoid a renal hyperplasia (clah). Accordingly, utilities of GAM26 include diagnosis and treatment of the abovementioned diseases and clinical conditions. The function and utilities of STAR have been established by previous studies, as described hereinabove with reference to FIG. 26D.

Referring now to STC1 BINDING SITE. Stanniocalcin 1 (STC1) is a target gene of GAM26, corresponding to GAM26-TARGET GENE of FIG. 26A. STC1 BINDING SITE is a binding site found in an untranslated region of STC1, corresponding to BINDING SITE of FIG. 26A. FIG. 26D illustrates the complementarity of the nucleotide sequence of STC1 BINDING SITE, designated SEQ ID:381508, to the nucleotide sequence of GAM26 RNA of FIG. 26A, designated SEQ ID:20604.

A further function of GAM26 is therefore inhibition of stanniocalcin 1 (STC1), a gene which encodes a protein that stimulates renal phosphate reabsorption, and could therefore prevent hypercalcemia. Accordingly, utilities of GAM26 include diagnosis and treatment of the abovementioned diseases and clinical conditions. The function and utilities of STC1 have been established by previous studies, as described hereinabove with reference to FIG. 26D.

Reference is now made to SYK BINDING SITE. Spleen tyrosine kinase (SYK) is a target gene of GAM26, corresponding to GAM26-TARGET GENE of FIG. 26A. SYK BINDING SITE is a binding site found in an untranslated region of SYK, corresponding to BINDING SITE of FIG. 26A. FIG. 26D illustrates the complementarity of the nucleotide sequence of SYK BINDING SITE, designated SEQ ID:384918, to the nucleotide sequence of GAM26 RNA of FIG. 26A, designated SEQ ID:20604.

Yet a further function of GAM26 is therefore inhibition of spleen tyrosine kinase (SYK), a gene which encodes a protein that may participate in signaling pathways and play a role in lymphocyte activation. Accordingly, utilities of GAM26 include diagnosis and treatment of the abovementioned diseases and clinical conditions.

The function of SYK has been established by previous studies. The pig protein-tyrosine kinase SYK, with a relative molecular mass of 72,000, was first described as a protein predominantly expressed in the spleen and thymus (Zioncheck et al., 1988). The nucleotide and deduced amino acid sequence indicated that SYK is a member of the family of nonreceptor type kinases (Taniguchi et al., 1991). Muller et al. (1994) cloned the human homolog. They found an open reading frame of 1,890 bp encoding a protein of 630 amino acids, in comparison with the pig SYK of 628 amino acids. In the human protein the N-terminal SH2 domain spans amino acids 10-102, the C-terminal SH2 domain spans amino acids 163-254, and the kinase domain includes amino acids 366-621. On the amino acid level, the overall similarity between human and pig SYK is 93%. The similarity was highest in the kinase domain.

Animal model experiments lend further support to the function of SYK. Colucci et al. (2002) noted that humans with mutations in ZAP70 have T-cell immunodeficiency, that mice lacking Zap70 have blocked T-cell development, and that mice lacking Syk have a failure of B-cell development. NK cells express both molecules, which associate with immunoreceptor tyrosine-based activation motifs (ITAMs). Using mice deficient in both Zap70 and Syk, Colucci et al. (2002) observed NK cell activity comparable to that in wildtype mice. The mutant cells expressed Nkg2d (602893) and were able to lyse targets with and without Nkg2d ligands in vitro and in vivo. However, wildtype cells, but not the double-deficient cells, responded to CD16 (146740) and Ly49d (see 604274) cross-linking with increased cytotoxicity, suggesting that these 2 ITAM-bearing receptors are unable to signal in the mutant cells. Inhibitors of PI3K (see 601232) or Src kinases blocked and, in combination, abrogated cytotoxic activity in the mutant cells, whereas inhibition of both kinases was required to reduce wildtype NK activity. Colucci et al. (2002) concluded that intracellular signaling in the adaptive immune system, i.e., in B and T cells, is fundamentally different from that in the NK cells of the innate immune system.

It is appreciated that the abovementioned animal model for SYK is acknowledged by those skilled in the art as a scientifically valid animal model, as can be further appreciated from the publications sited hereinbelow.

Full details of the abovementioned studies are described in the following publications, the disclosure of which are hereby incorporated by reference:

Colucci, F.; Schweighoffer, E.; Tomasello, E.; Turner, M.; Ortaldo, J. R.; Vivier, E.; Tybulewicz, V. L. J.; Di Santo, J. P.: Natural cytotoxicity uncoupled from the Syk and ZAP-70 intracellular kinases. Nature Immun. 3: 288-294, 2002. PubMed ID: 11836527 6. Muller, B.; Cooper, L.; Terhorst, C.: Molecular cloning of the human homologue to the pig protein-tyrosine kinase syk. Immunogenetics: 9: 359-362, 1994.

Further studies establishing the function and utilities of SYK are found in John Hopkins OMIM database record ID 600085, and in references numbered 1464-1472 listed hereinbelow.

Reference is now made to SYNGR2 BINDING SITE. Synaptogyrin 2 (SYNGR2) is a target gene of GAM26, corresponding to GAM26-TARGET GENE of FIG. 26A, SYNGR2 BINDING SITE is a binding site found in an untranslated region of SYNGR2, corresponding to BINDING SITE of FIG. 26A. FIG. 26D illustrates the complementarity of the nucleotide sequence of SYNGR2 BINDING SITE, designated SEQ ID:385461, to the nucleotide sequence of GAM26 RNA of FIG. 26A, designated SEQ ID:20604.

Another function of GAM26 is therefore inhibition of synaptogyrin 2 (SYNGR2), a gene which encodes a protein that may play a role in regulating membrane traffic in non-neuronal cells. Accordingly, utilities of GAM26 include diagnosis and treatment of the abovementioned diseases and clinical conditions.

The function of SYNGR2 has been established by previous studies. Synaptic vesicles represent specialized secretory organelles that store neurotransmitters in nerve terminals, and release them by fusing with the presynaptic plasma membrane during exocytosis. Synaptogyrin (SYNGR1; 603925) and synaptophysins I (see 313475) and II (synaptoporin) contain 4 transmembrane regions with cytoplasmic C and N termini, and are among the most abundant synaptic vesicle proteins. Janz and Sudhof (1998) identified a rat gene encoding cellugyrin, a protein related to synaptogyrin. Western blot analysis revealed that cellugyrin and synaptogyrin are expressed in mirror-image patterns in rat tissues: cellugyrin is ubiquitous with the lowest levels in brain, while synaptogyrin is detectable only in the brain. Subcellular fractionation of rat brain cells indicated that both synaptogyrin and cellugyrin are associated with microsomes; however, only synaptogyrin is found in synaptic vesicles. The authors suggested that synaptogyrin is a specialized version of the ubiquitous cellugyrin, supporting the concept that synaptic vesicles are a simplified and specialized form of a generic trafficking organelle. Independently, Kedra et al. (1998) identified cDNAs encoding the mouse and human homologs of cellugyrin, which they called synaptogyrin-2 (SYNGR2). Like SYNGR1, the predicted 224-amino a id human SYNGR2 protein contains 4 transmembrane regions. Northern blot analysis revealed that the 1.6 kb SYNGR2 mRNA was expressed at high levels in all tissues tested except brain.

Full details of the abovementioned studies are described in the following publications, the disclosure of which are hereby incorporated by reference:

Janz, R.; Sudhof, T. C.: Cellugyrin, a novel ubiquitous form of synaptogyrin that is phosphorylated by pp60(c-src). J. Biol. Chem. 273: 2851-2857, 1998. PubMed ID: 9446595
2. Kedra, D.; Pan, H. -Q.; Seroussi, E.; Fransson, I.; Guilbaud, C.; Collins, J. E.; Dunham, I.; Blennow, E.; Roe, B. A.; Piehl, F.; Dumanski, J. P.: Characterization of the synaptogyrin gene family. Hum. 103: 131-141, 1998.

Further studies establishing the function and utilities of SYNGR2 are found in John Hopkins OMIM database record ID 603926, and in references 1473-1474 listed hereinbelow.

Referring now to SYNGR2 BINDING SITE. Synaptogyrin 2 (SYNGR2) is a target gene of GAM26, corresponding to GAM26-TARGET GENE of FIG. 26A. SYNGR4 BINDING SITE is a binding site found in an untranslated region of SYNGR2, corresponding to BINDING SITE of FIG. 26A. FIG. 26D illustrates the complementarity of the nucleotide sequence of SYNGR2 BINDING SITE, designated SEQ ID:385484, to the nucleotide sequence of GAM26 RNA of FIG. 26A, designated SEQ ID:20604.

Yet another function of GAM26 is therefore inhibition of synaptogyrin 2 (SYNGR2), a gene which encodes a protein that may play a role in regulating membrane traffic in non-neuronal cells. Accordingly, utilities of GAM26 include diagnosis and treatment of the abovementioned diseases and clinical conditions. The function and utilities of SYNGR2 have been established by previous studies, as described hereinabove with reference to FIG. 26D.

Referring now to SYNGR2 BINDING SITE. Synaptogyrin 2 (SYNGR2) is a target gene of GAM26, corresponding to GAM26-TARGET GENE of FIG. 26A. SYNGR2 BINDING SITE is a binding site found in an untranslated region of SYNGR2, corresponding to BINDING SITE of FIG. 26A. FIG. 26D illustrates the complementarity of the nucleotide sequence of SYNGR2 BINDING SITE, designated SEQ ID:385485, to the nucleotide sequence of GAM26 RNA of FIG. 26A, designated SEQ ID:20604.

An additional function of GAM26 is therefore inhibition of synaptogyrin 2 (SYNGR2), a gene which encodes a protein that may play a role in regulating membrane traffic in non-neuronal cells. Accordingly, utilities of GAM26 include diagnosis and treatment of the abovementioned diseases and clinical conditions. The function and utilities of SYNGR2 have been established by previous studies, as described hereinabove with reference to FIG. 26D.

Reference is now made to TBL3 BINDING SITE. Transducin (beta)-like 3 (TBL3) is a target gene of GAM26, corresponding to GAM26-TARGET GENE of FIG. 26A. TBL3 BINDING SITE is a binding site found in an untranslated region of TBL3, corresponding to BINDING SITE of FIG. 26A. FIG. 26D illustrates the complementarity of the nucleotide sequence of TBL3 BINDING SITE, designated SEQ ID:388909, to the nucleotide sequence of GAM26 RNA of FIG. 26A, designated SEQ ID:20604.

A further function of GAM26 is therefore inhibition of transducin (beta)-like 3 (TBL3), a gene which encodes a protein that belongs to members of the beta-transducin superfamily. Accordingly, utilities of GAM26 include diagnosis and treatment of the abovementioned diseases and clinical conditions.

The function of TBL3 has been established by previous studies. Weinstat-Saslow et al. (1993) isolated cDNAs that map to chromosome 16p in the region of the autosomal dominant polycystic kidney disease locus (601313). Sequence analysis of one of these cDNAs, TBL3, which was designated SAZD by the authors, revealed a similarity to members of the beta-transducin superfamily. The full-length TBL3 cDNA encodes a 519-amino acid protein with 7 WD40 (beta-transducin) motifs, each of which contains 40 to 45 amino acids with an invariant tryptophan residue. TBL3 shares 18 to 25% sequence identity with G protein beta subunits, with homology occurring predominantly in the conserved repeated WD40 motifs. By somatic cell and radiation hybrid analyses, Weinstat-Saslow et al. (1993) assigned the TBL3 gene to chromosome 16p13.3.

Full details of the abovementioned studies are described in the following publications, the disclosure of which are hereby incorporated by reference:

Weinstat-Saslow, D. L.; Germino, G. G.; Somlo, S.; Reeders, S. T.: A transducin-like gene maps to the autosomal dominant polycystic kidney disease gene region. Genomics 18: 709-711, 1993.

Further studies establishing the function and utilities of TBL3 are found in John Hopkins OMIM database record ID 605915, and in references numbered 1475 listed hereinbelow.

Reference is now made to TCF4 BINDING SITE. Transcription factor 4 (TCF4) is a target gene of GAM26, corresponding to GAM26-TARGET GENE of FIG. 26A. TCF4 BINDING SITE is a binding site found in an untranslated region of TCF4, corresponding to BINDING SITE of FIG. 26A. FIG. 26D illustrates the complementarity of the nucleotide sequence of TCF4 BINDING SITE, designated SEQ ID:390926, to the nucleotide sequence of GAM RNA of FIG. 26A, designated SEQ ID:20604.

Yet a further function of GAM26 is therefore inhibition of transcription factor 4 (TCF4), a gene which encodes a protein that is a transcriptional activator; interacts with ITF1 (TCF3); and contains basic helix-loop-helix domain. Accordingly, utilities of GAM26 include diagnosis and treatment of the abovementioned diseases and clinical conditions.

The function of TCF4 has been established by previous studies. The high mobility group (HMG) box is a DNA-binding domain. TCF7 (189908), also called TCF1; and LEF1 (153245), also called TCF1-alpha, are human lymphoid transcription factors that contain a virtually identical HMG box. By PCR of human genomic DNA using degenerate oligonucleotides based on the HMG boxes of TCF7 and LEF1, Castrop et al. (1992) identified the TCF7L1 (604652) and TCF7L2 genes, which they called TCF3 and TCF4, respectively. TCF7L1 and TCF7L2 were not expressed in cells of the lymphoid lineage. The deduced amino acid sequences of the HMG boxes of TCF7L1, TCF7L2, and TCF7 show striking homology. The authors suggested the existence of a subfamily of TCF7-like HMG box-containing transcription factors.

Animal model experiments lend further support to the function of TCF4. To study the physiologic role of Tcf4 (which is encoded by the Tcf7l2 gene), Korinek et al. (1998) disrupted Tcf7l2 by homologous recombination. The homozygous null mice died shortly after birth. A single histopathologic abnormality was observed. An apparently normal transition of intestinal endoderm into epithelium occurred at approximately embryonic day (E) 14.5. However, no proliferative compartments were maintained in the prospective crypt regions between the villi. As a consequence, the neonatal epithelium was composed entirely of differentiated, nondividing villus cells. Korinek et al. (1998) concluded that the genetic program controlled by Tcf712 maintains the crypt stem cells of the small intestine. The constitutive activity of Tcf4 in APC-deficient epithelial cells may contribute to their malignant transformation by maintaining stem cell characteristics.

It is appreciated that the abovementioned animal model for TCF4 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Castrop, J.; van Norren, K.; Clevers, H.: A gene family of HMG-box transcription factors with homology to TCF-1. Nucleic Acids Res. 20: 611 only, 1992. PubMed ID: 1741298 5. Korinek, V.; Barker, N.; Moerer, P.; van Donselaar, E.; Huls, G.; Peters, P. J.; Clevers, H.: Depletion of epithelial stem cell compartments in the small intestine of mice lacking Tcf-4. Nature Genet 19: 379-383, 1998.

Further studies establishing the function and utilities of TCF4 are found in John Hopkins OMIM database record ID 602228, and in references numbered 1477-1478, 1478, 1480, 1483-1484, 1484, 1486-1487, 1487-1488 and 1488 listed hereinbelow.

Referring now to TCF4 BINDING SITE. Transcription factor 4 (TCF4) is a target gene of GAM26, corresponding to GAM26-TARGET GENE of FIG. 26A. TCF4 BINDING SITE is a binding site found in an untranslated region of TCF4, corresponding to BINDING SITE of FIG. 26A. FIG. 26D illustrates the complementarity of the nucleotide sequence of TCF4 BINDING SITE, designated SEQ ID:390929, to the nucleotide sequence of GAM26 RNA of FIG. 26A, designated SEQ ID:20604.

Another function of GAM26 is therefore inhibition of transcription factor 4 (TCF4), a gene which encodes a protein that is a transcriptional activator; interacts with ITF1 (TCF3); and contains basic helix-loop-helix domain. Accordingly, utilities of GAM26 include diagnosis and treatment of the abovementioned diseases and clinical conditions. The function and utilities of TCF4 have been established by previous studies, as described hereinabove with reference to FIG. 26D.

Referring now to TCF4 BINDING SITE. Transcription factor 4 (TCF4) is a target gene of GAM26, corresponding to GAM26-TARGET GENE of FIG. 26A. TCF4 BINDING SITE is a binding site found in an untranslated region of TCF4, corresponding to BINDING SITE of FIG. 26A. FIG. 26D illustrates the complementarity of the nucleotide sequence of TCF4 BINDING SITE, designated SEQ ID:390953, to the nucleotide sequence of GAM26 RNA of FIG. 26A, designated SEQ ID:20604.

Yet another function of GAM26 is therefore inhibition of transcription factor 4 (TCF4), a gene which encodes a protein that is a transcriptional activator; interacts with ITF1 (TCF 3); and contains basic helix-loop-helix domain. Accordingly, utilities of GAM26 include diagnosis and treatment of the abovementioned diseases and clinical conditions. The function and utilities of TCF4 have been established by previous studies, as described hereinabove with reference to FIG. 26D.

Referring now to TCF4 BINDING SITE. Transcription factor 4 (TCF4) is a target gene of GAM26, corresponding to GAM26-TARGET GENE of FIG. 26A. TCF4 BINDING SITE is a binding site found in an untranslated region of TCF4, corresponding to BINDING SITE of FIG. 26A. FIG. 26D illustrates the complementarity of the nucleotide sequence of TCF4 BINDING SITE, designated SEQ ID:390956, to the nucleotide sequence of GAM26 RNA of FIG. 26A, designated SEQ ID:20604.

An additional function of GAM26 is therefore inhibition of transcription factor 4 (TCF4), a gene which encodes a protein that is a transcriptional activator; interacts with ITF1 (TCF3); and contains basic helix-loop-helix domain. Accordingly, utilities of GAM26 include diagnosis and treatment of the abovementioned diseases and clinical conditions. The function and utilities of TCF4 have been established by previous studies, as described hereinabove with reference to FIG. 26D.

Reference is now made to THOP1 BINDING SITE. Thimet oligopeptidase 1 (THOP1) is a target gene of GAM26, corresponding to GAM26-TARGET GENE of FIG. 26A. THOP1 BINDING SITE is a binding site found in an untranslated region of THOP1, corresponding to BINDING SITE of FIG. 26A. FIG. 26D illustrates the complementarity of the nucleotide sequence of THOP1 BINDING SITE, designated SEQ ID:396604, to the nucleotide sequence of GAM26 RNA of FIG. 26A, designated SEQ ID:20604.

A further function of GAM26 is therefore inhibition of thimet oligopeptidase 1 (THOP1), a gene which encodes an enzyme that involves in the metabolism of neuropeptide and in cytoplasmic peptide degradation. Accordingly, utilities of GAM26 include diagnosis and treatment of the abovementioned diseases and clinical conditions.

The function of THOP1 has been established by previous studies. Papastoitsis et al. (1994) purified and characterized the metalloprotease from human Alzheimer disease brain that is able to cleave a synthetic peptide encompassing the amino-terminus of amyloid beta peptide and generate amyloidogenic fragments from recombinant human APP. Sequence comparison revealed that this enzyme has high homology to the previously described rat metalloendopeptidase 24.15 (EC 3.4.24.15). The beta-secretase-like activity of the human enzyme in vitro in combination with its localization in neurons its co-localization with APP in transport vesicles purified from rabbit optic nerve rendered this enzyme an interesting candidate for amyloidogenic processing of APP. Using a cDNA encoding the rat enzyme, Meckelein et al. (1996) assigned the human gene, symbolized THOP1, to chromosome 19 by hybridization to DNA from human/rodent somatic cell hybrids. By fluorescence in situ hybridization, they localized the gene to 19q13.3. However, after localizing the THOP1 gene to the high-resolution cosmid contig map of human chromosome 19, Torres et al. (1998) found that the FISH mapping to 19q13.3 by Meckelein et al. (1996) was incorrect. Results of the hybridization and FISH mapping of positive clones indicated localization of THOP1 to 19p13.3, thus excluding THOP1 as a candidate gene for AD2.

Full details of the abovementioned studies are described in the following publications, the disclosure of which are hereby incorporated by reference:

Papastoitsis, G.; Siman, R.; Scott, R.; Abraham, C. R.: Identification of a metalloprotease from Alzheimer's disease brain able to degrade the beta-amyloid precursor protein and generate amyloidogenic fragments. Biochemistry 33: 192-199, 1994. PubMed ID: 8286339 1. Meckelein, B.; Rohan de Silva, H. A.; Roses, A. D.; Rao, P. N.; Pettenati, M. J.; Xu, P. -T.; Hodge, R.; Glucksman, M. J.; Abraham, C. R.: Human endopeptidase (THOP1) is localized on chromosome 19 within the linkage region for the late-onset Alzheimer disease AD2 locus. Genomics 31: 246-249, 1996.

Further studies establishing the function and utilities of THOP1 are found in John Hopkins OMIM database record ID 601117, and in references numbered 1489-1491 listed hereinbelow.

Reference is now made to TIF1 BINDING SITE. Transcriptional intermediary factor 1 (TIF1) is a target gene of GAM26, corresponding to GAM26-TARGET GENE of FIG. 26A. TIF1 BINDING SITE is a binding site found in an untranslated region of TIF1, corresponding to BINDING SITE of FIG. 26A. FIG. 26D illustrates the complementarity of the nucleotide sequence of TIF1 BINDING SITE, designated SEQ ID:397065, to the nucleotide sequence of GAM26 RNA of FIG. 26A, designated SEQ ID:20604.

Yet a further function of GAM26 is therefore inhibition of transcriptional intermediary factor 1 (TIF1), a gene which encodes a transcription factor that mediates the activation function (AF-2) of nuclear estrogen receptor. Accordingly, utilities of GAM26 include diagnosis and treatment of the abovementioned diseases and clinical conditions.

The function of TIF1 has been established by previous studies. Hormonal regulation of gene activity is mediated by nuclear receptors acting as ligand-activated transcription factors. The activity of the ligand-dependent activation function, or AF2, of the receptors requires intermediary factors that interact with the AF2-activating domain, a C-terminal region that is highly conserved in the nuclear receptor family. Thenot et al. (1997) isolated human breast cancer cell cDNAs that encode transcription intermediary factor-1 (TIF1), a protein that is able to bind to the AF2-activating domain of the estrogen receptor (ESR; e.g., 133430). The deduced 1,013-amino acid TIF1 protein, which is more than 92% conserved with mouse Tif1, contains several domains: a RING finger, B-box fingers, a coiled-coil domain, a PHD homeodomain finger, and a bromodomain. A 26-amino acid region of TIF1 is sufficient for its hormone-dependent binding to the ESR. Thenot et al. (199% demonstrated that the AF2-activating domain of ESR is required but not sufficient for the binding of TIF1, that TIF1 association with DNA-bound ESR requires the presence of estradiol, and that TIF1 interacts selectively with different nuclear receptors. The authors identified a cDNA variant that encodes a TIF1 isoform containing a 34-amino acid insertion. Northern blot analysis detected a major 4.5-kb transcript in MCF7 breast cancer cells. Fusion of PML (102578) and TIF1A to RARA (180240) and BRAF (164757), respectively, results in the production of PML RAR-alpha and TIF1-alpha-B-RAF (T18) oncoproteins. Zhong et al. (1999) showed that PML, TIF1-alpha, and RXR-alpha (180245)/RAR-alpha function together in a retinoic acid-dependent transcription complex. Zhong et al. (1999) found that PML acts as a ligand-dependent coactivator of RXR-alpha/RARA-alpha. PML interacts with TIF1-alpha and CREB-binding protein (CBP; 600140). In PML −/− cells, the retinoic acid-dependent induction of genes such as RARB2 and the ability of TIF1-alpha and CBP to act as transcriptional coactivators on retinoic acid are impaired. Zhong et al. (1999) showed that both PML and TIF1-alpha are growth suppressors required for the growth-inhibitory activity of retinoic acid. T18, similar to PML-RAR-alpha, disrupts the retinoic acid-dependent activity of this complex in a dominant-negative manner, resulting in a growth advantage. PML-RAR-alpha was the first example of an oncoprotein generated by the fusion of 2 molecules participating in the same pathway, specifically the fusion of a transcription factor to one of its own cofactors. Since the PML and RAR-alpha pathways converge at the transcriptional level, there is no need for a double-dominant-negative product to explain the pathogenesis of acute promyelocytic leukemia, or APL. Beckstead et al. (2001) found that the *Drosophila* 'bonus' (bon) gene encodes a homolog of the vertebrate TIF1 transcriptional cofactors. Bon is required for male viability, molting, and numerous events in metamorphosis, including leg elongation, bristle development, and pigmentation. Most of these processes are associated with genes that are implicated in the ecdysone pathway, a nuclear hormone receptor pathway required throughout *Drosophila* development. Bon is associated with sites on the polytene chromosomes and can interact with numerous *Drosophila* nuclear receptor proteins. In vivo, bon behaves as a transcriptional inhibitor.

Full details of the abovementioned studies are described in the following publications, the disclosure of which are hereby incorporated by reference:

Zhong, S.; Delva, L.; Rachez, C.; Cenciarelli, C.; Gandini, D.; Zhang, H.; Kalantry, S.; Freedman, L. P.; Pandolfi, P. P.: A RA-dependent, tumour-growth suppressive transcription complex is the target of the PML-RAR-alpha and T18 oncoproteins. Nature Genet 23: 287-295, 1999. PubMed ID: 106101771. Beckstead, R.; Ortiz, J. A.; Sanchez, C.; Prokopenko, S. N.; Chambon, P.; Losson, R.; Bellen, H. J.: Bonus, a *Drosophila* homolog of TIF1 proteins, interacts with nuclear receptors and can inhibit beta-FTZ-F1-dependent transcription. Molec. Cell 7: 753-765, 2001.

Further studies establishing the function and utilities of TIF1 are found in John Hopkins OMIM database record ID 603406, and in references numbered 1492-1497 listed hereinbelow.

Reference is now made to TIMP3 BINDING SITE. Tissue inhibitor of metalloproteinase 3 (Sorsby fundus dystrophy, pseu (TIMP3) is a target gene of GAM26, corresponding to GAM26-TARGET GENE of FIG. 26A. TIMP3 BINDING SITE is a binding site found in an untranslated region of TIMP3, corresponding to BINDING SITE of FIG. 26A. FIG. 26D illustrates the complementarity of the nucleotide sequence of TIMP3 BINDING SITE, designated SEQ ID:397666, to the nucleotide sequence of GAM26 RNA of FIG. 26A, designated SEQ ID:20604.

Another function of GAM26 is therefore inhibition of tissue inhibitor of metalloproteinase 3 (Sorsby fundus dystrophy, pseu (TIMP3), a gene which encodes a protein that is associated with Sorsby's fundus dystrophy. Accordingly, utilities of GAM26 include diagnosis and treatment of the abovementioned diseases and clinical conditions.

The function of TIMP3 has been established by previous studies. Osman et al. (2002) showed that mature dendritic cells (DCs) produce more (120361) than do immature DCs, facilitating their hydroxaminic acid-inhibitable migration through gel in vitro and, presumably, through the extracellular matrix to monitor the antigenic environment in vivo. RT-PCR analysis indicated that the enhanced expression of MMP9 is correlated with a downregulation of TIMP1 and, particularly, TIMP2, while expression of TIMP3 is upregulated. The authors concluded that the balance of MMP and TIMP determines the net migratory capacity of DCs. They proposed that TIMP3 may be a marker for mature DCs. Langton et al. (1998) found that wildtype TIMP3 is localized entirely to the extracellular matrix (ECM) in both its glycosylated (27 kD) and unglycosylated (24 kD) forms. A COOH-terminally truncated TIMP3 molecule was found to be a non-ECM bound matrix metalloproteinase (MMP)

inhibitor, whereas a chimeric TIMP molecule, consisting of the NH2-terminal domain of TIMP2 fused to the COOH-terminal domain of TIMP3, displayed ECM binding, albeit with a lower affinity than the wildtype TIMP3 molecule. Thus, as in TIMP1 and TIMP2, the NH2-terminal domain is responsible for MMP inhibition, whereas the COOH-terminal domain is most important in mediating the specific functions of the molecule. A mutant TIMP3 in which serine-181 was changed to cysteine (188826.0001), found in Sorsby fundus dystrophy, gave rise to an additional 48-kD species (possibly a TIMP3 dimer) that retained its ability to inhibit MMPs and localize to the ECM when expressed in COS-7 cells. These data favored the hypothesis that the TIMP3 mutation seen in Sorsby fundus dystrophy contributes to disease progression by accumulation of mutant protein rather than by loss of functional TIMP3. Weber et al. (1994), who had mapped the gene for Sorsby fundus dystrophy (SFD; 1136900) to 22q13-qter, examined the TIMP3 gene as a possible site of causative mutations in SFD on the basis of its chromosomal location and its pivotal role in extracellular matrix remodeling. They identified point mutations in TIMP3 in affected members of 2 SFD pedigrees. These mutations were predicted to disrupt the tertiary structure and thus the functional properties of the mature protein.

Full details of the abovementioned studies are described in the following publications, the disclosure of which are hereby incorporated by reference:

Osman, M.; Tortorella, M.; Londei, M.; Quaratino, S.: Expression of matrix metalloproteinases and tissue inhibitors of metalloproteinases define the migratory characteristics of human monocyte-derived dendritic cells. Immunology 105: 73-82, 2002. PubMed ID: 11849317 11. Weber, B. H. F.; Vogt, G.; Pruett, R. C.; Stohr, H.; Felbor, U.: Mutations in the tissue inhibitor metalloproteinases-3 (TIMP3) in patients with Sorsby's fundus dystrophy. Nature Genet 8: 352-356, 1994.

Further studies establishing the function and utilities of TIMP3 are found in John Hopkins OMIM database record ID 188826, and in references numbered 1498-1510 listed hereinbelow.

Referring now to TIMP3 BINDING SITE. Tissue inhibitor of metalloproteinase 3 (Sorsby fundus dystrophy, pseu (TIMP3) is a target gene of GAM26, corresponding to GAM26-TARGET GENE of FIG. 26A. TIMP3 BINDING SITE is a binding site found in an untranslated region of TIMP3, corresponding to BINDING SITE of FIG. 26A. FIG. 26D illustrates the complementarity of the nucleotide sequence of TIMP3 BINDING SITE, designated SEQ ID:397672, to the nucleotide sequence of GAM26 RNA of FIG. 26A, designated SEQ ID:20604.

Yet another function of GAM26 is therefore inhibition of tissue inhibitor of metalloproteinase 3 (Sorsby fundus dystrophy, pseu (TIMP3), a gene which encodes a protein that is associated with Sorsby's fundus dystrophy. Accordingly, utilities of GAM26 include diagnosis and treatment of the abovementioned diseases and clinical conditions. The function and utilities of TIMP3 have been established by previous studies, as described hereinabove with reference to FIG. 26D.

Reference is now made to TMPO BINDING SITE. Thymopoietin (TMPO) is a target gene of GAM26, corresponding to GAM26-TARGET GENE of FIG. 26A. TMPO BINDING SITE is a binding site found in an untranslated region of TMPO, corresponding to BINDING SITE of FIG. 26A. FIG. 26D illustrates the complementarity of the nucleotide sequence of TMPO BINDING SITE, designated SEQ ID:400315, to the nucleotide sequence of GAM26 RNA of FIG. 26A, designated SEQ ID:20604.

An additional function of GAM26 is therefore inhibition of thymopoietin (TMPO), a gene which encodes a protein that plays important roles in T-cell development and function. Accordingly, utilities of GAM26 include diagnosis and treatment of the abovementioned diseases and clinical conditions.

The function of TMPO has been established by previous studies. A single TMPO gene encodes 3 thymopoietins: alpha (75 kD), beta (51 kD), and gamma (39 kD). TMPO-alpha is present diffusely throughout the nucleus, whereas TMPOs beta and gamma are localized to the nuclear membrane. Harris et al. (1995) cloned the TMPO gene. The 8 exons of the gene are spread over approximately 35 kb. The 3 isoforms are produced by alternative mRNA splicing. Exon 4, which is spliced into TMPO-alpha mRNA, contains sequences that encode a putative basic nuclear localization motif. Exon 8, which is spliced into TMPO-beta and TMPO-gamma mRNAs, encodes a hydrophobic putative membrane-spanning domain that is thought to target these 2 gene products to the nuclear membrane. Harris et al. (1995) pointed out that TMPO-beta appears to be the human homolog of the rat protein LAP (lamina-associated polypeptide 2), which is thought to play an important role in the regulation of nuclear architecture by binding lamin B1 and chromosomes, in a manner regulated by phosphorylation during mitosis.

Full details of the abovementioned studies are described in the following publications, the disclosure of which are hereby incorporated by reference:

Audhya, T.; Schlesinger, D. H.; Goldstein, G.: Isolation and complete amino acid sequence of human thymopoietin and splenin. Proc. Nat. Acad. Sci. 84: 3545-3549, 1987. PubMed ID: 3473468 3. Harris, C. A.; Andryuk, P. J.; Cline, S. W.; Mathew, S.; Siekierka, J. J.; Goldstein, G.: Structure and mapping of the human thymopoietin (TMPO) gene and relationship of human TMPO beta to rat lamin-associated polypeptide 2. Genomics 28: 198-205, 1995.

Further studies establishing the function and utilities of TMPO are found in John Hopkins OMIM database record ID 188380, and in reference numbered 1511-1513 listed hereinbelow.

Reference is now made to U2AF1 BINDING SITE. U2(RNU2) small nuclear RNA auxiliary factor 1 (non-standard symbol) (U2AF1) is a target gene of GAM26, corresponding to GAM26-TARGET GENE of FIG. 26A. U2AF1 BINDING SITE is a binding site found in an untranslated region of U2AF1, corresponding to BINDING SITE of FIG. 26A. FIG. 26D illustrates the complementarity of the nucleotide sequence of U2AF1 BINDING SITE, designated SEQ ID:411863, to the nucleotide sequence of GAM26 RNA of FIG. 26A, designated SEQ ID:20604.

A further function of GAM26 is therefore inhibition of U2(RNU2) small nuclear RNA auxillary factor 1 (non-standard symbol) (U2AF1), a gene which encodes a protein that plays a critical role in both splicing constitutive and enhancer-dependent splicing. Accordingly, utilities of GAM26 include diagnosis and treatment of the abovementioned diseases and clinical conditions.

The function of U2AF1 has been established by previous studies. In vitro experiments demonstrate that pre-mRNA splicing begins with the assembly of a multicomponent complex on the pre-mRNA. This complex, the spliceosome, contains 2 types of factors: small nuclear ribonucleoprotein particles (snRNPs) and proteins. Binding of U2 snRNP (180690) the pre-mRNA branch site requires, in addition to U2 snRNP itself, U1 snRNP (180680) and at least 3 protein factors: SF1, SF3, and U2 snRNP auxiliary factor (U2AF). Purified HeLa cell U2AF comprises 2 polypeptides of 65 (U2AF65; 191318) and 35 kD. U2AF35 is evolutionarily conserved and copurifies with U2AF65. Zhang et al. (1992) isolated a cDNA encoding U2AF35. They showed directly the interaction between the 65-kD and 35-kD proteins. With anti-peptide antibodies, they showed that the proteins have the same intranuclear location in coiled bodies, subnuclear organelles first identified by light microscopy in 1903. Lalioti et al. (1996) cloned portions of the UAF35 gene, or U2AF1, by exon trapping. The cDNA was then hybridized to a cosmid which maps to 21q22.3 near the cystathionine beta-synthase gene (236200). The map position was confirmed by fluorescence in situ hybridization.

Full details of the abovementioned studies are described in the following publications, the disclosure of which are hereby incorporated by reference:

Zhang, M.; Zamore, P. D.; Carmo-Fonseca, M.; Lamond, A. I.; Green, M. R.: Cloning and intracellular localization of the U2 small nuclear ribonucleoprotein auxiliary factor small subunit. Proc. Nat. Acad. Sci. 89: 8769-8773, 1992. PubMed ID:1388271. Lalioti, M. D.; Gos, A.; Green, M. R.; Rossier, C.; Morris, M. A.; Antonarakis, S. E.: The gene for human U2 snRNP auxiliary factor small 35-kDa subunit (U2AF1) maps to the progressive myoclonus epilepsy (EPM1) critical region on chromosome 21q22.3. Genomics 33: 298-300, 1996.

Further studies establishing the function and utilities of U2AF1 are found in John Hopkins OMIM database record ID 191317, and in references numbered 1514-1517 listed hereinbelow.

Referring now to UBE2B BINDING SITE. Ubiquitin-conjugating enzyme E2B, (RAD6 homolog) (UBE2B) is a target gene of GAM26, corresponding to GAM26-TARGET GENE of FIG. 26A. UBE2B BINDING SITE is a binding site found in an untranslated region of UBE2B, corresponding to BINDING SITE of FIG. 26A. FIG. 26D illustrates the complementarity of the nucleotide sequence of UBE2B BINDING SITE, designated SEQ ID:412149, to the nucleotide sequence of GAM26 RNA of FIG. 26A, designated SEQ ID:20604.

Yet a further function of GAM26 is therefore inhibition of ubiquitin-conjugating enzyme E2B (RAD6 homolog) (UBE2B), a gene which encodes a Enzyme that catalyzes the covalent attachment of ubiquitin to other proteins and is required for postreplication repair of uv-damaged DNA. Accordingly, utilities of GAM26 include diagnosis and treatment of the abovementioned diseases and clinical conditions. The function and utilities of UBE2B have been established by previous studies, as described hereinabove with reference to FIG. 26D.

Referring now to MLLT1 BINDING SITE. Myeloid/lymphoid or mixed-lineage leukemia (trithorax (*Drosophila*) horn (MLLT1) is a target gene of GAM26, corresponding to GAM26-TARGET GENE of FIG. 26A. MLLT1 BINDING SITE is a binding site found in an untranslated region of MLLT1, corresponding to BINDING SITE of FIG. 26A. FIG. 26D illustrates the complementarity of the nucleotide sequence of MLLT1 BINDING SITE, designated SEQ ID:412156, to the nucleotide sequence of GAM26 RNA of FIG. 26A, designated SEQ ID:20604.

Another function of GAM26 is therefore inhibition of myeloid/lymphoid or mixed-lineage leukemia (trithorax (*Drosophila*) horn (MLLT1), a gene which encodes a protein that is associated with acute leukemias. Accordingly, utilities of GAM26 include diagnosis and treatment of the abovementioned diseases and clinical conditions. The function and utilities of MLLT1 have been established by previous studies, as described hereinabove with reference to FIG. 26D.

Referring now to UBE2B BINDING SITE. Ubiquitin-conjugating enzyme E2B (RAD6 homolog) (UBE2B) is a target gene of GAM26, corresponding to GAM26-TARGET GENE of FIG. 26A. UBE2B BINDING SITE is a binding site found in an untranslated region of UBE2B, corresponding to BINDING SITE of FIG. 26A. FIG. 26D illustrates the complementarity of the nucleotide sequence of UBE2B BINDING SITE, designated SEQ ID:412156, to the nucleotide sequence of GAM26 RNA of FIG. 26A, designated SEQ ID:20604.

Yet another function of GAM26 is therefore inhibition of ubiquitin-conjugating enzyme E2B (RAD6 homolog) (UBE2B), a gene which encodes a Enzyme that catalyzes the covalent attachment of ubiquitin to other proteins and is required for postreplication repair of uv-damaged DNA. Accordingly, utilities of GAM26 include diagnosis and treatment of the abovementioned diseases and clinical conditions. The function and utilities of UBE2B have been established by previous studies, as described hereinabove with reference to FIG. 26D.

Referring now to UBE2B BINDING SITE. Ubiquitin-conjugating enzyme E2B (RAD6 homolog) (UBE2B) is a target gene of GAM26, corresponding to GAM26-TARGET GENE of FIG. 26A. UBE2B BINDING SITE is a binding site found in an untranslated region of UBE2B, corresponding to BINDING SITE of FIG. 26A. FIG. 26D illustrates the complementarity of the nucleotide sequence of UBE2B BINDING SITE, designated SEQ ID:412157, to the nucleotide sequence of GAM26 RNA of FIG. 26A, designated SEQ ID:20604.

An additional function of GAM26 is therefore inhibition of ubiquitin-conjugating enzyme E2B(RAD6 homolog) (UBE2B), a gene which encodes a Enzyme that catalyzes the covalent attachment of ubiquitin to other proteins and is required for postreplication repair of uv-damaged DNA. Accordingly, utilities of GAM26 include diagnosis and treatment of the abovementioned diseases and clinical conditions. The function and utilities of UBE2B have been established by previous studies, as described hereinabove with reference to FIG. 26D.

Reference is now made to UFD1L BINDING SITE. Ubiquitin fusion degradation 1-like (UFD1L) is a target gene of GAM26, corresponding to GAM26-TARGET GENE of FIG. 26A. UFD1L BINDING SITE is a binding site found in an untranslated region of UFD1L, corresponding to BINDING SITE of FIG. 26A. FIG. 26D illustrates the complementarity of the nucleotide sequence of UFD1L BINDING SITE, designated SEQ ID:414051, to the nucleotide sequence of GAM26 RNA of FIG. 26A, designated SEQ ID:20604.

A further function of GAM26 is therefore inhibition of ubiquitin fusion degradation 1-like (UFD1L), a gene which encodes a protein that is an essential component of the ubiquitin-dependent proteolytic pathway and is associated with some of the CATCH22-associated developmental defects. Accordingly, utilities of GAM26 include diagnosis and treatment of the abovementioned diseases and clinical conditions.

The function of UFD1L has been established by previous studies. In a search for genes in the 22q11.2 region possibly implicated in the DiGeorge syndrome (188400), Pizutti et al. (1997) identified a gene whose functional features and tissue-specific expression suggested a distinct role in embryogenesis. Symbolized UFD1L by them (for ubiquitin fusion degradation 1-like), the gene encodes the human homolog of the yeast ubiquitin fusion degradation 1 (UFD1) protein that is involved in the degradation of ubiquitin fusion proteins (see 191320). Cloning and characterization of the murine homolog (Ufd1l) showed it to be expressed during embryogenesis in the eyes and in the inner ear primordia. These findings suggested to Pizutti al. (1997) that the proteolytic pathway recognizing ubiquitin fusion proteins for degradation is conserved in vertebrates and that UFD1L gene hemizygosity may be the cause of some of the CATCH22-associated developmental defects. The basic helix-loop-helix transcription factor dHAND (HAND2, 602407) is required for survival of cells in the neural crest-derived branchial and aortic arch arteries and the right ventricle. Mice lacking endothelin-1 (EDN1; 131240) have cardiac and cranial neural crest defects typical of the 22q11 deletion syndrome and display downregulation of dHAND, suggesting that a molecular pathway involving dHAND may be disrupted in that syndrome. The HAND2, EDN1, and ET1 receptor (EDNRA; 131243) genes do not map to 21q11, the DiGeorge syndrome critical region, in humans a screen for mouse genes dependent on dHAND, Yamagishi et al. (1999) identified Ufd1, which maps to human 22q11 and encodes a protein involved in degradation of ubiquitinated proteins. Mouse Ufd1 was specifically expressed in most tissues affected in patients with the DiGeorge (22q11 deletion) syndrome. Yamagishi et al. (1999) found, furthermore that the human UFD1L gene was deleted in all 182 patients studied with the 22q11 deletion, and a smaller deletion of approximately 20 kb that removed exons 1 to 3 of UFD1L was found in 1 individual with features typical of 22q11 deletion syndrome. In the individual with the smaller deletion, patient J. F., Yamagishi et al. (1999) found that the CDC45L gene (603465), which is immediately telomeric of UFD1L, was the site of the deletion in the region between exons 5 and 6 of the 5-prime breakpoint. They considered that the deletion in CDC45L may act as a modifier of the phenotype in patient J. F. UFD1L and CDC45L are transcribed in opposite directions. The deletion left exons 4 to 12 of UFD1L intact; the first 5 exons of CDC45L were deleted. Patient J. F. had nearly all of the features commonly associated with the 2-Mb 22q11 deletion. Four days after birth the patient was diagnosed with interrupted aortic arch, persistent truncus arteriosus, cleft palate, small mouth, low-set ears, broad nasal bridge, neonatal hypocalcemia, T-lymphocyte deficiency, and syndactyly of her toes. The deletion was not present in her parents or in 100 control subjects.

Full details of the abovementioned studies are described in the following publications, the disclosure of which are hereby incorporated by reference:

izutti, A.; Novelli, G.; Ratti, A.; Amati, F.; Mari, A.; Calabrese, G.; Nicolis, S.; Silani, V.; Marino, B.; Scarlato, G.; Ottolenghi, S.; Dallapiccola, B.: UFD1L, a developmentally expressed ubiquitination gene, is deleted in CATCH22 syndrome. Hum. Molec. Genet. 6: 259-265, 1997. PubMed ID: 9063746 2. Yamagishi, H.; Garg, V.; Matsuoka, R.; Thomas, T.; Srivastava, D.: A molecular pathway revealing a genetic basis for human cardiac and craniofacial defects. Science 283: 1158-1161, 1999.

Further studies establishing the function and utilities of UFD1L are found in John Hopkins OMIM database record ID 601754, and in references numbered 1518-1519 listed hereinbelow.

Referring now to UFD1L BINDING SITE. Ubiquitin fusion degradation 1-like (UFD1L) is a target gene of GAM26, corresponding to GAM26-TARGET GENE of FIG. 26A. UFD1L BINDING SITE is a binding site found in an untranslated region of UFD1L, corresponding to BINDING SITE of FIG. 26A. FIG. 26D illustrates the complementarity of the nucleotide sequence of UFD1L BINDING SITE, designated SEQ ID:414052, to the nucleotide sequence of GAM26 RNA of FIG. 26A, designated SEQ ID:20604.

Yet a further function of GAM26 is therefore inhibition of ubiquitin fusion degradation 1-like (UFD1L), a gene which encodes a protein that is an essential component of the ubiquitin-dependent proteolytic pathway and is associated with some of the CATCH22-associated developmental defects. Accordingly, utilities of GAM26 include diagnosis and treatment of the abovementioned diseases and clinical conditions. The function and utilities of UFD1L have been established by previous studies, as described hereinabove with reference to FIG. 26D.

Referring now to UFD1L BINDING SITE. Ubiquitin fusion degradation 1-like (UFD1L) is a target gene of GAM26, corresponding to GAM26-TARGET GENE of FIG. 26A. UFD1L BINDING SITE is a binding site found in an untranslated region of UFD1L, corresponding to BINDING SITE of FIG. 26A. FIG. 26D illustrates the complementarity of the nucleotide sequence of UFD1L BINDING SITE, designated SEQ ID:414064, to the nucleotide sequence of GAM26 RNA of FIG. 26A, designated SEQ ID:20604.

Another function of GAM26 is therefore inhibition of ubiquitin fusion degradation 1-like (UFD1L), a gene which encodes a protein that is essential component of the ubiquitin-dependent proteolytic pathway and is associated with some of the CATCH22-associated developmental defects. Accordingly utilities of GAM26 include diagnosis and treatment of the abovementioned diseases and clinical conditions. The function and utilities of UFD1L have been established by previous studies, as described hereinabove with reference to FIG. 26D.

Reference is now made to UNC119 BINDING SITE. unc119 (C. elegans) homolog (UNC119) is a target gene of GAM26, corresponding to GAM26-TARGET GENE of FIG. 26A. UNC119 BINDING SITE is a binding site found in an untranslated region of UNC119, corresponding to BINDING SITE of FIG. 26A. FIG. 26D illustrates the complementarity of the nucleotide sequence of UNC119 BINDING SITE, designated SEQ ID:414673, to the nucleotide sequence of GAM26 RNA of FIG. 26A, designated SEQ ID:20604.

Yet another function of GAM26 is therefore inhibition of unc119 (C. elegans) homolog (UNC119), a gene which encodes a protein that is expressed in the retina and may play a role in the mechanism of photoreceptor neurotransmitter release through the synaptic vesicle cycle. Accordingly, utilities of GAM26 include diagnosis and treatment of the abovementioned diseases and clinical conditions.

The function of UNC119 has been established by previous studies. Using a subtractive hybridization strategy, Higashide et al. (1996) identified a retina-specific cDNA that they designated HRG4 (human retinal gene-4). Northern blot analysis revealed that the approximately 1.4-kb HRG4 mRNA is expressed specifically in human retina. The authors also cloned a cDNA encoding RRG4, the rat HRG4 homolog. The predicted 240-amino acid human and rat proteins both contain an N-terminal region rich in proline and glycine followed by a region with a mixture of alpha helices, beta sheets, and turns. Sequence comparisons indicated that the proline-glycine domains of RRG4 and HRG4 share only 67% homology, while the rest of the sequence is 100% identical. By in situ hybridization, Higashide et al. (1996) demonstrated that the HRG4 gene is expressed specifically in photoreceptors, both rods and cones, in human retina. In rat, the authors observed high levels of RRG4 expression in the outer retina beginning around postnatal day 5, when the photoreceptors begin to differentiate, and expression increased rapidly to reach the adult level by postnatal day 23. Mutations in the C. elegans unc119 gene lead to defects in locomotion, feeling behavior, and chemosensation. Both Swanson et al. (1998) and Higashide et al. (1998) observed that HRG4 shares strong homology with the C. elegans unc119 protein, leading Swanson et al. (1998) to designate the human protein UNC119. Swanson et al. (1998) stated that a human UNC119 cDNA functionally complemented the C. elegans unc119 mutation. Using immunofluorescence, Higashide et al. (1998) localized HRG4 to the outer plexiform layer of the retina in the synaptic termini of rod and cone photoreceptors. Electron microscopic immunolocalization showed that the protein is present in the cytoplasm and on the presynaptic membranes of the photoreceptor synapses. The authors suggested that HRG4 may play a role in the mechanism of photoreceptor neurotransmitter release through the synaptic vesicle cycle. They noted that the homology of HRG4 and unc119 is consistent with a possible role of HRG4 in the synaptic vesicle cycle, because the broad effects of unc119 on neuronal function are consistent with a defect in neurotransmission.

Full details of the abovementioned studies are described in the following publications, the disclosure of which are hereby incorporated by reference:

Higashide, T.; Murakami, A.; McLaren, M. J.; Inana, G.: Cloning of the cDNA for a novel photoreceptor protein. J. Biol. Chem. 271: 1797-1804, 1996. PubMed ID: 8576185 4. Swanson, D. A.; Chang, J. T.; Campochiaro, P. A.; Zack, D. J.; Valle, D.: Mammalian orthologs of C. elegans unc-119 highly express in photoreceptors. Invest Ophthal. Vis. Sci. 39: 2085-2094, 1998.

Further studies establishing the function and utilities of UNC119 are found in John Hopkins OMIM database record ID 604011, and in referee numbered 1520-1523 listed hereinbelow.

Referring now to UNC119 BINDING SITE. unc119 (C. elegans) homolog (UNC119) is a target gene of GAM26, corresponding to GAM26-TARGET GENE of FIG. 26A. UNC119 BINDING SITE is a binding site found in an untranslated region of UNC119, corresponding to BINDING SITE of FIG. 26A. FIG. 26D illustrates the complementarity of the nucleotide sequence of UNC119 BINDING SITE, designated SEQ ID:414674, to the nucleotide sequence of GAM26 RNA of FIG. 26A, designated SEQ ID:20604.

An additional function of GAM26 is therefore inhibition of unc119 (C. elegans) homolog (UNC119), a gene which encodes a protein that is expressed in the retina and may play a role in the mechanism of photoreceptor neurotransmitter release through the synaptic vesicle cycle. Accordingly, utilities of GAM26 include diagnosis and treatment the abovementioned diseases and clinical conditions. The function and utilities of UNC119 have been established by previous studies, as described hereinabove with reference to FIG. 26D.

Referring now to UNC119 BINDING SITE. unc119 (C. elegans) homolog (UNC119) is a target gene of GAM26, corresponding to GAM26-TARGET GENE of FIG. 26A. UNC119 BINDING SITE is a binding site found in an untranslated region of UNC119, corresponding to BINDING SITE of FIG. 26A. FIG. 26 illustrates the complementarity of the nucleotide sequence of UNC119 BINDING SITE, designated SEQ ID:414696, to the nucleotide sequence of GAM26 RNA of FIG. 26A, designated SEQ ID:20604.

A further function of GAM26 is therefore inhibition of unc119 (C. elegans) homolog (UNC119), a gene which encodes a protein that is expressed in the retina and may play a role in the mechanism of photoreceptor neurotransmitter release through the synaptic vesicle cycle. Accordingly, utilities of GAM26 include diagnosis and treatment of the abovementioned diseases and clinical conditions. The function and utilities of UNC119 have been established by previous studies, as described hereinabove with reference to FIG. 26D.

Reference is now made to USP11 BINDING SITE. Ubiquitin specific protease 11 (USP11) is a target gene of GAM26, corresponding to GAM26-TARGET GENE of FIG. 26A. USP11 BINDING SITE is a binding site found in an untranslated region of USP11, corresponding to BINDING SITE of FIG. 26A. FIG. 26D illustrates the complementarity of the nucleotide sequence of USP11 BINDING SITE, designated SEQ ID:415547, to the nucleotide sequence of GAM26 RNA of FIG. 26A, designated SEQ ID:20604.

Yet a further function of GAM26 is therefore inhibition of ubiquitin specific protease 11 (USP11), a gene which encodes an enzyme that removes ubiquitin from ubiquitin-conjugated proteins. Accordingly, utilities of GAM26 include diagnosis and treatment of the abovementioned diseases and clinical conditions.

The function of USP11 has been established by previous studies. Swanson et al. (1996) used a differential hybridization screen to isolate a novel cDNA from a human retina library. The cDNA encodes a protein of 690 amino acids and has strong homology to the proteins encoded by a variety of ubiquitin hydrolases (p values ranging between 2.4e-265 and 1.4e-13). Swanson et al. (1996) reviewed the role of ubiquitination in protein degradation and presented evidence that disturbances in protein processing and turnover can lead to retinal degeneration. They noted that there are at least 4 X-linked retinal diseases that map to a region within or overlapping the UHX1 interval. They cited evidence indicating that ubiquitin hydrolases play a role in oncogenesis (oncogenes and tumor suppressor gene products are degraded in ubiquitin-dependent pathways) and that the region of loss of heterozygosity in ovarian cancer lies within the mapping interval defined for UHX1. Swanson et al. (1996) mapped the structural gene encoding this cDNA, which they designated UHX1, to Xp21.2-p11.2 by somatic cell hybridization. Stoddart et al. (1999) mapped the UHX1 gene to Xp11.3 by inclusion within a YAC contig Full details of the abovementioned studies are described in the following publications, the disclosure of which are hereby incorporated by reference:

Swanson, D. A.; Freund, C. L.; Ploder, L.; McInnes, R. R.; Valle, D.: A ubiquitin C-terminal hydrolase gene on the proximal short arm of the X chromosome: implications for X-linked retinal disorders. Hum. Molec. Genet. 5: 533-538, 1996. PubMed ID: 8845848 1. Stoddart, K. L.; Jermak, C.; Nagaraja, R.; Schlessinger, D.; Bech-Hansen, N. T.: Physical map covering a 2 Mb region in human Xp11.3 distal to DX6849. Gene 227: 111-116, 1999.

Further studies establishing the function and utilities of USP11 are found in John Hopkins OMIM database record ID 300050, and in references numbered 1524-1525 listed hereinbelow.

Reference is now made to UVRAG BINDING SITE. UV radiation resistance associated gene (UVRAG) is a target gene of GAM26, corresponding to GAM26-TARGET GENE of FIG. 26A. UVRAG BINDING SITE is a binding site found in an untranslated region of UVRAG, corresponding to BINDING SITE of FIG. 26A. FIG. 26D illustrates the complementarity of the nucleotide sequence of UVRAG BINDING SITE, designated SEQ ID:416390, to the nucleotide sequence of GAM26 RNA of FIG. 26A, designated SEQ ID:20604.

Another function of GAM26 is therefore inhibition of UV radiation resistance associated gene (UVRAG), a gene which encodes a protein that confers UV radiation resistance a xeroderma pigmentosum cell line. Accordingly, utilities of GAM26 include diagnosis and treatment of the abovementioned diseases and clinical conditions.

The function of UVRAG has been established by previous studies. Teitz et al. (1990) identified a cDNA that partially complements the ultraviolet (UV) sensitivity of xeroderma pigmentosum complementation group C (see XPC; 278720) cells. Perelman et al. (1997) named this gene 'UV radiation resistance-associated gene' (UVRAG) and reported that the 4.0 kb UVRAG mRNA encodes a predicted 648-amino acid protein. Using cell fractionation studies, they found that the UVRAG protein either is localized within an organelle or is part of the cytoskeleton. Northern blotting showed that UVRAG is expressed ubiquitously in humans; it was also present in most of the vertebrate species tested. By fluorescence in situ hybridization and PCR analysis of somatic cell hybrids, Perelman et al. (1997) mapped the UVRAG gene to 11q13, between D11S916 and D11S906

Full details of the abovementioned studies are described in the following publications, the disclosure of which are hereby incorporated by reference:

Perelman, B.; Dafni, N.; Naiman, T.; Eli, D.; Yaakov, M.; Yang Feng, T. L.; Sinha, S.; Weber, G.; Khodaei, S.; Sancar, A.; Dotan, I.; Canaani, D.: Molecular cloning of a novel human gene encoding a 63-kDa protein and its sublocalization within the 11q13 locus. Genomics 41: 397-405, 1997.

Further studies establishing the function and utilities of UVRAG are found in John Hopkins OMIM database record ID 602493, and in references numbered 1526-1527 listed hereinbelow.

Referring now to UVRAG BINDING SITE. UV radiation resistance associated gene (UVRAG) is a target gene of GAM26, corresponding to GAM26-TARGET GENE of FIG. 26A. UVRAG BINDING SITE is a binding site found in an untranslated region of UVRAG, corresponding to BINDING SITE of FIG. 26A. FIG. 26D illustrates the complementarity of the nucleotide sequence of UVRAG BINDING SITE, designated SEQ ID:416391, to the nucleotide sequence of GAM26 RNA of FIG. 26A, designated SEQ ID:20604.

Yet another function of GAM26 is therefore inhibition of UV radiation resistance associated gene (UVRAG), a gene which encodes a protein that confers UV radiation resistance to a xeroderma pigmentosum cell line. Accordingly, utilities of GAM26 include diagnosis and treatment of the abovementioned diseases and clinical conditions. The function and utilities of UVRAG have been established by previous studies, as described hereinabove with reference to FIG. 26D.

Referring now to UVRAG BINDING SITE. UV radiation resistance associated gene (UVRAG) is a target gene of GAM26, corresponding to GAM26-TARGET GENE of FIG. 26A. UVRAG BINDING SITE is a binding site found in an untranslated region of UVRAG, corresponding to BINDING SITE of FIG. 26A. FIG. 26D illustrates the complementarity of the nucleotide sequence of UVRAG BINDING SITE, designated SEQ ID:416392, to the nucleotide sequence of GAM26 RNA of FIG. 26A, designated SEQ ID:20604.

An additional function of GAM26 is therefore inhibition of UV radiation resistance associated gene (UVRAG), a gene which encodes a protein that confers UV radiation resistance to a xeroderma pigmentosum cell line. Accordingly, utilities of GAM26 include diagnosis and treatment of the abovementioned diseases and clinical conditions. The function and utilities of UVRAG have been established by previous studies, as described hereinabove with reference to FIG. 26D.

Referring now to UVRAG BINDING SITE. UV radiation resistance associated gene (UVRAG) is a target gene of GAM26, corresponding to GAM26-TARGET GENE of FIG. 26A. UVRAG BINDING SITE is a bi ding site found in an untranslated region of UVRAG, corresponding to BINDING SITE of FIG. 26A. FIG. 26D illustrates the complementarity of the nucleotide sequence of UVRAG BINDING SITE, designated SEQ ID:416394, to the nucleotide sequence of GAM26 RNA of FIG. 26A, designated SEQ ID:20604.

A further function of GAM26 is therefore inhibition of UV radiation resistance associated gene (UVRAG), a gene which encodes a protein that confers UV radiation resistance to a xeroderma pigmentosum cell line. Accordingly, utilities of GAM26 include diagnosis and treatment of the abovementioned diseases and clinical conditions. The function and utilities of UVRAG have been established by previous studies, as described hereinabove with reference to FIG. 26D.

Referring now to UVRAG BINDING SITE. UV radiation resistance associated gene (UVRAG) is a target gene of GAM26, corresponding to GAM26-TARGET GENE of FIG. 26A. UVRAG BINDING SITE is a binding site found in an untranslated region of UVRAG, corresponding to BINDING SITE of FIG. 26A. FIG. 26D illustrates the complementarity of the nucleotide sequence of UVRAG BINDING SITE, designated SEQ ID:416396, to the nucleotide sequence of GAM26 RNA of FIG. 26A, designated SEQ ID:20604.

Yet a further function of GAM26 is therefore inhibition of UV radiation resistance associated gene (UVRAG), a gene which encodes a protein that confers UV radiation resistance to a xeroderma pigmentosum cell line. Accordingly, utilities of GAM26 include diagnosis and treatment of the abovementioned diseases and clinical conditions. The function and utilities of UVRAG have been established by previous studies, as described hereinabove with reference to FIG. 26D.

Referring now to UVRAG BINDING SITE. UV radiation resistance associated gene (UVRAG) is a target gene of GAM26, corresponding to GAM26-TARGET GENE of FIG. 26A. UVRAG BINDING SITE is a binding site found in an untranslated region of UVRAG, corresponding to BINDING SITE FIG. 26A. FIG. 26D illustrates the complementarity of the nucleotide sequence of UVRAG BINDING SITE, designated SEQ ID:416411, to the nucleotide sequence of GAM26 RNA of FIG. 26A, designated SEQ ID:20604.

Another function of GAM26 is therefore inhibition of UV radiation resistance associated gene (UVRAG), a gene which encodes a protein that confers UV radiation resistance to a xeroderma pigmentosum cell line. Accordingly, utilities of GAM26 include diagnosis and treatment of the abovementioned diseases and clinical conditions. The function and utilities of UVRAG have been established by previous studies, as described hereinabove with reference to FIG. 26D.

Referring now to UVRAG BINDING SITE. UV radiation resistance associated gene (UVRAG) is a target gene of GAM26, corresponding to GAM26-TARGET GENE of FIG. 26A. UVRAG BINDING SITE is a binding site found in an untranslated region of UVRAG, corresponding to BINDING SITE of FIG. 26A. FIG. 26D illustrates the complementarity of the nucleotide sequence of UVRAG BINDING SITE, designated SEQ ID:416412, to the nucleotide sequence of GAM26 RNA of FIG. 26A, designated SEQ ID:20604.

Yet another function of GAM26 is therefore inhibition of UV radiation resistance associated gene (UVRAG), a gene which encodes a protein that confers UV radiation resistance to a xeroderma pigmentosum cell line. Accordingly, utilities of GAM26 include diagnosis and treatment of the abovementioned diseases and clinical conditions. The function and utilities of UVRAG have been established by previous studies, as described hereinabove with reference to FIG. 26D.

Reference is now made to VAMP5 BINDING SITE. Vesicle-associated membrane protein 5 (myobrevin) (VAMP5) is a target gene of GAM26, corresponding to GAM26-TARGET GENE of FIG. 26A. VAMP5 BINDING SITE is a binding site found in an untranslated region of VAMP5, corresponding to BINDING SITE of FIG. 26A. FIG. 26D illustrates the complementarity of the nucleotide sequence of VAMP5 BINDING SITE, designated SEQ ID:416481, to the nucleotide sequence of GAM26 RNA of FIG. 26A, designated SEQ ID:20604.

An additional function of GAM26 is therefore inhibition of vesicle-associated membrane protein 5 (myobrevin) (VAMP5), a gene which encodes a protein that may participate in trafficking events that are associated with myogenesis. Accordingly, utilities of GAM26 include diagnosis and treatment of the abovementioned diseases and clinical conditions.

The function of VAMP5 has been established by previous studies. By database searching with the mouse synaptobrevin/Vamp2 (185881) sequence as query, Zeng et al. (1998) identified a mouse EST clone for Vamp5. The deduced 102-amino acid protein is predicted to contain a cytoplasmic coiled-coil structure at the N terminus, a hydrophobic domain, and a short hydrophilic C-terminal sequence. Vamp5 shares 33% sequence identity with cellubrevin (VAMP3; 603657) and synaptobrevin/Vamp2. Northern blot analysis detected a major 700-bp transcript in skeletal muscle and heart, with much lower expression in spleen, lung, liver, kidney, and testis, and no expression in brain. An approximately 1.5-kb transcript was detected in testis. By Northern blot analysis of mouse muscle cells in culture, Zeng et al. (1998) found that Vamp5 expression was 8- to 10-fold higher in multinucleated myotubes than in undifferentiated myoblasts. Western blot analysis revealed protein levels 6-fold higher in myotubes than in myoblasts. Immunofluorescence and electron microscopy indicated that Vamp5 localizes to intracellular perinuclear and peripheral vesicular structures of myotubes as well as to the plasma membrane. Vamp5 staining did not colocalize with a Golgi marker, GS28 (GOSR1; 604026), upon treatment of the cell with Golgi-disrupting agents.

Full details of the abovementioned studies are described in the following publications, the disclosure of which are hereby incorporated by reference:

Zeng, Q.; Subramaniam, V. N.; Wong, S. H.; Tang B. L.; Parton, R. G.; Rea, S.; James, D. E.; Hong, W.: A novel synaptobrevin/VAMP homologous protein (VAMP5) is increased during in vitro myogenesis and present in the plasma membrane. Molec. Biol. Cell 9: 2423-2437, 1998.

Further studies establishing the function and utilities of VAMP5 are found in John Hopkins OMIM database record ID 607029, and in references numbered 1528 listed hereinbelow.

Reference is now made to VEGF BINDING SITE. Vascular endothelial growth factor (VEGF) is a target gene of GAM26; corresponding to GAM26-TARGET GENE of FIG. 26A. VEGF BINDING SITE is a binding site found in an untranslated region of VEGF, corresponding to BINDING SITE of FIG. 26A. FIG. 26D illustrates the complementarity of the nucleotide sequence of VEGF BINDING SITE, designated SEQ ID:417797, to the nucleotide sequence of GAM26 RNA of FIG. 26A, designated SEQ ID:20604.

A further function of GAM26 is therefore inhibition of vascular endothelial growth factor (VEGF), a gene which encodes a protein that induces endothelial cell proliferation and vascular permeability and is associated with tumors. Accordingly, utilities of GAM26 include diagnosis and treatment of the abovementioned diseases and clinical conditions.

The function of VEGF has been established by previous studies. To explore the possibility that VEGF and angiopoietins (see ANG2, 60192) collaborate during tumor angiogenesis, Holash et al. (1999) analyzed several different murine and human tumor models. Holash et al. (1999) noted that angiopoietin-1 (ANG1; 601667) was antiapoptotic for cultured endothelial cells and expression of its antagonist angiopoietin-2 was induced in the endothelium of co-opted tumor vessels before their regression. In contrast, marked induct on of VEGF expression occurred much later in tumor progression, in the hypoxic periphery of tumor cells surrounding the few remaining internal vessels, as well as adjacent to the robust plexus of vessels at the tumor margin. Expression of Ang2 in the few surviving internal vessels and in the angiogenic vessels at the tumor margin suggested that the destabilizing action of angiopoietin-2 facilitates the angiogenic action of VEGF at the tumor rim. Holash et al. (1999) implanted rat RBA mammary adenocarcinoma cells into rat brains. Tumor cells rapidly associated with and migrated along cerebral blood vessels. There was minimal upregulation of VEGF. Holash et al. (1999) suggested that a subset of tumors rapidly co-opts existing host vessels to form an initially well vascularized tumor mass. Perhaps as part of a host defense mechanism there is widespread regression of these initially co-opted vessels, leading to a secondarily avascular tumor and a massive tumor cell loss. However, the remaining tumor is ultimately rescued by robust angiogenesis at the tumor margin.

Animal model experiments lend further support to the function of VEGF. De Fraipont et al. (2000) measured the cytosolic concentrations of 3 proteins involved in angiogenesis, namely, platelet-derived endothelial cell growth factor (PDECGF; 131222), VEGFA, and thrombospondin-1 (THBS1; 188060) in a series of 43 human sporadic adrenocortical tumors. The tumors were classified as adenomas, transitional tumors, or carcinomas. PDECGF/thymidine phosphorylase levels were not significantly different among these 3 groups. One hundred percent of the adenomas and 73% of the transitional tumors showed VEGFA concentrations under the threshold value of 107 ng/g protein, whereas 75% of the carcinomas had VEGFA concentrations above this threshold value. Similarly, 89% of the adenomas showed THBS1 concentrations above the threshold value of 57 microg/g protein, whereas only 25% of the carcinomas and 33% of the transitional tumor samples did so. IGF2 (147470) overexpression, a common genetic alteration of adrenocortical carcinomas, was significantly correlated with higher VEGFA and lower THBS1 concentrations. The authors concluded that a decrease in THBS1 expression is an event that precedes an increase in VEGFA expression during adrenocortical tumor progression. The population of premalignant tumors with low THBS1 and normal VEGFA levels could represent a selective target for antiangiogenic therapies.

It is appreciated that the abovementioned animal model for VEGF is acknowledged by those skilled in the art as a scientifically valid animal model, as can be further appreciated from the publications sited hereinbelow.

Full details of the abovementioned studies are described in the following publications, the disclosure of which are hereby incorporated by reference:

Holash, J.; Maisonpierre, P. C.; Compton, D.; Boland, P.; Alexander, C. R.; Zagzag, D.; Yancopoulos, G. D.; Wiegand, S. J.: Vessel cooption, regression, and growth in tumors mediated by angiopoietins and VEGF. Science 284: 1994-1998, 1999. PubMed ID: 10373119 de Fraipont, F.; El Atifi, M.; Gicquel, C.; Bertagna, X.; Chambaz, E. M.; Feige, J. J.: Expression of the angiogenesis markers vascular endothelial growth factor-A, thrombospondin-1, and platelet-derived endothelial cell growth factor in human sporadic adrenocortical tumors: correlation with genotypic alterations. J. Clin. Endocr. Metab. 85: 4734-4741, 2000.

Further studies establishing the function and utilities of VEGF are found in John Hopkins OMIM data base record ID 192240, and in references numbered 1529-1566 listed hereinbelow.

Reference is now made to WHSC1L1 BINDING SITE. Wolf-Hirschhorn syndrome candidate 1-like 1 (WHSC1L1) is a target gene of GAM26, corresponding to GAM26-TARGET GENE of FIG. 26A. WHSC1L1 BINDING SITE is a binding site found in an untranslated region of WHSC1L1, corresponding to BINDING SITE of FIG. 26A. FIG. 26D illustrates the complementarity of the nucleotide sequence of WHSC1L1 BINDING SITE, designated SEQ ID:422800, to the nucleotide sequence of GAM26 RNA of FIG. 26A, designated SEQ ID:20604.

Yet a further function of GAM26 is therefore inhibition of Wolf-Hirschhorn syndrome candidate 1-like 1 (WHSC1L1), a gene which encodes a protein that restores repair of base-base and single-nucleotide insertion-deletion mismatches, and increases the proficiency to process heteroduplexes with insertion-deletion mismatches. Accordingly, utilities of GAM26 include diagnosis and treatment of the abovementioned diseases and clinical conditions.

The function of WHSC1L1 has been established by previous studies. By EST database searching with mouse Nsd1 (606681) and human NSD2 (WHSC1; 602952) as probe and screening of an amnion cell cDNA library, Angrand et al. (2001) cloned a partial sequence for WHSC1L1, which they called NSD3. They obtained the full-length cDNA by 5-prime RACE. The deduced 1,437- amino acid protein contains 2 PWWP domains involved in protein-protein interaction, 5 PHD-type zinc finger motifs found in chromatin-associated proteins, a SAC (SET-associated cys-rich) domain, a SET domain, and a C-terminal C5HCH domain. They also identified a variant, arising from alternative polyadenylation and exon splicing, that encodes a deduced 645-amino acid peptide. The short isoform contains a single PWWP domain. By PCR analysis, Angrand et al. (2001) found the 2 variants, as well as a third, 1,388-amino acid peptide, in HeLa cells. WHSC1L1 shares 68% and 55% identity with mouse Nsd1 (606681) and human WHSC1 (602952), respectively, over a 700-amino acid block containing the SAC, SET, and C5HCH domains. Northern blot analysis detected an 8.5-kb transcript in all tissues examined, with highest expression in brain, heart, and skeletal muscle, and lower expression in liver and lung. Angrand et al. (2001) determined that the WHSC1L1 gene contains 24 exons and spans over 90 kb. By FISH, Angrand et al. (2001) mapped the WHSC1L1 gene to chromosome 8p12. Stec et al. (2001) identified a pseudogene (WHSC1L2P) on chromosome 17q21. Rosati et al. (2002) described fusion between the NUP98 gene (601021) and the NSD3 gene in a patient with acute myeloid leukemia associated with t(8;11)(p11.2;p15). FISH analysis revealed a split of a specific BAC which showed the fusion partner at 8p11.2 to be NSD3.

Full details of the abovementioned studies are described in the following publications, the disclosure of which are hereby incorporated by reference:

Angrand, P. -O.; Apiou, F.; Stewart, A. F.; Dutrillaux, B.; Losson, R.; Chambon, P.: NSD3, a new SET domain-containing gene, maps to 8p12 and is amplified in human breast cancer ell lines. Genomics 74: 79-88, 2001. PubMed ID: 11374904 2. Rosati, R.; La Starza, R.; Veronese, A.; Aventin, A.; Schwienbacher, C.; Vallespi, T.; Negrini, M.; Martelli, M. F.; Mecucci, C.: NUP98 is fused to the NSD3 gene in acute myeloid leukemia associated with t(8;11)(p11.2;p15). Blood 99: 3857-3860, 2002.

Further studies establishing the function and utilities of WHSC1L1 are found in John Hopkins OMIM database record ID 607083, and in references numbered 1567 and 1568 listed hereinbelow.

Referring now to WHSC1L1 BINDING SITE. Wolf-Hirschhorn syndrome candidate 1-like 1 (WHSC1L1) is a target gene of GAM26, corresponding to GAM26-TARGET GENE of FIG. 26A. WHSC1L1 BINDING SITE is a binding site found in an untranslated region of WHSC1L1, corresponding to BINDING SITE of FIG. 26A. FIG. 26D illustrates the complementarity of the nucleotide sequence of WHSC1L1 BINDING SITE, designated SEQ ID:422801, to the nucleotide sequence of GAM26 RNA of FIG. 26A, designated SEQ ID:20604.

Another function of GAM26 is therefore inhibition of Wolf-Hirschhorn syndrome candidate 1-like 1 (WHSC1L1), a gene which encode a protein that restores repair of base-base and single-nucleotide insertion-deletion mismatches, and increases the proficiency to process heteroduplexes with insertion deletion mismatches. Accordingly, utilities of GAM26 include diagnosis and treatment of the abovementioned diseases and clinical conditions. The function and utilities of WHSC1L1 have been established by previous studies, as described hereinabove with reference to FIG. 26D.

Referring now to WHSC1L1 BINDING SITE. Wolf-Hirschhorn syndrome candidate 1-like 1 (WHSC1L1) is a target gene of GAM26, corresponding to GAM26-TARGET GENE of FIG. 26A. WHSC1L1 BINDING SITE is a binding site found in an untranslated region of WHSC1L1, corresponding to BINDING SITE of FIG. 26A. FIG. 26D illustrates the complementarity of the nucleotide sequence of WHSC1L1 BINDING SITE, designated SEQ ID:422875, to the nucleotide sequence of GAM26 RNA of FIG. 26A, designated SEQ ID:20604.

Yet another function of GAM26 is therefore inhibition of Wolf-Hirschhorn syndrome candidate 1-like 1 (WHSC1L1), a gene which encodes a protein that restores repair of base-base and single-nucleotide insertion-deletion mismatches, and increases the proficiency to process heteroduplexes with insertion deletion mismatches. Accordingly, utilities of GAM26 include diagnosis and treatment of the abovementioned diseases and clinical conditions. The function and utilities of WHSC1L1 have been established by previous studies, as described hereinabove with reference to FIG. 26D.

Reference is now made to YWHAH BINDING SITE. Tyrosine 3-monooxygenase/tryptophan 5-monooxygenase activation protein (YWHAH) is a target gene of GAM26, corresponding to GAM26-TARGET GENE of FIG. 26A. YWHAH BINDING SITE is a binding site found in an untranslated region of YWHAH, corresponding to BINDING SITE of FIG. 26A. FIG. 26D illustrates the complementarity of the nucleotide sequence of YWHAH BINDING SITE, designate SEQ ID:426949, to the nucleotide sequence of GAM26 RNA of FIG. 26A, designated SEQ ID:20604.

An additional function of GAM26 is therefore inhibition of tyrosine 3-monooxygenase/tryptophan 5-monooxygenase activation protein (YWHAH), a gene which encodes a protein that activates tyrosine and tryptophan hydroxylases in the presence of and strongly activates protein kinase c. Accordingly, utilities of GAM26 include diagnosis and treatment of the abovementioned diseases and clinical conditions.

The function of YWHAH has been established by previous studies. Protein 14-3-3 is a protein kinase-dependent activator of tyrosine and tryptophan hydroxylases (191290, 191060) and an endogenous inhibitor of protein kinase C (176960). It was first described as a brain-specific bovine protein. It consists of acidic dimeric subunits of about 27 kD. Immunohistochemical analyses showed that the 14-3-3 protein is located exclusively in the cytoplasm of neurons in the cerebral cortex and is axonally transported to the nerve terminals. Electrophoresis and chromatography demonstrated that the 14-3-3 protein exists in at least 7 distinct forms: alpha, beta, gamma, delta, epsilon, zeta, and eta. Watanabe et al. (1994) found mRNA corresponding to an eighth subtype, which they termed theta, in rat brain. The mRNA theta subtype was found in the gray matter of cerebellar cortex and the hippocampus, as well as in white matter where cell bodies of glial cells predominate. In contrast, mRNA of the zeta subtype was distributed widely in the brain gray matter with high levels of transcripts in the neocortex, hippocampus, caudate-putamen, thalamus, cerebellar cortex, and several brain stem nuclei. A human protein with phospholipase A2 activity was shown to be the zeta subtype of the 14-3-3 protein (Zupan et al., 1992). The gene is also symbolized YWHAH. Muratake et al. (1996) determined that the human YWHAH gene has 2 exons separated by an intron of approximately 8 kb. Using S1 nuclease mapping, primer extension, and RACE PCR, Muratake et al. (1996) identified the transcription initiation site. They also identified several regulatory element sequences, including CRE, in the 5-prime noncoding region. Muratake et al. (1996) noted that the presence of a CRE binding element may indicate that this gene is involved in brain responses to narcotics. The authors also found changes in a 7-bp repeat sequence (GCCTGCA) located in the noncoding region of exon 1 and they speculated that these changes, or other changes in the sequence of this gene, may be associated with neuropsychiatric disorders.

Full details of the abovementioned studies are described in the following publications, the disclosure of which are hereby incorporated by reference:

Muratake, T.; Hayashi, S.; Ichikawa, T.; Kumanishi, T.; Ichimura, Y.; Kuwano, R.; Isobe, T.; Wang, Y.; Minoshima, S.; Shimizu, N.; Takahashi, Y.: Structural organization and chromosomal assignment of the human 14-3-3-eta chain gene (YWHAH). Genomics 36: 63-69, 1996. PubMed ID: 8812417 6. Zupan, L. A.; Steffens, D. L.; Berry, C. A.; Landt, M.; Gross, R. W.: Cloning and express on of a human 14-3-3 protein mediating phospholipolysis. J. Biol. Chem. 267: 8707-8710, 1992.

Further studies establishing the function and utilities of YWHAH are found in John Hopkins OMIM database record ID 113508, and in references numbered 1569-1574 listed hereinbelow.

Referring now to ZNF6 BINDING SITE. Zinc finger protein 6 (CMPX1) (ZNF6) is a target gene of GAM26, corresponding to GAM26-TARGET GENE of FIG. 26A. ZNF6 BINDING SITE is a binding site found in an untranslated region of ZNF6, corresponding to BINDING SITE of FIG. 26A. FIG. 26D illustrates the complementarity of the nucleotide sequence of ZNF6 BINDING SITE, designated SEQ ID:432632, to the nucleotide sequence of GAM26 RNA of FIG. 26A, designated SEQ ID:20604.

A further function of GAM26 is therefore inhibition of zinc finger protein 6 (CMPX1) (ZNF6), a gene which encodes a protein that is probably a transcriptional activator. Accordingly, utilities of GAM26 include diagnosis and treatment of the abovementioned diseases and clinical conditions. The function and utilities of ZNF6 have been established by previous studies, as described hereinabove with reference to FIG. 26D.

Referring now to ZNF6 BINDING SITE. Zinc finger protein 6 (CMPX1) (ZNF6) is a target gene of GAM26, corresponding to GAM26-TARGET GENE of FIG. 26A. ZNF6 BINDING SITE is a binding site found in an untranslated region of ZNF6, corresponding to BINDING SITE of FIG. 26A. FIG. 26D illustrates the complementarity of the nucleotide sequence of ZNF6 BINDING SITE, designated SEQ ID:432637, to the nucleotide sequence of GAM26 RNA of FIG. 26A, designated SEQ ID:20604.

Yet a further function of GAM26 is therefore inhibition of zinc finger protein 6 (CMPX1) (ZNF6), a gene which encodes a protein that is probably a transcriptional activator. Accordingly, utilities of GAM26 include diagnosis and treatment of the abovementioned diseases and clinical conditions. The function and utilities of ZNF6 have been established by previous studies, as described hereinabove with reference to FIG. 26D.

Referring now to ADARB1 BINDING SITE. Adenosine deaminase, RNA-specific, B1 (homolog of rat RED1) (ADARB1) is a target gene of GAM26, corresponding to GAM26-TARGET GENE of FIG. 26A. ADARB1 BINDING SITE is a binding site found in an untranslated region of ADARB1, corresponding to BINDING SITE of FIG. 26A. FIG. 26D illustrates the complementarity of the nucleotide sequence of ADARB1 BINDING SITE, designated SEQ ID:432641, to the nucleotide sequence of GAM26 RNA of FIG. 26A, designated SEQ ID:20604.

Another function of GAM26 is therefore inhibition of adenosine deaminase, RNA-specific, B1 (homolog of rat RED1) (ADARB1), a gene which encodes an enzyme that RNA editing involves the deamination of adenosines at specific sites. Accordingly, utilities of GAM26 include diagnosis and treatment of the abovementioned diseases and clinical conditions. The function and utilities of ADARB1 have been established by previous studies, as described hereinabove with reference to FIG. 26D.

Referring now to BCL11B BINDING SITE. B-cell CLL/lymphoma 11B (zinc finger protein) (BCL11B) is a target gene of GAM26, corresponding to GAM26-TARGET GENE of FIG. 26A. BCL11B BINDING SITE is a binding site found in an untranslated region of BCL11B, corresponding to BINDING SITE of FIG. 26A. FIG. 26D illustrates the complementarity of the nucleotide sequence of BCL11B BINDING SITE, designated SEQ ID:432641, to the nucleotide sequence of GAM25 RNA of FIG. 26A, designated SEQ ID:20604.

Yet another function of GAM26 is therefore inhibition of B-cell CLL/lymphoma 11B (zinc finger protein) (BCL11B), a gene which encodes a protein that is implicated in mouse and human leukemias and is associated with T-cell leukemia/lymphoma. Accordingly, utilities of GAM26 include diagnosis and treatment of the abovementioned diseases and clinical conditions. The function and utilities of BCL11B have been established by previous studies, as described hereinabove with reference to FIG. 26D.

Referring now to BCR BINDING SITE. Breakpoint cluster region (BCR) is a target gene of GAM26, corresponding to GAM26-TARGET GENE of FIG. 26A. BCR BINDING SITE is a binding site found in an untranslated region of BCR, corresponding to BINDING SITE of FIG. 26A. FIG. 26D illustrates the complementarity of the nucleotide sequence of BCR BINDING SITE, designated SEQ ID:432641, to the nucleotide sequence of GAM26 RNA of FIG. 26A, designated SEQ ID:20604.

An additional function of GAM26 is therefore inhibition of breakpoint cluster region (BCR), a gene which encodes a protein that is a serine/threonine kinase that involves in the t(9;22) translocation (Philadelphia chromosome) and is associated with chronic myeloid leukemia (cml), acute myeloid leukemia (aml), acute lymphoblastic leukemia (all). Accordingly, utilities of GAM26 include diagnosis and treatment of the abovementioned diseases and clinical conditions. The function and utilities of BCR have been established by previous studies, as described hereinabove with reference to FIG. 26D.

Referring now to BCR BINDING SITE. Breakpoint cluster region (BCR) is a target gene of GAM26, corresponding to GAM26-TARGET GENE of FIG. 26A. BCR BINDING SITE is a binding site found in an untranslated region of BCR, corresponding to BINDING SITE of FIG. 26A. FIG. 26D illustrate the complementarity of the nucleotide sequence of BCR BINDING SITE, designated SEQ ID:432641, to the nucleotide sequence of GAM26 RNA of FIG. 26A, designated SEQ ID:20604.

A further function of GAM26 is therefore inhibition of breakpoint cluster region (BCR), a gene which encodes a protein that is a serine/threonine kinase that involves in the t(9;22) translocation (Philadelphia chromosome) and is associated with chronic myeloid leukemia (cml), acute myeloid leukemia (aml) acute lymphoblastic leukemia (all). Accordingly, utilities of GAM26 include diagnosis and treatment of the abovementioned diseases and clinical conditions. The function and utilities of BCR have been established by previous studies, as described hereinabove with reference to FIG. 26D.

Referring now to ZNF6 BINDING SITE. Zinc finger protein 6 (CMPX1) (ZNF6) is a target gene of GAM26, corresponding to GAM26-TARGET GENE of FIG. 26A. ZNF6 BINDING SITE is a binding site found in an untranslated region of ZNF6, corresponding to BINDING SITE of FIG. 26A. FIG. 26D illustrates the complementarity of the nucleotide sequence of ZNF6 BINDING SITE, designated SEQ ID:432641, to the nucleotide sequence of GAM26 RNA of FIG. 26A, designated SEQ ID:20604.

Yet a further function of GAM26 is therefore inhibition of zinc finger protein 6 (CMPX1) (ZNF6), a gene which encodes a protein that is probably a transcriptional activator. Accordingly, utilities of GAM26 include diagnosis and treatment of the abovementioned diseases and clinical conditions. The function and utilities of ZNF6 have been established by previous studies, as described hereinabove with reference to FIG. 26D.

Referring now to ZNF6 BINDING SITE. Zinc finger protein 6 (CMPX1) (ZNF6) is a get gene of GAM26, corresponding to GAM2-TARGET GENE of FIG. 26A. ZNF6 BINDING SITE is a binding site found in an untranslated region of ZNF6, corresponding to BINDING SITE of FIG. 26A. FIG. 26D illustrates the complementarity of the nucleotide sequence of ZNF6 BINDING SITE, designated SEQ ID:432642, to the nucleotide sequence of GAM26 RNA of FIG. 26A, designated SEQ ID:20604.

Another function of GAM26 is therefore inhibition of zinc finger protein 6 (CMPX1) (ZNF6), a gene which encodes a protein that is probably a transcriptional activator. Accordingly, utilities of GAM26 include diagnosis and treatment of the abovementioned diseases and clinical conditions. The function and utilities of ZNF6 have been established by previous studies, as described hereinabove, with reference to FIG. 26D.

Referring now to ADARB1 BINDING SITE. Adenosine deaminase, RNA-specific, B1 (homolog of rat RED1) (ADARB1) is a target gene of GAM26, corresponding to GAM26-TARGET GENE of FIG. 26A. ADARB1 BINDING SITE is a binding site found in an untranslated region of ADARB1, corresponding to BINDING SITE of FIG. 26A. FIG. 26D illustrates the complementarity of the nucleotide sequence of ADARB1 BINDING SITE, designated SEQ ID:432644, to the nucleotide sequence of GAM26 RNA of FIG. 26A, designated SEQ ID:20604.

Yet another function of GAM26 is therefore inhibition of adenosine deaminase, RNA-specific, B1 (homolog of rat RED1) (ADARB1), a gene which encodes a Enzyme that RNA editing involves the deamination of adenosines at specific sites. Accordingly, utilities of GAM26 include diagnosis and treatment of the abovementioned diseases and clinical conditions. The function and utilities of ADARB1 have been established by previous studies, as described hereinabove with reference to FIG. 26D.

Referring now to BCL11B BINDING SITE. B-cell CLL/lymphoma 11B (zinc finger protein) (BCL11B) is a target gene of GAM26, corresponding to GAM26-TARGET GENE of FIG. 26A. BCL11B BINDING SITE is a binding site found in an untranslated region of BCL11B, corresponding to BINDING SITE of FIG. 26A. FIG. 26D illustrates the complementarity of the nucleotide sequence of BCL11B BINDING SITE, designated SEQ ID:432644, to the nucleotide sequence of GAM26 RNA of FIG. 26A, designated SEQ ID:20604.

An additional function of GAM26 is therefore inhibition of B-cell CLL/lymphoma 11B (zinc finger protein) (BCL11B), a gene which encodes a protein that is implicated in mouse and human leukemias and is associated with T-cell leukemia/lymphoma. Accordingly, utilities of GAM26 include diagnosis and treatment of the abovementioned diseases and clinical conditions. The function and utilities of BCL11B have been established by previous studies, as described hereinabove with reference to FIG. 26D.

Referring now to BCR BINDING SITE. Breakpoint cluster region (BCR) is a target gene of GAM26, corresponding to GAM26-TARGET GENE of FIG. 26A. BCR BINDING SITE is a binding site found in an untranslated region of BCR, corresponding to BINDING SITE of FIG. 26A. FIG. 26D illustrates the complementarity of the nucleotide sequence of BCR BINDING SITE, designated SEQ ID:432644, to the nucleotide sequence of GAM26 RNA of FIG. 26A, designated SEQ ID:20604.

A further function of GAM26 is therefore inhibition of breakpoint cluster region (BCR), a gene which encodes a protein that is a serine/threonine kinase that involves in the t(9;22) translocation (Philadelphia chromosome) and is associated with chronic myeloid leukemia (cml), acute myeloid leukemia (aml), acute lymphoblastic leukemia (all). Accordingly, utilities of GAM26 include diagnosis and treatment of the abovementioned diseases and clinical conditions. The function and utilities of BCR have been established by previous studies, as described hereinabove with reference to FIG. 26D.

Referring now to BCR BINDING SITE. Breakpoint cluster region (BCR) is a target gene of GAM26, corresponding to GAM26-TARGET GENE of FIG. 26A. BCR BINDING SITE is a binding site found in an untranslated region of BCR, corresponding to BINDING SITE of FIG. 26A. FIG. 26D illustrates the complementarity of the nucleotide sequence of BCR BINDING SITE, designated SEQ ID:432644, to the nucleotide sequence of GAM26 RNA of FIG. 26A, designated SEQ ID:20604.

Yet a further function of GAM26 is therefore inhibition of breakpoint cluster region (BCR), a gene which encodes a protein that is a serine/threonine kinase that involves in the t(9;22) translocation (Philadelphia chromosome) and is associated with chronic myeloid leukemia (cml), acute myeloid leukemia (aml), acute lymphoblastic leukemia (all). Accordingly, utilities of GAM26 include diagnosis and treatment of the abovementioned diseases and clinical conditions. The function and utilities of BCR have been established by previous studies, as described hereinabove with reference to FIG. 26D.

Referring now to REPS2 BINDING SITE. RALBP1 associated Eps domain containing 2 (REPS2) is a target gene of GAM26, corresponding to GAM26-TARGET GENE of FIG. 26A. REPS2 BINDING SITE is a binding site found in an untranslated region of REPS2, corresponding to BINDING SITE of FIG. 26A. FIG. 26D illustrates the complementarity of the nucleotide sequence of REPS2 BINDING SITE, designated SEQ ID:432644, to the nucleotide sequence of GAM26 RNA of FIG. 26A, designated SEQ ID:20604.

Another function of GAM26 is therefore inhibition of RALBP1 associated Eps domain containing 2 (REPS2), a gene which encodes a protein that interacts with the active form of RAS with adaptor protein GRB2 and binds calcium. Accordingly, utilities of GAM26 include diagnosis and treatment of the abovementioned diseases and clinical conditions. The function and utilities of REPS2 have been established by previous studies, as described hereinabove with reference to FIG. 26D.

Referring now to ZNF6 BINDING SITE. Zinc finger protein 6 (CMPX1) (ZNF6) is a target gene of GAM26, corresponding to GAM26-TARGET GENE of FIG. 26A. ZNF6 BINDING SITE is a binding site found in an untranslated region of ZNF6, corresponding to BINDING SITE of FIG. 26A. FIG. 26D illustrates the complementarity of the nucleotide sequence of ZNF6 BINDING SITE, designated SEQ ID:432644, to the nucleotide sequence of GAM26 RNA of FIG. 26A, designated SEQ ID:20604.

Yet another function of GAM26 is therefore inhibition of zinc finger protein 6 (CMPX1) (ZNF6), a gene which encodes a protein that is probably a transcriptional activator. Accordingly, utilities of GAM26 include diagnosis and treatment of the abovementioned diseases and clinical conditions. The function and utilities of ZNF6 have been established by previous studies, as described hereinabove with reference to FIG. 26D.

Referring now to ZNF6 BINDING SITE. Zinc finger protein 6 (CMPX1) (ZNF6) is a target gene of GAM26, corresponding to GAM26-TARGET GENE of FIG. 26A. ZNF6 BINDING SITE is a binding site found in an untranslated region of ZNF6, corresponding to BINDING SITE of FIG. 26A. FIG. 26D illustrates the complementarity of the nucleotide sequence of ZNF6 BINDING SITE, designated SEQ ID:432645, to the nucleotide sequence of GAM26 RNA of FIG. 26A, designated SEQ ID:20604.

An additional function of GAM26 is therefore inhibition of zinc finger protein 6 (CMPX1) (ZNF6), a gene which encodes a protein that is probably a transcriptional activator. Accordingly, utilities of GAM26 include diagnosis and treatment of the abovementioned diseases and clinical conditions. The function and utilities of ZNF6 have been established by previous studies, as described hereinabove with reference to FIG. 26D.

Referring now to ZNF6 BINDING SITE. Zinc finger protein 6 (CMPX1) (ZNF6) is a target gene of GAM26, corresponding to GAM26-TARGET GENE of FIG. 26A. ZNF6 BINDING SITE is a binding site found in an untranslated region of ZNF6, corresponding to BINDING SITE of FIG. 26A. FIG. 26D illustrates the complementarity of the nucleotide sequence of ZNF6 BINDING SITE, designated SEQ ID:432654, to the nucleotide sequence of GAM26 RNA of FIG. 26A, designated SEQ ID:20604.

A further function of GAM26 is therefore inhibition of zinc finger protein 6 (CMPX1) (ZNF6), a gene which encodes a protein that is probably a transcriptional activator. Accordingly, utilities of GAM26 include diagnosis and treatment of the abovementioned diseases and clinical conditions. The function and utilities of ZNF6 have been established by previous studies, as described hereinabove with reference to FIG. 26D.

Referring now to ZNF6 BINDING SITE. Zinc finger protein 6 (CMPX1) (ZNF6) is a target gene of GAM26, corresponding to GAM26-TARGET GENE of FIG. 26A. ZNF6 BINDING SITE is a binding site found in an untranslated region of ZNF6, corresponding to BINDING SITE of FIG. 26A. FIG. 26D illustrates the complementarity of the nucleotide sequence of ZNF6 BINDING SITE, designated SEQ ID:432654, to the nucleotide sequence of GAM26 RNA of FIG. 26A, designated SEQ ID:20604.

Yet a further function of GAM26 is therefore inhibition of zinc finger protein 6 (CMPX1) (ZNF16), a gene which encodes a protein that is probably a transcriptional activator. Accordingly, utilities of GAM26 include diagnosis and treatment of the abovementioned diseases and clinical conditions. The function and utilities of ZNF6 have been established by previous studies, as described hereinabove with reference to FIG. 26D.

Referring now to ZNF6 BINDING SITE. Zinc finger protein 6 (CMPX1) (ZNF6) is a target gene of GAM26, corresponding to GAM26-TARGET GENE of FIG. 26A. ZNF6 BINDING SITE is a binding site found in an untranslated region of ZNF6, corresponding to BINDING SITE of FIG. 26A. FIG. 26D illustrates the complementarity of the nucleotide sequence of ZNF6 BINDING SITE, designated SEQ ID:432655, to the nucleotide sequence of GAM26 RNA of FIG. 26A, designated SEQ ID:20604.

Another function of GAM26 is therefore inhibition of zinc finger protein 6 (CMPX1) (ZNF6), a gene which encodes a protein is probably a transcriptional activator. Accordingly, utilities of GAM26 include diagnosis and treatment of the abovementioned diseases and clinical condition. The function and utilities of ZNF6 have been established by previous studies, as described hereinabove with reference to FIG. 26D.

Referring now to RELN BINDING SITE. Reelin (RELN) is a target gene of GAM26, corresponding to GAM26-TARGET GENE of FIG. 26A. RELN BINDING SITE is a binding site found in an untranslated region of RELN, corresponding to BINDING SITE of FIG. 26A. FIG. 26D illustrates the complementarity of the nucleotide sequence of RELN BINDING SITE, designated SEQ ID:547115, to the nucleotide sequence of GAM26 RNA of FIG. 26A, designated SEQ ID:20604.

Yet another function of GAM26 is therefore inhibition of reelin (RELN), a gene which encodes transcription factor that is associated with Norman-Roberts syndrome. Accordingly, utilities of GAM26 include diagnosis and treatment of the abovementioned diseases and clinical conditions. The function and utilities of RELN have been established by previous studies, as described hereinabove with reference to FIG. 26D.

Referring now to DR1 BINDING SITE. Down-regulator of transcription 1, TBP-binding (negative cofactor 2) (DR1) is a et gene of GAM26, corresponding to GAM26-TARGET GENE of FIG. 26A. DR1 BINDING SITE is a binding site found in an untranslated region of DR1, corresponding to BINDING SITE of FIG. 26A. FIG. 26D illustrates the complementarity of the nucleotide sequence of DR1 BINDING SITE, designated SEQ ID:625767, to the nucleotide sequence of GAM26 RNA of FIG. 26A, designated SEQ ID:20604.

An additional function of GAM26 is therefore inhibition of down-regulator of transcription 1, TBP-binding (negative cofactor 2) (DR1), a gene which encodes a protein that influences functional repression of both activated and basal transcription of class II genes. Accordingly, utilities of GAM26 include diagnosis and treatment of the abovementioned diseases and clinical conditions. The function and utilities of DR1 have been established by previous studies, as described hereinabove with reference to FIG. 26D.

Referring now to SOX10 BINDING SITE. SRY (sex determining region Y)-box 10 (SOX10) is a target gene of GAM26, corresponding to GAM26-TARGET GENE of FIG. 26A. SOX10 BINDING SITE is a binding site found in an untranslated region of SOX10, corresponding to BINDING SITE of FIG. 26A. FIG. 26D illustrates the complementarity of the nucleotide sequence of SOX10 BINDING SITE, designated SEQ ID:717573, to the nucleotide sequence of GAM26 RNA of FIG. 26A, designated SEQ ID:20604.

A further function of GAM26 is therefore inhibition of SRY (sex determining region Y)-box 10 (SOX10), a gene which encodes a transcription factor that is associated with Waardenburg syndrome type 4. Accordingly utilities of GAM26 include diagnosis and treatment of the abovementioned diseases and clinical conditions. The function and utilities of SOX10 have been established by previous studies, as described hereinabove with reference to FIG. 26D.

Referring now to ADRBK1 BINDING SITE. Adrenergic beta, receptor kinase 1 (ADRBK1) is a target gene of GAM26, corresponding to GAM26-TARGET GENE of FIG. 26A. ADRBK1 BINDING SITE is a binding site found in an untranslated region of ADRBK1, corresponding to BINDING SITE of FIG. 26A. FIG. 26D illustrates the complementarity of the nucleotide sequence of ADRBK1 BINDING SITE, designated SEQ ID:816521, to the nucleotide sequence of GAM26 RNA of FIG. 26A, designated SEQ ID:20604.

Yet a further function of GAM26 is therefore inhibition of adrenergic, beta, receptor kinase 1 (ADRBK1), a gene which encodes a Enzyme that regulates desensitization of b-adrenergic receptors and related GPCRs. Accordingly, utilities of GAM26 include diagnosis and treatment of the abovementioned diseases and clinical conditions. The function and utilities of ADRBK1 have been established by previous studies, as described hereinabove with reference to FIG. 26D.

Referring now to PEA15 BINDING SITE. Phosphoprotein enriched in astrocytes 15 (PEA15) is a target gene of GAM26, corresponding to GAM26-TARGET GENE of FIG. 26A. PEA15 BINDING SITE is a binding site found in an untranslated region of PEA15, corresponding to BINDING SITE of FIG. 26A. FIG. 26D illustrates the complementarity of the nucleotide sequence of PEA15 BINDING SITE, designated SEQ ID:816521, to the nucleotide sequence of GAM26 RNA of FIG. 26A, designated SEQ ID:20604.

Another function of GAM26 is therefore inhibition of phosphoprotein enriched in astrocytes 15 (PEA15), a gene which encodes a protein that is a phosphoprotein and involved in glucose uptake. Accordingly, utilities of GAM26 include diagnosis and treatment of the abovementioned diseases and clinical conditions. The function and utilities of PEA15 have been established by previous studies, as described hereinabove with reference to FIG. 26D.

Referring now to ADRBK1 BINDING SITE. Adrenergic beta, receptor kinase 1 (ADRBK1) is a target gene of GAM26, corresponding to GAM26-TARGET GENE of FIG. 26A. ADRBK1 BINDING SITE is a binding site found in an untranslated region of ADRBK1, corresponding to BINDING SITE of FIG. 26A. FIG. 26D illustrates the complementarity of the nucleotide sequence of ADRBK1 BINDING SITE, designated SEQ ID:844404, to the nucleotide sequence of GAM26 RNA of FIG. 26A, designated SEQ ID:20604.

Yet another function of GAM26 is therefore inhibition of adrenergic, beta, receptor kinase 1 (ADRBK1), a gene which encodes an enzyme that regulates desensitization of b-adrenergic receptors and related GPCRs. Accordingly, utilities of GAM26 include diagnosis and treatment of the abovementioned diseases and clinical conditions. The function and utilities of ADRBK1 have been established by previous studies, as described hereinabove with reference to FIG. 26D.

Referring now to FOXF1 BINDING SITE. Forkhead box F1 (FOXF1) is a target gene of GAM26, corresponding to GAM26-TARGET GENE of FIG. 26A FOXF1 SITE is a binding site found in an untranslated region of FOXF1, corresponding to BINDING SITE of FIG. 26A. FIG. 26D illustrates the complementarity of the nucleotide sequence of FOXF1 BINDING SITE, designated SEQ ID:844404, to the nucleotide sequence of GAM26 RNA of FIG. 26A, designated SEQ ID:20604.

An additional function of GAM26 is therefore inhibition of forkhead box F1 (FOXF1), a gene which encodes a transcription factor that is probable transcription activator for a number of lung-specific genes. Accordingly, utilities of GAM26 include diagnosis and treatment the abovementioned diseases and clinical conditions. The function and utilities of FOXF1 have been established by previous studies, as described hereinabove with reference to FIG. 26D.

Reference is now made to CHIC2 BINDING SITE. Cystein-rich hydrophobic domain 2 (CHIC2) is a target gene of GAM26, corresponding to GAM26-TARGET GENE of FIG. 26A. CHIC2 BINDING SITE is a binding site found in an untranslated region CHIC2, corresponding to BINDING SITE of FIG. 26A. FIG. 26D illustrates the complementarity of the nucleotide sequence of CHIC2 BINDING SITE, designated SEQ ID:893635, to the nucleotide sequence of GAM26 RNA of FIG. 26A, designated SEQ ID 20604.

A further function of GAM26 is therefore inhibition of cystein-rich hydrophobic domain 2 (CHIC2), a gene which encodes a protein that is a Cysteine-rich hydrophobic protein 2, and is associated with acute myeloid leukemia. Accordingly, utilities of GAM26 include diagnosis and treatment of the abovementioned diseases and clinical conditions.

The function of CHIC2 has been established by previous studies. The ETV6 gene (600618), also known as TEL, is the main target of chromosomal translocations affecting 12p3. The rearrangements fuse ETV6 to a wide variety of partner genes in both myeloid and lymphoid malignancies. Cools al. (1999) reported 4 cases of acute myeloid leukemia with very immature myeloblasts and a t(4;12)(q11-q12;p13). In all cases, ETV6 was found to be recombined with a novel gene homologous to the mouse Brx gene the authors therefore named the gene 'Brx-like translocated in leukemia,' or BTL. RT-PCR Experiments indicated that expression of the BTL-ETV6 transcript but not of the reciprocal ETV6-BTL transcript is a common finding in these leukemias. In contrast to most of the other ETV6 fusions, both the complete helix-loop-helix and ETS DNA-binding domains of ETV6 are present in the predicted BTL-ETV6 fusion protein, and a chimeric gene is transcribed from the BTL promoter.

Full details of the abovementioned studies are described in the following publications, the disclosure of which are hereby incorporated by reference:

Cools, J.; Bilhou-Nabera, C.; Wlodarska, I.; Cabrol, C.; Talmant, P.; Bernard, P.; Hagemeijer, A.; Marynen, P.: Fusion of a novel gene, BTL, to ETV6 in acute myeloid leukemias with a t(4;12)(q11-q12;p13). Blood 94: 1820-1824, 1999.

Further studies establishing the function and utilities of CHIC2 are found in John Hopkins OMIM database record ID 604332, and in references numbered 1575 listed hereinbelow.

Referring now to MAP4K5 BINDING SITE. Mitogen-activated protein kinase kinase kinase kinase 5 (MAP4K5) is a target gene of GAM26, corresponding to GAM26-TARGET GENE of FIG. 26A. MAP4K5 BINDING SITE is a binding site found in an untranslated region of MAP4K5, corresponding to BINDING SITE of FIG. 26A. FIG. 26D illustrates the complementarity of the nucleotide sequence of MAP4K5 BINDING SITE, designated SEQ ID:918189, to the nucleotide sequence of GAM26 RNA of FIG. 26A, designated SEQ ID:20604.

Yet a further function of GAM26 is therefore inhibition of mitogen-activated protein kinase kinase kinase kinase 5 (MAP4K5), a gene which encodes an enzyme that is a serine/threonine protein kinase required for spore wall development, activates Jun N-terminal kinase, a member of the STE20 kinase family. Accordingly, utilities of GAM26 include diagnosis and treatment of the abovementioned diseases and clinical conditions. The function and utilities of MAP4K5 have been established by previous studies, as described hereinabove with reference to FIG. 26D.

Referring now to ATP2B2 BINDING SITE. ATPase, Ca++ transporting, plasma membrane 2 (NOTE: redefinition of sy (ATP2B2) is a target gene of GAM26, corresponding to GAM26-TARGET GENE of FIG. 26A. ATP2B2 BINDING SITE is a binding site found in an untranslated region of ATP2B2, corresponding to BINDING SITE of FIG. 26A. FIG. 2 illustrates the complementarity of the nucleotide sequence of ATP2B2 BINDING SITE designated SEQ ID:947819, to the nucleotide sequence of GAM26 RNA of FIG. 26A, designated SEQ ID:20604.

Another function of GAM26 is therefore inhibition of ATPase, Ca++ transporting, plasma membrane 2 (NOTE: redefinition of sy (ATP2B2), a gene which encodes a Enzyme that catalyzes the hydrolysis of ATP coupled with the transport of calcium out of the cell. Accordingly, utilities of GAM26 include diagnosis and treatment of the abovementioned diseases and clinical conditions. The function and utilities of ATP2B2 have been established by previous studies, as described hereinabove with reference to FIG. 26D.

Referring now to SERPINB8 BINDING SITE. Serine (or cysteine) proteinase inhibitor, clade B (ovalbumin), member (SERPINB8) is a target gene of GAM26, corresponding to GAM26-TARGET GENE of FIG. 26A. SERPINB8 BINDING SITE is a binding site found in an untranslated region of SERPINB8, corresponding to BINDING SITE of FIG. 26A. FIG. 26D illustrates the complementarity of the nucleotide sequence of SERPINB8 BINDING SITE, designated SEQ ID:950359, to the nucleotide sequence of GAM26 RNA of FIG. 26A, designated SEQ ID:20604.

Yet another function of GAM26 is therefore inhibition of serine (or cysteine) proteinase inhibitor, clade B (ovalbumin), member (SERPINB8), a gene which encodes a protein protease inhibitors; may be a serpin serine protease inhibitor that binds thrombin. Accordingly, utilities of GAM26 include diagnosis and treatment of the abovementioned diseases and clinical conditions. The fun on and utilities of SERPINB8 have been established by previous studies, as described hereinabove with reference to FIG. 26D.

Referring now to SERPINB8 BINDING SITE. Serine (or cysteine) proteinase inhibitor, clade B (ovalbumin), member (SERPINB8) is a target gene of GAM26, corresponding to GAM26-TARGET GENE of FIG. 26A. SERPINB8 BINDING SITE is a binding site found in an untranslated region of SERPINB8, corresponding to BINDING SITE of FIG. 26A. FIG. 26D illustrates the complementarity of the nucleotide sequence of SERPINB8 BINDING SITE, designated SEQ ID:950360, to the nucleotide sequence of GAM26 RNA of FIG. 26A, designated SEQ ID:20604.

An additional function of GAM26 is therefore inhibition of serine (or cysteine) proteinase inhibitor, clade B (ovalbumin), member (SERPINB8), a gene which encodes a protein protease inhibitors; may be a serpin serine protease inhibitor that binds thrombin. Accordingly, utilities of GAM26 include diagnosis and treatment of the abovementioned diseases and clinical conditions. The function and utilities of SERPINB8 have been established by previous studies, as described hereinabove with reference to FIG. 26D.

Referring now to FOXF1 BINDING SITE. Forkhead box F1 (FOXF1) is a target gene of GAM26, corresponding to GAM26-TARGET GENE of FIG. 26A. FOXF1 BINDING SITE is a binding site found in an untranslated region of FOXF1, corresponding to BINDING SITE of FIG. 26A. FIG. 26D illustrates the complementarity of the nucleotide sequence of FOXF1 BINDING SITE, designated SEQ ID:969275, to the nucleotide sequence of GAM26 RNA of FIG. 26A, designated SEQ ID:20604.

A further function of GAM26 is therefore inhibition of forkhead box F1 (FOXF1), a gene which encodes a transcription factor that is a probable transcription activator for a number of lung-specific genes. Accordingly, utilities of GAM26 include diagnosis and treatment of the abovementioned diseases and clinical conditions. The function and utilities of FOXF1 have been established by previous studies, as described hereinabove with reference to FIG. 26D.

Reference is now made to MMP2 BINDING SITE. Matrix metalloproteinase 2 (gelatinase A, 72 kD gelatinase, 72 kD type I (MMP2) is a target gene of GAM26, corresponding to GAM26-TARGET GENE of FIG. 26A. MMP2 BINDING SITE is a binding site found in an untranslated region of MMP2, corresponding to BINDING SITE of FIG. 26A. FIG. 26D illustrates the complementarity of the nucleotide sequence of MMP2 BINDING SITE, designated SEQ ID:969275, to the nucleotide sequence of GAM26 RNA of FIG. 26A, designated SEQ ID:20604.

Yet a further function of GAM26 is therefore inhibition of matrix metalloproteinase 2 (gelatinase A, 72 kD gelatinase, 72 kD type I (MMP2), a gene which encodes an enzyme that prevents trom binding to alpha-V/beta-3 and blocks cell surface collagenolytic activity and is associated with OSTEOLYSIS, IDIOPATHIC. Accordingly, utilities of GAM26 include diagnosis and treatment of the abovementioned diseases and clinical conditions.

The function of MMP2 has been established by previous studies. Angiogenesis depends both cell adhesion and proteolytic mechanisms. Matrix metalloproteinase-2 and integrin alpha-V/beta-3 are functionally associated on the surface of angiogenic blood vessels. Brooks et al. (1998) found that a fragment of MMP2, which comprises the C-terminal hemopexin-like domain (amino acids 445-635) and is termed PEX, prevents this enzyme from binding to alpha-V/beta-3 and blocks cell surface collagenolytic activity in melanoma and endothelial cells. PEX blocks MMP2 activity on the chick chorioallantoic membrane where it disrupts angiogenesis and tumor growth. Brooks et al. (1998) also found that a naturally occurring form of PEX can be detected in vivo in conjunction with alpha-V/beta-3 expression in tumors and during developmental retinal neovascularization. Levels of PEX in these vascularized tissues suggest that it interacts with endothelial cell alpha-V/beta-3 where it serves as a natural inhibitor of MMP2 activity, thereby regulating the invasive behavior of new blood vessels. The authors concluded that recombinant PEX may provide a potentially novel therapeutic approach for diseases associated with neovascularization.

Animal model experiments lend further support to the function of MMP2. To study the role of Mmp2 in angiogenesis, Kato et al. (2001) analyzed the Mmp2-deficient mice generated by Itoh et al. (1998). To determine whether corneal vascularization was altered in Mmp2-deficient mice, they implanted basic fibroblast growth factor (FGF) containing micropellets into the cornea of mice and observed that Mmp2-deficient mice had decreased corneal neovascularization. The angiogenetic response normally induced by basic FGF is markedly reduced in mice lacking functional Mmp2. To determine the role of Mmp2 in vascular endothelial cell migration and tube formation in vitro, the authors prepared aortic rings from Mmp2-deficient mice. They observed that Mmp2-deficient mice showed a significant reduction of endothelial outgrowth compared to wildtype mice after stimulation with basic FGF. Kato et al. (2001) concluded that Mmp2 may play an important role in the regulation of corneal angiogenesis.

It is appreciated that the abovementioned animal model for MMP2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Brooks, P. C.; Silletti, S.; von Schalscha, T. L.; Friedlander, M.; Cheresh, D. A.: Disruption of angiogenesis by PEX, a noncatalytic metalloproteinase fragment with integrin binding activity. Cell 92: 391-400, 1998 Kato, T.; Kure, T.; Chang, J. -H., Gabison, E. E.; Itoh, T.; Itohara, S.; Azar, D. T.: Diminished corneal angiogenesis in gelatinase A-deficient mice. FEBS Lett. 508: 187-190, 2001.

Further studies establishing the function and utilities of MMP2 are found in John Hopkins OMIM database record ID 120360, and in reference numbered 1576-1593 listed hereinbelow.

Referring now to CACNA1A BINDING SITE. Calcium channel, voltage-dependent, P/Q type, alpha 1A subunit (CACNA1A) is a target gene of GAM26, corresponding to GAM26-TARGET GENE of FIG. 26A. CACNA1A BINDING SITE is a binding site found in an untranslated region of CACNA1A, corresponding to BINDING SITE of FIG. 26A. FIG. 2 5D illustrates the complementarity of the nucleotide sequence of CACNA1A BINDING SITE, designated SEQ ID:969284, to the nucleotide sequence of GAM26 RNA of FIG. 26A, designated SEQ ID:20604.

Another function of GAM26 is therefore inhibition of calcium channel, voltage-dependent, P/Q type, alpha 1A subunit (CACNA1A), a gene which encodes a protein that is associated with episodic ataxia type 2, familial hemiplegic migraine, spinocerebellar ataxia type 6, and idiopathic generalized epilepsy. Accordingly, utilities of GAM26 include diagnosis and treatment of the abovementioned diseases and clinical conditions. The function and utilities of CACNA1A have been established by previous studies, as described hereinabove with reference to FIG. 26D.

Referring now to CAMK4 BINDING SITE. Calcium/calmodulin-dependent protein kinase IV (CAMK4) is a target gene of GAM26, corresponding to GAM26-TARGET GENE of FIG. 26A. CAMK4 BINDING SITE is a binding site found in an untranslated region of CAMK4, corresponding to BINDING SITE of FIG. 26A. FIG. 26D illustrates the complementarity of the nucleotide sequence of CAMK4 BINDING SITE, designated SEQ ID:969284, to the nucleotide sequence of GAM26 RNA of FIG. 26A, designated SEQ ID:20604.

Yet another function of GAM26 is therefore inhibition of calcium/calmodulin-dependent protein kinase IV (CAMK4), a gene which encodes a Enzyme that is a heat-sable, acidic, calmodulin-binding protein. Accordingly, utilities of GAM26 include diagnosis and treatment of the abovementioned diseases and clinical conditions. The function and utilities of CAMK4 have been established by previous studies, as described hereinabove with reference to FIG. 26D.

Referring now to FGF18 BINDING SITE. Fibroblast growth factor 18 (FGF18) is a target gene of GAM26, corresponding to GAM26-TARGET GENE of FIG. 26A. FGF18 BINDING SITE is a binding site found in an untranslated region of FGF18, corresponding to BINDING SITE of FIG. 26A. FIG. 26D illustrates the complementarity of the nucleotide sequence of FGF18 BINDING SITE, designated SEQ ID:969284, to the nucleotide sequence of GAM26 RNA of FIG. 26A, designated SEQ ID:20604.

An additional function of GAM26 is therefore inhibition of fibroblast growth factor 18 (FGF18), a gene which encodes a protein that stimulates hepatic and intestinal proliferation. Accordingly, utilities of GAM26 include diagnosis and treatment of the abovementioned diseases and clinical conditions. The function and utilities of FGF18 have been established by previous studies, as described hereinabove with reference to FIG. 26D.

Referring now to RGS19IP1 BINDING SITE. (RGS19IP1) is a target gene of GAM26, corresponding to GAM26-TARGET GENE of FIG. 26A. RGS19IP1 BINDING SITE is a binding site found in an untranslated region of RGS19IP1, corresponding to BINDING SITE of FIG. 26A. FIG. 26D illustrates the complementarity of the nucleotide sequence of RGS19IP1 BINDING SITE, designated SEQ ID:969284, to the nucleotide sequence of GAM26 RNA of FIG. 26A, designated SEQ ID:20604.

A further function of GAM26 is therefore inhibition of (RGS19IP1), a gene which encodes a protein that is involved in g protein-linked signaling. Accordingly, utilities of GAM26 include diagnosis and treatment of the abovementioned diseases and clinical conditions. The function and utilities of RGS19IP1 have been established by previous studies, as described hereinabove with reference to FIG. 26D.

Referring now to LRP8 BINDING SITE. Low density lipoprotein receptor-related protein 8, apolipoprotein e r (LRP8) is a target gene of GAM26, corresponding to GAM26-TARGET GENE of FIG. 26A. LRP8 BINDING SITE is a binding site found in an untranslated region of LRP8, corresponding to BINDING SITE of FIG. 26A. FIG. 26D illustrates the complementarity of the nucleotide sequence of LRP8 BINDING SITE, designated SEQ ID:969288, to the nucleotide sequence of GAM26 RNA of FIG. 26A, designated SEQ ID:20604.

Yet a further function of GAM26 is therefore inhibition of low density lipoprotein receptor-related protein 8, apolipoprotein e r (LRP8), a gene which encodes a receptor that binds vldl and transports it into cells by endocytosis. Accordingly, utilities of GAM26 include diagnosis and treatment of the abovementioned diseases and clinical conditions. The function and utilities of LRP8 have been established by previous studies, as described hereinabove with reference to FIG. 26D.

Referring now to REPS2 BINDING SITE. RALBP1 associated Eps domain containing 2 (REPS2) is a target gene of GAM26, corresponding to GAM26-TARGET GENE of FIG. 26A. REPS2 BINDING SITE is a binding site found in an untranslated region of REPS2, corresponding to BINDING SITE of FIG. 26A. FIG. 26D illustrates the complementarity of the nucleotide sequence of REPS2 BINDING SITE, designated SEQ ID:969288, to the nucleotide sequence of GAM26 RNA of FIG. 26A, designated SEQ ID:20604.

Another function of GAM26 is therefore inhibition RALBP1 associated Eps domain containing 2 (REPS2), a gene which encodes a protein that interacts with the active form of RAS with adaptor protein GRB2 and binds calcium. Accordingly, utilities of GAM26 include diagnosis and treatment of the abovementioned diseases and clinical conditions. The unction and utilities of REPS2 have been established by previous studies, as described hereinabove with reference to FIG. 26D.

Reference is now made to CRAT BINDING SITE. carnitine acetyltransferase (CRAT) target gene of GAM26, corresponding to GAM26-TARGET GENE of FIG. 26A. CRAT BINDING SITE is a binding site found in an untranslated region of CRAT, corresponding to BINDING SITE FIG. 26A. FIG. 26D illustrates the complementarity of the nucleotide sequence of CRAT BINDING SITE, designated SEQ ID:982983, to the nucleotide sequence of GAM26 RNA of FIG. 26A, designated SEQ ID:20604.

Yet another function of GAM26 is therefore inhibition of carnitine acetyltransferase (CRAT), a gene which encodes an enzyme that catalyzes the reversible transfer of acyl groups from an acyl-CoA thioester to carnitine, and is associated with Alzheimer's disease. Accordingly, utilities of GAM26 include diagnosis and treatment of the abovementioned diseases and clinical condition.

The function of CRAT has been established by previous studies. Carnitine acyltransferases are a group of enzymes that catalyze the reversible transfer of acyl groups from an acyl-CoA thioester to carnitine, thus forming the corresponding acylcarnitine. These enzymes can be distinguished according to their substrate specificity in carnitine palmitoyltransferase (see CPT1, 600528 and CPT2, 600650), carnitine octanoyltransferase (CROT; 606090), and carnitine acetyltransferase (EC 2.3.1.7). CRAT is a key enzyme for metabolic pathways involved with the control of the acyl-CoA/CoA ratio in mitochondria, peroxisomes, and endoplasmic reticulum Acetylcarnitine, which can be a precursor for acetylcholine synthesis catalyzed by choline acetyltransferase, is thought to slow the rate of mental deterioration in Alzheimer patients, and Kalaria and Harik (1992) found decreased function of CRAT in the brain of Alzheimer patients Full details of the abovementioned studies are described in the following publications, the disclosure of which are hereby incorporated by reference:

Kalaria, R. N.; Harik, S. I.: Carnitine acetyltransferase activity in the human brain and its microvessels is decreased in Alzheimer's disease. Ann. Neurol. 32: 583-586, 1992. PubMed ID: 1456745 3. van der Leij, F. R.; Huijkman, N. C. A.; Boomsma, C.; Kuipers, J. R. G.; Bartelds, B.: Genomics of the human carnitine acyltransferase genes. Molec. Genet. Metab. 71: 139-153, 2000

Further establishing the function and utilities found in John Hopkins OMIM record ID 600184, and in references numbered 1591-1596 listed hereinbelow.

Referring now to PX19 BINDING SITE. (PX19) is a target gene of GAM26, corresponding to GAM26-TARGET GENE of FIG. 26A. PX19 BINDING SITE is a binding site found in an untranslated region of PX19, corresponding to BINDING SITE of FIG. 26A. FIG. 2D illustrates the complementarity of the nucleotide sequence of PX19 BINDING SITE, designated SEQ ID:993966, to the nucleotide sequence of GAM26 RNA of FIG. 26A, designated SEQ ID:20604.

An addition function of GAM26 is therefore inhibit of (PX19), a gene which encodes a protein that plays a role in hemopoiesis. Accordingly, utilities of GAM26 include diagnosis and treatment of the abovementioned diseases and clinical conditions. The function and utilities of PX19 have been established by previous studies, as described hereinabove with reference to FIG. 26D.

Reference is now made to ADAM10 BINDING SITE. A disintegrin and metalloproteinase domain 10 (ADAM10) is a target gene of GAM26, corresponding to GAM26-TARGET GENE of FIG. 26A. ADAM10 BINDING SITE is a binding site found in an untranslated region of ADAM10, corresponding to BINDING SITE of FIG. 26A. FIG. 26D illustrates the complementarity of the nucleotide sequence of ADAM10 BINDING SITE, designated SEQ ID:993970, to the nucleotide sequence of GAM26 RNA of FIG. 26A, designated SEQ ID:20604.

A further function of GAM26 is therefore inhibition of a disintegrin and metalloproteinase domain 10 (ADAM10), a gene which encodes an enzyme that Member of ADAM family of zinc metalloproteases. Accordingly, utilities of GAM26 include diagnosis and treatment of the abovementioned diseases and clinical conditions.

The function of ADAM10 has been established by previous studies. Wolfsberg et al. (1995) identified a family of proteins containing a disintegrin and metalloproteinase (ADAM) domain. Members of this family are cell surface proteins with a unique structure possessing both potential adhesion and protease domains. Tumor necrosis factor-alpha (TNFA; 191160) is synthesized as a proinflammatory cytokine from a 233-amino acid precursor. Conversion of the membrane-bound precursor to a secreted mature protein is mediated by a protease termed TNFA convertase. Lunn et al. (1997) found that ADAM10 possesses TNFA convertase activity. TNFA is involved in a variety of diseases. To elucidate whether the ADAM10 locus maps to the same region as a disease susceptibility, Yamazaki et al. (1997) mapped the ADAM10 locus. Using a radiation hybrid mapping method, they showed that ADAM10 is located on 15q21.3-q23. Although ephrins form a high-affinity multivalent complex with their receptors present on axons, axons can be rapidly repelled rather than being bound. Hattori et al. (2000) showed that ephrin-A2 (602756) forms a stable complex with the metalloproteinase Kuzbanian (ADAM10) involving interactions outside the cleavage region and the protease domain. Eph receptor binding triggered ephrin-A2 cleavage in a localized reaction specific to the cognate ligand. The cleavage-inhibiting mutation in ephrin-A2 delayed axon withdrawal. Hattori et al. (2000) concluded that their studies reveal mechanisms for protease recognition and control of cell surface proteins, and, for ephrin-A2, they may provide a means for efficient axon detachment and termination of signaling.

Full details of the abovementioned studies are described in the following publications, the disclosure of which are hereby incorporated by reference:

Lunn, C. A.; Fan, X.; Dalie, B.; Miller, K.; Zavodny, P. J.; Narula, S. K.; Lundell, D.: Purification of ADAM 10 from bovine spleen as a TNFalpha convertase. FEBS Lett. 400: 333-335, 1997. PubMed ID: 9009225 1. Hattori, M.; Osterfield, M.; Flanagan, J. G.: Regulated cleavage of a contact-mediated axon repellent. Science 289: 1360-1365, 2000.

Further studies establishing the function and utilities of ADAM10 are found in John Hopkins OMIM database record ID 602192, and in references numbered 1597-1600 listed hereinbelow.

Referring now to REPS2 BINDING SITE. RALBP1 associated Eps domain containing 2 (REPS2) is a target gene of GAM26, corresponding to GAM26-TARGET GENE of FIG. 26A. REPS2 BINDING SITE is a binding site found in an untranslated region of REPS2, corresponding to BINDING SITE of FIG. 26A. FIG. 26D illustrates the complementarity of the nucleotide sequence of REPS2 BINDING SITE, designated SEQ ID:993970, to the nucleotide sequence of GAM26 RNA of FIG. 26A, designated SEQ ID:20604.

Yet a further function of GAM26 is therefore inhibition of RALBP1 associated Eps domain containing 2 (REPS2), a gene which encodes a protein that interacts with the active form of RAS with adaptor protein GRB2 and binds calcium. Accordingly, utilities of GAM26 include diagnosis and treatment of the abovementioned diseases and clinical conditions. The function and utilities of REPS2 have been established by previous studies, as described hereinabove with reference to FIG. 26D.

Reference is now made to EXTL3 BINDING SITE. Exostoses (multiple)-like 3 (EXTL3) is a target gene of GAM26, corresponding to GAM26-TARGET GENE of FIG. 26A. EXTL3 BINDING SITE is a binding site found in an untranslated region of EXTL3, corresponding to BINDING SITE of FIG. 26A. FIG. 26D illustrates the complementarity of the nucleotide sequence of EXTL3 BINDING SITE, designated SEQ ID:1065873, to the nucleotide sequence of GAM26 RNA of FIG. 26A, designated SEQ ID:20604.

Another function of GAM26 is therefore inhibition of exostoses (multiple)-like 3 (EXTL3), a gene which encodes a protein that a member of the multiple exostoses gene family. Accordingly, utilities of GAM26 include diagnosis and treatment of the abovementioned diseases and clinical conditions.

The function of EXTL3 has been established by previous studies. By EST database searching with the sequences of EXT1 (133700), EXT2 (133701), and EXTL1 (601738), followed by 5-prime and 3-prime RACE, Saito et al. (1998) cloned full-length cDNAs for 2 new members of the EXT family, EXTL2 (602411) and EXTL3, which they called EXTR2 and EXTR1, respectively. The deduced 919-amino acid EXTL3 protein contains a highly conserved region in the C terminus common to other EXT proteins. Northern blot analysis detected expression of 6.2- and 4.7-kb EXTR1 transcripts in all tissues tested except ovary. The larger transcript was predominant in brain, skeletal muscle, and testis, and the shorter transcript in heart, liver, thymus, and prostate. Kobayashi et al. (2000) isolated a cDNA for a REG protein (see 167770) receptor from a rat islet cDNA library. Cells into which the cDNA had been introduced bound REG protein with high affinity. When the cDNA was introduced into a pancreatic beta-cell line that showed REG-dependent growth, the transformants exhibited a significant increase in the incorporation of 5-prime-bromo-2-prime-deoxyuridine as well as in the cell numbers in response to REG protein. A homology search revealed that the rat REG protein receptor cDNA is a homolog of EXTL3. The rat and human proteins share 97% sequence identity. Kobayashi et al. (2000) found that REG receptor mRNA in the rat is detectable in liver, kidney, stomach, small intestine, colon, adrenal gland, pituitary gland, and brain, but not in heart, suggesting the possible involvement of the REG-REG protein receptor signal system in a variety of cell types other than pancreatic beta cells. By somatic cell hybrid and radiation hybrid analyses, Saito et al. (1998) mapped the human EXTL3 gene to chromosome 8p21. By FISH, radiation hybrid analysis, and inclusion within a mapped contig, Van Hul et al. (1998) mapped the gene to 8p21-p12.

Full details of the abovementioned studies are described in the following publications, the disclosure of which are hereby incorporated by reference:
Saito T.; Seki, N.; Yamauchi, M.; Tsuji, S.; Hayashi, A.; Kozuma, S.; Hori, T.: Structure, chromosomal location, and expression profile of EXTR1 and EXTR2, new members of the multiple exostoses gene family. Biochem. Biophys. Res. Commun. 243: 61-66, 1998. PubMed ID: 9473480 3. Van Hul, W.; Wuyts, W.; Hendrickx, J.; Speleman, F.; Wauters, J.; De Boulle, K.; Van Roy, N.; Bossuyt, P.; Willems, P. J.: Identification of a third EXT-like gene (EXTL3) belonging to the EXT gene family. Genomics 47: 230-237, 1998.

Further studies establishing the function and utilities of EXTL3 are found in John Hopkins OMIM database record ID 605744, and in references numbered 1601-1603 listed hereinbelow.

Referring now to CAMK4 BINDING SITE. Calcium/calmodulin-dependent protein kinase IV (CAMK4) is a target gene of GAM26, corresponding to GAM26-TARGET GENE of FIG. 26A. CAMK4 BINDING SITE is a binding site found in an untranslated region of CAMK4, corresponding to BINDING SITE of FIG. 26A. FIG. 26D illustrates the complementarity of the nucleotide sequence of CAMK4 BINDING SITE, designated SEQ ID:1295963, to the nucleotide sequence of GAM26 RNA of FIG. 26A, designated SEQ ID:20604.

Yet another function of GAM26 is therefore inhibition of calcium/calmodulin-dependent protein kinase IV (CAMK4), a gene which encodes a Enzyme that is a heat-stable, acidic, calmodulin-binding protein. Accordingly, utilities of GAM26 include diagnosis and treatment of the abovementioned diseases and clinical conditions. The function and utilities of CAMK4 have been established by previous studies, as described hereinabove with reference to FIG. 26D.

Referring now to EXTL3 BINDING SITE. Exostoses (multiple)-like 3 (EXTL3) is a target gene of GAM26, corresponding to GAM26-TARGET GENE of FIG. 26A. EXTL3 BINDING SITE is a binding site found in an untranslated region of EXTL3, corresponding to BINDING SITE of FIG. 26A. FIG. 26D illustrates the complementarity of the nucleotide sequence of EXTL3 BINDING SITE, designated SEQ ID:1310953, to the nucleotide sequence of GAM26 RNA of FIG. 26A, designated SEQ ID:20604.

An additional function of GAM26 is therefore inhibition of exostoses (multiple)-like 3 (EXTL3), a gene which encodes a protein a member of the multiple exostoses gene family. Accordingly, utilities of GAM26 include diagnosis and treatment of the abovementioned diseases and clinical conditions. The function and utilities of EXTL3 have seen established by previous studies, as described hereinabove with reference to FIG. 26D.

Referring now to REPS2 BINDING SITE. RALBP1 associated Eps domain containing 2 (REPS2) is a target gene of GAM26, corresponding to GAM26-TARGET GENE of FIG. 26A. REPS2 BINDING SITE is a binding site found in an untranslated region of REPS2, corresponding to BINDING SITE of FIG. 26A. FIG. 26D illustrates the complementarity of the nucleotide sequence of REPS2 BINDING SITE, designated SEQ ID:1323750, to the nucleotide sequence of GAM26 RNA of FIG. 26A, designated SEQ ID:20604.

A further function of GAM26 is therefore inhibition of RALBP1 associated Eps domain containing 2 (REPS2), a gene which encodes a protein that interacts with the active form of RAS with adaptor protein GRB2 and binds calcium. Accordingly, utilities of GAM26 include diagnosis and treatment of the abovementioned diseases and clinical conditions. The function and utilities of REPS2 have been established by previous studies, as described hereinabove with reference to FIG. 26D.

Reference is now made to FAF1 BINDING SITE. FAF1 is a target gene of GAM26, corresponding to GAM26-TARGET GENE of FIG. 26A. FAF1 BINDING SITE is a binding site found in an untranslated region of FAF1, corresponding to BINDING SITE of FIG. 26A. FIG. 26D illustrates the complementarity of the nucleotide sequence of FAF1 BINDING SITE, designated SEQ ID:46198, to the nucleotide sequence of GAM26 RNA of FIG. 26A, designated SEQ ID:20604. Yet a further function of GAM26 is therefore inhibition of (FAF1). Accordingly, utilities of GAM26 include diagnosis and treatment of diseases and clinical conditions with which FAF1 is associated.

Reference is now made to FLJ12377 BINDING SITE. FLJ12377 is a target gene of GAM26, corresponding to GAM26-TARGET GENE of FIG. 26A. FLJ12377 BINDING SITE is a binding site found in an untranslated region of FLJ12377, corresponding to BINDING SITE of FIG. 26A. FIG. 26D illustrates the complementarity of the nucleotide sequence of FLJ12377 BINDING SITE, designated SEQ ID:46198, to the nucleotide sequence of GAM26 RNA of FIG. 26A, designated SEQ ID:20604. Another function of GAM26 is therefore inhibition of (FLJ12377). Accordingly, utilities of GAM26 include diagnosis and treatment of diseases and clinical conditions with which FLJ12377 is associated.

Reference is now made to CHSY1 BINDING SITE. CHSY1 is a target gene of GAM26, corresponding to GAM26-TARGET GENE of FIG. 26A. CHSY1 BINDING SITE is a binding site found in an untranslated region of CHSY1, corresponding to BINDING SITE of FIG. 26A. FIG. 26D illustrates the complementarity of the nucleotide sequence of CHSY1 BINDING SITE, designated SEQ ID:94853, to the nucleotide sequence of GAM26 RNA of FIG. 26A, designated SEQ ID:20604. Yet another function of GAM26 is therefore inhibition of (CHSY1). Accordingly, utilities of GAM26 include diagnosis and treatment of diseases and clinical conditions with which CHSY1 is associated.

Reference is now made to CHSY1 BINDING SITE. CHSY1 is a target gene of GAM26, corresponding to GAM26-TARGET GENE of FIG. 26A. CHSY1. BINDING SITE is a binding site found in an untranslated region of CHSY1, corresponding to BINDING SITE of FIG. 26A. FIG. 26D illustrates the complementarity of the nucleotide sequence of CHSY1 BINDING SITE, designated SEQ ID:94853, to the nucleotide sequence of GAM26 RNA of FIG. 26A, designates SEQ ID:20604. An additional function of GAM26 is therefore inhibition of (CHSY1). Accordingly, utilities of GAM26 include diagnosis and treatment of diseases and clinical conditions with which CHSY1 is associated.

Reference is now made to FLJ21588 BINDING SITE. FLJ21588 is a target gene of GAM26, corresponding to GAM26-TARGET GENE of FIG. 26A. FLJ21588 BINDING SITE is a binding site found in an untranslated region of FLJ21588, corresponding to BINDING SITE of FIG. 26A. FIG. 26D illustrates the complementarity of the nucleotide sequence of FLJ21588 BINDING SITE, designated SEQ ID:94853, to the nucleotide sequence of GAM26 RNA of FIG. 26A, designated SEQ ID:20604. A further function of GAM26 is therefore inhibition of (FLJ21588). Accordingly, utilities of GAM26 include diagnosis and treatment of diseases and clinical conditions with which FLJ21588 is associated.

Reference is now made to MGC10702 BINDING SITE. MGC10702 is a target gene of GAM26, corresponding to GAM26-TARGET GENE of FIG. 26A. MGC10702 BINDING SITE is a binding site found in an untranslated region of MGC10702, corresponding to BINDING SITE of FIG. 26A. FIG. 26D illustrates the complementarity of the nucleotide sequence of MGC10702 BINDING SITE, designated SEQ ID:94853, to the nucleotide sequence of GAM26 RNA of FIG. 26A, designated SEQ ID:20604. Yet a further function of GAM26 is therefore inhibition of (MGC10702). Accordingly, utilities of GAM26 include diagnosis and treatment of diseases and clinical conditions with which MGC10702 is associated.

Reference is now made to QKI BINDING SITE. QKI is a target gene of GAM26, corresponding to GAM26-TARGET GENE of FIG. 26A. QKI BINDING SITE is a binding site found in an untranslated region of QKI, corresponding to BINDING SITE of FIG. 26A. FIG. 26D illustrates the complementarity of the nucleotide sequence of QKI BINDING SITE, designated SEQ ID:94853, to the nucleotide sequence of GAM26 RNA of FIG. 26A, designated SEQ ID:20604. Another function of GAM26 is therefore inhibition of (QKI). Accordingly, utilities of GAM26 include diagnosis and treatment of diseases and clinical conditions with which QKI is associated.

Reference is now made to STK39 BINDING SITE. STK39 is a target gene of GAM26, corresponding to GAM26-TARGET GENE of FIG. 26A. STK39 BINDING SITE is a binding site found in an untranslated region of STK39, corresponding to BINDING SITE of FIG. 26A. FIG. 26D illustrates the complementarity of the nucleotide sequence of STK39 BINDING SITE, designated SEQ ID:94853, to the nucleotide sequence of GAM26 RNA of FIG. 26A, designated SEQ ID:20604. Yet another function of GAM26 is therefore inhibition of (STK39). Accordingly, utilities of GAM26 include diagnosis and treatment of diseases and clinical conditions with which STK39 is associated.

Reference is now made to STK39 BINDING SITE. STK39 is a target gene of GAM26, corresponding to GAM26-TARGET GENE of FIG. 26A. STK39 BINDING SITE is a binding site found in an untranslated region of STK39, corresponding to BINDING SITE of FIG. 26A. FIG. 26D illustrates the complementarity of the nucleotide sequence of STK39 BINDING SITE, designated SEQ ID:94853, to the nucleotide sequence of GAM26 RNA of FIG. 26A, designated SEQ ID:20604. An additional function of GAM26 is therefore inhibition of (STK39). Accordingly, utilities of GAM26 include diagnosis and of diseases and clinical conditions STK39 is associated.

Reference is now made to STK39 BINDING SITE. STK39 is a target gene of GAM26, corresponding to GAM26-TARGET GENE of FIG. 26A. STK39 BINDING SITE is a binding site found in an untranslated region of STK39, corresponding to BINDING SITE of FIG. 26A. FIG. 26D illustrates the complementarity of the nucleotide sequence of STK39 BINDING SITE, designated SEQ ID:94853, to the nucleotide sequence of GAM26 RNA of FIG. 26A, designated SEQ ID:20604. A further function of GAM26 is therefore inhibition of (STK39). Accordingly, utilities of GAM26 include diagnosis and treatment of diseases and clinical conditions with which STK39 is associated.

Reference is now made to FLJ10996 BINDING SITE. FLJ10996 is a target gene of GAM26, corresponding to GAM26-TARGET GENE of FIG. 26A. FLJ10996 BINDING SITE is a binding site found in an untranslated region of FLJ10996, corresponding to BINDING SITE of FIG. 26A. FIG. 26D illustrates the complementarity of the nucleotide sequence of FLJ10996 BINDING SITE, designated SEQ ID:94860, to the nucleotide sequence of GAM26 RNA of FIG. 26A, designated SEQ ID:20604. Yet a further function of GAM26 is therefore inhibition of (FLJ10996). Accordingly, utilities of GAM26 include diagnosis and treatment of diseases and clinical conditions with which FLJ10996 is associated.

Reference is now made to FLJ21588 BINDING SITE. FLJ21588 is a target gene of GAM26, corresponding to GAM26-TARGET GENE of FIG. 26A. FLJ21588 BINDING SITE is a binding site found in an untranslated region of FLJ21588, corresponding to BINDING SITE of FIG. 26A, FIG. 26D illustrates the complementarity of the nucleotide sequence of FLJ21588 BINDING SITE, designated SEQ ID:94860, to the nucleotide sequence of GAM26 RNA of FIG. 26A, designated SEQ ID:20604. Another function of GAM26 is therefore inhibition of (FLJ21588). Accordingly, utilities of GAM26 include diagnosis and treatment of diseases and clinical conditions with which FLJ21588 is associated.

Reference is now made to MGC4796 BINDING SITE. MGC4796 is a target gene of GAM26, corresponding to GAM26-TARGET GENE of FIG. 26A. MGC4796 BINDING SITE is a binding site found in an untranslated region of MGC4796, corresponding to BINDING SITE of FIG. 26A. FIG. 26D illustrates the complementarity of the nucleotide sequence of MGC4796 BINDING SITE, designated SEQ ID:94860, to the nucleotide sequence of GAM26 RNA of FIG. 26A, designated SEQ ID:20604. Yet another function of GAM26 is therefore inhibition of (MGC4796). Accordingly, utilities of GAM26 include diagnosis and treatment of diseases and clinical conditions with which MGC4796 is associated.

Reference is now made to OATPRP4 BINDING SITE. OATPRP4 is a target gene of GAM26, corresponding to GAM26-TARGET GENE of FIG. 26A. OATPRP4 BINDING SITE is a binding site found in an untranslated region of OATPRP4, corresponding to BINDING SITE of FIG. 26A. FIG. 26D illustrates the complementarity of the nucleotide sequence of OATPRP4 BINDING SITE, designated SEQ ID:163380, to the nucleotide sequence of GAM26 RNA of FIG. 26A, designated SEQ ID:20604. An additional function of GAM26 is therefore inhibition of (OATPRP4). Accordingly, utilities of GAM26 include diagnosis and treatment of diseases and clinical conditions with which OATPRP4 is associated.

Reference is now made to FLJ10996 BINDING SITE. FLJ10996 is a target gene of GAM26, corresponding to GAM26-TARGET GENE of FIG. 26A. FLJ10996 BINDING SITE is a binding site found in an untranslated region of FLJ10996, corresponding to BINDING SITE of FIG. 26A. FIG. 26D illustrates the complementarity of the nucleotide sequence of FLJ10996 BINDING SITE, designated SEQ ID:167722, to the nucleotide sequence of GAM26 RNA of FIG. 26A, designate SEQ ID:20604. A further function of GAM26 is therefore inhibition of (FLJ10996). Accordingly, utilities of GAM26 include diagnosis and treatment of diseases and clinical conditions with which FLJ10996 is associated.

Reference is now made to KIAA1483 BINDING SITE. KIAA1483 is a target gene of GAM26, corresponding to GAM26-TARGET GENE of FIG. 26A. KIAA1483 BINDING SITE is a binding site found in an untranslated region of KIAA1483, corresponding to BINDING SITE of FIG. 26A. FIG. 26D illustrates the complementarity of the nucleotide sequence of KIAA1483 BINDING SITE, designated SEQ ID:193594, to the nucleotide sequence of GAM26 RNA of FIG. 26A, designated SEQ ID:20604. Yet a further function of GAM26 is therefore inhibition of (KIAA1483). Accordingly, utilities of GAM26 include diagnosis and treatment of diseases and clinical conditions with which KIAA1483 is associated.

Reference is now made to FLJ20539 BINDING SITE. FLJ20539 is a target gene of GAM26, corresponding to GAM26-TARGET GENE of FIG. 26A. FLJ20539 BINDING SITE is a binding site found in an untranslated region of FLJ20539, corresponding to BINDING SITE of FIG. 26A. FIG. 26D illustrates the complementarity of the nucleotide sequence of FLJ20539 BINDING SITE, designated SEQ ID:241978, to the nucleotide sequence of GAM26 RNA of FIG. 26A, designated SEQ ID:20604. Another function of GAM26 is therefore inhibition of (FLJ20539). Accordingly, utilities of GAM26 include diagnosis and treatment of diseases and clinical conditions with which FLJ20539 is associated.

Reference is now made to MGC2599 BINDING SITE. MGC2599 is a target gene of GAM26, corresponding to GAM26-TARGET GENE of FIG. 26A. MGC2599 BINDING SITE is a binding site found in an untranslated region of MGC2599, corresponding to BINDING SITE of FIG. 26A. FIG. 26D illustrates the complementarity of the nucleotide sequence of MGC2599 BINDING SITE, designated SEQ ID:241978, to the nucleotide sequence of GAM26 RNA of FIG. 26A, designated SEQ ID:20604. Yet another function of GAM26 is therefore inhibition of (MGC2599). Accordingly, utilities of GAM26 include diagnosis and treatment of diseases and clinical conditions with which MGC2599 is associated.

Reference is now made to TSLL2 BINDING SITE. TSLL2 is a target gene of GAM26, corresponding to GAM26-TARGET GENE of FIG. 26A. TSLL2 BINDING SITE is a binding site found in an untranslated region of TSLL2, corresponding to BINDING SITE of FIG. 26A. FIG. 26D illustrates the complementarity of the nucleotide sequence of TSLL2 BINDING SITE, designated SEQ ID:241978, to the nucleotide sequence of GAM26 RNA of FIG. 26A, designated SEQ ID:20604. An additional function of GAM26 is therefore inhibition of (TSLL2). Accordingly, utilities of GAM26 include diagnosis and treatment of diseases and clinical conditions with which TSLL2 is associated.

Reference is now made to KIAA0995 BINDING SITE. KIAA0995 is a target gene of GAM26, corresponding to GAM26-TARGET GENE of FIG. 26A. KIAA0995 BINDING SITE is a binding site found in an untranslated region of KIAA0995, corresponding to BINDING SITE of FIG. 26A. FIG. 26D illustrates the complementarity of the nucleotide sequence of KIAA0995 BINDING SITE, designated SEQ ID:245294, to the nucleotide sequence of GAM26 RNA of FIG. 26A, designated SEQ ID:20604. A further function of GAM26 is therefore inhibition of (KIAA0995). Accordingly, utilities of GAM26 include diagnosis and treatment of diseases and clinical conditions with which KIAA0995 is associated.

Reference is now made to PMX2B BINDING SITE. PMX2B is a target gene of GAM26, corresponding to GAM26-TARGET GENE of FIG. 26A. PMX2B BINDING SITE is a binding site found in an untranslated region of PMX2B, corresponding to BINDING SITE of FIG. 26A. FIG. 26D illustrates the complementarity of the nucleotide sequence of PMX2B BINDING SITE, designated SEQ ID:245294, to the nucleotide sequence of GAM26 RNA of FIG. 26A, designated SEQ ID:20604. Yet a further function of GAM26 is therefore inhibition of (PMX2B). Accordingly, utilities of GAM26 include diagnosis and treatment of diseases and clinical conditions with which PMX2B is associated.

Reference is now made to CLSTN1 BINDING SITE. CLSTN1 is a target gene of GAM26, corresponding to GAM26-TARGET GENE of FIG. 26A. CLSTN1 BINDING SITE is a binding site found in an untranslated region of CLSTN1, corresponding to BINDING SITE of FIG. 26A. FIG. 26D illustrates the complementarity of the nucleotide sequence of CLSTN1 BINDING SITE, designated SEQ ID:324417, to the nucleotide sequence of GAM26 RNA of FIG. 26A, designated SEQ ID:20604. Another function of GAM26 is therefore inhibition of (CLSTN1). Accordingly, utilities of GAM26 include diagnosis and treatment of diseases and clinical conditions with which CLSTN1 is associated.

Reference is now made to FLJ10996 BINDING SITE. FLJ10996 is a target gene of GAM26, corresponding to GAM26-TARGET GENE of FIG. 26A. FLJ10996 BINDING SITE is a binding site found in an untranslated region of FLJ10996, corresponding to BINDING SITE of FIG. 26A. FIG. 26D illustrates the complementarity of the nucleotide sequence of FLJ10996 BINDING SITE, designated SEQ ID:324417, to the nucleotide sequence of GAM26 RNA of FIG. 26A, designated SEQ ID:20604. Yet another function of GAM26 is therefore inhibition of (FLJ10996). Accordingly, utilities of GAM26 include diagnosis and treatment of diseases and clinical conditions with which FLJ10996 is associated.

Reference is now made to MGC4170 BINDING SITE. MGC4170 is a target gene of GAM26, corresponding to GAM26-TARGET GENE of FIG. 26A. MGC4170 BINDING SITE is a binding site found in an untranslated region of MGC4170, corresponding to BINDING SITE of FIG. 26A. FIG. 26D illustrates the complementarity of the nucleotide sequence of MGC4170 BINDING SITE, designated SEQ ID:324417, to the nucleotide sequence of GAM26 RNA of FIG. 26A, designated SEQ ID:20604. An additional function of GAM26 is therefore inhibition of (MGC4170). Accordingly, utilities of GAM26 include diagnosis and treatment of diseases and clinical conditions with which MGC4170 is associated.

Reference is now made to SSBP3 BINDING SITE. SSBP3 is a target gene of GAM26, corresponding to GAM26-TARGET GENE of FIG. 26A. SSBP3 BINDING SITE is a binding site found in an untranslated region of SSBP3, corresponding to BINDING SITE of FIG. 26A. FIG. 26D illustrates the complementarity of the nucleotide sequence of SSBP3 BINDING SITE, designated SEQ ID:412156, to the nucleotide sequence of GAM26 RNA of FIG. 26A, designated SEQ ID:20604. A further function of GAM26 is therefore inhibition of (SSBP3). Accordingly, utilities of GAM26 include diagnosis and treatment of diseases and clinical conditions with which SSBP3 is associated.

Reference is now made to ADAR3 BINDING SITE. ADAR3 is a target gene of GAM26, corresponding to GAM26-TARGET GENE of FIG. 26A. ADAR3 BINDING SITE is a binding site found in an untranslated region of ADAR3, corresponding to BINDING SITE of FIG. 26A. FIG. 26D illustrates the complementarity of the nucleotide sequence of ADAR3 BINDING SITE, designated SEQ ID:436814, to the nucleotide sequence of GAM26 RNA of FIG. 26A, designated SEQ ID:20604. Yet a further function of GAM26 is therefore inhibition of (ADAR3). Accordingly, utilities of GAM26 include diagnosis and treatment of diseases and clinical conditions with which ADAR3 is associated.

Reference is now made to ADPRTL2 BINDING SITE. ADPRTL2 is a target gene of GAM26, corresponding to GAM26-TARGET GENE of FIG. 26A. ADPRTL2 BINDING SITE is a binding site found in an untranslated region of ADPRTL2, corresponding to BINDING SITE of FIG. 26A. FIG. 26D illustrates the complementarity of the nucleotide sequence of ADPRTL2 BINDING SITE, designated SEQ ID:437139, to the nucleotide sequence of GAM26 RNA of FIG. 26A, designated SEQ ID:20604. Another function of GAM26 is therefore inhibition of (ADPRTL2). Accordingly, utilities of GAM26 include diagnosis and treatment of diseases and clinical conditions with which ADPRTL2 is associated.

Reference is now made to ADPRTL2 BINDING SITE. ADPRTL2 is a target gene of GAM26, corresponding to GAM26-TARGET GENE of FIG. 26A. ADPRTL2 BINDING SITE is a binding site found in an untranslated region of ADPRTL2, corresponding to BINDING SITE of FIG. 26A. FIG. 26D illustrates the complementarity of the nucleotide sequence of ADPRTL2 BINDING SITE, designated SEQ ID:437144, to the nucleotide sequence of GAM26 RNA of FIG. 26A, designated SEQ ID:20604. Yet another function of GAM26 is therefore inhibition of (ADPRTL2). Accordingly, utilities of GAM26 include diagnosis and treatment of diseases and clinical conditions with which ADPRTL2 is associated.

Reference is now made to AKAP9 BINDING SITE, AKAP9 is a target gene of GAM26, corresponding to GAM26-TARGET GENE of FIG. 26A. AKAP9 BINDING SITE is a binding site found in an untranslated region of AKAP9, corresponding to BINDING SITE of FIG. 26A. FIG. 26D illustrates the complementarity of the nucleotide sequence of AKAP9 BINDING SITE, designated SEQ ID:439691, to the nucleotide sequence if GAM26 RNA of FIG. 26A, designates SEQ ID:20604. An additional function of GAM26 is therefore inhibition of (AKAP9). Accordingly, utilities of GAM26 include diagnosis and treatment of diseases and clinical conditions with which AKAP9 is associated.

Reference is now made to ALTE BINDING SITE. ALTE is a target gene of GAM26, corresponding to GAM26-TARGET GENE of FIG. 26A. ALTE BINDING SITE is a binding site found in an untranslated region of ALTE corresponding to BINDING SITE of FIG. 26A. FIG. 26D illustrates the complementarity of the nucleotide sequence of ALTE BINDING SITE, designated SEQ ID:440959, to the nucleotide sequence of GAM26 RNA of FIG. 26A, designated SEQ ID:20604. A further function of GAM26 is therefore inhibition of (ALTE). Accordingly, utilities of GAM26 include diagnosis and treatment of diseases and clinical conditions with which ALTE is associated.

Reference is now made to AP1GBP1 BINDING SITE. AP1GBP1 is a target gene of GAM26, corresponding to GAM26-TARGET GENE of FIG. 26A. AP1GBP1 BINDING SITE is a binding site found in an untranslated region of AP1GBP1, corresponding to BINDING SITE of FIG. 26A. FIG. 26D illustrates the complementarity of the nucleotide sequence of AP1GBP1 BINDING SITE, designated SEQ ID:442346, to the nucleotide sequence of GAM26 RNA of FIG. 26A, designated SEQ ID:20604. Yet a further function of GAM26 is therefore inhibition of (AP1GBP1). Accordingly, utilities of include diagnosis and treatment of diseases and clinical conditions with which AP1GBP1 is associated.

Reference is now made to AP4E1 BINDING SITE. AP4E1 is a target gene of GAM26, corresponding to GAM26-TARGET GENE of FIG. 26A. AP4E1 BINDING SITE is a binding site found in an untranslated region of AP4E1, corresponding to BINDING SITE of FIG. 26A. FIG. 26D illustrates the complementarity of the nucleotide sequence of AP4E1 BINDING SITE, designated SEQ ID:443308, to the nucleotide sequence of GAM26 RNA of FIG. 26A, designated SEQ ID:20604. Another function of GAM26 is therefore inhibition of (AP4E1). Accordingly, utilities of GAM26 include diagnosis and treatment of diseases and clinical conditions with which AP4E1 is associated.

Reference is now made to ARF6 BINDING SITE. ARF6 is a target gene of GAM26, corresponding to GAM26-TARGET GENE of FIG. 26A. ARF6 BINDING SITE is a binding site found in an untranslated region of ARF6, corresponding to BINDING SITE of FIG. 26A. FIG. 26D illustrates the complementarity of the nucleotide sequence of ARF6 BINDING SITE, designated SEQ ID:445874, to the nucleotide sequence of GAM26 RNA of FIG. 26A, designated SEQ ID:20604. Yet another function of GAM26 is therefore inhibition of (ARF6). Accordingly, utilities of GAM26 include diagnosis and treatment of diseases and clinical conditions with which ARF6 is associated.

Reference is now made to ARF6 BINDING SITE. ARF6 is a target gene of GAM26, corresponding to GAM26-TARGET GENE of FIG. 26A. ARF6 BINDING SITE is a binding site found in an untranslated region of ARF6, corresponding to BINDING SITE of FIG. 26A. FIG. 26D illustrates the complementarity of the nucleotide sequence of ARF6 BINDING SITE, designated SEQ ID:445885, to the nucleotide sequence of GAM26 RNA of FIG. 26A, designated SEQ ID:20604. An additional function of GAM26 is therefore inhibition of (ARF6). Accordingly, utilities of GAM26 include diagnosis and treatment of diseases and clinical condition with which ARF6 is associated.

Reference is now made to ARTS-1 BINDING SITE. ARTS-1 is a target gene of GAM26, corresponding to GAM26-TARGET GENE of FIG. 26A. ARTS-1 BINDING SITE is a binding site found in an untranslated region of ARTS-1, corresponding to BINDING SITE of FIG. 26A. FIG. 26D illustrates the complementarity of the nucleotide sequence of ARTS-1 BINDING SITE, designated SEQ ID:449602, to the nucleotide sequence of GAM26 RNA of FIG. 26A, designated SEQ ID:20604. A further function of GAM26 is therefore inhibition of (ARTS-1). Accordingly, utilities of GAM26 include diagnosis and treatment of diseases and clinical conditions with which ARTS-1 is associated.

Reference is now made to ATE1 BINDING SITE. ATE1 is a target gene of GAM26, corresponding to GAM26-TARGET GENE of FIG. 26A. ATE1 BINDING SITE is a binding site found in an untranslated region of ATE1, corresponding to BINDING SITE of FIG. 26A. FIG. 26D illustrates the complementarity of the nucleotide sequence of ATE1 BINDING SITE, designated SEQ ID:450724, to the nucleotide sequence of GAM26 RNA of FIG. 26A, designated SEQ ID:20604. Yet a further function of GAM26 is therefore inhibition of (ATE1). Accordingly, utilities of GAM26 include diagnosis and treatment of diseases and clinical conditions with which ATE1 is associated.

Reference is now made to ATP6V1B2 BINDING SITE. ATP6V1B2 is a target gene of GAM26, corresponding to GAM26-TARGET GENE of FIG. 26A. ATP6V1B2 BINDING SITE is a binding site found in an untranslated region of ATP6V1B2, corresponding to BINDING SITE of FIG. 26A. FIG. 26D illustrates the complementarity of the nucleotide sequence of ATP6V1B2 BINDING SITE, designated SEQ ID:451749, to the nucleotide sequence of GAM26 RNA of FIG. 26A, designated SEQ ID:20604. Another function of GAM26 is therefore inhibition of (ATP6V1B2). Accordingly, utilities of GAM26 include diagnosis and treatment of diseases and clinical conditions with which ATP6V1B2 is associated.

Reference is now made to AWP1 BINDING SITE. AWP1 is a target gene of GAM26, corresponding to GAM26-TARGET GENE of FIG. 26A. AWP1 BINDING SITE is a binding site found in an untranslated region of AWP1, corresponding to BINDING SITE of FIG. 26A. FIG. 26D illustrates the complementarity of the nucleotide sequence of AWP1 BINDING SITE, designated SEQ ID:452398, to the nucleotide sequence of GAM26 RNA of FIG. 26A, designated SEQ ID:20604. Yet another function of GAM26 is therefore inhibition of (AWP1). Accordingly, utilities of GAM26 include diagnosis and treatment of diseases and clinical conditions with which AWP1 is associated.

Reference is now made to AWP1 BINDING SITE. AWP1 is a target gene of GAM26, correspondingly to GAM26-TARGET GENE of FIG. 26A. AWP1 BINDING SITE is a binding site found in an untranslated region of AWP1, corresponding to BINDING SITE of FIG. 26A. FIG. 26D illustrates the complementarity of the nucleotide sequence of AWP1 BINDING SITE, designated SEQ ID:452399, to the nucleotide sequence of GAM26 RNA of FIG. 26A, designated SEQ ID:20604. An additional function of GAM26 is therefore inhibition of (AWP1). Accordingly, utilities of GAM26 include diagnosis and treatment of diseases and clinical conditions with which AWP1 is associated.

Reference is now made to BA108L7.2 BINDING SITE. BA108L7.2 is a target gene of GAM26, corresponding to GAM26-TARGET GENE of FIG. 26A. BA108L7.2 BINDING SITE is a binding site found in an untranslated region of BA108L7.2, corresponding to BINDING SITE of FIG. 26A. FIG. 26D illustrates the complementarity of the nucleotide sequence of BA108L7.2 BINDING SITE, designated SEQ ID:453226, to the nucleotide sequence of GAM26 RNA of FIG. 26A, designated SEQ ID:20604. A further function of GAM26 is therefore inhibition of (BA108L7.2). Accordingly, utilities of GAM26 include diagnosis and treatment of diseases and clinical conditions with which BA108L7.2 is associated.

Reference is now made to BC-2 BINDING SITE. BC-2 is a target gene of GAM26, corresponding to GAM26-TARGET GENE of FIG. 26A. BC-2 BINDING SITE is a binding site found in an untranslated region of BC-2, corresponding to BINDING SITE of FIG. 26A. FIG. 26D illustrates the complementarity of the nucleotide sequence of BC-2 BINDING SITE designated SEQ ID:454363, to the nucleotide sequence of GAM26 RNA of FIG. 26A, designated SEQ ID:20604. Yet a further function of GAM26 is therefore inhibition of (BC-2). Accordingly, utilities of GAM26 include diagnosis and treatment of diseases and clinical conditions with which BC-2 is associated.

Reference is now made to BEX1 BINDING SITE. BEX1 is a target gene of GAM26, corresponding to GAM26-TARGET GENE of FIG. 26A. BEX1 BINDING SITE is a binding site found in an untranslated region of BEX1, corresponding to BINDING SITE of FIG. 26A. FIG. 26D illustrates the complementarity of the nucleotide sequence of BEX1 BINDING SITE, designated SEQ ID:455564, to the nucleotide sequence of GAM26 RNA of FIG. 26A, designated SEQ ID:20604. Another function of GAM26 is therefore inhibition of (BEX1). Accordingly, utilities of GAM26 include diagnosis and treatment of diseases and clinical conditions with which BEX1 is associated.

Reference is now made to BLCAP BINDING SITE. BLCAP is a target gene of GAM26, corresponding to GAM26-TARGET GENE of FIG. 26A. BLCAP BINDING SITE is a binding site found in an untranslated region of BLCAP, corresponding to BINDING SITE of FIG. 26A. FIG. 26D illustrate the complementarity of the nucleotide sequence of BLCAP BINDING SITE, designated SEQ ID:457198, to the nucleotide sequence of GAM26 RNA of FIG. 26A, designated SEQ ID:20604. Yet another function of GAM26 is therefore inhibition of (BLCAP). Accordingly, utilities of GAM26 include diagnosis and treatment of diseases and clinical conditions with which BLCAP is associated.

Reference is now made to BLCAP BINDING SITE. BLCAP is a target gene of GAM26, corresponding to GAM26-TARGET GENE of FIG. 26A. BLCAP BINDING SITE is a binding site found in an untranslated region of BLCAP, corresponding to BINDING SITE of FIG. 26A. FIG. 26D illustrates the complementarity of the nucleotide sequence of BLCAP BINDING SITE, designate SEQ ID:457204, to the nucleotide sequence of GAM26 RNA of FIG. 26A, designated SEQ ID:20604. An additional function of GAM26 is therefore inhibition of (BLCAP). Accordingly, utilities of GAM26 include diagnosis and treatment of diseases and clinical conditions with which BLCAP is associated.

Reference is now made to BTBD1 BINDING SITE. BTBD1 is a target gene of GAM26, corresponding to GAM26-TARGET GENE of FIG. 26A. BTBD1 BINDING SITE is a binding site found in an untranslated region of BTBD1, corresponding to BINDING SITE of FIG. 26A. FIG. 26D illustrates the complementarity of the nucleotide sequence of BTBD1 BINDING SITE, designate SEQ ID:460514, to the nucleotide sequence of GAM26 RNA of FIG. 26A, designate SEQ ID:20604. A further function of GAM26 is therefore inhibition of (BTBD1). Accordingly, utilities of GAM26 include diagnosis and treatment of diseases and clinical conditions with which BTBD1 is associated.

Reference is now made to C12orf22 BINDING SITE. C12orf22 is a target gene of GAM26, corresponding to GAM26-TARGET GENE of FIG. 26A. C12orf22 BINDING SITE is a binding site found in an untranslated region of C12orf22, corresponding to BINDING SITE of FIG. 26A. FIG. 26D illustrates the complementarity of the nucleotide sequence of C12orf22 BINDING SITE, designated SEQ ID:463154, to the nucleotide sequence of GAM26 RNA of FIG. 26A, designated SEQ ID:20604. Yet a further function of GAM26 is therefore inhibition of (C12orf22). Accordingly, utilities of GAM26 include diagnosis and treatment of diseases and clinical conditions with which C12orf22 is associated.

Reference is now made to C12orf22 BINDING SITE. C12orf22 is a target gene of GAM26, corresponding to GAM26-TARGET GENE of FIG. 26A. C12orf22 BINDING SITE is a binding site found in an untranslated region of C12orf22, corresponding to BINDING SITE of FIG. 26A. FIG. 26D illustrates the complementarity of the nucleotide sequence of C12orf22 BINDING SITE, designated SEQ ID:463178, to the nucleotide sequence of GAM26

RNA of FIG. 26A, designated SEQ ID:20604. Another function of GAM26 is therefore inhibition of (C12orf22). Accordingly, utilities of GAM26 include diagnosis and treatment of diseases and clinical conditions with which C12orf22 is associated.

Reference is now made to C20orf124 BINDING SITE. C20orf124 is a target gene of GAM26, corresponding to GAM26-TARGET GENE of FIG. 26A. C20orf124 BINDING SITE is a binding site found in an untranslated region of C20orf124, corresponding to BINDING SITE of FIG. 26A. FIG. 26D illustrates the complementarity of the nucleotide sequence of C20orf124 BINDING SITE, designated SEQ ID:468753, to the nucleotide sequence of GAM26 RNA of FIG. 26A, designated SEQ ID:20604. Yet another function of GAM26 is therefore inhibition of (C20orf124). Accordingly, utilities of GAM26 include diagnosis and treatment of diseases and clinical conditions with which C20orf124 is associated.

Reference is now made to C20orf139 BINDING SITE. C20orf139 is a target gene of GAM26, corresponding to GAM26-TARGET GENE of FIG. 26A. C20orf139 BINDING SITE is a binding site found in an untranslated region of C20orf139, corresponding to BINDING SITE of FIG. 26A. FIG. 26D illustrates the complementarity of the nucleotide sequence of C20orf139 BINDING SITE, designated SEQ ID:469119, to the nucleotide sequence of GAM26 RNA of FIG. 26A, designated SEQ ID:20604. An additional function of GAM26 is therefore inhibition of (C20orf139). Accordingly, utilities of GAM26 include diagnosis and treatment of diseases and clinical conditions with which C20orf139 is associated.

Reference is now made to C20orf178 BINDING SITE. C20orf178 is a target gene of GAM26, corresponding to GAM26-TARGET GENE of FIG. 26A. C20orf178 BINDING SITE is a binding site found in an untranslated region of C20orf178, corresponding to BINDING SITE of FIG. 26A. FIG. 26D illustrates the complementarity of the nucleotide sequence of C20orf178 BINDING SITE, designated SEQ ID:470891, to the nucleotide sequence of GAM26 RNA of FIG. 26A, designated SEQ ID:20604. A further function of GAM26 is therefore inhibition of (C20orf178). Accordingly, utilities of GAM26 include diagnosis and treatment of diseases and clinical conditions with which C20orf178 is associated.

Reference is now made to C2orf7 BINDING SITE. C2orf7 is a target gene of GAM26, corresponding to GAM26-TARGET GENE of FIG. 26A. C2orf7 BINDING SITE is a binding site found in an untranslated region of C2orf7, corresponding to BINDING SITE of FIG. 26A. FIG. 26D illustrates the complementarity of the nucleotide sequence of C2orf7 BINDING SITE, designated SEQ ID:476575, to the nucleotide sequence of GAM26 RNA of FIG. 26A, designated SEQ ID:20604. Yet a further function of GAM26 is therefore inhibition of (C2orf7). Accordingly, utilities of GAM26 include diagnosis and treatment of diseases and clinical conditions with which C2orf7 is associated.

Reference is now made to C4S-2 BINDING SITE. C4S-2 is a target gene of GAM26, corresponding to GAM26-TARGET GENE of FIG. 26A. C4S-2 BINDING SITE is a binding site fund in an untranslated region of C4S-2, corresponding to BINDING SITE of FIG. 26D illustrates the complementarity of the nucleotide sequence of C4S-2 BINDING SITE, designated SEQ ID:477108, to the nucleotide sequence of GAM26 RNA of FIG. 26A, designated SEQ ID:20604. Another function of GAM26 is therefore inhibition of (C4S-2). Accordingly, utilities of GAM26 include diagnosis and treatment of diseases and clinical conditions with which C4S-2 is associated.

Reference is now made to CAMTA1 BINDING SITE. CAMTA1 is a target gene of GAM26, corresponding to GAM26-TARGET GENE of FIG. 26A. CAMTA1 BINDING SITE is a binding site found in an untranslated region of CAMTA1, corresponding to BINDING SITE of FIG. 26A. FIG. 26D illustrates the complementarity of the nucleotide sequence of CAMTA1 BINDING SITE, designated SEQ ID:483028, to the nucleotide sequence of GAM26 RNA of FIG. 26A, designate SEQ ID:20604. Yet another function of GAM26 is therefore inhibition of (CAMTA1). Accordingly, utilities of GAM26 include diagnosis and treatment of diseases and clinical conditions with which CAMTA1 is associated.

Reference is now made to CARM1 BINDING SITE. CARM1 is a target gene of GAM26, corresponding to GAM26-TARGET GENE of FIG. 26A. CARM1 BINDING SITE is a binding site found in an untranslated region of CARM1, corresponding to BINDING SITE of FIG. 26A. FIG. 26D illustrates the complementarity of the nucleotide sequence of CARM1 BINDING SITE, designated SEQ ID:483979, to the nucleotide sequence GAM26 RNA of FIG. 26A, designate SEQ ID:20604. An additional function of GAM26 is therefore inhibition of (CARM1). Accordingly, utilities of GAM26 include diagnosis and treatment of diseases and clinical conditions with which CARM1 is associated.

Reference is now made to CARM1 BINDING SITE. CARM1 is a target gene of GAM26, corresponding to GAM26-TARGET GENE of FIG. 26A. CARM1 BINDING SITE is a binding site found in an untranslated region of CARM1, corresponding to BINDING SITE of FIG. 26A. FIG. 26D illustrates the complementarity of the nucleotide sequence of CARM1 BINDING SITE, designate SEQ ID:483989, to the nucleotide sequence of GAM26 RNA of FIG. 26A, designate SEQ ID:20604. A further function of GAM26 is therefore inhibition of (CARM1). Accordingly, utilities of GAM26 include diagnosis and treatment of diseases and clinical conditions with which CARM1 is associated.

Reference is now made to CBLN1 BINDING SITE. CBLN1 is a target gene of GAM26, corresponding to GAM26-TARGET GENE of FIG. 26A. CBLN1 BINDING SITE is a binding site found in an untranslated region of CBLN1, corresponding to BINDING SITE of FIG. 26A. FIG. 26D illustrates the complementarity of the nucleotide sequence of CBLN1 BINDING SITE, designated SEQ ID:485030, to the nucleotide sequence of GAM26 RNA of FIG. 26A, designated SEQ ID:20604. Yet a further function of GAM26 is therefore inhibition of (CBLN1). Accordingly, utilities of GAM26 include diagnosis and treatment of diseases and clinical conditions with which CBLN1 is associated.

Reference is now made to CBLN1 BINDING SITE. CBLN1 is a target gene of GAM26, corresponding to GAM26-TARGET GENE of FIG. 26A. CBLN1 BINDING SITE is a binding site found in an untranslated region of CBLN1, corresponding to BINDING SITE of FIG. 26A. FIG. 26D illustrated the complementarity of the nucleotide sequence of CBLN1 BINDING SITE, designated SEQ ID:485054, to the nucleotide sequence of GAM26 RNA of FIG. 26A, designated SEQ ID:20604. Another function of GAM26 is therefore inhibition of (CBLN1). Accordingly, utilities of GAM26 include diagnosis and treatment of diseases and clinical conditions with which CBLN1 is associated.

Reference is now made to CDC14A BINDING SITE. CDC14A is a target gene of GAM26, corresponding to GAM26-TARGET GENE of FIG. 26A. CDC14A BINDING SITE is a binding site found in an untranslated region of CDC14A, corresponding to BINDING SITE of FIG. 26A. FIG. 26D illustrates the complementarity of the nucleotide sequence of CDC14A BINDING SITE, designated SEQ ID:487263, to the nucleotide sequence of GAM26 RNA of FIG. 26A, designated SEQ ID:20604. Yet another function of GAM26 is therefore inhibition of (CDC14A). Accordingly, utilities of GAM26 include diagnosis and treatment of diseases and clinical conditions with which CDC14A is associated.

Reference is now made to CDC14A BINDING SITE. CDC14A is a target gene of GAM26, corresponding to GAM26-TARGET GENE of FIG. 26A. CDC14A BINDING SITE is a binding site found in an untranslated region of CDC14A, corresponding to BINDING SITE of FIG. 26A. FIG. 26D illustrates the complementarity of the nucleotide sequence of CDC14A BINDING SITE, designated SEQ ID:487263, to the nucleotide sequence of GAM26 RNA of FIG. 26A, designated SEQ ID:20604. An additional function of GAM26 is therefore inhibition of (CDC14A). Accordingly, utilities of GAM26 include diagnosis and treatment of diseases and clinical conditions with which CDC14A is associated.

Reference is now made to CDC16 BINDING SITE. CDC16 is a target gene of GAM26, corresponding to GAM26-TARGET GENE of FIG. 26A. CDC16 BINDING SITE is a binding site found in an untranslated region of CDC16, corresponding to BINDING SITE of FIG. 26A. FIG. 26D illustrates the complementarity of the nucleotide sequence of CDC16 BINDING SITE, designated SEQ ID:487765, to the nucleotide sequence of GAM26 RNA of FIG. 26A, designated SEQ ID:20604. A further function of GAM26 is therefore inhibition of (CDC16). Accordingly, utilities of GAM26 include diagnosis and treatment of diseases and clinical conditions with which CDC16 is associated.

Reference is now made to CDC42BPB BINDING SITE. CDC42BPB is a target gene of GAM26, corresponding to GAM26-TARGET GENE of FIG. 26A. CDC42BPB BINDING SITE is a binding site found in an untranslated region of CDC42BPB, corresponding to BINDING SITE of FIG. 26A. FIG. 26D illustrates the complementarity of the nucleotide sequence of CDC42BPB BINDING SITE, designated SEQ ID:487991, to the nucleotide sequence of GAM26 RNA of FIG. 26A, designated SEQ ID:20604. Yet a further function of GAM26 is therefore inhibition of (CDC42BPB). Accordingly, utilities of GAM26 include diagnosis and treatment of diseases and clinical conditions with which CDC42BPB is associated.

Reference is now made to CDCA4 BINDING SITE. CDCA4 is a target gene of GAM26, corresponding to GAM26-TARGET GENE of FIG. 26A. CDCA4 BINDING SITE is a binding site found in an untranslated region of CDCA4, corresponding to BINDING SITE of FIG. 26A. FIG. 26D illustrates the complementarity of the nucleotide sequence of CDCA4 BINDING SITE, designated SEQ ID:488095, to the nucleotide sequence of GAM26 RNA of FIG. 26A, designated SEQ ID:20604. Another function of GAM26 is therefore inhibition of (CDCA4). Accordingly, utilities of GAM26 include diagnosis and treatment of diseases and clinical conditions with which CDCA4 is associated.

Reference is now made to CECR2 BINDING SITE. CECR2 is a target gene of GAM26, corresponding to GAM26-TARGET GENE of FIG. 26A. CECR2 BINDING SITE is a binding site found in an untranslated region of CECR2, corresponding to BINDING SITE of FIG. 26A. FIG. 26D illustrate the complementarity of the nucleotide sequence of CECR2 BINDING. SITE, designate SEQ ID:489555, to the nucleotide sequence GAM26 RNA of FIG. 26A, designated SEQ ID:20604. Yet another function of GAM26 is therefore inhibition of (CECR2). Accordingly, utilities of GAM26 include diagnosis and treatment of diseases and clinical conditions with which CECR2 is associated.

Reference is now made to CGGBP1 BINDING SITE. CGGBP1 is a target gene of GAM26, corresponding to GAM26-TARGET GENE of FIG. 26A. CGGBP1 BINDING SITE is a binding site found in an untranslated region of CGGBP1, corresponding to BINDING SITE of FIG. 26A. FIG. 26D illustrates the complementarity of the nucleotide sequence of CGGBP1 BINDING SITE, designate SEQ ID:492176, to the nucleotide sequence of GAM26 RNA of FIG. 26A, designate SEQ ID:20604. An additional function of GAM26 is therefore inhibition of (CGGBP1). Accordingly, utilities of GAM26 include diagnosis and treatment of diseases and clinical conditions with which CGGBP1 is associated.

Reference is now made to CGGBP1 BINDING SITE. CGGBP1 is a target gene of GAM26, corresponding to GAM26-TARGET GENE of FIG. 26A. CGGBP1 BINDING SITE is a binding site found in an untranslated region of CGGBP1, corresponding to BINDING SITE of FIG. 26A. FIG. 26D illustrates the complementarity of the nucleotide sequence of CGGBP1 BINDING SITE, designated SEQ ID:492221, to the nucleotide sequence of GAM26 RNA of FIG. 26A, designate SEQ ID:20604. A further function of GAM26 is therefore inhibition of (CGGBP1). Accordingly, utilities of GAM26 include diagnosis and treatment of diseases and clinical conditions with which CGGBP1 is associated.

Reference is now made to CHSY1 BINDING SITE. CHSY1 is a target gene of GAM26, corresponding to GAM26-TARGET GENE of FIG. 26A. CHSY1 BINDING SITE is a binding site found in an untranslated region of CHSY1, corresponding to BINDING SITE of FIG. 26A. FIG. 26D illustrates the complementarity of the nucleotide sequence of CHSY1 BINDING SITE, designated SEQ ID:494504, to the nucleotide sequence of GAM26 RNA of FIG. 26A, designated SEQ ID:20604. Yet a further function of GAM26 is therefore inhibition of (CHSY1). Accordingly, utilities of GAM26 include diagnosis and treatment of diseases and clinical conditions with which CHSY1 is associated.

Reference is now made to CHSY1 BINDING SITE. CHSY1 is a target gene of GAM26, corresponding to GAM26-TARGET GENE of FIG. 26A. CHSY1 BINDING SITE is a binding site found in an untranslated region of CHSY1, corresponding to BINDING SITE of FIG. 26A. FIG. 26D illustrates the complementarity of the nucleotide sequence of CHSY1 BINDING SITE, designate SEQ ID:494516, to the nucleotide sequence of GAM26 RNA of FIG. 26A, designated SEQ ID:20604. Another function of GAM26 is therefore inhibition of (CHSY1). Accordingly, utilities of GAM26 include diagnosis and treatment of diseases and clinical conditions with which CHSY1 is associated.

Reference is now made to CHSY1 BINDING SITE. CHSY1 is a target gene of GAM26, corresponding to GAM26-TARGET GENE of FIG. 26A. CHSY1 BINDING SITE is a binding site found in an untranslated region of CHSY1, corresponding to BINDING SITE of FIG. 26A. FIG. 26D illustrates the complementarity of the nucleotide sequence of CHSY1 BINDING SITE, designated SEQ ID:494532, to the nucleotide sequence of GAM26 RNA of FIG. 26A, designated SEQ ID:20604. Yet another function of GAM26 is therefore inhibition of (CHSY1). Accordingly, utilities of GAM26 include diagnosis and treatment of diseases and clinical conditions with which CHSY1 is associated.

Reference is now made to CHSY1 BINDING SITE. CHSY1 is a target gene of GAM26, corresponding to GAM26-TARGET GENE of FIG. 26A. CHSY1 BINDING SITE is a binding site found in an untranslated region of CHSY1, corresponding to BINDING SITE of FIG. 26A. FIG. 26D illustrates the complementarity of the nucleotide sequence of CHSY1 BINDING SITE, designated SEQ ID:494603, to the nucleotide sequence of GAM26 RNA of FIG. 26A, designated SEQ ID:20604. An additional function of GAM26 is therefore inhibition of (CHSY1). Accordingly, utilities of GAM26 include diagnosis and treatment of diseases and clinical conditions with which CHSY1 is associated.

Reference is now made to CLSTN1 BINDING SITE. CLSTN1 is a target gene of GAM26, corresponding to GAM26-TARGET GENE of FIG. 26A. CLSTN1 BINDING SITE is a binding site found in an untranslated region of CLSTN1, corresponding to BINDING SITE of FIG. 26A. FIG. 26D illustrates the complementarity of the nucleotide sequence of CLSTN1 BINDING SITE, designated SEQ ID:496944, to the nucleotide sequence of GAM26 RNA of FIG. 26A, designated SEQ ID:20604. A further function of GAM26 is therefore inhibition of (CLSTN1). Accordingly, utilities of GAM26 include diagnosis and treatment of diseases and clinical conditions with which CLSTN1 is associated.

Reference is now made to CNNM3 BINDING SITE. CNNM3 is a target gene of GAM26, corresponding to GAM26-TARGET GENE of FIG. 26A. CNNM3 BINDING SITE is a binding site found in an untranslated region of CNNM3, corresponding to BINDING SITE of FIG. 26A. FIG. 26D illustrates the complementarity of the nucleotide sequence of CNNM3 BINDING SITE, designate SEQ ID:498002, to the nucleotide sequence of GAM26 RNA of FIG. 26A, designated SEQ ID:20604. Yet a further function of GAM26 is therefore inhibition of (CNNM3). Accordingly, utilities of GAM26 include diagnosis and treatment of diseases and clinical conditions with which CNNM3 is associated.

Reference is now made to COASTER BINDING SITE. COASTER is a target gene of GAM26, corresponding to GAM26-TARGET GENE of FIG. 26A. COASTER BINDING SITE is a binding site found in an untranslated region of COASTER, corresponding to BINDING SITE of FIG. 26A. FIG. 26D illustrates the complementarity of the nucleotide sequence of COASTER BINDING SITE, designated SEQ ID:498924, to the nucleotide sequence of GAM26 RNA of FIG. 26A, designated SEQ ID:20604. Another function of GAM26 is therefore inhibition of (COASTER). Accordingly, utilities of include diagnosis and treatment of diseases and clinical conditions with which COASTER is associated.

Reference is now made to COL4A3BP BINDING SITE. COL4A3BP is a target gene of GAM26, corresponding to GAM26-TARGET GENE of FIG. 26A. COL4A3BP BINDING SITE is a binding site found in an untranslated region of COL4A3BP, corresponding to BINDING SITE of FIG. 26A. FIG. 26D illustrates the complementarity of the nucleotide sequence of COL4A3BP BINDING SITE, designated SEQ ID:499352, to the nucleotide sequence of GAM26 RNA of FIG. 26A, designated SEQ ID:20604. Yet another function of GAM26 is therefore inhibition of (COL4A3BP). Accordingly, utilities of GAM26 include diagnosis and treatment of diseases and clinical conditions with which COL4A3BP is associated.

Reference is now made to CTCF BINDING SITE. CTCF is a target gene of GAM26, corresponding to GAM26-TARGET GENE of FIG. 2A. CTCF BINDING SITE is a binding site found in an untranslated region of CTF, corresponding to BINDING SITE of FIG. 26A. FIG. 26D illustrates the complementarity of the nucleotide sequence of CTCF BINDING SITE, designated SEQ ID:503528, to the nucleotide sequence of GAM26 RNA of FIG. 26A, designated SEQ ID:20604. An additional function of GAM26 is therefore inhibition of (CTCF). Accordingly, utilities of GAM26 include diagnosis and treatment of diseases and clinical conditions with which CTCF is associated.

Reference is now made to CTCF BINDING SITE. CTCF is a target gene of GAM26, corresponding to GAM26-TARGET GENE of FIG. 26A. CTCF BINDING SITE is a binding site fund in an untranslated region of CTCF, corresponding to BINDING SITE of FIG. 26A. FIG. 26D illustrates the complementarity of the nucleotide sequence of CTCF BINDING SITE, designated SEQ ID:503529, to the nucleotide sequence of GAM26 RNA of FIG. 26A, designated SEQ ID:20604. A further function of GAM26 is therefore inhibition of (CTCF). Accordingly, utilities of GAM26 include diagnosis and treatment of diseases and clinical conditions with which CTCF is associated.

Reference is now made to DDM36 BINDING SITE. DDM36 is a target gene of GAM26, corresponding to GAM26-TARGET GENE of FIG. 26A. DDM36 BINDING SITE is a binding site found in an untranslated region of DDM36, corresponding to BINDING SITE of FIG. 26A. FIG. 26D illustrate the complementarity of the nucleotide sequence of DDM36 BINDING SITE, designated SEQ ID:508506, to the nucleotide sequence of GAM26 RNA of FIG. 26A, designated SEQ ID:20604. Yet a further function of GAM26 is therefore inhibition of (DDM36). Accordingly, utilities of GAM26 include diagnosis and treatment of diseases and clinical conditions with which DDM36 is associated.

Reference is now made to DDM36 BINDING SITE. DDM36 is a target gene of GAM26, corresponding to GAM26-TARGET GENE of FIG. 26A. DDM36 BINDING SITE is a binding site found in an untranslated region of DDM36, corresponding to BINDING SITE of FIG. 26A. FIG. 26D illustrates the complementarity of the nucleotide sequence of DDM36 BINDING SITE, designate SEQ ID:508575, to the nucleotide sequence of GAM26 RNA of FIG. 26A, designated SEQ ID:20604. Another function of GAM26 is therefore inhibition of (DDM36). Accordingly, utilities of GAM26 include diagnosis and treatment of diseases and clinical conditions with which DDM36 is associated.

Reference is now made to DKFZP434D1335 BINDING SITE. DKFZP434D1335 is a target gene of GAM26, corresponding GAM26-TARGET GENE of FIG. 26A. DKFZP434D1335 BINDING SITE is a binding site found in an untranslated region of DKFZP434D1335, corresponding to BINDING SITE of FIG. 26A. FIG. 26D illustrates the complementarity of the nucleotide sequence of DKFZP434D1335 BINDING SITE, designated SEQ ID:516151, to the nucleotide sequence of GAM26 RNA of FIG. 26A, designated SEQ ID:20604. Yet another function of GAM26 is therefore inhibition of (DKFZP434D1335). Accordingly, utilities of GAM26 include diagnosis and treatment of diseases and clinical conditions with which DKFZP434D1335 is associated.

Reference is now made to DKFZP434J154 BINDING SITE. DKFZP434J154 is a target gene of GAM26, corresponding to GAM26-TARGET GENE of FIG. 26A. DKFZP434J154 BINDING SITE is a binding site found in an untranslated region of DKFZP434J154, corresponding to BINDING SITE of FIG. 26A. FIG. 26D illustrates the complementarity of the nucleotide sequence of DKFZP434J154 BINDING SITE, designated SEQ ID:520474, to the nucleotide sequence of GAM26 RNA of FIG. 26A, designated SEQ ID:20604. An additional function of GAM26 is therefore inhibition of (DKFZP434J154). Accordingly utilities of GAM26 include diagnosis and treatment of diseases and clinical conditions with which DKFZP434J154 is associated.

Reference is now made to DKFZP434N093 BINDING SITE. DKFZP434N093 is a target gene of GAM26, corresponding to GAM26-TARGET GENE of FIG. 26A. DKFZP434N093 BINDING SITE is a binding site found in an untranslated region of DKFZP434N093, corresponding to BINDING SITE of FIG. 26A. FIG. 26D illustrates the complementarity of the nucleotide sequence of DKFZP434N093 BINDING SITE, designated SEQ ID:522414, to the nucleotide sequence of GAM26 RNA of FIG. 26A, designated SEQ ID:20604. A further function of GAM26 is therefore inhibition of (DKFZP434N093). Accordingly, utilities of GAM26 include diagnosis and treatment of diseases and clinical conditions with which DKFZP434N093 is associated.

Reference is now made to DKFZP434P106 BINDING SITE. DKFZP434P106 is a target gene of GAM26, corresponding to GAM26-TARGET GENE of FIG. 26A. DKFZP434P106 BINDING SITE is a binding site found in an untranslated region of DKFZP434P106, corresponding to BINDING SITE of FIG. 26A. FIG. 26D illustrates the complementarity of the nucleotide sequence of DKFZP434P106 BINDING SITE, designated SEQ ID:523992, to the nucleotide sequence of GAM26 RNA of FIG. 26A, designated SEQ ID:20604. Yet a further function of GAM26 therefore inhibition of (DKFZP434P106). Accordingly, utilities of GAM26 include diagnosis and treatment of diseases and clinical conditions with which DKFZP434P106 is associated.

Reference is now made to DKFZP566A1524 BINDING SITE. DKFZP566A1524 is a target gene of GAM26, corresponding of GAM26-TARGET GENE of FIG. 26A. DKFZP566A1524 BINDING SITE is a binding site found in an untranslated region of DKFZP566A1524, corresponding to BINDING SITE of FIG. 26A. FIG. 26D illustrates the complementarity of the nucleotide sequence DKFZP566A1524 BINDING SITE, designated SEQ ID:531199, to the nucleotide sequence of GAM26 RNA of FIG. 26A, designated SEQ ID:20604. Another function of GAM26 is therefore inhibition of (DKFZP566A1524). Accordingly, utilities of GAM26 include diagnosis and treatment of diseases and clinical conditions with which DKFZP566A1524 is associated.

Reference is now made to DKFZP566K1924 BINDING SITE. DKFZP566K1924 is a target gene of GAM26, corresponding to GAM26-TARGET GENE of FIG. 26A. DKFZP566K1924 BINDING SITE is a binding site found in an untranslated region of DKFZP566K1924, corresponding to BINDING SITE of FIG. 26A. FIG. 26D illustrates the complementarity of the nucleotide sequence of DKFZP566K1924 BINDING SITE, designated SEQ ID:532863, to the nucleotide sequence of GAM26 RNA of FIG. 26A, designated SEQ ID:20604. Yet another function of GAM26 is therefore inhibition of (DKFZP566K1924). Accordingly, utilities of GAM26 include diagnosis and treatment of diseases and clinical conditions with which DKFZP566K1924 is associated.

Reference is now made to DKFZp761B0514 BINDING SITE. DKFZp761B0514 is a target gene of GAM26, corresponding to GAM26-TARGET GENE of FIG. 26A. DKFZp761B0514 BINDING SITE is a binding site found in an untranslated region of DKFZp761B0514, corresponding to BINDING SITE of FIG. 26A. FIG. 26D illustrates the complementarity of the nucleotide sequence of DKFZp761B0514 BINDING SITE, designated SEQ ID:536448, to the nucleotide sequence of GAM26 RNA of FIG. 26A, designated SEQ ID:20604. An additional function of GAM26 is therefore inhibition of (DKFZp761B0514). Accordingly, utilities of GAM26 include diagnosis and treatment of diseases and clinical conditions with which DKFZp761B0514 is associated.

Reference is now made to DKFZp762E1511 BINDING SITE. DKFZp762E1511 is a target gene of GAM26, corresponding to GAM26-TARGET GENE of FIG. 26A. DKFZp762E1511 BINDING SITE is a binding site found in an untranslated region of DKFZp762E1511, corresponding to BINDING SITE of FIG. 26A. FIG. 26D illustrates the complementarity of the nucleotide sequence of DKFZp762E1511 BINDING SITE, designated SEQ ID:539970, to the nucleotide sequence of GAM26 RNA of FIG. 26A, designated SEQ ID:20604. A further function of GAM26 is therefore inhibition of (DKFZp762E1511). Accordingly, utilities of GAM26 include diagnosis and treatment of diseases and clinical conditions with which DKFZp762E1511 is associated.

Reference is now made to Dlc2 BINDING SITE. Dlc2 is a target gene of GAM26, corresponding to GAM26-TARGET GENE of FIG. 26A. Dlc2 BINDING SITE is a binding site found in an untranslated region of Dlc2, corresponding to BINDING SITE of FIG. 26A. FIG. 26D illustrates the complementarity of the nucleotide sequence of Dlc2 BINDING SITE, designated SEQ ID:540962, to the nucleotide sequence of GAM26 RNA of FIG. 26A, designated SEQ ID:20604. Yet a further function of GAM26 is therefore inhibition of (Dlc2). Accordingly, utilities of GAM26 include diagnosis and treatment of diseases and clinical conditions with which Dlc2 is associated.

Reference is now made to E46L BINDING SITE. E46L is a target gene of GAM26, corresponding to GAM26-TARGET GENE of FIG. 26A. E46L BINDING SITE is a binding site found in an untranslated region of E46L, corresponding to BINDING SITE of FIG. 26A. FIG. 26D illustrates the complementarity of the nucleotide sequence of E46L BINDING SITE, designated SEQ ID:545962, to the nucleotide sequence of GAM26 RNA of FIG. 26A, designated SEQ ID:20604. Another function of GAM26 is therefore inhibition of (E46L). Accordingly, utilities of GAM26 include diagnosis and treatment of diseases and clinical conditions with which E46L is associated.

Reference is now made to E46L BINDING SITE. E46L is a target gene of GAM26, corresponding to GAM26-TARGET GENE of FIG. 26A. E46L BINDING SITE is a binding site found in an untranslated region of E46L, corresponding to BINDING SITE of FIG. 26A. FIG. 26D illustrates the complementarity of the nucleotide sequence of E46L BINDING SITE, designated SEQ ID:545966, to the nucleotide sequence of GAM26 RNA of FIG. 26A, designated SEQ ID:20604. Yet another function of GAM26 is therefore inhibition of (E46L). Accordingly, utilities of GAM26 include diagnosis and treatment of diseases and clinical conditions with which E46L is associated.

Reference is now made to EHM2 BINDING SITE. EHM2 is a target gene of GAM26, corresponding to GAM26-TARGET GENE of FIG. 26A. EHM2 BINDING SITE is a binding site found in an untranslated region of EHM2, corresponding to BINDING SITE of FIG. 26A. FIG. 26D illustrates the complementarity of the nucleotide sequence of EHM2 B DING SITE, designated SEQ ID:547115, to the nucleotide sequence of GAM26 RNA of FIG. 26A, designated SEQ ID:20604. An additional function of GAM26 is therefore inhibition of (EHM2). Accordingly, utilities of GAM26 include diagnosis and treatment of diseases and clinical conditions with which EHM2 is associated.

Reference is now made to EHM2 BINDING SITE. EHM2 is a target gene of GAM26, corresponding to GAM26-TARGET GENE of FIG. 26A. EHM2 BINDING SITE is a binding site found in an untranslated region of EHM2, corresponding to BINDING SITE of FIG. 26A. FIG. 26D illustrates the complementarity of the nucleotide sequence of EHM2 BINDING SITE, designated SEQ ID:547149, to the nucleotide sequence of GAM26 RNA of FIG. 26A, designated SEQ ID:20604, A further function of GAM26 is therefore inhibition of (EHM2). Accordingly, utilities of GAM26 include diagnosis and treatment of diseases and clinical conditions with which EHM2 is associated.

Reference is now made to EHM2 BINDING SITE. EHM2 is a target gene of GAM26, corresponding to GAM26-TARGET GENE of FIG. 26A. EHM2 BINDING SITE is a binding site found in an untranslated region of EHM2, corresponding to BINDING SITE of FIG. 26A. FIG. 26D illustrates the complementarity of the nucleotide sequence of EHM2 BINDING SITE, designated SEQ ID:547151, to the nucleotide sequence of GAM26 RNA of FIG. 26A, designated SEQ ID:20604. Yet a further function of GAM26 is therefore inhibition of (EHM2). Accordingly, utilities of GAM26 include diagnosis and treatment of diseases and clinical conditions with which EHM2 is associated.

Reference is now made to ELKS BINDING SITE. ELKS is a target gene of GAM26, corresponding to GAM26-TARGET GENE of FIG. 26A. ELKS BINDING SITE is a binding site found in an untranslated region of ELKS, corresponding to BINDING SITE of FIG. 26A. FIG. 26D illustrates the complementarity of the nucleotide sequence of ELKS BINDING SITE, designated SEQ ID:548280, to the nucleotide sequence of GAM26 RNA of FIG. 26A, designated SEQ ID:20604. Another function of GAM26 is therefore inhibition of (ELKS). Accordingly, utilities of GAM26 include diagnosis and treatment of diseases and clinical conditions with which ELKS is associated.

Reference is now made to ELKS BINDING SITE. ELKS is a target gene of GAM26, corresponding to GAM26-TARGET GENE of FIG. 26A. ELKS BINDING SITE is a binding site found in an untranslated region of ELKS, corresponding to BINDING SITE of FIG. 26A. FIG. 26D illustrates the complementarity of the nucleotide sequence of ELKS BINDING SITE, designated SEQ ID:548281, to the nucleotide sequence of GAM26 RNA of FIG. 26A, designated SEQ ID:20604. Yet another function of GAM26 is therefore inhibition of (ELKS). Accordingly, utilities of GAM26 include diagnosis and treatment of diseases and clinical conditions with which ELKS is associated.

Reference is now made to ELKS BINDING SITE. ELKS is a target gene of GAM26, corresponding to GAM26-TARGET GENE of FIG. 26A. ELKS BINDING SITE is a binding site found in an untranslated region of ELKS, corresponding to BINDING SITE of FIG. 26. FIG. 26D illustrates the complementarity of the nucleotide sequence of ELKS BINDING SITE, designated SEQ ID:548286, to the nucleotide sequence of GAM26 RNA of FIG. 26A, designated SEQ ID:20604. An additional function of GAM26 is therefore inhibition of (ELKS). Accordingly, utilities of GAM26 include diagnosis and treatment of diseases and clinical conditions with which ELKS is associated.

Reference is now made to ELKS BINDING SITE. ELKS is a target gene of GAM26, corresponding to GAM26-TARGET GENE of FIG. 26A. ELKS BINDING SITE is a binding site found in an untranslated region of ELKS, corresponding to BINDING SITE of FIG. 26A. FIG. 26D illustrates the complementarity of the nucleotide sequence of ELKS BINDING SITE, designated SEQ ID:548299, to the nucleotide sequence of GAM26 RNA of FIG. 26A, designated SEQ ID:20604. A further function of GAM26 is therefore inhibition of (ELKS). Accordingly, utilities of GAM26 include diagnosis and treatment of diseases and clinical conditions with which ELKS is associated.

Reference is now made to ELL2 BINDING SITE. ELL2 is a target gene of GAM26, corresponding to GAM26-TARGET GENE of FIG. 26A. ELL2 BINDING SITE is a binding site found in an untranslated region of ELL2, corresponding to BINDING SITE of FIG. 26A. FIG. 26D illustrates the complementarity of the nucleotide sequence of ELL2 BINDING SITE, designated SEQ ID:548421, to the nucleotide sequence of GAM26 RNA of FIG. 26A, designated SEQ ID:20604. Yet a further function of GAM26 is therefore inhibition of (ELL2). Accordingly, utilities of GAM26 include diagnosis and treatment of diseases and clinical conditions with which ELL2 is associated.

Reference is now made to ELL2 BINDING SITE. ELL2 is a target gene of GAM26, corresponding to GAM26-TARGET GENE of FIG. 26A. ELL2 BINDING SITE is a binding site found in an untranslated region of ELL2, corresponding to BINDING SITE of FIG. 26A. FIG. 26D illustrates the complementarity of the nucleotide sequence of ELL2 BINDING SITE, designated SEQ ID:548442, to the nucleotide sequence of GAM26 RNA of FIG. 26A, designated SEQ ID:20604. Another function of GAM26 is therefore inhibition of (ELL2). Accordingly, utilities of GAM26 include diagnosis and treatment of diseases and clinical conditions with which ELL2 is associated.

Reference is now made to FAF1 BINDING SITE. FAF1 is a target gene of GAM26, corresponding to GAM26-TARGET GENE of FIG. 26A. FAF1 BINDING SITE is a binding site found in an untranslated region of FAF1, corresponding to BINDING SITE of FIG. 26A. FIG. 26D illustrates the complementarity of the nucleotide sequence of FAF1 BINDING SITE, designated SEQ ID:552942, to the nucleotide sequence of GAM26 RNA of FIG. 26A, designated SEQ ID:20604. Yet another function of GAM26 is therefore inhibition of (FAF1). Accordingly, utilities of GAM26 include diagnosis and treatment of diseases and clinical conditions with which FAF1 is associated.

Reference is now made to FAF1 BINDING SITE. FAF1 is a target gene of GAM26, corresponding to GAM26-TARGET GENE of FIG. 26A. FAF1 BINDING SITE is a binding site found in an untranslated region of FAF1, corresponding to BINDING SITE of FIG. 26A. FIG. 26D illustrates the complementarity of the nucleotide sequence of FAF1 BINDING SITE, designated SEQ ID:552963, to the nucleotide sequence of GAM26 RNA of FIG. 26A, designated SEQ ID:20604. An additional function of GAM26 is therefore inhibition of (FAF1). Accordingly, utilities of GAM26 include diagnosis and treatment of diseases and clinical conditions with which FAF1 is associated.

Reference is now made to FEM1B BINDING SITE. FEM1B is a target gene of GAM26, corresponding to GAM26-TARGET GENE of FIG. 26A. FEM1B BINDING SITE is a binding site found in an untranslated region of FEM1B, corresponding to BINDING SITE of FIG. 26A. FIG. 26D illustrate the complementarity of the nucleotide sequence of FEM1B BINDING SITE, designated SEQ ID:556003, to the nucleotide sequence of GAM26 RNA of FIG. 26A, designated SEQ ID:20604. A further function of GAM26 is therefore inhibition of (FEM1B). Accordingly, utilities of GAM26 include diagnosis and treatment of diseases and clinical conditions with which FEM1B is associated.

Reference is now made to FJX1 BINDING SITE. FJX1 is a target gene of GAM26, corresponding to GAM26-TARGET GENE of FIG. 26A. FJX1 BINDING SITE is a binding site found in an untranslated region of FJX1, corresponding to BINDING SITE of FIG. 26A. FIG. 26D illustrates the complementarity of the nucleotide sequence of FJX1 BINDING SITE, designated SEQ ID:557158, to the nucleotide sequence of GAM26 RNA of FIG. 26A, designated SEQ ID:20604. Yet a further function of GAM26 is therefore inhibition of (FJX1). Accordingly, utilities of GAM26 include diagnosis and treatment of diseases and clinical conditions with which FJX1 is associated.

Reference is now made to FLJ10211 BINDING SITE. FLJ0211 is a target gene of GAM26, corresponding to GAM26-TARGET GENE of FIG. 26A. FLJ10211 BINDING SITE is a binding site found in an untranslated region of FLJ10211, corresponding to BINDING SITE of FIG. 26A. FIG. 26D illustrates the complementarity of the nucleotide sequence of FLJ10211 BINDING SITE, designated SEQ ID:562466, to the nucleotide sequence of GAM26 RNA of FIG. 26A, designated SEQ ID:20604. Another function of GAM26 is therefore inhibition of (FLJ10211). Accordingly, utilities of GAM26 include diagnosis and treatment of diseases and clinical conditions with which FLJ10211 is associated.

Reference is now made to FLJ10211 BINDING SITE. FLJ10211 is a target gene of GAM26, corresponding to GAM26-TARGET GENE of FIG. 26A. FLJ0211 BINDING SITE is a binding site found in an untranslated region of FLJ10211, corresponding to BINDING SITE of FIG. 26A. FIG. 26D illustrates the complementarity of the nucleotide sequence of FLJ10211 BINDING SITE, designated SEQ ID:562496, to the nucleotide sequence of GAM26 RNA of FIG. 26A, designated SEQ ID:20604. Yet another function of GAM26 is therefore inhibition of (FLJ10211). Accordingly, utilities of GAM26 include diagnosis and treatment of diseases and clinical conditions with which FLJ10211 is associated.

Reference is now made to FLJ10211 BINDING SITE. FLJ10211 is a target gene of GAM26, corresponding to GAM26-TARGET GENE of FIG. 26A. FLJ10211 BINDING SITE is a binding site found in an untranslated region of FLJ10211, corresponding to BINDING SITE of FIG. 26A. FIG. 26D illustrates the complementarity of the nucleotide sequence of FLJ10211 BINDING SITE, designate SEQ ID:562509, to the nucleotide sequence of GAM26 RNA of FIG. 26A, designate SEQ ID:20604. An additional function of GAM26 is therefore inhibition of (FLJ10211). Accordingly, utilities of GAM26 include diagnosis and treatment of diseases and clinical conditions with which FLJ10211 is associated.

Reference is now made to FLJ10244 BINDING SITE. FLJ10244 is a target gene of GAM26, corresponding to GAM26-TARGET GENE of FIG. 26A. FLJ10244 BINDING SITE is a binding site found in an untranslated region of FLJ10244, corresponding to BINDING SITE of FIG. 26A. FIG. 26D illustrates the complementarity of the nucleotide sequence of FLJ10244 BINDING SITE, designated SEQ ID:562895, to the nucleotide sequence of GAM26 RNA of FIG. 26A, designated SEQ ID:20604. A further function of GAM2 is therefore inhibition of (FLJ10244). Accordingly, utilities of GAM26 include diagnosis and treatment of diseases and clinical conditions with which FLJ10244 is associated.

Reference is now made to FLJ10244 BINDING SITE. FLJ10244 is a target gene of GAM26, corresponding to GAM26-TARGET GENE of FIG. 26A. FLJ10244 BINDING SITE is a binding site found in an untranslated region of FLJ10244, corresponding to BINDING SITE of FIG. 26A. FIG. 26D illustrate the complementarity of the nucleotide sequence of FLJ10244 BINDING SITE, designate SEQ ID:562897, to the nucleotide sequence of GAM26 RNA of FIG. 26A, designated SEQ ID:20604. Yet a further function of GAM26 is therefore inhibition of (FLJ10244). Accordingly, utilities of GAM26 include diagnosis and treatment of diseases and clinical conditions with which FLJ10244 is associated.

Reference is now made to FLJ10244 BINDING SITE. FLJ10244 is a target gene of GAM26, corresponding to GAM26-TARGET GENE of FIG. 26A. FLJ10244 BINDING SITE is a binding site found in an untranslated region of FLJ10244, corresponding to BINDING SITE of FIG. 26A. FIG. 26D illustrates the complementarity of the nucleotide sequence of FLJ10244 BINDING SITE, designated SEQ ID:562906, to the nucleotide sequence of GAM26 RNA of FIG. 26A, designated SEQ ID:20604. Another function of GAM26 is therefore inhibition of (FLJ10244). Accordingly, utilities of GAM26 include diagnosis and treatment of diseases and clinical conditions with which FLJ10244 is associated.

Reference is now made to FLJ10244 BINDING SITE. FLJ10244 is a target gene of GAM26, corresponding to GAM26-TARGET GENE of FIG. 26A. FLJ10244 BINDING SITE, is a binding site found in an untranslated region of FLJ10244, corresponding to BINDING SITE of FIG. 26A. FIG. 26D illustrates the complementarity of the nucleotide sequence of FLJ10244 BINDING SITE, designated SEQ ID:562923, to the nucleotide sequence of GAM26 RNA of FIG. 26A, designated SEQ ID:20604. Yet another function of GAM26 is therefore inhibition of (FLJ10244). Accordingly, utilities of GAM26 include diagnosis and treatment of diseases and clinical conditions with which FLJ10244 is associated.

Reference is now made to FLJ10244 BINDING SITE. FLJ10244 is a target gene of GAM26, corresponding to GAM26-TARGET GENE of FIG. 26A. FLJ10244 BINDING SITE is a binding site found in an untranslated region of FLJ10244, corresponding to BINDING SITE of FIG. 26A. FIG. 26D illustrates the complementarity of the nucleotide sequence of FLJ10244 BINDING SITE, designated SEQ ID:562943, to the nucleotide sequence of GAM26 RNA of FIG. 26A, designate SEQ ID:20604. An additional function of GAM26 is therefore inhibition of (FLJ10244).

Accordingly, utilities of GAM26 include diagnosis and treatment of diseases and clinical conditions with which FLJ10244 is associated.

Reference is now made to FLJ10342 BINDING SITE. FLJ10342 is a target gene of GAM26, corresponding to GAM26-TARGET GENE of FIG. 26A. FLJ10342 BINDING SITE is a binding site found in an untranslated region of FLJ10342, corresponding to BINDING SITE of FIG. 26A. FIG. 26D illustrates the complementarity of the nucleotide sequence of FLJ10342 BINDING SITE, designated SEQ ID:564347, to the nucleotide sequence of GAM26 RNA of FIG. 26A, designated SEQ ID:20604. A further function of GAM26 is therefore inhibition of (FLJ10342). Accordingly, utilities of GAM26 include diagnosis and treatment of diseases and clinical conditions with which FLJ10342 is associated.

Reference is now made to FLJ10648 BINDING SITE. FLJ10648 is a target gene of GAM26, corresponding to GAM26-TARGET GENE of FIG. 26A. FLJ10648 BINDING SITE is a binding site found in an untranslated region of FLJ10648, corresponding to BINDING SITE of FIG. 26A. FIG. 26D illustrates the complementarity of the nucleotide sequence of FLJ10648 BINDING SITE, designated SEQ ID:569200, to the nucleotide sequence of GAM26 RNA of FIG. 26A, designated SEQ ID:20604. Yet a further function of GAM26 is therefore inhibition of (FLJ10648). Accordingly, utilities of GAM26 include diagnosis and treatment of diseases and clinical conditions with which FLJ10648 is associated.

Reference is now made to FLJ10709 BINDING SITE. FLJ10709 is a target gene of GAM26, corresponding to GAM26-TARGET GENE of FIG. 26A. FLJ10709 BINDING SITE is a binding site found in an untranslated region of FLJ10709, corresponding to BINDING SITE of FIG. 26A. FIG. 26D illustrates the complementarity of the nucleotide sequence of FLJ10709 BINDING SITE, designated SEQ ID:570431, to the nucleotide sequence of GAM26 RNA of FIG. 26A, designated SEQ ID:20604. Another function of GAM26 is therefore inhibition of (FLJ10709). Accordingly, utilities of GAM26 include diagnosis and treatment of diseases and clinical conditions with which FLJ10709 is associated.

Reference is now made to FLJ10856 BINDING SITE. FLJ10856 is a target gene of GAM26, corresponding to GAM2 TARGET GENE of FIG. 26A. FLJ10856 BINDING SITE is a binding site found in an untranslated region of FLJ10856, corresponding to BINDING SITE of FIG. 26A. FIG. 26D illustrates the complementarity of the nucleotide sequence of FLJ10856 BINDING SITE, designated SEQ ID:574295, to the nucleotide sequence of GAM26 RNA of FIG. 26A, designated SEQ ID:20604. Yet another function of GAM26 is therefore inhibition of (FLJ10856). Accordingly, utilities of GAM26 include diagnosis and treatment of diseases and clinical conditions with which FLJ10856 is associated.

Reference is now made to FLJ10925 BINDING SITE. FLJ10925 is a target gene of GAM26, corresponding to GAM26-TARGET GENE of FIG. 26A. FLJ10925 BINDING SITE is a binding site found in an untranslated region of FLJ10925, corresponding to BINDING SITE of FIG. 26A. FIG. 26D illustrate the complementarity of the nucleotide sequence of FLJ10925 BINDING SITE, designated SEQ ID:575621, to the nucleotide sequence of GAM26 RNA of FIG. 26A, designated SEQ ID:20604. An additional function of GAM26 is therefore inhibition of (FLJ0925). Accordingly, utilities of GAM26 include diagnosis and treatment of diseases and clinical conditions with which FLJ10925 is associated.

Reference is now made to FLJ10996 BINDING SITE. FLJ10996 is a target gene of GAM26, corresponding to GAM26-TARGET GENE of FIG. 26A. FLJ10996 BINDING SITE is a binding site found in an untranslated region of FLJ10996, corresponding to BINDING SITE of FIG. 26A. FIG. 26D illustrates the complementarity of the nucleotide sequence of FLJ10996 BINDING SITE, designated SEQ ID:576651, to the nucleotide sequence of GAM26 RNA of FIG. 26A, designated SEQ ID:20604. A further function of GAM26 is therefore inhibition of (FLJ10996). Accordingly, utilities of GAM26 include diagnosis and treatment of diseases and clinical conditions with which FLJ10996 is associated.

Reference is now made to FLJ11700 BINDING SITE. FLJ11700 is a target gene of GAM26, corresponding to GAM26-TARGET GENE of FIG. 26A. FLJ11700 BINDING SITE is a binding site found in an untranslated region of FLJ11700, corresponding to BINDING SITE of FIG. 26A. FIG. 26D illustrates the complementarity of the nucleotide sequence of FLJ11700 BINDING SITE, designated SEQ ID:582367, to the nucleotide sequence of GAM26 RNA of FIG. 26A, designated SEQ ID:20604. Yet a further function of GAM26 is therefore inhibition of (FLJ11700). Accordingly, utilities of GAM26 include diagnosis and treatment of diseases and clinical conditions with which FLJ11700 is associated.

Reference is now made to FLJ12363 BINDING SITE. FLJ12363 is a target gene of GAM26, corresponding to GAM26-TARGET GENE of FIG. 26A. FLJ12363 BINDING SITE is a binding site found in an untranslated region of FLJ12363, corresponding to BINDING SITE of FIG. 26A. FIG. 26D illustrates the complementarity of the nucleotide sequence of FLJ12363 BINDING SITE, designated SEQ ID:587504, to the nucleotide sequence of GAM26 RNA of FIG. 26A, designated SEQ ID:20604. Another function of GAM26 is therefore inhibition of (FLJ12363). Accordingly, utilities of GAM26 include diagnosis and treatment of diseases and clinical conditions with which FLJ12363 is associated.

Reference is now made to FLJ12363 BINDING SITE. FLJ12363 is a target gene of GAM26, corresponding to GAM26-TARGET GENE of FIG. 26A. FLJ12363 BINDING SITE is a binding site found in an untranslated region of FLJ12363, corresponding to BINDING SITE of FIG. 26A. FIG. 26D illustrates the complementarity of the nucleotide sequence of FLJ12363 BINDING SITE, designated SEQ ID:587507, to the nucleotide sequence of GAM26 RNA of FIG. 26A, designated SEQ ID:20604. Yet another function of GAM26 is therefore inhibition of (FLJ12363). Accordingly, utilities of GAM26 include diagnosis and treatment of diseases and clinical conditions with which FLJ12363 is associated.

Reference is now made to FLJ12377 BINDING SITE. FLJ12377 is a target gene of GAM26, corresponding to GAM26-TARGET GENE of FIG. 26A. FLJ12377 BINDING SITE is a binding site found in an untranslated region of FLJ12377, corresponding to BINDING SITE of FIG. 26A. FIG. 26D illustrates the complementarity of the nucleotide sequence of FLJ12377 BINDING SITE, designated SEQ ID:587654, to the nucleotide sequence of GAM26 RNA of FIG. 26A, designated SEQ ID:20604. An additional function of GAM26 is therefore inhibition of (FLJ12377).

Accordingly, utilities of GAM26 include diagnosis and treatment of diseases and clinical conditions with which FLJ12377 is associated.

Reference is now made to FLJ12697 BINDING SITE. FLJ12697 is a target gene of GAM26, corresponding to GAM26-TARGET GENE of FIG. 26A. FLJ12697 BINDING SITE is a binding site found in an untranslated region of FLJ12697, corresponding to BINDING SITE of FIG. 26A. FIG. 26D illustrates the complementarity of the nucleotide sequence of FLJ12697 BINDING SITE, designated SEQ ID:592585, to the nucleotide sequence of GAM26 RNA of FIG. 26A, designated SEQ ID:20604. A further function of GAM26 is therefore inhibition of (FLJ12697). Accordingly, utilities of GAM26 include diagnosis and treatment of diseases and clinical conditions with which FLJ12697 is associated.

Reference is now made to FLJ12750 BINDING SITE. FLJ12750 is a target gene of GAM26, corresponding to GAM26-TARGET GENE of FIG. 26A. FLJ12750 BINDING SITE is a binding site found in an untranslated region of FLJ12750, corresponding to BINDING SITE of FIG. 26A. FIG. 26D illustrates the complementarity of the nucleotide sequence of FLJ12750 BINDING SITE, designate SEQ ID:593299, to the nucleotide sequence of GAM26 RNA of FIG. 26A, designated SEQ ID:20604. Yet a further function of GAM26 is therefore inhibition of (FLJ12750). Accordingly, utilities of GAM26 include diagnosis and treatment of diseases and clinical conditions with which FLJ12750 is associated.

Reference is now made to FLJ13189 BINDING SITE. FLJ13189 is a target gene of GAM26, corresponding to GAM26-TARGET GENE of FIG. 26A. FLJ13189 BINDING SITE is a binding site found in an untranslated region of FLJ13189, corresponding to BINDING SITE of FIG. 26A. FIG. 26D illustrates the complementarity of the nucleotide sequence of FLJ13189 BINDING SITE, designated SEQ ID:599594, to the nucleotide sequence of GAM26 RNA of FIG. 26A, designated SEQ ID:20604. Another function of GAM26 is therefore inhibition of (FLJ13189). Accordingly, utilities of GAM26 include diagnosis and treatment of diseases and clinical conditions with which FLJ13189 is associated.

Reference is now made to FLJ13189 BINDING SITE. FLJ13189 is a target gene of GAM26, corresponding to GAM26-TARGET GENE of FIG. 26A. FLJ13189 BINDING SITE is a binding site found in an untranslated region of FLJ13189, corresponding to BINDING SITE of FIG. 26A. FIG. 26D illustrates the complementarity of the nucleotide sequence of FLJ13189 BINDING SITE, designated SEQ ID:599628, to the nucleotide sequence of GAM26 RNA of FIG. 26A, designated SEQ ID:20604. Yet another function of GAM26 is therefore inhibition of (FLJ13189). Accordingly, utilities of GAM26 include diagnosis and treatment of diseases and clinical conditions with which FLJ13189 is associated.

Reference is now made to FLJ13194 BINDING SITE. FLJ13194 is a target gene of GAM26, corresponding to GAM26-TARGET GENE of FIG. 26A. FLJ3194 BINDING SITE is a binding site found in an untranslated region of FLJ13194, corresponding to BINDING SITE of FIG. 26A. FIG. 26D illustrates the complementarity of the nucleotide sequence of FLJ13194 BINDING SITE, designated SEQ ID:600122, to the nucleotide sequence of GAM26 RNA of FIG. 26A, designated SEQ ID:20604. An additional function of GAM26 is therefore inhibition of (FLJ13194). Accordingly, utilities of GAM26 include diagnosis and treatment of diseases and clinical conditions with which FLJ13194 is associated.

Reference is now made to FLJ13340 BINDING SITE. FLJ13340 is a target gene of GAM26, corresponding to GAM26-TARGET GENE of FIG. 26A. FLJ13340 BINDING SITE is a binding site found in an untranslated region of FLJ13340, corresponding to BINDING SITE of FIG. 26A. FIG. 26D illustrates the complementarity of the nucleotide sequence of FLJ13340 BINDING SITE, designated SEQ ID:601522, to the nucleotide sequence of GAM26 RNA of FIG. 26A, designated SEQ ID:20604. A further function of GAM26 is therefore inhibition of (FLJ13340). Accordingly, utilities of GAM26 include diagnosis and treatment of diseases and clinical conditions with which FLJ13340 is associated.

Reference is now made to TBDN100 BINDING SITE. TBDN100 is a target gene of GAM26, corresponding to GAM26-TARGET GENE of FIG. 26A. TBDN100 BINDING SITE is a binding site found in an untranslated region of TBDN100, corresponding to BINDING SITE of FIG. 26A. FIG. 26D illustrates the complementarity of the nucleotide sequence of TBDN100 BINDING SITE, designated SEQ ID:601522, to the nucleotide sequence of GAM26 RNA of FIG. 26A, designated SEQ ID:20604. Yet a further function of GAM26 is therefore inhibition of (TBDN100). Accordingly, utilities of GAM26 include diagnosis and treatment of diseases and clinical conditions with which TBDN100 is associated.

Reference is now made to FLJ13855 BINDING SITE. FLJ13855 is a target gene of GAM26, corresponding to GAM26-TARGET GENE of FIG. 26A. FIJI 3855 BINDING SITE is a binding site found in an untranslated region of FLJ13855, corresponding to BINDING SITE of FIG. 26A. FIG. 26D illustrates the complementarity of the nucleotide sequence of FLJ13855 BINDING SITE, designated SEQ ID:605857, to the nucleotide sequence of GAM26 RNA of FIG. 26A, designated SEQ ID:20604. Another function of GAM26 is therefore inhibition of (FLJ13855). Accordingly, utilities of GAM26 include diagnosis and treatment of diseases and clinical conditions with which FLJ13855 is associated.

Reference is now made to FLJ13855 BINDING SITE. FLJ13855 is a target gene of GAM26, corresponding to GAM26-TARGET GENE of FIG. 26A. FLJ13855 BINDING SITE is a binding site found in an untranslated region of FLJ13855, corresponding to BINDING SITE of FIG. 26A. FIG. 26D illustrates the complementarity of the nucleotide sequence of FLJ13855 BINDING SITE, designate SEQ ID:605858, to the nucleotide sequence of GAM26 RNA of FIG. 26A, designated SEQ ID:20604. Yet another function of GAM26 is therefore inhibition of (FLJ13855). Accordingly, utilities of GAM26 include diagnosis and treatment of diseases and clinical conditions with which FLJ13855 is associated.

Reference is now made to FLJ14299 BINDING SITE. FLJ14299 is a target gene of GAM26, corresponding to GAM26-TARGET GENE of FIG. 26A. FLJ14299 BINDING SITE is a binding site found in an untranslated region of FLJ14299, corresponding to BINDING SITE of FIG. 26A. FIG. 26D illustrates the complementarity of the nucleotide sequence of FLJ14299 BINDING SITE, designated SEQ ID:610393, to the nucleotide sequence of GAM26 RNA of FIG. 26A, designated SEQ ID:20604. An additional function of GAM26 is therefore inhibition of (FLJ14299).

Accordingly, utilities of GAM26 include diagnosis and treatment of diseases and clinical conditions with which FLJ14299 is associated.

Reference is now made to FLJ14451 BINDING SITE. FLJ14451 is a target gene of GAM26, corresponding to GAM26-TARGET GENE of FIG. 26A. FLJ14451 BINDING SITE is a binding site found in an untranslated region of FLJ14451, corresponding to BINDING SITE of FIG. 26A. FIG. 26D illustrates the complementarity of the nucleotide sequence of FLJ14451 BINDING SITE, designated SEQ ID:612603, to the nucleotide sequence of GAM26 RNA of FIG. 26A, designated SEQ ID:20604. A further function of GAM2 is therefore inhibition of (FLJ14451). Accordingly, utilities of GAM26 include diagnosis and treatment of diseases and clinical conditions with which FLJ14451 is associated.

Reference is now made to FLJ14451 BINDING SITE. FLJ14451 is a target gene of GAM26, corresponding to GAM26-TARGET GENE of FIG. 26A. FLJ14451 BINDING SITE is a binding site found in an untranslated region of FLJ14451, corresponding to BINDING SITE of FIG. 26A. FIG. 26D illustrates the complementarity of the nucleotide sequence of FLJ14451 BINDING SITE, designated SEQ ID:612607, to the nucleotide sequence of GAM26 RNA of FIG. 26A, designated SEQ ID:20604. Yet a further function of GAM26 is therefore inhibition of (FLJ14451). Accordingly, utilities of GAM26 include diagnosis and treatment of diseases and clinical conditions with which FLJ14451 is associated.

Reference is now made to FLJ20288 BINDING SITE. FLJ20288 is a target gene of GAM26, corresponding to GAM26-TARGET GENE of FIG. 26A. FLJ20288 BINDING SITE is a binding site found in an untranslated region of FLJ20288, corresponding to BINDING SITE of FIG. 26A. FIG. 26D illustrates the complementarity of the nucleotide sequence of FLJ20288 BINDING SITE, designate SEQ ID:625741, to the nucleotide sequence of GAM26 RNA of FIG. 26A, designated SEQ ID:20604. Another function of GAM26 is therefore inhibition of (FLJ20288). Accordingly, utilities of GAM26 include diagnosis and treatment of diseases and clinical conditions with which FLJ20288 is associated.

Reference is now made to FLJ20288 BINDING SITE. FLJ20288 is a target gene of GAM26, corresponding to GAM26-TARGET GENE of FIG. 26A. FLJ20288 BINDING SITE is a binding site found in an untranslated region of FLJ20288, corresponding to BINDING SITE of FIG. 26A. FIG. 26D illustrates the complementarity of the nucleotide sequence of FLJ20288 BINDING SITE, designated SEQ ID:625764, to the nucleotide sequence of GAM26 RNA of FIG. 26A, designated SEQ ID:20604. Yet another function of GAM26 is therefore inhibition of (FLJ20288). Accordingly, utilities of GAM26 include diagnosis and treatment of diseases and clinical conditions with which FLJ20288 is associated.

Reference is now made to PCAF BINDING SITE. PCAF is a target gene of GAM26, corresponding to GAM26-TARGET GENE of FIG. 26A. PCAF BINDING SITE is a binding site found in an untranslated region of PCAF, corresponding to BINDING SITE of FIG. 26A. FIG. 26D illustrates the complementarity of the nucleotide sequence of PCAF BINDING SITE, designated SEQ ID:625767, to the nucleotide sequence of GAM26 RNA of FIG. 26A, designated SEQ ID:29604. An additional function of GAM26 is therefore inhibition of (PCAF). Accordingly, utilities of GAM26 include diagnosis and treatment of diseases and clinical conditions with which PCAF is associated.

Reference is now made to FLJ20288 BINDING SITE. FLJ20288 is a target gene of GAM26, corresponding to GAM26-TARGET GENE of FIG. 26A. FLJ20288 BINDING SITE is a binding site found in an untranslated region of FLJ20288, corresponding to BINDING SITE of FIG. 26A. FIG. 26D illustrates the complementarity of the nucleotide sequence of FLJ20288 BINDING SITE, designated SEQ ID:625783, to the nucleotide sequence of GAM26 RNA of FIG. 26A, designated SEQ ID:20604. A further function of GAM26 is therefore inhibition of (FLJ20288). Accordingly, utilities of GAM26 include diagnosis and treatment of diseases and clinical conditions with which FLJ20288 is associated.

Reference is now made to FLJ20288 BINDING SITE. FLJ20288 is a target gene of GAM26, corresponding to GAM26-TARGET GENE of FIG. 26A. FLJ20288 BINDING SITE is a binding site found in an untranslated region of FLJ20288, corresponding to BINDING SITE of FIG. 26A. FIG. 26D illustrates, the complementarity of the nucleotide sequence of FLJ20288 BINDING SITE, designated SEQ ID:625785, to the nucleotide sequence of GAM26 RNA of FIG. 26A, designated SEQ ID:20604. Yet a further function of GAM26 is therefore inhibition of (FLJ20288). Accordingly, utilities of GAM26 include diagnosis and treatment of diseases and clinical conditions with which FLJ20288 is associated.

Reference is now made to FLJ20288 BINDING SITE. FLJ20288 is a target gene of GAM26, corresponding to GAM26-TARGET GENE of FIG. 26A. FLJ20288 BINDING SITE is a binding site found in an untranslated region of FLJ20288, corresponding to BINDING SITE of FIG. 26A. FIG. 26D illustrates the complementarity of the nucleotide sequence of FLJ20288 BINDING SITE, designated SEQ ID:625802, to the nucleotide sequence of GAM26 RNA of FIG. 26A, designated SEQ ID:20604. Another function of GAM26 is therefore inhibition of (FLJ20288). Accordingly, utilities of GAM26 include diagnosis and treatment of diseases and clinical conditions with which FLJ20288 is associated.

Reference is now made to FLJ20400 BINDING SITE. FLJ20400 is a target gene of GAM26, corresponding to GAM26-TARGET GENE of FIG. 26A. FLJ20400 BINDING SITE is a binding site found in an untranslated region of FLJ20400, corresponding to BINDING SITE of FIG. 26A. FIG. 26D illustrates the complementarity of the nucleotide sequence of FLJ20400 BINDING SITE, designated SEQ ID:629258, to the nucleotide sequence of GAM26 RNA of FIG. 26A, designated SEQ ID:20604. Yet another function of GAM26 is therefore inhibition of (FLJ20400). Accordingly, utilities of GAM26 include diagnosis and treatment of diseases and clinical conditions with which FLJ20400 is associated.

Reference is now made to FLJ20421 BINDING SITE. FLJ20421 is a target gene of GAM26, corresponding to GAM26-TARGET GENE of FIG. 26A. FLJ20421 BINDING SITE is a binding site found in an untranslated region of FLJ20421, corresponding to BINDING SITE of FIG. 26A. FIG. 26D illustrates the complementarity of the nucleotide sequence of FLJ20421 BINDING SITE, designated SEQ ID:629645, to the nucleotide sequence of GAM26 RNA of FIG. 26A, designated SEQ ID:20604. An additional function of GAM26 is therefore inhibition of (FLJ20421). Accordingly, utilities of GAM26 include diagnosis and treatment of diseases and clinical conditions with which FLJ20421 is associated.

Reference is now made to FLJ20421 BINDING SITE. FLJ20421 is a target gene of GAM26, corresponding to GAM26-TARGET GENE of FIG. 26A. FLJ20421 BINDING SITE is a binding site found in an untranslated region of FLJ20421, corresponding to BINDING SITE of FIG. 26A. FIG. 26D illustrates the complementarity of the nucleotide sequence of FLJ20421 BINDING SITE, designated SEQ ID:629655, to the nucleotide sequence of GAM26 RNA of FIG. 26A, designated SEQ ID:20604. A further function of GAM26 is therefore inhibition of (FLJ20421). Accordingly, utilities of GAM26 include diagnosis and treatment of diseases and clinical conditions with which FLJ20421 is associated.

Reference is now made to FLJ20421 BINDING SIT. FLJ20421 is a target gene of GAM26, corresponding to GAM26-TARGET GENE of FIG. 26A. FLJ20421 BINDING SITE is a binding site found in an untranslated region of FLJ20421, corresponding to BINDING SITE of FIG. 26A. FIG. 26D illustrates the complementarity of the nucleotide sequence of FLJ20421 BINDING SITE, designated SEQ ID:629660, to the nucleotide sequence of GAM26 RNA of FIG. 26A, designated SEQ ID:20604. Yet a further function of GAM26 is therefore inhibition of (FLJ20421). Accordingly, utilities of GAM26 include diagnosis and treatment of diseases and clinical conditions with which FLJ20421 is associated.

Reference is now made to FLJ20425 BINDING SITE. FLJ20425 is a target gene of GAM26, corresponding to GAM26-TARGET GENE of FIG. 26A. FLJ20425 BINDING SITE is a binding site found in an untranslated region of FLJ20425, corresponding to BINDING SITE of FIG. 26A. FIG. 26D illustrate the complementarity of the nucleotide sequent of FLJ20425 BINDING SITE, designated SEQ ID:629739, to the nucleotide sequence of GAM26 RNA of FIG. 26A, designated SEQ ID:20604. Another function of GAM26 is therefore inhibition of (FLJ20425). Accordingly, utilities of GAM26 include diagnosis and treatment of diseases and clinical conditions with which FLJ20425 is associated.

Reference is now made to FLJ20539 BINDING SITE. FLJ20539 is a target gene of GAM26, corresponding to GAM26-TARGET GENE of FIG. 26A. FLJ20539 BINDING SITE is a binding site found in an untranslated region of FLJ20539, corresponding to BINDING SITE of FIG. 26A. FIG. 26D illustrates the complementarity of the nucleotide sequence of FLJ20539 BINDING SITE, designated SEQ ID:632084, to the nucleotide sequence GAM26 RNA of FIG. 26A, designated, SEQ ID:20604. Yet another function of GAM26 is therefore inhibition of (FLJ20539). Accordingly, utilities of GAM26 include diagnosis and treatment of diseases and clinical conditions with which FLJ20539 is associated.

Reference is now made to FLJ20718 BINDING SITE. FLJ20718 is a target gene of GAM26, corresponding to GAM26-TARGET GENE of FIG. 26A. FLJ20718 BINDING SITE is a binding site found in an untranslated region of FLJ20718, corresponding to BINDING SITE of FIG. 26A. FIG. 26D illustrates the complementarity of the nucleotide sequence of FLJ20718 BINDING SITE, designated SEQ ID:635286, to the nucleotide sequence of GAM26 RNA of FIG. 26A, designated SEQ ID:20604. An additional function of GAM26 is therefore inhibition of (FLJ20718). Accordingly, utilities of GAM26 include diagnosis and treatment of diseases and clinical conditions with which FLJ20718 is associated.

Reference is now made to FLJ21588 BINDING SITE. FLJ21588 is a target gene of GAM26, corresponding to GAM26-TARGET GENE of FIG. 26A. FLJ21588 BINDING SITE is a binding site found in an untranslated region of FLJ21588, corresponding to BINDING SITE of FIG. 26A. FIG. 26D illustrates the complementarity of the nucleotide sequence of FLJ21588 BINDING SITE, designated SEQ ID:641646, to the nucleotide sequence of GAM26 RNA of FIG. 26A, designated SEQ ID:20604. A further function of GAM25 is therefore inhibition of (FLJ21588). Accordingly, utilities of GAM26 include diagnosis and treatment of diseases and clinical conditions with which FLJ21588 is associated.

Reference is now made to FLJ21613 BINDING SITE. FLJ21613 is a target gene of GAM26, corresponding to GAM26-TARGET GENE of FIG. 26A. FLJ21613 BINDING SITE is a binding site found in an untranslated region of FLJ21613; corresponding to BINDING SITE of FIG. 26A. FIG. 26D illustrates the complementarity of the nucleotide sequence of FLJ21613 BINDING SITE, designated SEQ ID:641999, to the nucleotide sequence of GAM26 RNA of FIG. 26A, designated SEQ ID:20604. Yet a further function of GAM26 is therefore inhibition of (FLJ21613). Accordingly, utilities of GAM26 include diagnosis and treatment of diseases and clinical conditions with which FLJ21613 is associated.

Reference is now made to FLJ22393 BINDING SITE. FLJ22393 is a target gene of GAM26, corresponding to GAM26-TARGET GENE of FIG. 26A. FLJ22393 BINDING SITE is a binding site found in an untranslated region of FLJ22393, corresponding to BINDING SITE of FIG. 26A. FIG. 26D illustrates the complementarity of the nucleotide sequence of FLJ22393 BINDING SITE, designated SEQ ID:649088, to the nucleotide sequence of GAM26 RNA of FIG. 26A, designated SEQ ID:20604. Another function of GAM26 is therefore inhibition of (FLJ22393). Accordingly, utilities of GAM26 include diagnosis and treatment of diseases and clinical conditions with which FLJ22393 is associated.

Reference is now made to FLJ23251 BINDING SITE. FLJ23251 is a target gene of GAM26, corresponding to GAM26-TARGET GENE of FIG. 26A. FLJ23251 BINDING SITE is a binding site found in an untranslated region of FLJ23251, corresponding to BINDING SITE of FIG. 26A. FIG. 26D illustrates the complementarity of the nucleotide sequence of FLJ23251 BINDING SITE, designated SEQ ID:657789, to the nucleotide sequence of GAM26 RNA of FIG. 26A, designate SEQ ID:20604. Yet another function of GAM26 is therefore inhibition of (FLJ23251). Accordingly, utilities of GAM26 include diagnosis and treatment of diseases and clinical conditions with which FLJ23251 is associated.

Reference is now made to FLJ31564 BINDING SITE. FLJ31564 is a target gene of GAM26, corresponding to GAM26-TARGET GENE of FIG. 26A. FLJ31564 BINDING SITE is a binding site found in an untranslated region of FLJ31564, corresponding to BINDING SITE of FIG. 26A. FIG. 26D illustrates the complementarity of the nucleotide sequence of FLJ31564 BINDING SITE, designated SEQ ID:665686, to the nucleotide sequence of GAM26 RNA of FIG. 26A, designated SEQ ID:20604. An additional function of GAM26 is therefore inhibition of (FLJ31564). Accordingly, utilities of GAM26 include diagnosis and treatment of diseases and clinical conditions with which FLJ31564 is associated.

Reference is now made to FLJ31978 BINDING SITE. FLJ31978 is a target gene of GAM26, corresponding to GAM26-TARGET GENE of FIG. 26A. FLJ31978 BINDING SITE is a binding site found in an untranslated region of FLJ31978, corresponding to BINDING SITE of FIG. 26A. FIG. 26D illustrates the complementarity of the nucleotide sequence of FLJ31978 BINDING SITE, designated SEQ ID:666546, to the nucleotide sequence of GAM26 RNA of FIG. 26A, designated SEQ ID:20604. A further function of GAM26 is therefore inhibition of (FLJ31978). Accordingly, utilities of GAM26 include diagnosis and treatment of diseases and clinical conditions with which FLJ31978 is associated.

Reference is now made to FOXO3A BINDING SITE. FOXO3A is a target gene of GAM26, corresponding to GAM26-TARGET GENE of FIG. 26A. FOXO3A BINDING SITE is a binding site found in an untranslated region of FOXO3A, corresponding to BINDING SITE of FIG. 26A. FIG. 26D illustrates the complementarity of the nucleotide sequence of FOXO3A BINDING SITE, designated SEQ ID:669368, to the nucleotide sequence of GAM26 RNA of FIG. 26A, designated SEQ ID:20604. Yet a further function of GAM26 is therefore inhibition of (FOXO3A). Accordingly, utilities of GAM26 include diagnosis and treatment of diseases and clinical conditions with which FOXO3A is associated.

Reference is now made to FUBP3 BINDING SITE. FUBP3 is a target gene of GAM26, corresponding to GAM26-TARGET GENE FIG. 26A. FUBP3 BINDING SITE is a binding site found in an untranslated region of FUBP3, corresponding to BINDING SITE of FIG. 26A. FIG. 26D illustrates the complementarity of the nucleotide sequence of FUBP3 BINDING SITE, designated SEQ ID:670361, to the nucleotide sequence of GAM26 RNA of FIG. 26A, designated SEQ ID:20604. Another function of GAM26 is therefore inhibition of (FUBP3). Accordingly, utilities of GAM26 include diagnosis and treatment of diseases and clinical conditions with which FUBP3 is associated.

Reference is now made to FUBP3 BINDING SITE. FUBP3 is a target gene of GAM26, corresponding to GAM26-TARGET GENE of FIG. 26A. FUBP3 BINDING SITE is a binding site found in an untranslated region of FUBP3, corresponding to BINDING SITE of FIG. 26A. FIG. 26D illustrates the complementarity of the nucleotide sequence of FUBP3 BINDING SITE, designated SEQ ID:670394, to the nucleotide sequence of GAM26 RNA of FIG. 26A, designated SEQ ID:20604. Yet another function of GAM26 is therefore inhibition of (FUBP3). Accordingly, utilities of GAM26 include diagnosis and treatment of diseases and clinical conditions with which FUBP3 is associated.

Reference is now made to GIOT-3 BINDING SITE. GIOT-3 is a target gene of GAM26, corresponding to GAM26-TARGET GENE of FIG. 26A. GIOT-3 BINDING SITE is a binding site found in an untranslated region of GIOT-3, corresponding to BINDING SITE of FIG. 26A. FIG. 26D illustrates the complementarity of the nucleotide sequence of GIOT-3 BINDING SITE, designated SEQ ID:674988, to the nucleotide sequence of GAM26 RNA of FIG. 26A, designated SEQ ID:20604. An additional function of GAM26 is therefore inhibition of (GIOT-3). Accordingly, utilities of GAM26 include diagnosis and treatment of diseases and clinical conditions with which GIOT-3 is associated.

Reference is now made to GIOT-3 BINDING SITE. GIOT-3 is a target gene of GAM26, corresponding to GAM26-TARGET GENE of FIG. 26A. GIOT-3 BINDING SITE is a binding site found in an untranslated region of GIOT-3, corresponding to BINDING SITE of FIG. 26A. FIG. 26D illustrates the complementarity of the nucleotide sequence of GIOT-3 BINDING SITE, designated SEQ ID:674995, to the nucleotide sequence of GAM26 RNA of FIG. 26A, designated SEQ ID:20604. A further function of GAM26 is therefore inhibition of (GIOT-3). Accordingly, utilities of GAM26 include diagnosis and treatment of diseases and clinical conditions with which GIOT-3 is associated.

Reference is now made to MGC14425 BINDING SITE. MGC14425 is a target gene of GAM26, corresponding to GAM26-TARGET GENE of FIG. 26A. MGC14425 BINDING SITE is a binding site found in an untranslated region of MGC14425, corresponding to BINDING SITE of FIG. 26A. FIG. 26D illustrates the complementarity of the nucleotide sequence of MGC14425 BINDING SITE, designated SEQ ID:676856, to the nucleotide sequence of GAM26 RNA of FIG. 26A, designated SEQ ID:20604. Yet a further function of GAM26 is therefore inhibition of (MGC14425). Accordingly, utilities of GAM26 include diagnosis and treatment of diseases and clinical conditions with which MGC14425 is associated.

Reference is now made to GNA13 BINDING SITE. GNA13 is a target gene of GAM26, corresponding to GAM26-TARGET GENE of FIG. 26A. GNA13 BINDING SITE is a binding site found in an untranslated region of GNA13, corresponding to BINDING SITE of FIG. 26A. FIG. 26D illustrate the complementarity of the nucleotide sequence of GNA13 BINDING SITE, designated SEQ ID:676857, to the nucleotide sequence of GAM26 RNA of FIG. 26A, designated SEQ ID:20604. Another function of GAM26 is therefore inhibition of (GNA13). Accordingly, utilities of GAM26 include diagnosis and treatment of diseases and clinical conditions with which GNA13 is associated.

Reference is now made to GOLPH2 BINDING SITE. GOLPH2 is a target gene of GAM26, corresponding to GAM26-TARGET GENE of FIG. 26A. GOLPH2 BINDING SITE is a binding site found in an untranslated region of GOLPH2, corresponding to BINDING SITE of FIG. 26A. FIG. 26D illustrates the complementarity of the nucleotide sequence of GOLPH2 BINDING SITE, designated SEQ ID:677940, to the nucleotide sequence of GAM26 RNA of FIG. 26A, designated SEQ ID:20604. Yet another function of GAM26 is therefore inhibition of (GOLPH2). Accordingly, utilities of GAM26 include diagnosis and treatment of diseases and clinical conditions with which GOLPH2 is associated.

Reference is now made to GSK3A BINDING SITE. GSK3A is a target gene of GAM26, corresponding to GAM26-TARGET GENE of FIG. 26A. GSK3A BINDING SITE is a binding site found in an untranslated region of GSK3A, corresponding to BINDING SITE of FIG. 26A. FIG. 26D illustrates the complementarity of the nucleotide sequence of GSK3A BINDING SITE, designated SEQ ID:681389, to the nucleotide sequence GAM26 RNA of FIG. 26A, designated SEQ ID:20604. An additional function of GAM26 is therefore inhibition of (GSK3A). Accordingly, utilities of GAM26 include diagnosis and treatment of diseases and clinical conditions with which GSK3A is associated.

Reference is now made to GSK3A BINDING SITE. GSK3A is a target gene of GAM26, corresponding to GAM26-TARGET GENE of FIG. 26A. GSK3A BINDING SITE is a binding site found in an untranslated region of GSK3A, corresponding to BINDING SITE of FIG. 26A. FIG. 26D illustrate the complementarity of the nucleotide sequence of GSK3A BINDING SITE, designate SEQ ID:681400, to the nucleotide sequence of GAM26 RNA of FIG. 26A, designated SEQ ID:20604. A further function of GAM26 is therefore inhibition of (GSK3A). Accordingly, utilities of GAM26 include diagnosis and treatment of diseases and clinical conditions with which GSK3A is associated.

Reference is now made to GTF2A1 BINDING SITE. GTF2A1 is a target gene of GAM26, corresponding to GAM26-TARGET GENE of FIG. 26A. GTF2A1 BINDING SITE is a binding site found in an untranslated region of GTF2A1, corresponding to BINDING SITE of FIG. 26A. FIG. 26D illustrates the complementarity of the nucleotide sequence of GTF2A1 BINDING SITE, designated SEQ ID:681625, to the nucleotide sequence of GAM26 RNA of FIG. 26A, designated SEQ ID:20604. Yet a further function of GAM26 is therefore inhibition of (GTF2A1). Accordingly, utilities of GAM26 include diagnosis and treatment of diseases and clinical conditions with which GTF2A1 is associated.

Reference is now made to GTF2A1 BINDING SITE GTF2A1 is a target gene of GAM26, corresponding to GAM26-TARGET GENE of FIG. 26A. GTF2A1 BINDING SITE is a binding site found in an untranslated region of GTF2A1, corresponding to BINDING SITE of FIG. 26A. FIG. 26D illustrates the complementarity of the nucleotide sequence of GTF2A1 BINDING SITE, designated SEQ ID:681632, to the nucleotide sequence of GAM26 RNA of FIG. 26A, designated SEQ ID:20604. Another function of GAM26 is therefore inhibition of (GTF2A1). Accordingly, utilities of GAM26 include diagnosis and treatment of diseases and clinical conditions with which GTF2A1 is associated.

Reference is now made to H2AV BINDING SITE. H2AV is a target gene of GAM26, corresponding to GAM26-TARGET GENE of FIG. 26A. H2AV BINDING SITE is a binding site found in an untranslated region of H2AV, corresponding to BINDING SITE of FIG. 26A. FIG. 26D illustrates the complementarity of the nucleotide sequence of H2AV BINDING SITE, designated SEQ ID:683857, to the nucleotide sequence of GAM26 RNA of FIG. 26A, designated SEQ ID:20604. Yet another function of GAM26 is therefore inhibition of (H2AV). Accordingly, utilities of GAM26 include diagnosis and treatment of diseases and clinical conditions with which H2AV is associated.

Reference is now made to H2AV BINDING SITE. H2AV is a target gene of GAM26, corresponding to GAM26-TARGET GENE of FIG. 26A. H2AV BINDING SITE is a binding site found in an untranslated region of H2AV, corresponding to BINDING SITE of FIG. 26A. FIG. 26D illustrates the complementarity of the nucleotide sequence of H2AV BINDING SITE, designated SEQ ID:683934, to the nucleotide sequence of GAM26 RNA of FIG. 26A, designated SEQ ID:20604. An additional function of GAM26 is therefore inhibition of (H2AV). Accordingly, utilities of GAM26 include diagnosis and treatment of diseases and clinical conditions with which H2AV is associated.

Reference is now made to HNRPA0 BINDING SITE. HNRPA0 is a target gene of GAM26, corresponding to GAM26-TARGET GENE of FIG. 26A. HNRPA0 BINDING SITE is a binding site found in an untranslated region of HNRPA0, corresponding to BINDING SITE of FIG. 26A. FIG. 26D illustrates the complementarity of the nucleotide sequence of HNRPA0 BINDING SITE, designated SEQ ID:689726, to the nucleotide sequence of GAM26 RNA of FIG. 26A, designated SEQ ID:20604. A further function of GAM26 is therefore inhibition of (HNRPA0). Accordingly, utilities of GAM26 include diagnosis and treatment of diseases and clinical conditions with which HNRPA0 is associated.

Reference is now made to HRIHFB2122 BINDING SITE. HRIHFB2122 is a target gene of GAM126, corresponding to GAM26-TARGET GENE of FIG. 26A. HRIHFB2122 BINDING SITE is a binding site found in an untranslated region of HRIHFB2122, corresponding to BINDING SITE of FIG. 26A. FIG. 26D illustrates the complementarity of the nucleotide sequence of HRIHFB2122 BINDING SITE, designated SEQ ID:691356, to the nucleotide sequence of GAM26 RNA of FIG. 26A, designated SEQ ID:20604. Yet a further function of GAM26 is therefore inhibition of (HRIHFB2122). Accordingly, utilities of GAM26 include diagnosis and treatment of diseases and clinical conditions with which HRIHFB2122 is associated.

Reference is now made to HS6ST1 BINDING SITE. HS6ST1 is a target gene of GAM26, corresponding to GAM26-TARGET GENE of FIG. 26A. HS6ST1 BINDING SITE is a binding site found in an untranslated region of HS6ST1, corresponding to BINDING SITE of FIG. 26A. FIG. 26D illustrates the complementarity of the nucleotide sequent of HS6ST1 BINDING SITE, designated SEQ ID:691939, to the nucleotide sequence of GAM26 RNA of FIG. 26A, designated SEQ ID:20604. Another function of GAM26 is therefore inhibition of (HS6ST1). Accordingly, utilities of GAM26 include diagnosis and treatment of diseases and clinical conditions with which HS6ST1 is associated.

Reference is now made to HSPC195 BINDING SITE. HSPC195 is a target gene of GAM26, corresponding to GA 6-TARGET GENE of FIG. 26A. HSPC195 BINDING SITE is a binding site found in an untranslated region of HSPC195, corresponding to BINDING SITE of FIG. 26A. FIG. 26D illustrates the complementarity of the nucleotide sequence of HSPC195 BINDING SITE, designated SEQ ID:696302, to the nucleotide sequence of GAM26 RNA of FIG. 26A, designated SEQ ID:20604. Yet another function of GAM26 is therefore inhibition of (HSPC195). Accordingly, utilities of GAM26 include diagnosis and treatment of diseases and clinical conditions with which HSPC195 is associated.

Reference is now made to HSPC195 BINDING SITE. HSPC195 is a target gene of GAM26, corresponding to GAM26-TARGET GENE of FIG. 26A. HSPC195 BINDING SITE is a binding site found in an untranslated region of HSPC195, corresponding to BINDING SITE of FIG. 26A. FIG. 26D illustrates the complementarity of the nucleotide sequence of HSPC195 BINDING SITE, designated SEQ ID:696329, to the nucleotide sequence of GAM26 RNA of FIG. 26A, designated SEQ ID:20604. An additional function of GAM26 is therefore inhibition of (HSPC195). Accordingly, utilities of GAM26 include diagnosis and treatment of diseases and clinical conditions with which HSPC195 is associated.

Reference is now made to HSPC195 BINDING SITE. HSPC195 is a target gene of GAM26, corresponding to GAM26-TARGET GENE of FIG. 26A. HSPC195 BINDING SITE is a binding site found in an untranslated region of HSPC195, corresponding to BINDING SITE of FIG. 26A. FIG. 26D illustrates the complementarity of the nucleotide sequence of HSPC195 BINDING SITE, designated SEQ ID:696330, to the nucleotide sequence of GAM26 RNA of FIG. 26A, designated SEQ ID:20604. A further function of GAM26 is therefore inhibition of (HSPC195). Accordingly, utilities of GAM26 include diagnosis and treatment of diseases and clinical conditions with which HSPC195 is associated.

Reference is now made to HSPC195 BINDING SITE. HSPC195 is a target gene of GAM26, corresponding to GAM26-TARGET GENE of FIG. 26A. HSPC195 BINDING SITE is a binding site found in an untranslated region of HSPC195, corresponding to BINDING SITE of FIG. 26A. FIG. 26D illustrates the complementarity of the nucleotide sequence of HSPC195 BINDING SITE, designated SEQ ID:696332, to the nucleotide sequence of GAM26 RNA of FIG. 26A, designated SEQ ID:20604. Yet a further function of GAM26 is therefore inhibition of (HSPC195). Accordingly, utilities of GAM26 include diagnosis and treatment of diseases and clinical conditions with which HSPC195 is associated.

Reference is now made to HSPC195 BINDING SITE. HSPC195 is a target gene of GAM26, corresponding to GAM26-TARGET GENE of FIG. 26A. HSPC195 BINDING SITE is a binding site found in an untranslated region of HSPC195, corresponding to BINDING SITE of FIG. 26A. FIG. 26D illustrates the complementarity of the nucleotide sequence of HSPC195 BINDING SITE, designated SEQ ID:696333, to the nucleotide sequence of GAM26 RNA of FIG. 26A, designated SEQ ID:20604. Another function of GAM26 is therefore inhibition of (HSPC195). Accordingly, utilities of GAM26 include diagnosis and treatment of diseases and clinical conditions with which HSPC195 is associated.

Reference is now made to HUMAGCGB BINDING SITE. HUMAGCGB is a target gene of GAM26, corresponding to GAM26-TARGET GENE of FIG. 26A. HUMAGCGB BINDING SITE is a binding site found in an untranslated region of HUMAGCGB, corresponding to BINDING SITE of FIG. 26A. FIG. 26D illustrates the complementarity of the nucleotide sequence of HUMAGCGB BINDING SITE, designated SEQ ID:698714, to the nucleotide sequence of GAM26 RNA of FIG. 26A, designated SEQ ID:20604. Yet another function of GAM26 is therefore inhibition of (HUMAGCGB). Accordingly, utilities of GAM26 include diagnosis and treatment of diseases and clinical conditions with which HUMAGCGB is associated.

Reference is now made to ILF3 BINDING SITE. ILF3 is a target gene of GAM26, corresponding to GAM26-TARGET GENE of FIG. 26A. ILF3 BINDING SITE is a binding site found in an untranslated region of ILF3, corresponding to BINDING SITE of FIG. 26A. FIG. 26D illustrates the complementarity of the nucleotide sequence of ILF3 BINDING SITE, designated SEQ ID:701811, to the nucleotide sequence of GAM26 RNA of FIG. 26A, designated SEQ ID:20604. An additional function of GAM26 is therefore inhibition of (ILF3). Accordingly, utilities of GAM26 include diagnosis and treatment of diseases and clinical conditions with which ILF3 is associated.

Reference is now made to ITPK1 BINDING SITE. ITPK1 is a target gene of GAM26, corresponding to GAM26-TARGET GENE of FIG. 26A. ITPK1 BINDING SITE is a binding site found in an untranslated region of ITPK1, corresponding to BINDING SITE of FIG. 26A. FIG. 26D illustrates the complementarity of the nucleotide sequence of ITPK1 BINDING SITE, designated SEQ ID:704065, to the nucleotide sequence of GAM26 RNA of FIG. 26A, designated SEQ ID:20604. A further function of GAM26 is therefore inhibition of (ITPK1). Accordingly, utilities of GAM26 include diagnosis and treatment of diseases and clinical conditions with which ITPK1 is associated.

Reference is now made to KCNT1 BINDING SITE. KCNT1 is a target gene of GAM26, corresponding to GAM26-TARGET GENE of FIG. 26A. KCNT1 BINDING SITE is a binding site found in an untranslated region of KCNT1, corresponding to BINDING SITE of FIG. 26A. FIG. 26D illustrates the complementarity of the nucleotide sequence of KCNT1 BINDING SITE, designated SEQ ID:707411, to the nucleotide sequence of GAM26 RNA of FIG. 26A, designated SEQ ID:20604. Yet a further function of GAM26 is therefore inhibition of (KCNT1). Accordingly, utilities of GAM26 include diagnosis and treatment of diseases and clinical conditions with which KCNT1 is associated.

Reference is now made to KIAA0082 BINDING SITE. KIAA0082 is a target gene of GAM26, corresponding to GAM26-TARGET GENE of FIG. 26A. KIAA0082 BINDING SITE is a binding site found in an untranslated region of KIAA0082, corresponding to BINDING SITE of FIG. 26A. FIG. 26D illustrates the complementarity of the nucleotide sequence of KIAA0082 BINDING SITE, designated SEQ ID:710416, to the nucleotide sequence of GAM26 RNA of FIG. 26A, designated SEQ ID:20604. Another function of GAM26 is therefore inhibition of (KIAA0082). Accordingly, utilities of GAM26 include diagnosis and treatment of diseases and clinical conditions with which KIAA0082 is associated.

Reference is now made to KIAA0082 BINDING SITE. KIAA0082 is a target gene of GAM26, corresponding to GAM26-TARGET GENE of FIG. 26A. KIAA0082 BINDING SITE is a binding site found in an untranslated region of KIAA0082, corresponding to BINDING SITE of FIG. 26A. FIG. 26D illustrates the complementarity of the nucleotide sequence of KIAA0082 BINDING SITE, designated SEQ ID:710439, to the nucleotide sequence of GAM26 RNA of FIG. 26A, designated SEQ ID:20604. Yet another function of GAM26 is therefore inhibition of (KIAA0082). Accordingly, utilities of GAM26 include diagnosis and treatment of diseases and clinical conditions with which KIAA0082 is associated.

Reference is now made to KIAA0084 BINDING SITE. KIAA0084 is a target gene of GAM26, corresponding to GAM26-TARGET GENE of FIG. 26A. KIAA0084 BINDING SITE is a binding site found in an untranslated region of KIAA0084, corresponding to BINDING SITE of FIG. 26A. FIG. 26D illustrates the complementarity of the nucleotide sequence of KIAA0084 BINDING SITE, designated SEQ ID:710507, to the nucleotide sequence of GAM26 RNA of FIG. 26A, designated SEQ ID:20604. An additional function of GAM26 is therefore inhibition of (KIAA0084). Accordingly, utilities of GAM26 include diagnosis and treatment of diseases and clinical conditions with which KIAA0084 is associated.

Reference is now made to KIAA0084 BINDING SITE. KIAA0084 is a target gene of GAM26, corresponding to GAM26-TARGET GENE of FIG. 26A. KIAA0084 BINDING SITE is a binding site found in an untranslated region of KIAA0084, corresponding to BINDING SITE of FIG. 26A. FIG. 26D illustrates the complementarity of the nucleotide sequence of KIAA0084 BINDING SITE, designated SEQ ID:710522, to the nucleotide sequence of GAM26 RNA of FIG. 26A, designated SEQ ID:20604. A further function of GAM26 is therefore inhibition of (KIAA0084). Accordingly, utilities of GAM26 include diagnosis and treatment of diseases and clinical conditions with which KIAA0084 is associated.

Reference is now made to KIAA0191 BINDING SITE. KIAA0191 is a target gene of GAM26, corresponding to GAM26-TARGET GENE of FIG. 26A. KIAA0191 BINDING SITE is a binding site found in an untranslated region of KIAA0191, corresponding to BINDING SITE of FIG. 26A. FIG. 26D illustrates the complementarity of the nucleotide sequence of KIAA0191 BINDING SITE, designated SEQ ID:715434, to the nucleotide sequence of GAM26 RNA of FIG. 26A, designated SEQ ID:20604. Yet a further function of GAM26 is therefore inhibition of (KIAA0191). Accordingly, utilities of GAM26 include diagnosis and treatment of diseases and clinical conditions with which KIAA0191 is associated.

Reference is now made to KIAA0191 BINDING SITE. KIAA0191 is a target gene of GAM26, corresponding to GAM26-TARGET GENE of FIG. 26A. KIAA0191 BINDING SITE is a binding site found in an untranslated region of KIAA0191, corresponding to BINDING SITE of FIG. 26A. FIG. 26D illustrates the complementarity of the nucleotide sequence of KIAA0191 BINDING SITE, designated SEQ ID:715436, to the nucleotide sequence of GAM26 RNA of FIG. 26A, designated SEQ ID:20604. Another function of GAM26 is therefore inhibition of (KIAA0191). Accordingly, utilities of GAM26 include diagnosis and treatment of diseases and clinical conditions with which KIAA0191 is associated.

Reference is now made to KIAA0191 BINDING SITE. KIAA0191 is a target gene of GAM26, corresponding to GAM26-TARGET GENE of FIG. 26A. KIAA0191 BINDING SITE is a binding site found in an untranslated region of KIAA0191, corresponding to BINDING SITE of FIG. 26A. FIG. 26D illustrates the complementarity of the nucleotide sequence of KIAA0191 BINDING SITE, designated SEQ ID:715438, to the nucleotide sequence of GAM26 RNA of FIG. 26A, designated SEQ ID:20604. Yet another function of GAM26 is therefore inhibition of (KIAA0191). Accordingly, utilities of GAM26 include diagnosis and treatment of diseases and clinical conditions with which KIAA0191 is associated.

Reference is now made to KIAA0191 BINDING SITE. KIAA0191 is a target gene of GAM26, corresponding to GAM26-TARGET GENE of FIG. 26A. KIAA0191 BINDING SITE is a binding site found in an untranslated region of KIAA0191, corresponding to BINDING SITE of FIG. 26A. FIG. 26D illustrates the complementarity of the nucleotide sequence of KIAA0191 BINDING SITE, designated SEQ ID:715439, to the nucleotide sequence of GAM26 RNA of FIG. 26A, designated SEQ ID:20604. An additional function of GAM26 is therefore inhibition of (KIAA0191). Accordingly, utilities of GAM26 include diagnosis and treatment of diseases and clinical conditions with which KIAA0191 is associated.

Reference is now made to KIAA0191 BINDING SITE. KIAA0191 is a target gene of GAM26, corresponding to GAM26-TARGET GENE of FIG. 26A. KIAA0191 BINDING SITE is a binding site found in an untranslated region of KIAA0191, corresponding to BINDING SITE of FIG. 26A. FIG. 26D illustrates the complementarity of the nucleotide sequence of KIAA0191 BINDING SITE, designated SEQ ID:715444, to the nucleotide sequence of GAM26 RNA of FIG. 26A, designated SEQ ID:20604. A further function of GAM26 is therefore inhibition of (KIAA0191). Accordingly, utilities of GAM26 include diagnosis and treatment of diseases and clinical conditions with which KIAA0191 is associated.

Reference is now made to KIAA0191 BINDING SITE. KIAA0191 is a target gene of GAM26, corresponding to GAM26-TARGET GENE of FIG. 26A. KIAA0191 BINDING SITE is a binding site found in an untranslated region of KIAA0191, corresponding to BINDING SITE of FIG. 26A. FIG. 26D illustrates the complementarity of the nucleotide sequence of KIAA0191 BINDING SITE, designated SEQ ID:715447, to the nucleotide sequence of GAM26 RNA of FIG. 26A, designated SEQ ID:20604. Yet a further function of GAM26 is therefore inhibition of (KIAA0191). Accordingly, utilities of GAM26 include diagnosis and treatment of diseases and clinical conditions with which KIAA0191 is associated.

Reference is now made to KIAA0227 BINDING SITE. KIAA0227 is a target gene of GAM26, corresponding to GAM26-TARGET GENE of FIG. 26A. KIAA0227 BINDING SITE is a binding site found in an untranslated region of KIAA0227, corresponding to BINDING SITE of FIG. 26A. FIG. 26D illustrates the complementarity of the nucleotide sequence of KIAA0227 BINDING SITE, designated SEQ ID:717573, to the nucleotide sequence of GAM26 RNA of FIG. 26A, designated SEQ ID:20604. Another function of GAM26 is therefore inhibition of (KIAA0227). Accordingly, utilities of GAM26 include diagnosis and treatment of diseases and clinical conditions with which KIAA0227 is associated.

Reference is now made to KIAA0227 BINDING SITE. KIAA0227 is a target gene of GAM26, corresponding to GAM26-TARGET GENE of FIG. 26A. KIAA0227 BINDING SITE is a binding site found in an untranslated region of KIAA0227, corresponding to BINDING SITE of FIG. 26A. FIG. 26D illustrates the complementarity of the nucleotide sequence of KIAA0227 BINDING SITE, designated SEQ ID:717578, to the nucleotide sequence of GAM26 RNA of FIG. 26A, designated SEQ ID:20604. Yet another function of GAM26 is therefore inhibition of (KIAA0227). Accordingly, utilities of GAM26 include diagnosis and treatment of diseases and clinical conditions with which KIAA0227 is associated.

Reference is now made to KIAA0227 BINDING SITE. KIAA0227 is a target gene of GAM26, corresponding to GAM26-TARGET GENE of FIG. 26A. KIAA0227 BINDING SITE is a binding site found in an untranslated region of KIAA0227, corresponding to BINDING SITE of FIG. 26A. FIG. 26D illustrates the complementarity of the nucleotide sequence of KIAA0227 BINDING SITE, designated SEQ ID:717615, to the nucleotide sequence of GAM26 RNA of FIG. 26A, designated SEQ ID:20604. An additional function of GAM26 is therefore inhibition of (KIAA0227). Accordingly, utilities of GAM26 include diagnosis and treatment of diseases and clinical conditions with which KIAA0227 is associated.

Reference is now made to KIAA0252 BINDING SITE. KIAA0252 is a target gene of GAM26, corresponding to GAM26-TARGET GENE of FIG. 26A. KIAA0252 BINDING SITE is a binding site found in an untranslated region of KIAA0252, corresponding to BINDING SITE of FIG. 26A. FIG. 26D illustrates the complementarity of the nucleotide sequence of KIAA0252 BINDING SITE, designated SEQ ID:718931, to the nucleotide sequence of GAM26 RNA of FIG. 26A, designated SEQ ID:20604. A further function of GAM26 is therefore inhibition of (KIAA0252). Accordingly, utilities of GAM26 include diagnosis and treatment of diseases and clinical conditions with which KIAA0252 is associated.

Reference is now made to KIAA0252 BINDING SITE. KIAA0252 is a target gene of GAM26, corresponding to GAM26-TARGET GENE of FIG. 26A. KIAA0252 BINDING SITE is a binding site found in an untranslated region of KIAA0252, corresponding to BINDING SITE of FIG. 26A. FIG. 26D illustrates the complementarity of the nucleotide sequence of KIAA0252 BINDING SITE, designated SEQ ID:718993, to the nucleotide sequence of GAM26

RNA of FIG. 26A, designated SEQ ID:20604. Yet a further function of GAM26 is therefore inhibition of (KIAA0252). Accordingly, utilities of GAM26 include diagnosis and treatment of diseases and clinical conditions with which KIAA0252 is associated.

Reference is now made to KIAA0252 BINDING SITE. KIAA0252 is a target gene of GAM26, corresponding to GAM26-TARGET GENE of FIG. 26A. KIAA0252 BINDING SITE is a binding site found in an untranslated region of KIAA0252, corresponding to BINDING SITE of FIG. 26A. FIG. 26D illustrates the complementarity of the nucleotide sequence of KIAA0252 BINDING SITE, designated SEQ ID:719014, to the nucleotide sequence of GAM26 RNA of FIG. 26A, designated SEQ ID:20604. Another function of GAM26 is therefore inhibition of (KIAA0252). Accordingly, utilities of GAM26 include diagnosis and treatment of diseases and clinical conditions with which KIAA0252 is associated.

Reference is now made to KIAA0336 BINDING SITE. KIAA0336 is a target gene of GAM26, corresponding to GAM26-TARGET GENE of FIG. 26A. KIAA0336 BINDING SITE is a binding site found in an untranslated region of KIAA0336, corresponding to BINDING SITE of FIG. 26A. FIG. 26D illustrates the complementarity of the nucleotide sequence of KIAA0336 BINDING SITE, designated SEQ ID:724234, to the nucleotide sequence of GAM26 RNA of FIG. 26A, designated SEQ ID:20604. Yet another function of GAM26 is therefore inhibition of (KIAA0336). Accordingly, utilities of GAM26 include diagnosis and treatment of diseases and clinical conditions with which KIAA0336 is associated.

Reference is now made to KIAA0397 BINDING SITE. KIAA0397 is a target gene of GAM26, corresponding to GAM26-TARGET GENE of FIG. 26A. KIAA0397 BINDING SITE is a binding site found in an untranslated region of KIAA0397, corresponding to BINDING SITE of FIG. 26A. FIG. 26D illustrates the complementarity of the nucleotide sequence of KIAA0397 BINDING SITE, designated SEQ ID:726863, to the nucleotide sequence of GAM26 RNA of FIG. 26A, designated SEQ ID:20604. An additional function of GAM26 is therefore inhibition of (KIAA0397). Accordingly, utilities of GAM26 include diagnosis and treatment of diseases and clinical conditions with which KIAA0397 is associated.

Reference is now made to KIAA0406 BINDING SITE. KIAA0406 is a target gene of GAM26, corresponding to GAM26-TARGET GENE of FIG. 26A. KIAA0406 BINDING SITE is a binding site found in an untranslated region of KIAA0406, corresponding to BINDING SITE of FIG. 26A. FIG. 26D illustrates the complementarity of the nucleotide sequence of KIAA0406 BINDING SITE, designated SEQ ID:726937, to the nucleotide sequence of GAM26 RNA of FIG. 26A, designated SEQ ID:20604. A further function of GAM26 is therefore inhibition of (KIAA0406). Accordingly, utilities of GAM26 include diagnosis and treatment of diseases and clinical conditions with which KIAA0406 is associated.

Reference is now made to KIAA0441 BINDING SITE. KIAA0441 is a target gene of GAM26, corresponding to GAM26-TARGET GENE of FIG. 26A. KIAA0441 BINDING SITE is a binding site found in an untranslated region of KIAA0441, corresponding to BINDING SITE of FIG. 26A. FIG. 26D illustrates the complementarity of the nucleotide sequence of KIAA0441 BINDING SITE, designated SEQ ID:730328, to the nucleotide sequence of GAM26 RNA of FIG. 26A, designated SEQ ID:20604. Yet a further function of GAM26 is therefore inhibition of (KIAA0441). Accordingly, utilities of include diagnosis and treatment of diseases and clinical conditions with which KIAA0441 is associated.

Reference is now made to KIAA0475 BINDING SITE. KIAA0475 is a target gene of GAM26, corresponding to GAM26-TARGET GENE of FIG. 26A. KIAA0475 BINDING SITE is a binding site found in an untranslated region of KIAA0475, corresponding to BINDING SITE of FIG. 26A. FIG. 26D illustrates the complementarity of the nucleotide sequence of KIAA0475 BINDING SITE, designated SEQ ID:734620, to the nucleotide sequence of GAM26 RNA of FIG. 26A, designated SEQ ID:20604. Another function of GAM26 is therefore inhibition of (KIAA0475). Accordingly, utilities of GAM26 include diagnosis and treatment of diseases and clinical conditions with which KIAA0475 is associated.

Reference is now made to KIAA0633 BINDING SITE. KIAA0633 is a target gene of GAM26, corresponding to GAM26-TARGET GENE of FIG. 26A. KIAA0633 BINDING SITE is a binding site found in an untranslated region of KIAA0633, corresponding to BINDING SITE of FIG. 26A. FIG. 26D illustrates the complementarity of the nucleotide sequence of KIAA0633 BINDING SITE, designated SEQ ID:744516, to the nucleotide sequence of GAM26 RNA of FIG. 26A, designated SEQ ID:20604. Yet another function of GAM26 is therefore inhibition of (KIAA0633). Accordingly, utilities of GAM26 include diagnosis and treatment of diseases and clinical conditions with which KIAA0633 is associated.

Reference is now made to KIAA0649 BINDING SITE. KIAA0649 is a target gene of GAM26, corresponding to GAM26-TARGET GENE of FIG. 26A. KIAA0649 BINDING SITE is a binding site found in an untranslated region of KIAA0649, corresponding to BINDING SITE of FIG. 26A. FIG. 26D illustrates the complementarity of the nucleotide sequence of KIAA0649 BINDING SITE, designated SEQ ID:745411, to the nucleotide sequence of GAM26 RNA of FIG. 26A, designated SEQ ID:20604. An additional function of GAM26 is therefore inhibition of (KIAA0649). Accordingly, utilities of GAM26 include diagnosis and treatment of diseases and clinical conditions with which KIAA0649 is associated.

Reference is now made to KIAA0649 BINDING SITE. KIAA0649 is a target gene of GAM26, corresponding to GAM26-TARGET GENE of FIG. 26A. KIAA0649 BINDING SITE is a binding site found in an untranslated region of KIAA0649, corresponding to BINDING SITE of FIG. 26A. FIG. 26D illustrates the complementarity of the nucleotide sequence of KIAA0649 BINDING SITE, designated SEQ ID:745444, to the nucleotide sequence of GAM26 RNA of FIG. 26A, designated SEQ ID:20604. A further function of GAM26 is therefore inhibition of (KIAA0649). Accordingly, utilities of GAM26 include diagnosis and treatment of diseases and clinical conditions with which KIAA0649 is associated.

Reference is now made to KIAA0700 BINDING SITE. KIAA0700 is a target gene of GAM26, corresponding to GAM26-TARGET GENE of FIG. 26A. KIAA0700 BINDING SITE is a binding site found in an untranslated region of KIAA0700, corresponding to BINDING SITE of FIG. 26A. FIG. 26D illustrates the complementarity of the nucleotide sequence of KIAA0700 BINDING SITE, designated SEQ ID:747790, to the nucleotide sequence of GAM26 RNA of FIG. 26A, designated SEQ ID:20604. Yet a further function of GAM26 is therefore inhibition of (KIAA0700).

Accordingly, utilities of GAM26 include diagnosis and treatment of diseases and clinical conditions with which KIAA0700 is associated.

Reference is now made to KIAA0844 BINDING SITE. KIAA0844 is a target gene of GAM26, corresponding to GAM26-TARGET GENE of FIG. 26A. KIAA0844 BINDING SITE is a binding site found in an untranslated region of KIAA0844, corresponding to BINDING SITE of FIG. 26A. FIG. 26D illustrates the complementarity of the nucleotide sequence of KIAA0844 BINDING SITE, designated SEQ ID:754642, to the nucleotide sequence of GAM26 RNA of FIG. 26A, designated SEQ ID:20604. Another function of GAM26 is therefore inhibition of (KIAA0844). Accordingly, utilities of GAM26 include diagnosis and treatment of diseases and clinical conditions with which KIAA0844 is associated.

Reference is now made to KIAA0960 BINDING SITE. KIAA0960 is a target gene of GAM26, corresponding to GAM26-TARGET GENE of FIG. 26A. KIAA0960 BINDING SITE is a binding site found in an untranslated region of KIAA0960, corresponding to BINDING SITE of FIG. 26A. FIG. 26D illustrates the complementarity of the nucleotide sequence of KIAA0960 BINDING SITE, designated SEQ ID:760740, to the nucleotide sequence of GAM26 RNA of FIG. 26A, designated SEQ ID:20604. Yet another function of GAM26 is therefore inhibition of (KIAA0960). Accordingly, utilities of GAM26 include diagnosis and treatment of diseases and clinical conditions with which KIAA0960 is associated.

Reference is now made to KIAA0963 BINDING SITE. KIAA0963 is a target gene of GAM26, corresponding to GAM26-TARGET GENE of FIG. 26A. KIAA0963 BINDING SITE is a binding site found in an untranslated region of KIAA0963, corresponding to BINDING SITE of FIG. 26A. FIG. 26D illustrates the complementarity of the nucleotide sequence of KIAA0963 BINDING SITE, designated SEQ ID:761105, to the nucleotide sequence of GAM26 RNA of FIG. 26A, designated SEQ ID:20604. An additional function of GAM26 is therefore inhibition of (KIAA0963). Accordingly, utilities of GAM26 include diagnosis and treatment of diseases and clinical conditions with which KIAA0963 is associated.

Reference is now made to KIAA0979 BINDING SITE. KIAA0979 is a target gene of GAM26, corresponding to GAM26-TARGET GENE of FIG. 26A. KIAA0979 BINDING SITE is a binding site found in an untranslated region of KIAA0979, corresponding to BINDING SITE of FIG. 26A. FIG. 26D illustrates the complementarity of the nucleotide sequence of KIAA0979 BINDING SITE, designated SEQ ID:762065, to the nucleotide sequence of GAM26 RNA of FIG. 26A, designated SEQ ID:20604. A further function of GAM26 is therefore inhibition of (KIAA0979). Accordingly, utilities of GAM26 include diagnosis and treatment of diseases and clinical conditions with which KIAA0979 is associated.

Reference is now made to FUBP3 BINDING SITE. FUBP3 is a target gene of GAM26, corresponding to GAM26-TARGET GENE of FIG. 26A. FUBP3 BINDING SITE is a binding site found in an untranslated region of FUBP3, corresponding to BINDING SITE of FIG. 26A. FIG. 26D illustrates the complementarity of the nucleotide sequence of FUBP3 BINDING SITE, designated SEQ ID:763022, to the nucleotide sequence of GAM26 RNA of FIG. 26A, designated SEQ ID:20604. Yet a further function of GAM26 is therefore inhibition of (FUBP3). Accordingly, utilities of GAM26 include diagnosis and treatment of diseases and clinical conditions with which FUBP3 is associated.

Reference is now made to KIAA0995 BINDING SITE. KIAA0995 is a target gene of GAM26, corresponding to GAM26-TARGET GENE of FIG. 26A. KIAA0995 BINDING SITE is a binding site found in an untranslated region of KIAA0995, corresponding to BINDING SITE of FIG. 26A. FIG. 26D illustrates the complementarity of the nucleotide sequence of KIAA0995 BINDING SITE, designated SEQ ID:763022, to the nucleotide sequence of GAM26 RNA of FIG. 26A, designated SEQ ID:20604. Another function of GAM26 is therefore inhibition of (KIAA0995). Accordingly, utilities of GAM26 include diagnosis and treatment of diseases and clinical conditions with which KIAA0995 is associated.

Reference is now made to KIAA0995 BINDING SITE. KIAA0995 is a target gene of GAM26, corresponding to GAM26-TARGET GENE of FIG. 26A. KIAA0995 BINDING SITE is a binding site found in an untranslated region of KIAA0995, corresponding to BINDING SITE of FIG. 26A. FIG. 26D illustrates the complementarity of the nucleotide sequence of KIAA0995 BINDING SITE, designated SEQ ID:763026, to the nucleotide sequence of GAM26 RNA of FIG. 26A, designated SEQ ID:20604. Yet another function of GAM26 is therefore inhibition of (KIAA0995). Accordingly, utilities of GAM26 include diagnosis and treatment of diseases and clinical conditions with which KIAA0995 is associated.

Reference is now made to KIAA0995 BINDING SITE. KIAA0995 is a target gene of GAM26, corresponding to GAM26-TARGET GENE of FIG. 26A. KIAA0995 BINDING SITE is a binding site found in an untranslated region of KIAA0995, corresponding to BINDING SITE of FIG. 26A. FIG. 26D illustrates the complementarity of the nucleotide sequence of KIAA0995 BINDING SITE, designated SEQ ID:763030, to the nucleotide sequence of GAM26 RNA of FIG. 26A, designated SEQ ID:20604. An additional function of GAM26 is therefore inhibition of (KIAA0995). Accordingly, utilities of GAM26 include diagnosis and treatment of diseases and clinical conditions with which KIAA0995 is associated.

Reference is now made to KIAA0995 BINDING SITE. KIAA0995 is a target gene of GAM26, corresponding to GAM26-TARGET GENE of FIG. 26A. KIAA0995 BINDING SITE is a binding site found in an untranslated region of KIAA0995, corresponding to BINDING SITE of FIG. 26A. FIG. 26D illustrates the complementarity of the nucleotide sequence of KIAA0995 BINDING SITE, designated SEQ ID:763031, to the nucleotide sequence of GAM26 RNA of FIG. 26A, designated SEQ ID:20604. A function of GAM26 is therefore inhibition of (KIAA0995). Accordingly, utilities of GAM26 include diagnosis and treatment of diseases and clinical conditions with which KIAA0995 is associated.

Reference is now made to KIAA0995 BINDING SITE. KIAA0995 is a target gene of GAM26, corresponding to GAM26-TARGET GENE of FIG. 26A. KIAA0995 BINDING SITE is a binding site found in an untranslated region of KIAA0995, corresponding to BINDING SITE of FIG. 26A. FIG. 26D illustrates the complementarity of the nucleotide sequence of KIAA0995 BINDING SITE, designated SEQ ID:763039, to the nucleotide sequence of GAM26 RNA of FIG. 26A, designated SEQ ID:20604. Yet a further function of GAM26 is therefore inhibition of (KIAA0995).

Accordingly, utilities of GAM26 include diagnosis and treatment of diseases and clinical conditions with which KIAA0995 is associated.

Reference is now made to KIAA1016 BINDING SITE. KIAA1016 is a target gene of GAM26, corresponding to GAM26-TARGET GENE of FIG. 26A. KIAA1016 BINDING SITE is a binding site found in an untranslated region of KIAA1016, corresponding to BINDING SITE of FIG. 26A. FIG. 26D illustrates the complementarity of the nucleotide sequence of KIAA1016 BINDING SITE, designated SEQ ID:764057, to the nucleotide sequence of GAM26 RNA of FIG. 26A, designated SEQ ID:20604. Another function of GAM26 is therefore inhibition of (KIAA1016). Accordingly, utilities of GAM26 include diagnosis and treatment of diseases and clinical conditions with which KIAA1016 is associated.

Reference is now made to KIAA1061 BINDING SITE. KIAA1061 is a target gene of GAM26, corresponding to GAM26-TARGET GENE of FIG. 26A. KIAA1061 BINDING SITE is a binding site found in an untranslated region of KIAA1061, corresponding to BINDING SITE of FIG. 26A. FIG. 26D illustrates the complementarity of the nucleotide sequence of KIAA1061 BINDING SITE, designated SEQ ID:768364, to the nucleotide sequence of GAM26 RNA of FIG. 26A, designated SEQ ID:20604. Yet another function of GAM26 is therefore inhibition of (KIAA1061). Accordingly, utilities of GAM26 include diagnosis and treatment of diseases and clinical conditions with which KIAA1061 is associated.

Reference is now made to KIAA1079 BINDING SITE. KIAA1079 is a target gene of GAM26, corresponding to GAM26-TARGET GENE of FIG. 26A. KIAA1079 BINDING SITE is a binding site found in an untranslated region of KIAA1079, corresponding to BINDING SITE of FIG. 26A. FIG. 26D illustrates the complementarity of the nucleotide sequence of KIAA1079 BINDING SITE, designated SEQ ID:769234, to the nucleotide sequence of GAM26 RNA of FIG. 26A, designated SEQ ID:20604. An additional function of GAM26 is therefore inhibition of (KIAA1079). Accordingly, utilities of GAM26 include diagnosis and treatment of diseases and clinical conditions with which KIAA1079 is associated.

Reference is now made to KIAA1091 BINDING SITE. KIAA1091 is a target gene of GAM26, corresponding to GAM26-TARGET GENE of FIG. 26A. KIAA1091 BINDING SITE is a binding site found in an untranslated region of KIAA1091, corresponding to BINDING SITE of FIG. 26A. FIG. 26D illustrates the complementarity of the nucleotide sequence of KIAA1091 BINDING SITE, designated SEQ ID:769882, to the nucleotide sequence of GAM26 RNA of FIG. 26A, designated SEQ ID:20604. A further function of GAM26 is therefore inhibition of (KIAA1091). Accordingly, utilities of GAM26 include diagnosis and treatment of diseases and clinical conditions with which KIAA1091 is associated.

Reference is now made to KIAA1140 BINDING SITE. KIAA1140 is a target gene of GAM26, corresponding to GAM26-TARGET GENE of FIG. 26A. KIAA1140 BINDING SITE is a binding site found in an untranslated region of KIAA1140, corresponding to BINDING SITE of FIG. 26A. FIG. 26D illustrates the complementarity of the nucleotide sequence of KIAA1140 BINDING SITE, designated SEQ ID:771839, to the nucleotide sequence of GAM26 RNA of FIG. 26A, designated SEQ ID:20604. Yet a further function of GAM26 is therefore inhibition of (KIAA1140). Accordingly, utilities of GAM26 include diagnosis and treatment of diseases and clinical conditions with which KIAA1140 is associated.

Reference is now made to KIAA1140 BINDING SITE. KIAA11140 is a target gene of GAM26, corresponding to GAM26-TARGET GENE of FIG. 26A.

KIAA1140 BINDING SITE is a binding site found in an untranslated region of KIAA1140, corresponding to BINDING SITE of FIG. 26A. FIG. 26D illustrates the complementarity of the nucleotide sequence of KIAA1140 BINDING SITE, designated SEQ ID:771842, to the nucleotide sequence of GAM26 RNA of FIG. 26A, designated SEQ ID:20604. Another function of GAM26 is therefore inhibition of (KIAA1140). Accordingly, utilities of GAM26 include diagnosis and treatment of diseases and clinical conditions with which KIAA1140 is associated.

Reference is now made to KIAA1194 BINDING SITE. KIAA1194 is a target gene of GAM26, corresponding to GAM26-TARGET GENE of FIG. 26A. KIAA1194 BINDING SITE is a binding site found in an untranslated region of KIAA1194, corresponding to BINDING SITE of FIG. 26A. FIG. 26D illustrates the complementarity of the nucleotide sequence of KIAA1194 BINDING SITE, designated SEQ ID:776042, to the nucleotide sequence of GAM26 RNA of FIG. 26A, designated SEQ ID:20604. Yet another function of GAM26 is therefore inhibition of (KIAA1194). Accordingly, utilities of GAM26 include diagnosis and treatment of diseases and clinical conditions with which KIAA1194 is associated.

Reference is now made to KIAA1233 BINDING SITE. KIAA1233 is a target gene of GAM26, corresponding to GAM26-TARGET GENE of FIG. 26A. KIAA1233 BINDING SITE is a binding site found in an untranslated region of KIAA1233, corresponding to BINDING SITE of FIG. 26A. FIG. 26D illustrates the complementarity of the nucleotide sequence of KIAA1233 BINDING SITE, designated SEQ ID:779098, to the nucleotide sequence of GAM26 RNA of FIG. 26A, designated SEQ ID:20604. An additional function of GAM26 is therefore inhibition of (KIAA1233). Accordingly, utilities of GAM26 include diagnosis and treatment of diseases and clinical conditions with which KIAA1233 is associated.

Reference is now made to KIAA1332 BINDING SITE. KIAA1332 is a target gene of GAM26, corresponding to GAM26-TARGET GENE of FIG. 26A. KIAA1332 BINDING SITE is a binding site found in an untranslated region of KIAA1332, corresponding to BINDING SITE of FIG. 26A. FIG. 26D illustrates the complementarity of the nucleotide sequence of KIAA1332 BINDING SITE, designated SEQ ID:785691, to the nucleotide sequence of GAM26 RNA of FIG. 26A, designated SEQ ID:20604. A further function of GAM26 is therefore inhibition of (KIAA1332). Accordingly, utilities of GAM26 include diagnosis and treatment of diseases and clinical conditions with which KIAA1332 is associated.

Reference is now made to KIAA1458 BINDING SITE. KIAA1458 is a target gene of GAM26, corresponding to GAM26-TARGET GENE of FIG. 26A. KIAA1458 BINDING SITE is a binding site found in an untranslated region of KIAA1458, corresponding to BINDING SITE of FIG. 26A. FIG. 26D illustrates the complementarity of the nucleotide sequence of KIAA1458 BINDING SITE, designated SEQ ID:791465, to the nucleotide sequence of GAM26 RNA of FIG. 26A, designated SEQ ID:20604. Yet a further function of GAM26 is therefore inhibition of (KIAA1458).

Accordingly, utilities of GAM26 include diagnosis and treatment of diseases and clinical conditions with which KIAA1458 is associated.

Reference is now made to KIAA1458 BINDING SITE. KIAA1458 is a target gene of GAM26, corresponding to GAM26-TARGET GENE of FIG. 26A. KIAA1458 BINDING SITE is a binding site found in an untranslated region of KIAA1458, corresponding to BINDING SITE of FIG. 26A. FIG. 26D illustrates the complementarity of the nucleotide sequence of KIAA1458 BINDING SITE, designated SEQ ID:791473, to the nucleotide sequence of GAM26 RNA of FIG. 26A, designated SEQ ID:20604. Another function of GAM26 is therefore inhibition of (KIAA1458). Accordingly, utilities of GAM26 include diagnosis and treatment of diseases and clinical conditions with which KIAA1458 is associated.

Reference is now made to KIAA1483 BINDING SITE. KIAA1483 is a target gene of GAM26, corresponding to GAM26-TARGET GENE of FIG. 26A. KIAA1483 BINDING SITE is a binding site found in an untranslated region of KIAA1483, corresponding to BINDING SITE of FIG. 26A. FIG. 26D illustrates the complementarity of the nucleotide sequence of KIAA1483 BINDING SITE, designated SEQ ID:792995, to the nucleotide sequence of GAM26 RNA of FIG. 26A, designated SEQ ID:20604. Yet another function of GAM26 is therefore inhibition of (KIAA1483). Accordingly, utilities of GAM26 include diagnosis and treatment of diseases and clinical conditions with which KIAA1483 is associated.

Reference is now made to KIAA1483 BINDING SITE. KIAA1483 is a target gene of GAM26, corresponding to GAM26-TARGET GENE of FIG. 26A. KIAA1483 BINDING SITE is a binding site found in an untranslated region of KIAA1483, corresponding to BINDING SITE of FIG. 26A. FIG. 26D illustrates the complementarity of the nucleotide sequence of KIAA1483 BINDING SITE, designated SEQ ID:793014, to the nucleotide sequence of GAM26 RNA of FIG. 26A, designated SEQ ID:20604. An additional function of GAM26 is therefore inhibition of (KIAA1483). Accordingly, utilities of GAM26 include diagnosis and treatment of diseases and clinical conditions with which KIAA1483 is associated.

Reference is now made to KIAA1542 BINDING SITE. KIAA1542 is a target gene of GAM26, corresponding to GAM26-TARGET GENE of FIG. 26A. KIAA1542 BINDING SITE is a binding site found in an untranslated region of KIAA1542, corresponding to BINDING SITE of FIG. 26A. FIG. 26D illustrates the complementarity of the nucleotide sequence of KIAA1542 BINDING SITE, designated SEQ ID:795954, to the nucleotide sequence of GAM26 RNA of FIG. 26A, designated SEQ ID:20604. A further function of GAM26 is therefore inhibition of (KIAA1542). Accordingly, utilities of GAM26 include diagnosis and treatment of diseases and clinical conditions with which KIAA1542 is associated.

Reference is now made to KIAA1542 BINDING SITE. KIAA1542 is a target gene of GAM26, corresponding to GAM26-TARGET GENE of FIG. 26A. KIAA1542 BINDING SITE is a binding site found in an untranslated region of KIAA1542, corresponding to BINDING SITE of FIG. 26A. FIG. 26D illustrates the complementarity of the nucleotide sequence of KIAA1542 BINDING SITE, designated SEQ ID:795958, to the nucleotide sequence of GAM26 RNA of FIG. 26A, designated SEQ ID):20604. Yet a further function of GAM26 is therefore inhibition of (KIAA1542).

Accordingly, utilities of GAM26 include diagnosis and treatment of diseases and clinical conditions with which KIAA1542 is associated.

Reference is now made to KIAA1542 BINDING SITE. KIAA1542 is a target gene of GAM26, corresponding to GAM26-TARGET GENE of FIG. 26A. KIAA1542 BINDING SITE is a binding site found in an untranslated region of KIAA1542, corresponding to BINDING SITE of FIG. 26A. FIG. 26D illustrates the complementarity of the nucleotide sequence of KIAA1542 BINDING SITE, designated SEQ ID:795963, to the nucleotide sequence of GAM26 RNA of FIG. 26A, designated SEQ ID:20604. Another function of GAM26 is therefore inhibition of (KIAA1542). Accordingly, utilities of GAM26 include diagnosis and treatment of diseases and clinical conditions with which KIAA1542 is associated.

Reference is now made to KIAA1608 BINDING SITE. KIAA1608 is a target gene of GAM26, corresponding to GAM26-TARGET GENE of FIG. 26A. KIAA1608 BINDING SITE is a binding site found in an untranslated region of KIAA1608, corresponding to BINDING SITE of FIG. 26A. FIG. 26D illustrates the complementarity of the nucleotide sequence of KIAA1608 BINDING SITE, designated SEQ ID:799200, to the nucleotide sequence of GAM26 RNA of FIG. 26A, designated SEQ ID:20604. Yet another function of GAM26 is therefore inhibition of (KIAA1608). Accordingly, utilities of GAM26 include diagnosis and treatment of diseases and clinical conditions with which KIAA1608 is associated.

Reference is now made to KIAA1608 BINDING SITE. KIAA1608 is a target gene of GAM26, corresponding to GAM26-TARGET GENE of FIG. 26A. KIAA1608 BINDING SITE is a binding site found in an untranslated region of KIAA1608, corresponding to BINDING SITE of FIG. 26A. FIG. 26D illustrates the complementarity of the nucleotide sequence of KIAA1608 BINDING SITE, designated SEQ ID:799201, to the nucleotide sequence of GAM26 RNA of FIG. 26A, designated SEQ ID:20604. An additional function of GAM26 is therefore inhibition of (KIAA1608). Accordingly, utilities of GAM26 include diagnosis and treatment of diseases and clinical conditions with which KIAA1608 is associated.

Reference is now made to KIAA1766 BINDING SITE. KIAA1766 is a target gene of GAM26, corresponding to GAM26-TARGET GENE of FIG. 26A. KIAA1766 BINDING SITE is a binding site found in an untranslated region of KIAA1766, corresponding to BINDING SITE of FIG. 26A. FIG. 26D illustrates the complementarity of the nucleotide sequence of KIAA1766 BINDING SITE, designated SEQ ID:808833, to the nucleotide sequence of GAM26 RNA of FIG. 26A, designated SEQ ID:20604. A further function of GAM26 is therefore inhibition of (KIAA1766). Accordingly, utilities of GAM26 include diagnosis and treatment of diseases and clinical conditions with which KIAA1766 is associated.

Reference is now made to KIAA1893 BINDING SITE. KIAA1893 is a target gene of GAM26, corresponding to GAM26-TARGET GENE of FIG. 26A. KIAA1893 BINDING SITE is a binding site found in an untranslated region of KIAA1893, corresponding to BINDING SITE of FIG. 26A. FIG. 26D illustrates the complementarity of the nucleotide sequence of KIAA1893 BINDING SITE, designated SEQ ID:816521, to the nucleotide sequence of GAM26 RNA of FIG. 26A, designated SEQ ID:20604. Yet a further function of GAM26 is therefore inhibition of (KIAA1893).

Accordingly, utilities of GAM26 include diagnosis and treatment of diseases and clinical conditions with which KIAA1893 is associated.

Reference is now made to KIAA1966 BINDING SITE. KIAA1966 is a target gene of GAM26, corresponding to GAM26-TARGET GENE of FIG. 26A. KIAA1966 BINDING SITE is a binding site found in an untranslated region of KIAA1966, corresponding to BINDING SITE of FIG. 26A. FIG. 26D illustrates the complementarity of the nucleotide sequence of KIAA1966 BINDING SITE, designated SEQ ID:822274, to the nucleotide sequence of GAM26 RNA of FIG. 26A, designated SEQ ID:20604. Another function of GAM26 is therefore inhibition of (KIAA1966). Accordingly, utilities of GAM26 include diagnosis and treatment of diseases and clinical conditions with which KIAA1966 is associated.

Reference is now made to KIAA1966 BINDING SITE. KIAA1966 is a target gene of GAM26, corresponding to GAM26-TARGET GENE of FIG. 26A. KIAA1966 BINDING SITE is a binding site found in an untranslated region of KIAA1966, corresponding to BINDING SITE of FIG. 26A. FIG. 26D illustrates the complementarity of the nucleotide sequence of KIAA1966 BINDING SITE, designated SEQ ID:822277, to the nucleotide sequence of GAM26 RNA of FIG. 26A, designated SEQ ID:20604. Yet another function of GAM26 is therefore inhibition of (KIAA1966). Accordingly, utilities of GAM26 include diagnosis and treatment of diseases and clinical conditions with which KIAA1966 is associated.

Reference is now made to KIAA1981 BINDING SITE. KIAA1981 is a target gene of GAM26, corresponding to GAM26-TARGET GENE of FIG. 26A. KIAA1981 BINDING SITE is a binding site found in an untranslated region of KIAA1981, corresponding to BINDING SITE of FIG. 26A. FIG. 26D illustrates the complementarity of the nucleotide sequence of KIAA1981 BINDING SITE, designated SEQ ID:823610, to the nucleotide sequence of GAM26 RNA of FIG. 26A, designated SEQ ID:20604. An additional function of GAM26 is therefore inhibition of (KIAA1981). Accordingly, utilities of GAM26 include diagnosis and treatment of diseases and clinical conditions with which KIAA1981 is associated.

Reference is now made to LANCL2 BINDING SITE. LANCL2 is a target gene of GAM26, corresponding to GAM26-TARGET GENE of FIG. 26A. LANCL2 BINDING SITE is a binding site found in an untranslated region of LANCL2, corresponding to BINDING SITE of FIG. 26A. FIG. 26D illustrates the complementarity of the nucleotide sequence of LANCL2 BINDING SITE, designated SEQ ID:828560, to the nucleotide sequence of GAM26 RNA of FIG. 26A, designated SEQ ID:20604. A further function of GAM26 is therefore inhibition of (LANCL2). Accordingly, utilities of GAM26 include diagnosis and treatment of diseases and clinical conditions with which LANCL2 is associated.

Reference is now made to LANO BINDING SITE. LANO is a target gene of GAM26, corresponding to GAM26-TARGET GENE of FIG. 26A. LANO BINDING SITE is a binding site found in an untranslated region of LANO, corresponding to BINDING SITE of FIG. 26A. FIG. 26D illustrates the complementarity of the nucleotide sequence of LANO BINDING SITE, designated SEQ ID:828789, to the nucleotide sequence of GAM26 RNA of FIG. 26A, designated SEQ ID:20604. Yet a further function of GAM26 is therefore inhibition of (LANO). Accordingly, utilities of GAM26 include diagnosis and treatment of diseases and clinical conditions with which LANO is associated.

Reference is now made to LAP1B BINDING SITE. LAP1B is a target gene of GAM26, corresponding to GAM26-TARGET GENE of FIG. 26A. LAP1B BINDING SITE is a binding site found in an untranslated region of LAP1B, corresponding to BINDING SITE of FIG. 26A. FIG. 26D illustrates the complementarity of the nucleotide sequence of LAP1B BINDING SITE, designated SEQ ID:828926, to the nucleotide sequence of GAM26 RNA of FIG. 26A, designated SEQ ID:20604. Another function of GAM26 is therefore inhibition of (LAP1B). Accordingly, utilities of GAM26 include diagnosis and treatment of diseases and clinical conditions with which LAP1B is associated.

Reference is now made to LSM4 BINDING SITE. LSM4 is a target gene of GAM26, corresponding to GAM26-TARGET GENE of FIG. 26A. LSM4 BINDING SITE is a binding site found in an untranslated region of LSM4, corresponding to BINDING SITE of FIG. 26A. FIG. 26D illustrates the complementarity of the nucleotide sequence of LSM4 BINDING SITE, designated SEQ ID:834693, to the nucleotide sequence of GAM26 RNA of FIG. 26A, designated SEQ ID:20604. Yet another function of GAM26 is therefore inhibition of (LSM4). Accordingly, utilities of GAM26 include diagnosis and treatment of diseases and clinical conditions with which LSM4 is associated.

Reference is now made to MAP2K7 BINDING SITE. MAP2K7 is a target gene of GAM26, corresponding to GAM26-TARGET GENE of FIG. 26A. MAP2K7 BINDING SITE is a binding site found in an untranslated region of MAP2K7, corresponding to BINDING SITE of FIG. 26A. FIG. 26D illustrates the complementarity of the nucleotide sequence of MAP2K7 BINDING SITE, designated SEQ ID:838581, to the nucleotide sequence of GAM26 RNA of FIG. 26A, designated SEQ ID:20604. An additional function of GAM26 is therefore inhibition of (MAP2K7). Accordingly, utilities of GAM26 include diagnosis and treatment of diseases and clinical conditions with which MAP2K7 is associated.

Reference is now made to MAPK8IP3 BINDING SITE. MAPK8IP3 is a target gene of GAM26, corresponding to GAM26-TARGET GENE of FIG. 26A. MAPK8IP3 BINDING SITE is a binding site found in an untranslated region of MAPK8IP3, corresponding to BINDING SITE of FIG. 26A. FIG. 26D illustrates the complementarity of the nucleotide sequence of MAPK8IP3 BINDING SITE, designated SEQ ID:839431, to the nucleotide sequence of GAM26 RNA of FIG. 26A, designated SEQ ID:20604. A further function of GAM26 is therefore inhibition of (MAPK8IP3). Accordingly, utilities of GAM26 include diagnosis and treatment of diseases and clinical conditions with which MAPK8IP3 is associated.

Reference is now made to MESDC1 BINDING SITE. MESDC1 is a target gene of GAM26, corresponding to GAM26-TARGET GENE of FIG. 26A. MESDC1 BINDING SITE is a binding site found in an untranslated region of MESDC1, corresponding to BINDING SITE of FIG. 26A. FIG. 26D illustrates the complementarity of the nucleotide sequence of MESDC1 BINDING SITE, designated SEQ ID:842805, to the nucleotide sequence of GAM26 RNA of FIG. 26A, designated SEQ ID:20604. Yet a further function of GAM26 is therefore inhibition of (MESDC1). Accordingly, utilities of GAM26 include diagnosis and treatment of diseases and clinical conditions with which MESDC1 is associated.

Reference is now made to MESDC1 BINDING SITE. MESDC1 is a target gene of GAM26, corresponding to GAM26-TARGET GENE of FIG. 26A. MESDC1 BINDING SITE is a binding site found in an untranslated region of MESDC1, corresponding to BINDING SITE of FIG. 26A. FIG. 26D illustrates the complementarity of the nucleotide sequence of MESDC1 BINDING SITE, designated SEQ ID:842838, to the nucleotide sequence of GAM26 RNA of FIG. 26A, designated SEQ ID:20604. Another function of GAM26 is therefore inhibition of (MESDC1). Accordingly, utilities of GAM26 include diagnosis and treatment of diseases and clinical conditions with which MESDC1 is associated.

Reference is now made to OATPRP4 BINDING SITE. OATPRP4 is a target gene of GAM26, corresponding to GAM26-TARGET GENE of FIG. 26A. OATPRP4 BINDING SITE is a binding site found in an untranslated region of OATPRP4, corresponding to BINDING SITE of FIG. 26A. FIG. 26D illustrates the complementarity of the nucleotide sequence of OATPRP4 BINDING SITE, designated SEQ ID:844404, to the nucleotide sequence of GAM26 RNA of FIG. 26A, designated SEQ ID:20604. Yet another function of GAM26 is therefore inhibition of (OATPRP4). Accordingly, utilities of GAM26 include diagnosis and treatment of diseases and clinical conditions with which OATPRP4 is associated.

Reference is now made to SLC21A11 BINDING SITE. SLC21A11 is a target gene of GAM26, corresponding to GAM26-TARGET GENE of FIG. 26A. SLC21A11 BINDING SITE is a binding site found in an untranslated region of SLC21A11, corresponding to BINDING SITE of FIG. 26A. FIG. 26D illustrates the complementarity of the nucleotide sequence of SLC21A11 BINDING SITE, designated SEQ ID:844404, to the nucleotide sequence of GAM26 RNA of FIG. 26A, designated SEQ ID:20604. An additional function of GAM26 is therefore inhibition of (SLC21A11). Accordingly, utilities of GAM26 include diagnosis and treatment of diseases and clinical conditions with which SLC21A11 is associated.

Reference is now made to MGC10702 BINDING SITE. MGC10702 is a target gene of GAM26, corresponding to GAM26-TARGET GENE of FIG. 26A. MGC10702 BINDING SITE is a binding site found in an untranslated region of MGC10702, corresponding to BINDING SITE of FIG. 26A. FIG. 26D illustrates the complementarity of the nucleotide sequence of MGC10702 BINDING SITE, designated SEQ ID:844408, to the nucleotide sequence of GAM26 RNA of FIG. 26A, designated SEQ ID:20604. A further function of GAM26 is therefore inhibition of (MGC10702). Accordingly, utilities of GAM26 include diagnosis and treatment of diseases and clinical conditions with which MGC10702 is associated.

Reference is now made to MGC13159 BINDING SITE. MGC13159 is a target gene of GAM26, corresponding to GAM26-TARGET GENE of FIG. 26A. MGC13159 BINDING SITE is a binding site found in an untranslated region of MGC13159, corresponding to BINDING SITE of FIG. 26A. FIG. 26D illustrates the complementarity of the nucleotide sequence of MGC13159 BINDING SITE, designated SEQ ID:851324, to the nucleotide sequence of GAM26 RNA of FIG. 26A, designated SEQ ID:20604. Yet a further function of GAM26 is therefore inhibition of (MGC13159). Accordingly, utilities of GAM26 include diagnosis and treatment of diseases and clinical conditions with which MGC13159 is associated.

Reference is now made to MGC14425 BINDING SITE. MGC14425 is a target gene of GAM26, corresponding to GAM26-TARGET GENE of FIG. 26A. MGC14425 BINDING SITE is a binding site found in an untranslated region of MGC14425, corresponding to BINDING SITE of FIG. 26A. FIG. 26D illustrates the complementarity of the nucleotide sequence of MGC14425 BINDING SITE, designated SEQ ID:852921, to the nucleotide sequence of GAM26 RNA of FIG. 26A, designated SEQ ID:20604. Another function of GAM26 is therefore inhibition of (MGC14425). Accordingly, utilities of GAM26 include diagnosis and treatment of diseases and clinical conditions with which MGC14425 is associated.

Reference is now made to MGC15396 BINDING SITE. MGC15396 is a target gene of GAM26, corresponding to GAM26-TARGET GENE of FIG. 26A. MGC15396 BINDING SITE is a binding site found in an untranslated region of MGC15396, corresponding to BINDING SITE of FIG. 26A. FIG. 26D illustrates the complementarity of the nucleotide sequence of MGC15396 BINDING SITE, designated SEQ ID:853827, to the nucleotide sequence of GAM26 RNA of FIG. 26A, designated SEQ ID:20604. Yet another function of GAM26 is therefore inhibition of (MGC15396). Accordingly, utilities of GAM26 include diagnosis and treatment of diseases and clinical conditions with which MGC15396 is associated.

Reference is now made to MGC15396 BINDING SITE. MGC15396 is a target gene of GAM26, corresponding to GAM26-TARGET GENE of FIG. 26A. MGC15396 BINDING SITE is a binding site found in an untranslated region of MGC15396, corresponding to BINDING SITE of FIG. 26A. FIG. 26D illustrates the complementarity of the nucleotide sequence of MGC15396 BINDING SITE, designated SEQ ID:853851, to the nucleotide sequence of GAM26 RNA of FIG. 26A, designated SEQ ID:20604. An additional function of GAM26 is therefore inhibition of (MGC15396). Accordingly, utilities of GAM26 include diagnosis and treatment of diseases and clinical conditions with which MGC15396 is associated.

Reference is now made to MGC17347 BINDING SITE. MGC17347 is a target gene of GAM26, corresponding to GAM26-TARGET GENE of FIG. 26A. MGC17347 BINDING SITE is a binding site found in an untranslated region of MGC17347, corresponding to BINDING SITE of FIG. 26A. FIG. 26D illustrates the complementarity of the nucleotide sequence of MGC17347 BINDING SITE, designated SEQ ID:858358, to the nucleotide sequence of GAM26 RNA of FIG. 26A, designated SEQ ID:20604. A further function of GAM26 is therefore inhibition of (MGC17347). Accordingly, utilities of GAM26 include diagnosis and treatment of diseases and clinical conditions with which MGC17347 is associated.

Reference is now made to MGC17347 BINDING SITE. MGC17347 is a target gene of GAM26, corresponding to GAM26-TARGET GENE of FIG. 26A. MGC17347 BINDING SITE is a binding site found in an untranslated region of MGC17347, corresponding to BINDING SITE of FIG. 26A. FIG. 26D illustrates the complementarity of the nucleotide sequence of MGC17347 BINDING SITE, designated SEQ ID:858360, to the nucleotide sequence of GAM26 RNA of FIG. 26A, designated SEQ ID:20604. Yet a further function of GAM26 is therefore inhibition of (MGC17347). Accordingly, utilities of GAM26 include diagnosis and treatment of diseases and clinical conditions with which MGC117347 is associated.

Reference is now made to MGC1842 BINDING SITE. MGC1842 is a target gene of GAM26, corresponding to GAM26-TARGET GENE of FIG. 26A. MGC1842 BINDING SITE is a binding site found in an untranslated region of MGC1842, corresponding to BINDING SITE of FIG. 26A. FIG. 26D illustrates the complementarity of the nucleotide sequence of MGC1842 BINDING SITE, designated SEQ ID:858800, to the nucleotide sequence of GAM26 RNA of FIG. 26A, designated SEQ ID:20604. Another function of GAM26 is therefore inhibition of (MGC1842). Accordingly, utilities of GAM26 include diagnosis and treatment of diseases and clinical conditions with which MGC1842 is associated.

Reference is now made to MGC22679 BINDING SITE. MGC22679 is a target gene of GAM26, corresponding to GAM26-TARGET GENE of FIG. 26A. MGC22679 BINDING SITE is a binding site found in an untranslated region of MGC22679, corresponding to BINDING SITE of FIG. 26A. FIG. 26D illustrates the complementarity of the nucleotide sequence of MGC22679 BINDING SITE, designated SEQ ID:861565, to the nucleotide sequence of GAM26 RNA of FIG. 26A, designated SEQ ID:20604. Yet another function of GAM26 is therefore inhibition of (MGC22679). Accordingly, utilities of GAM26 include diagnosis and treatment of diseases and clinical conditions with which MGC22679 is associated.

Reference is now made to MGC2594 BINDING SITE. MGC2594 is a target gene of GAM26, corresponding to GAM26-TARGET GENE of FIG. 26A. MGC2594 BINDING SITE is a binding site found in an untranslated region of MGC2594, corresponding to BINDING SITE of FIG. 26A. FIG. 26D illustrates the complementarity of the nucleotide sequence of MGC2594 BINDING SITE, designated SEQ ID:864289, to the nucleotide sequence of GAM26 RNA of FIG. 26A, designated SEQ ID:20604. An additional function of GAM26 is therefore inhibition of (MGC2594). Accordingly, utilities of GAM26 include diagnosis and treatment of diseases and clinical conditions with which MGC2594 is associated.

Reference is now made to MGC26684 BINDING SITE. MGC26684 is a target gene of GAM26, corresponding to GAM26-TARGET GENE of FIG. 26A. MGC26684 BINDING SITE is a binding site found in an untranslated region of MGC26684, corresponding to BINDING SITE of FIG. 26A. FIG. 26D illustrates the complementarity of the nucleotide sequence of MGC26684 BINDING SITE, designated SEQ ID:865556, to the nucleotide sequence of GAM26 RNA of FIG. 26A, designated SEQ ID:20604. A further function of GAM26 is therefore inhibition of (MGC26684). Accordingly, utilities of GAM26 include diagnosis and treatment of diseases and clinical conditions with which MGC26684 is associated.

Reference is now made to MGC3222 BINDING SITE. MGC3222 is a target gene of GAM26, corresponding to GAM26-TARGET GENE of FIG. 26A. MGC3222 BINDING SITE is a binding site found in an untranslated region of MGC3222, corresponding to BINDING SITE of FIG. 26A. FIG. 26D illustrates the complementarity of the nucleotide sequence of MGC3222 BINDING SITE, designated SEQ ID:870434, to the nucleotide sequence of GAM26 RNA of FIG. 26A, designated SEQ ID:20604. Yet a further function of GAM26 is therefore inhibition of (MGC3222). Accordingly, utilities of GAM26 include diagnosis and treatment of diseases and clinical conditions with which MGC3222 is associated.

Reference is now made to MGC4170 BINDING SITE. MGC4170 is a target gene of GAM26, corresponding to GAM26-TARGET GENE of FIG. 26A. MGC4170 BINDING SITE is a binding site found in an untranslated region of MGC4170, corresponding to BINDING. SITE of FIG. 26A. FIG. 26D illustrates the complementarity of the nucleotide sequence of MGC4170 BINDING SITE, designated SEQ ID:872011, to the nucleotide sequence of GAM26 RNA of FIG. 26A, designated SEQ ID:20604. Another function of GAM26 is therefore inhibition of (MGC4170). Accordingly, utilities of GAM26 include diagnosis and treatment of diseases and clinical conditions with which MGC4170 is associated.

Reference is now made to MGC4172 BINDING SITE. MGC4172 is a target gene of GAM26, corresponding to GAM26-TARGET GENE of FIG. 26A. MGC4172 BINDING SITE is a binding site found in an untranslated region of MGC4172, corresponding to BINDING SITE of FIG. 26A. FIG. 26D illustrates the complementarity of the nucleotide sequence of MGC4172 BINDING SITE, designated SEQ ID:872115, to the nucleotide sequence of GAM26 RNA of FIG. 26A, designated SEQ ID:20604. Yet another function of GAM26 is therefore inhibition of (MGC4172). Accordingly, utilities of GAM26 include diagnosis and treatment of diseases and clinical conditions with which MGC4172 is associated.

Reference is now made to MGC4172 BINDING SITE. MGC4172 is a target gene of GAM26, corresponding to GAM26-TARGET GENE of FIG. 26A. MGC4172 BINDING SITE is a binding site found in an untranslated region of MGC4172, corresponding to BINDING SITE of FIG. 26A. FIG. 26D illustrates the complementarity of the nucleotide sequence of MGC4172 BINDING SITE, designated SEQ ID:872142, to the nucleotide sequence of GAM26 RNA of FIG. 26A, designated SEQ ID:20604. An additional function of GAM26 is therefore inhibition of (MGC4172). Accordingly, utilities of GAM26 include diagnosis and treatment of diseases and clinical conditions with which MGC4172 is associated.

Reference is now made to MGC5466 BINDING SITE. MGC5466 is a target gene of GAM26, corresponding to GAM26-TARGET GENE of FIG. 26A. MGC5466 BINDING SITE is a binding site found in an untranslated region of MGC5466, corresponding to BINDING SITE of FIG. 26A. FIG. 26D illustrates the complementarity of the nucleotide sequence of MGC5466 BINDING SITE, designated SEQ ID:877031, to the nucleotide sequence of GAM26 RNA of FIG. 26A, designated SEQ ID:20604. A further function of GAM26 is therefore inhibition of (MGC5466). Accordingly, utilities of GAM26 include diagnosis and treatment of diseases and clinical conditions with which MGC5466 is associated.

Reference is now made to MIP-T3 BINDING SITE. MIP-T3 is a target gene of GAM26, corresponding to GAM26-TARGET GENE of FIG. 26A. MIP-T3 BINDING SITE is a binding site found in an untranslated region of MIP-T3, corresponding to BINDING SITE of FIG. 26A. FIG. 26D illustrates the complementarity of the nucleotide sequence of MIP-T3 BINDING SITE, designated SEQ ID:879055, to the nucleotide sequence of GAM26 RNA of FIG. 26A, designated SEQ ID:20604. Yet a further function of GAM26 is therefore inhibition of (MIP-T3). Accordingly, utilities of GAM26 include diagnosis and treatment of diseases and clinical conditions with which MIP-T3 is associated.

Reference is now made to MIR BINDING SITE. MIR is a target gene of GAM26, corresponding to GAM26-TARGET GENE of FIG. 26A. MIR BINDING SITE is a binding site found in an untranslated region of MIR, corresponding to BINDING SITE of FIG. 26A. FIG. 26D illustrates the complementarity of the nucleotide sequence of MIR BINDING SITE, designated SEQ ID:879086, to the nucleotide sequence of GAM26 RNA of FIG. 26A, designated SEQ ID:20604. Another function of GAM26 is therefore inhibition of (MIR). Accordingly, utilities of GAM26 include diagnosis and treatment of diseases and clinical conditions with which MIR is associated.

Reference is now made to MOV34-34KD BINDING SITE. MOV34-34KD is a target gene of GAM26, corresponding to GAM26-TARGET GENE of FIG. 26A. MOV34-34KD BINDING SITE is a binding site found in an untranslated region of MOV34-34KD, corresponding to BINDING SITE of FIG. 26A. FIG. 26D illustrates the complementarity of the nucleotide sequence of MOV34-34KD BINDING SITE, designated SEQ ID:881891, to the nucleotide sequence of GAM26 RNA of FIG. 26A, designated SEQ ID:20604. Yet another function of GAM26 is therefore inhibition of (MOV34-34KD). Accordingly, utilities of GAM26 include diagnosis and treatment of diseases and clinical conditions with which MOV34-34KD is associated.

Reference is now made to MOV34-34KD BINDING SITE. MOV34-34KD is a target gene of GAM26, corresponding to GAM26-TARGET GENE of FIG. 26A. MOV34-34KD BINDING SITE is a binding site found in an untranslated region of MOV34-34KD, corresponding to BINDING SITE of FIG. 26A. FIG. 26D illustrates the complementarily of the nucleotide sequence of MOV34-34KD BINDING SITE, designated SEQ ID:881892, to the nucleotide sequence of GAM26 RNA of FIG. 26A, designated SEQ ID:20604. An additional function of GAM26 is therefore inhibition of (MOV34-34KD). Accordingly, utilities of GAM26 include diagnosis and treatment of diseases and clinical conditions with which MOV34-34KD is associated.

Reference is now made to MOV34-34KD BINDING SITE. MOV34-34KD is a target gene of GAM26, corresponding to GAM26-TARGET GENE of FIG. 26A. MOV34-34KD BINDING SITE is a binding site found in an untranslated region of MOV34-34KD, corresponding to BINDING SITE of FIG. 26A. FIG. 26D illustrates the complementarity of the nucleotide sequence of MOV34-34KD BINDING SITE, designated SEQ ID:881894, to the nucleotide sequence of GAM26 RNA of FIG. 26A, designated SEQ ID:20604. A further function of GAM26 is therefore inhibition of (MOV34-34KD). Accordingly, utilities of GAM26 include diagnosis and treatment of diseases and clinical conditions with which MOV34-34KD is associated.

Reference is now made to MPZL1 BINDING SITE. MPZL1 is a target gene of GAM26, corresponding to GAM26-TARGET GENE of FIG. 26A. MPZL1 BINDING SITE is a binding site found in an untranslated region of MPZL1, corresponding to BINDING SITE of FIG. 26A. FIG. 26D illustrates the complementarity of the nucleotide sequence of MPZL1 BINDING SITE, designated SEQ ID:882046, to the nucleotide sequence of GAM26 RNA of FIG. 26A, designated SEQ ID:20604. Yet a further function of GAM26 is therefore inhibition of (MPZL1). Accordingly, utilities of GAM26 include diagnosis and treatment of diseases and clinical conditions with which MPZL1 is associated.

Reference is now made to MPZL1 BINDING SITE. MPZL1 is a target gene of GAM26, corresponding to GAM26-TARGET GENE of FIG. 26A. MPZL1 BINDING SITE is a binding site found in an untranslated region of MPZL1, corresponding to BINDING SITE of FIG. 26A. FIG. 26D illustrates the complementarity of the nucleotide sequence of MPZL1 BINDING SITE, designated SEQ ID:882049, to the nucleotide sequence of GAM26 RNA of FIG. 26A, designated SEQ ID:20604. Another function of GAM26 is therefore inhibition of (MPZL1). Accordingly, utilities of GAM26 include diagnosis and treatment of diseases and clinical conditions with which MPZL1 is associated.

Reference is now made to NCOR1 BINDING SITE. NCOR1 is a target gene of GAM26, corresponding to GAM26-TARGET GENE of FIG. 26A. NCOR1 BINDING SITE is a binding site found in an untranslated region of NCOR1, corresponding to BINDING SITE of FIG. 26A. FIG. 26D illustrates the complementarity of the nucleotide sequence of NCOR1 BINDING SITE, designated SEQ ID:889437, to the nucleotide sequence of GAM26 RNA of FIG. 26A, designated SEQ ID:20604. Yet another function of GAM26 is therefore inhibition of (NCOR1). Accordingly, utilities of GAM26 include diagnosis and treatment of diseases and clinical conditions with which NCOR1 is associated.

Reference is now made to NCOR1 BINDING SITE. NCOR1 is a target gene of GAM26, corresponding to GAM26-TARGET GENE of FIG. 26A. NCOR1 BINDING SITE is a binding site found in an untranslated region of NCOR1, corresponding to BINDING SITE of FIG. 26A. FIG. 26D illustrates the complementarity of the nucleotide sequence of NCOR1 BINDING SITE, designated SEQ ID:889452, to the nucleotide sequence of GAM26 RNA of FIG. 26A, designated SEQ ID:20604. An additional function of GAM26 is therefore inhibition of (NCOR1). Accordingly, utilities of GAM26 include diagnosis and treatment of diseases and clinical conditions with which NCOR1 is associated.

Reference is now made to NFAT5 BINDING SITE. NFAT5 is a target gene of GAM26, corresponding to GAM26-TARGET GENE of FIG. 26A. NFAT5 BINDING SITE is a binding site found in an untranslated region of NFAT5, corresponding to BINDING SITE of FIG. 26A. FIG. 26D illustrates the complementarity of the nucleotide sequence of NFAT5 BINDING SITE, designated SEQ ID:892135, to the nucleotide sequence of GAM26 RNA of FIG. 26A, designated SEQ ID:20604. A further function of GAM26 is therefore inhibition of (NFAT5). Accordingly, utilities of GAM26 include diagnosis and treatment of diseases and clinical conditions with which NFAT5 is associated.

Reference is now made to NIR1 BINDING SITE. NIR1 is a target gene of GAM26, corresponding to GAM26-TARGET GENE of FIG. 26A. NIR1 BINDING SITE is a binding site found in an untranslated region of NIR1, corresponding to BINDING SITE of FIG. 26A. FIG. 26D illustrates the complementarity of the nucleotide sequence of NIR1 BINDING SITE, designated SEQ ID:893156, to the nucleotide sequence of GAM26 RNA of FIG. 26A, designated SEQ ID:20604. Yet a further function of GAM26 is therefore inhibition of (NIR1). Accordingly, utilities of GAM26 include diagnosis and treatment of diseases and clinical conditions with which NIR1 is associated.

Reference is now made to NIR1 BINDING SITE. NIR1 is a target gene of GAM26, corresponding to GAM26-TARGET GENE of FIG. 26A. NIR1 BINDING SITE is a binding site found in an untranslated region of NIR1, corresponding to BINDING SITE of FIG. 26A. FIG. 26D illustrates the complementarity of the nucleotide sequence of NIR1 BINDING SITE, designated SEQ ID:893162, to the nucleotide sequence of GAM26 RNA of FIG. 26A, designated SEQ ID:20604. Another function of GAM26 is therefore inhibition of (NIR1). Accordingly, utilities of GAM26 include diagnosis and treatment of diseases and clinical conditions with which NIR1 is associated.

Reference is now made to NKX2B BINDING SITE. NKX2B is a target gene of GAM26, corresponding to GAM26-TARGET GENE of FIG. 26A. NKX2B BINDING SITE is a binding site found in an untranslated region of NKX2B, corresponding to BINDING SITE of FIG. 26A. FIG. 26D illustrates the complementarity of the nucleotide sequence of NKX2B BINDING SITE, designated SEQ ID:893635, to the nucleotide sequence of GAM26 RNA of FIG. 26A, designated SEQ ID:20604. Yet another function of GAM26 is therefore inhibition of (NKX2B). Accordingly, utilities of GAM26 include diagnosis and treatment of diseases and clinical conditions with which NKX2B is associated.

Reference is now made to NS1-BP BINDING SITE. NS1-BP is a target gene of GAM26, corresponding to GAM26-TARGET GENE of FIG. 26A. NS1-BP BINDING SITE is a binding site found in an untranslated region of NS1-BP, corresponding to BINDING SITE of FIG. 26A. FIG. 26D illustrates the complementarity of the nucleotide sequence of NS1-BP BINDING SITE, designated SEQ ID:896538, to the nucleotide sequence of GAM26 RNA of FIG. 26A, designated SEQ ID:20604. An additional function of GAM26 is therefore inhibition of (NS1-BP). Accordingly, utilities of GAM26 include diagnosis and treatment of diseases and clinical conditions with which NS1-BP is associated.

Reference is now made to NTN4 BINDING SITE. NTN4 is a target gene of GAM26, corresponding to GAM26-TARGET GENE of FIG. 26A. NTN4 BINDING SITE is a binding site found in an untranslated region of NTN4, corresponding to BINDING SITE of FIG. 26A. FIG. 26D illustrates the complementarity of the nucleotide sequence of NTN4 BINDING SITE, designated SEQ ID:896979, to the nucleotide sequence of GAM26 RNA of FIG. 26A, designated SEQ ID:20604. A further function of GAM26 is therefore inhibition of (NTN4). Accordingly, utilities of GAM26 include diagnosis and treatment of diseases and clinical conditions with which NTN4 is associated.

Reference is now made to OAZ1 BINDING SITE. OAZ1 is a target gene of GAM26, corresponding to GAM26-TARGET GENE of FIG. 26A. OAZ1 BINDING SITE is a binding site found in an untranslated region of OAZ1, corresponding to BINDING SITE of FIG. 26A. FIG. 26D illustrates the complementarity of the nucleotide sequence of OAZ1 BIN DING SITE, designated SEQ ID:899518, to the nucleotide sequence of GAM26 RNA of FIG. 26A, designated SEQ ID:20604. Yet a further function of GAM26 is therefore inhibition of (OAZ1). Accordingly, utilities of GAM26 include diagnosis and treatment of diseases and clinical conditions with which OAZ1 is associated.

Reference is now made to OAZ1 BINDING SITE. OAZ1 is a target gene of GAM26, corresponding to GAM26-TARGET GENE of FIG. 26A. OAZ1 BINDING SITE is a binding site found in an untranslated region of OAZ1, corresponding to BINDING SITE of FIG. 26A. FIG. 26D illustrates the complementarity of the nucleotide sequence of OAZ1 BINDING SITE, designated SEQ ID:899526, to the nucleotide sequence of GAM26 RNA of FIG. 26A, designated SEQ ID:20604. Another function of GAM26 is therefore inhibition of (OAZ1). Accordingly, utilities of GAM26 include diagnosis and treatment of diseases and clinical conditions with which OAZ1 is associated.

Reference is now made to OAZ2 BINDING SITE. OAZ2 is a target gene of GAM26, corresponding to GAM26-TARGET GENE of FIG. 26A. OAZ2 BINDING SITE is a binding site found in an untranslated region of OAZ2, corresponding to BINDING SITE of FIG. 26A. FIG. 26D illustrates the complementarity of the nucleotide sequence of OAZ2 BINDING SITE, designated SEQ ID:899599, to the nucleotide sequence of GAM26 RNA of FIG. 26A, designated SEQ ID:20604. Yet another function of GAM26 is therefore inhibition of (OAZ2). Accordingly, utilities of GAM26 include diagnosis and treatment of diseases and clinical conditions with which OAZ2 is associated.

Reference is now made to OAZ2 BINDING SITE. OAZ2 is a target gene of GAM26, corresponding to GAM26-TARGET GENE of FIG. 26A. OAZ2 BINDING SITE is a binding site found in an untranslated region of OAZ2, corresponding to BINDING SITE of FIG. 26A. FIG. 26D illustrates the complementarity of the nucleotide sequence of OAZ2 BINDING SITE, designated SEQ ID:899619, to the nucleotide sequence of GAM26 RNA of FIG. 26A, designated SEQ ID:20604. An additional function of GAM26 is therefore inhibition of (OAZ2). Accordingly, utilities of GAM26 include diagnosis and treatment of diseases and clinical conditions with which OAZ2 is associated.

Reference is now made to OSBPL1A BINDING SITE. OSBPL1A is a target gene of GAM26, corresponding to GAM26-TARGET GENE of FIG. 26A. OSBPL1A BINDING SITE is a binding site found in an untranslated region of OSBPL1A, corresponding to BINDING SITE of FIG. 26A. FIG. 26D illustrates the complementarity of the nucleotide sequence of OSBPL1A BINDING SITE, designated SEQ ID:902150, to the nucleotide sequence of GAM26 RNA of FIG. 26A, designated SEQ ID:20604. A further function of GAM26 is therefore inhibition of (OSBPL1A). Accordingly, utilities of GAM26 include diagnosis and treatment of diseases and clinical conditions with which OSBPL1A is associated.

Reference is now made to PARG1 BINDING SITE. PARG1 is a target gene of GAM26, corresponding to GAM26-TARGET GENE of FIG. 26A. PARG1 BINDING SITE is a binding site found in an untranslated region of PARG1, corresponding to BINDING SITE of FIG. 26A. FIG. 26D illustrates the complementarity of the nucleotide sequence of PARG1 BINDING SITE, designated SEQ ID:907038, to the nucleotide sequence of GAM26 RNA of FIG. 26A, designated SEQ ID:20604. Yet a further function of GAM26 is therefore inhibition of (PARG1). Accordingly, utilities of GAM26 include diagnosis and treatment of diseases and clinical conditions with which PARG1 is associated.

Reference is now made to PCAF BINDING SITE. PCAF is a target gene of GAM26, corresponding to GAM26-TARGET GENE of FIG. 26A. PCAF BINDING SITE is a binding site found in an untranslated region of PCAF, corresponding to BINDING SITE of FIG. 26A. FIG. 26D illustrates the complementarity of the nucleotide sequence of PCAF BINDING SITE, designated SEQ ID:908148, to the nucleotide sequence of GAM26 RNA of FIG. 26A, designated SEQ ID:20604. Another function of GAM26 is therefore inhibition of (PCAF). Accordingly, utilities of GAM26 include diagnosis and treatment of diseases and clinical conditions with which PCAF is associated.

Reference is now made to PCCX2 BINDING SITE. PCCX2 is a target gene of GAM26, corresponding to GAM26-TARGET GENE of FIG. 26A. PCCX2 BINDING SITE is a binding site found in an untranslated region of PCCX2, corresponding to BINDING SITE of FIG. 26A. FIG. 26D illustrates the complementarity of the nucleotide sequence of PCCX2 BINDING SITE, designated SEQ ID:908515, to the nucleotide sequence of GAM26 RNA of FIG. 26A, designated SEQ ID:20604. Yet another function of GAM26 is therefore inhibition of (PCCX2). Accordingly, utilities of GAM26 include diagnosis and treatment of diseases and clinical conditions with which PCCX2 is associated.

Reference is now made to PELI2 BINDING SITE. PELI2 is a target gene of GAM26, corresponding to GAM26-TARGET GENE of FIG. 26A. PELI2. BINDING SITE is a binding site found in an untranslated region of PELI2, corresponding to BINDING SITE of FIG. 26A. FIG. 26D illustrates the complementarity of the nucleotide sequence of PELI2 BINDING SITE, designated SEQ ID:912193, to the nucleotide sequence of GAM26 RNA of FIG. 26A, designated SEQ ID:20604. An additional function of GAM26 is therefore inhibition of (PELI2). Accordingly, utilities of GAM26 include diagnosis and treatment of diseases and clinical conditions with which PELI2 is associated.

Reference is now made to PELI2 BINDING SITE. PELI2 is a target gene of GAM26, corresponding to GAM26-TARGET GENE of FIG. 26A. PELI2 BINDING SITE is a binding site found in an untranslated region of PELI2, corresponding to BINDING SITE of FIG. 26A. FIG. 26D illustrates the complementarity of the nucleotide sequence of PELI2 BIN DING SITE, designated SEQ ID:912206, to the nucleotide sequence of GAM26 RNA of FIG. 26A, designated SEQ ID:20604. A further function of GAM26 is therefore inhibition of (PELI2). Accordingly, utilities of GAM26 include diagnosis and treatment of diseases and clinical conditions with which PELI2 is associated.

Reference is now made to PF1 BINDING SITE. PF1 is a target gene of GAM26, corresponding to GAM26-TARGET GENE of FIG. 26A. PF1 BINDING SITE is a binding site found in untranslated region of PF1, corresponding to BINDING SITE of FIG. 26A. FIG. 26D illustrates the complementarity of the nucleotide sequence of PF1 BINDING SITE, designated SEQ ID:912812, to the nucleotide sequence of GAM26 RNA of FIG. 26A, designated SEQ ID:20604. Yet a further function of GAM26 is therefore inhibition of (PF1). Accordingly, utilities of GAM26 include diagnosis and treatment of diseases and clinical conditions with which PF1 is associated.

Reference is now made to PLCL2 BINDING SITE. PLCL2 is a target gene of GAM26, corresponding to GAM26-TARGET GENE of FIG. 26A. PLCL2 BINDING SITE is a binding site found in an untranslated region of PLCL2, corresponding to BINDING SITE of FIG. 26A. FIG. 26D illustrates the complementarity of the nucleotide sequence of PLCL2 BINDING SITE, designated SEQ ID:917013, to the nucleotide sequence of GAM26 RNA of FIG. 26A, designated SEQ ID:20604. Another function of GAM26 is therefore inhibition of (PLCL2). Accordingly, utilities of GAM26 include diagnosis and treatment of diseases and clinical conditions with which PLCL2 is associated.

Reference is now made to PM5 BINDING SITE. PM5 is a target gene of GAM26, corresponding to GAM26-TARGET GENE of FIG. 26A. PM5 BINDING SITE is a binding site found in an untranslated region of PM5, corresponding to BINDING SITE of FIG. 26A. FIG. 26D illustrates the complementarity of the nucleotide sequence of PM5 BINDING SITE, designated SEQ ID:917719, to the nucleotide sequence of GAM26 RNA of FIG. 26A, designated SEQ ID:20604. Yet another function of GAM26 is therefore inhibition of (PM5). Accordingly, utilities of GAM26 include diagnosis and treatment of diseases and clinical conditions with which PM5 is associated.

Reference is now made to PMX2B BINDING SITE. PMX2B is a target gene of GAM26, corresponding to GAM26-TARGET GENE of FIG. 26A. PMX2B BINDING SITE is a binding site found in an untranslated region of PMX2B, corresponding to BINDING SITE of FIG. 26A. FIG. 26D illustrates the complementarity of the nucleotide sequence of PMX2B BINDING SITE, designated SEQ ID:918145, to the nucleotide sequence of GAM26 RNA of FIG. 26A, designated SEQ ID:20604. An additional function of GAM26 is therefore inhibition of (PMX2B). Accordingly, utilities of GAM26 include diagnosis and treatment of diseases and clinical conditions with which PMX2B is associated.

Reference is now made to PMX2B BINDING SITE. PMX2B is a target gene of GAM26, corresponding to GAM26-TARGET GENE of FIG. 26A. PMX2B BINDING SITE is a binding site found in an untranslated region of PMX2B, corresponding to BINDING SITE of FIG. 26A. FIG. 26D illustrates the complementarity of the nucleotide sequence of PMX2B BINDING SITE, designated SEQ ID:918187, to the nucleotide sequence of GAM26 RNA of FIG. 26A, designated SEQ ID:20604. A further function of GAM26 is therefore inhibition of (PMX2B). Accordingly, utilities of GAM26 include diagnosis and treatment of diseases and clinical conditions with which PMX2B is associated.

Reference is now made to PMX2B BINDING SITE. PMX2B is a target gene of GAM26, corresponding to GAM26-TARGET GENE of FIG. 26A. PMX2B BINDING SITE is a binding site found in an untranslated region of PMX2B, corresponding to BINDING SITE of FIG. 26A. FIG. 26D illustrates the complementarity of the nucleotide sequence of PMX2B BINDING SITE, designated SEQ ID:918189, to the nucleotide sequence of GAM26 RNA of FIG. 26A, designated SEQ ID:20604. Yet a further function of GAM26 is therefore inhibition of (PMX2B). Accordingly, utilities of GAM26 include diagnosis and treatment of diseases and clinical conditions with which PMX2B is associated.

Reference is now made to PRDM8 BINDING SITE. PRDM8 is a target gene of GAM26, corresponding to GAM26-TARGET GENE of FIG. 26A. PRDM8 BINDING SITE is a binding site found in an untranslated region of PRDM8, corresponding to BINDING SITE of FIG. 26A. FIG. 26D illustrates the complementarity of the nucleotide sequence of PRDM8 BINDING SITE, designated SEQ ID:924600, to the nucleotide sequence of GAM26 RNA of FIG. 26A, designated SEQ ID:20604. Another function of GAM26 is therefore inhibition of (PRDM8). Accordingly, utilities of GAM26 include diagnosis and treatment of diseases and clinical conditions with which PRDM8 is associated.

Reference is now made to PSIP2 BINDING SITE. PSIP2 is a target gene of GAM26, corresponding to GAM26-TARGET GENE of FIG. 26A. PSIP2 BINDING SITE is a binding site found in an untranslated region of PSIP2, corresponding to BINDING SITE of FIG. 26A. FIG. 26D illustrates the complementarity of the nucleotide sequence of PSIP2 BINDING SITE, designated SEQ ID:933689, to the nucleotide sequence of GAM26 RNA of FIG. 26A, designated SEQ ID:20604. Yet another function of GAM26 is therefore inhibition of (PSIP2). Accordingly, utilities of GAM26 include diagnosis and treatment of diseases and clinical conditions with which PSIP2 is associated.

Reference is now made to PSIP2 BINDING SITE. PSIP2 is a target gene of GAM26, corresponding to GAM26-TARGET GENE of FIG. 26A. PSIP2 BINDING SITE is a binding site found in an untranslated region of PSIP2, corresponding to BINDING SITE of FIG. 26A. FIG. 26D illustrates the complementarity of the nucleotide sequence of PSIP2 BINDING SITE, designated SEQ ID:933709, to the nucleotide sequence of GAM26 RNA of FIG. 26A, designated SEQ ID:20604. An additional function of GAM26 is therefore inhibition of (PSIP2). Accordingly, utilities of GAM26 include diagnosis and treatment of diseases and clinical conditions with which PSIP2 is associated.

Reference is now made to PTR4 BINDING SITE. PTR4 is a target gene of GAM26, corresponding to GAM26-TARGET GENE of FIG. 26A. PTR4 BINDING SITE is a binding site found in an untranslated region of PTR4, corresponding to BINDING SITE of FIG. 26A. FIG. 26D illustrates the complementarity of the nucleotide sequence of PTR4 BINDING SITE, designated SEQ ID:937407, to the nucleotide sequence of GAM26 RNA of FIG. 26A, designated SEQ ID:20604. A further function of GAM26 is therefore inhibition of (PTR4). Accordingly, utilities of GAM26 include diagnosis and treatment of diseases and clinical conditions with which PTR4 is associated.

Reference is now made to QKI BINDING SITE. QKI is a target gene of GAM26, corresponding to GAM26-TARGET GENE of FIG. 26A. QKI BINDING SITE is a binding site found in an untranslated region of QKI, corresponding to BINDING SITE of FIG. 26A. FIG. 26D illustrates the complementarity of the nucleotide sequence of QKI BINDING SITE, designated SEQ ID:938140, to the nucleotide sequence of GAM26 RNA of FIG. 26A, designated SEQ ID:20604. Yet a further function of GAM26 is therefore inhibition of (QKI). Accordingly, utilities of GAM26 include diagnosis and treatment of diseases and clinical conditions with which QKI is associated.

Reference is now made to QKI BINDING SITE. QKI is a target gene of GAM26, corresponding to GAM26-TARGET GENE of FIG. 26A. QKI BINDING SITE is a binding site found in an untranslated region of QKI, corresponding to BINDING SITE of FIG. 26A. FIG. 26D illustrates the complementarity of the nucleotide sequence of QKI BINDING SIT, designated SEQ ID:938170, to the nucleotide sequence of GAM26 RNA of FIG. 26A, designated SEQ ID:20604. Another function of GAM26 is therefore inhibition of (QKI). Accordingly, utilities of GAM26 include diagnosis and treatment of diseases and clinical conditions with which QKI is associated.

Reference is now made to QKI BINDING SITE. QKI is a target gene of GAM26, corresponding to GAM26-TARGET GENE of FIG. 26A. QKI BINDING SITE is a binding site found in an untranslated region of QKI, corresponding to BINDING SITE of FIG. 26A. FIG. 26D illustrates the complementarity of the nucleotide sequence of QKI BINDING SITE, designated SEQ ID:938172, to the nucleotide sequence of GAM26 RNA of FIG. 26A, designated SEQ ID:20604. Yet another function of GAM26 is therefore inhibition of (QKI). Accordingly, utilities of GAM26 include diagnosis and treatment of diseases and clinical conditions with which QKI is associated.

Reference is now made to QKI BINDING SITE. QKI is a target gene of GAM26, corresponding to GAM26-TARGET GENE of FIG. 26A. QKI BINDING SITE is a binding site found in an untranslated region of QKI, corresponding to BINDING SITE of FIG. 26A. FIG. 26D illustrates the complementarity of the nucleotide sequence of QKI BINDING SITE, designated SEQ ID:938196, to the nucleotide sequence of GAM26 RNA of FIG. 26A, designated SEQ ID:20604. An additional function of GAM26 is therefore inhibition of (QKI). Accordingly, utilities of GAM26 include diagnosis and treatment of diseases and clinical conditions with which QKI is associated.

Reference is now made to RAB2 BINDING SITE. RAB2 is a target gene of GAM26, corresponding to GAM26-TARGET GENE of FIG. 26A. RAB2 BINDING SITE is a binding site found in an untranslated region of RAB2, corresponding to BINDING SITE of FIG. 26A. FIG. 26D illustrates the complementarity of the nucleotide sequence of RAB2 BINDING SITE, designated SEQ ID:939662, to the nucleotide sequence of GAM26 RNA of FIG. 26A, designated SEQ ID:20604. A further function of GAM26 is therefore inhibition of (RAB2). Accordingly, utilities of GAM26 include diagnosis and treatment of diseases and clinical conditions with which RAB2 is associated.

Reference is now made to RAB2 BINDING SITE. RAB2 is a target gene of GAM26, corresponding to GAM26-TARGET GENE of FIG. 26A. RAB2 BINDING SITE is a binding site found in an untranslated region of RAB2, corresponding to BINDING SITE of FIG. 26A. FIG. 26D illustrates the complementarity of the nucleotide sequence of RAB2 BINDING SITE, designated SEQ ID:939672, to the nucleotide sequence of GAM26 RNA of FIG. 26A, designated SEQ ID:20604. Yet a further function of GAM26 is therefore inhibition of (RAB2). Accordingly, utilities of GAM26 include diagnosis and treatment of diseases and clinical conditions with which RAB2 is associated.

Reference is now made to RAB2 BINDING SITE. RAB2 is a target gene of GAM26, corresponding to GAM26-TARGET GENE of FIG. 26A. RAB2 BINDING SITE is a binding site found in an untranslated region of RAB2, corresponding to BINDING SITE of FIG. 26A. FIG. 26D illustrates the complementarity of the nucleotide sequence of RAB2 BINDING SITE, designated SEQ ID:939672, to the nucleotide sequence of GAM26 RNA of FIG. 26A, designated SEQ ID:20604. Another function of GAM26 is therefore inhibition of (RAB2). Accordingly, utilities of GAM26 include diagnosis and treatment of diseases and clinical conditions with which RAB2 is associated.

Reference is now made to RAB22A BINDING SITE. RAB22A is a target gene of GAM26, corresponding to GAM26-TARGET GENE of FIG. 26A. RAB22A BINDING SITE is a binding site found in an untranslated region of RAB22A, corresponding to BINDING SITE of FIG. 26A. FIG. 26D illustrates the complementarity of the nucleotide sequence of RAB22A BINDING SITE, designated SEQ ID:939920, to the nucleotide sequence of GAM26 RNA of FIG. 26A, designated SEQ ID:20604. Yet another function of GAM26 is therefore inhibition of (RAB22A). Accordingly, utilities of GAM26 include diagnosis and treatment of diseases and clinical conditions with which RAB22A is associated.

Reference is now made to RAB22A BINDING SITE. RAB22A is a target gene of GAM26, corresponding to GAM26-TARGET GENE of FIG. 26A. RAB22A BINDING SITE is a binding site found in an untranslated region of RAB22A, corresponding to BINDING SITE of FIG. 26A. FIG. 26D illustrates the complementarity of the nucleotide sequence of RAB22A BINDING SITE, designated SEQ ID:939925, to the nucleotide sequence of GAM26 RNA of FIG. 26A, designated SEQ ID:20604. An additional function of GAM26 is therefore inhibition of (RAB22A). Accordingly, utilities of GAM26 include diagnosis and treatment of diseases and clinical conditions with which RAB22A is associated.

Reference is now made to RAB5EP BINDING SITE. RAB5EP is a target gene of GAM26, corresponding to GAM26-TARGET GENE of FIG. 26A. RAB5EP BINDING SITE is a binding site found in an untranslated region of RAB5EP, corresponding to BINDING SITE of FIG. 26A. FIG. 26D illustrates the complementarity of the nucleotide sequence of RAB5EP BINDING SITE, designated SEQ ID:941423, to the nucleotide sequence of GAM26 RNA of FIG. 26A, designated SEQ ID:20604. A further function of GAM26 is therefore inhibition of (RAB5EP). Accordingly, utilities of GAM26 include diagnosis and treatment of diseases and clinical conditions with which RAB5EP is associated.

Reference is now made to RALY BINDING SITE. RALY is a target gene of GAM26, corresponding to GAM26-TARGET GENE of FIG. 26A. RALY BINDING SITE is a binding site found in an untranslated region of RALY, corresponding to BINDING SITE of FIG. 26A. FIG. 26D illustrates the complementarity of the nucleotide sequence of RALY BINDING SITE, designated SEQ ID:943042, to the nucleotide sequence of GAM26 RNA, of FIG. 26A, designated SEQ ID:20604. Yet a further function of GAM26 is therefore inhibition of (RALY). Accordingly, utilities of GAM26 include diagnosis and treatment of diseases and clinical conditions with which RALY is associated.

Reference is now made to RALY BINDING SITE. RALY is a target gene of GAM26, corresponding to GAM26-TARGET GENE of FIG. 26A. RALY BINDING SITE is a binding site found in an untranslated region of RALY, corresponding to BINDING SITE of FIG. 26A. FIG. 26D illustrates the complementarity of the nucleotide sequence of RALY BINDING SITE, designated SEQ ID:943043, to the nucleotide sequence of GAM26 RNA of FIG. 26A, designated SEQ ID:20604. Another function of GAM26 is therefore inhibition of (RALY). Accordingly, utilities of GAM26 include diagnosis and treatment of diseases and clinical conditions with which RALY is associated.

Reference is now made to RALY BINDING SITE. RALY is a target gene of GAM26, corresponding to GAM26-TARGET GENE of FIG. 26A. RALY BINDING SITE is a binding site found in an untranslated region of RALY, corresponding to BINDING SITE of FIG. 26A. FIG. 26D illustrates the complementarity of the nucleotide sequence of RALY BINDING SITE, designated SEQ ID:943044, to the nucleotide sequence of GAM26 RNA of FIG. 26A, designated SEQ ID:20604. Yet another function of GAM26 is therefore inhibition of (RALY). Accordingly, utilities of GAM26 include diagnosis and treatment of diseases and clinical conditions with which RALY is associated.

Reference is now made to RC3 BINDING SITE. RC3 is a target gene of GAM26, corresponding to GAM26-TARGET GENE of FIG. 26A. RC3 BINDING SITE is a binding site found in an untranslated region of RC3, corresponding to BINDING SITE of FIG. 26A. FIG. 26D illustrates the complementarity of the nucleotide sequence of RC3 BINDING SITE, designated SEQ ID:945022, to the nucleotide sequence of GAM26 RNA of FIG. 26A, designated SEQ ID:20604. An additional function of GAM26 is therefore inhibition of (RC3). Accordingly, utilities of GAM26 include diagnosis and treatment of diseases and clinical conditions with which RC3 is associated.

Reference is now made to RNPC2 BINDING SITE. RNPC2 is a target gene of GAM26, corresponding to GAM26-TARGET GENE of FIG. 26A. RNPC2 BINDING SITE is a binding site found in an untranslated region of RNPC2, corresponding to BINDING SITE of FIG. 26A. FIG. 26D illustrates the complementarity of the nucleotide sequence of RNPC2 BINDING SITE, designated SEQ ID:950359, to the nucleotide sequence of GAM26 RNA of FIG. 26A, designated SEQ ID:20604. A further function of GAM26 is therefore inhibition of (RNPC2). Accordingly, utilities of GAM26 include diagnosis and treatment of diseases and clinical conditions with which RNPC2 is associated.

Reference is now made to RNPC2 BINDING SITE. RNPC2 is a target gene of GAM26, corresponding to GAM26-TARGET GENE of FIG. 26A. RNPC2 BINDING SITE is a binding site found in an untranslated region of RNPC2, corresponding to BINDING SITE of FIG. 26A. FIG. 26D illustrates the complementarity of the nucleotide sequence of RNPC2 BINDING SITE, designated SEQ ID:950360, to the nucleotide sequence of GAM26 RNA of FIG. 26A, designated SEQ ID:20604. Yet a further function of GAM26 is therefore inhibition of (RNPC2). Accordingly, utilities of GAM26 include diagnosis and treatment of diseases and clinical conditions with which RNPC2 is associated.

Reference is now made to RPS6KC1 BINDING SITE. RPS6KC1 is a target gene of GAM26, corresponding to GAM26-TARGET GENE of FIG. 26A. RPS6KC1 BINDING SITE is a binding site found in an untranslated region of RPS6KC1, corresponding to BINDING SITE of FIG. 26A. FIG. 26D illustrates the complementarity of the nucleotide sequence of RPS6KC1 BINDING SITE, designated SEQ ID:952575, to the nucleotide sequence of GAM26 RNA of FIG. 26A, designated SEQ ID:20604. Another function of GAM26 is therefore inhibition of (RPS6KC1). Accordingly, utilities of GAM26 include diagnosis and treatment of diseases and clinical conditions with which RPS6KC1 is associated.

Reference is now made to SERP1 BINDING SITE. SERP1 is a target gene of GAM26, corresponding to GAM26-TARGET GENE of FIG. 26A. SERP1 BINDING SITE is a binding site found in an untranslated region of SERP1, corresponding to BINDING SITE of FIG. 26A. FIG. 26D illustrates the complementarity of the nucleotide sequence of SERP1 BINDING SITE, designated SEQ ID:963975, to the nucleotide sequence of GAM26 RNA of FIG. 26A, designated SEQ ID:20604. Yet another function of GAM26 is therefore inhibition of (SERP1). Accordingly, utilities of GAM26 include diagnosis and treatment of diseases and clinical conditions with which SERP1 is associated.

Reference is now made to SERP1 BINDING SITE. SERP1 is a target gene of GAM26, corresponding to GAM26-TARGET GENE of FIG. 26A. SERP1 BINDING SITE is a binding site found in an untranslated region of SERP1, corresponding to BINDING SITE of FIG. 26A. FIG. 26D illustrates the complementarity of the nucleotide sequence of SERP1 BINDING SITE, designated SEQ ID:963978, to the nucleotide sequence of GAM26 RNA of FIG. 26A, designated SEQ ID:20604. An additional function of GAM26 is therefore inhibition of (SERP1). Accordingly, utilities of GAM26 include diagnosis and treatment of diseases and clinical conditions with which SERP1 is associated.

Reference is now made to SERP1 BINDING SITE. SERP1 is a target gene of GAM26, corresponding to GAM26-TARGET GENE of FIG. 26A. SERP1 BINDING SITE is a binding site found in an untranslated region of SERP1, corresponding to BINDING SITE of FIG. 26A. FIG. 26D illustrates the complementarity of the nucleotide sequence of SERP1 BINDING SITE, designated SEQ ID:964015, to the nucleotide sequence of GAM26 RNA of FIG. 26A, designated SEQ ID:20604. A further function of GAM26 is therefore inhibition of (SERP1). Accordingly, utilities of GAM26 include diagnosis and treatment of diseases and clinical conditions with which SERP1 is associated.

Reference is now made to SFRS9 BINDING SITE. SFRS9 is a target gene of GAM26, corresponding to GAM26-TARGET GENE of FIG. 26A. SFRS9 BINDING SITE is a binding site found in an untranslated region of SFRS9, corresponding to BINDING SITE of FIG. 26A. FIG. 26D illustrates the complementarity of the nucleotide sequence of SFRS9 BINDING SITE, designated SEQ ID:964985, to the nucleotide sequence of GAM26 RNA of FIG. 26A, designated SEQ ID:20604. Yet a further function of GAM26 is therefore inhibition of (SFRS9). Accordingly, utilities of GAM26 include diagnosis and treatment of diseases and clinical conditions with which SFRS9 is associated.

Reference is now made to SH2D3C BINDING SITE. SH2D3C is a target gene of GAM26, corresponding to GAM26-TARGET GENE of FIG. 26A. SH2D3C BINDING SITE is a binding site found in an untranslated region of SH2D3C, corresponding to BINDING SITE of FIG. 26A. FIG. 26D illustrates the complementarity of the nucleotide sequence of SH2D3C BINDING SITE, designated SEQ ID:965802, to the nucleotide sequence of GAM26 RNA of FIG. 26A, designated SEQ ID:20604. Another function of GAM26 is therefore inhibition of (SH2D3C). Accordingly, utilities of GAM26 include diagnosis and treatment of diseases and clinical conditions with which SH2D3C is associated.

Reference is now made to SHANK3 BINDING SITE. SHANK3 is a target gene of GAM26, corresponding to GAM26-TARGET GENE of FIG. 26A. SHANK3 BINDING SITE is a binding site found in an untranslated region of SHANK3, corresponding to BINDING SITE of FIG. 26A. FIG. 26D illustrates the complementarity of the nucleotide sequence of SHANK3 BINDING SITE, designated SEQ ID:966276, to the nucleotide sequence of GAM26 RNA of FIG. 26A, designated SEQ ID:20604. Yet another function of GAM26 is therefore inhibition of (SHANK3). Accordingly, utilities of GAM26 include diagnosis and treatment of diseases and clinical conditions with which SHANK3 is associated.

Reference is now made to SHARP BINDING SITE. SHARP is a target gene of GAM26, corresponding to GAM26-TARGET GENE of FIG. 26A. SHARP BINDING SITE is a binding site found in an untranslated region of SHARP, corresponding to BINDING SITE of FIG. 26A. FIG. 26D illustrates the complementarity of the nucleotide sequence of SHARP BINDING SITE, designated SEQ ID:966487, to the nucleotide sequence of GAM26 RNA of FIG. 26A, designated SEQ ID:20604. An additional function of GAM26 is therefore inhibition of (SHARP). Accordingly, utilities of GAM26 include diagnosis and treatment of diseases and clinical conditions with which SHARP is associated.

Reference is now made to SIAT8A BINDING SITE. SIAT8A is a target gene of GAM26, corresponding to GAM26-TARGET GENE of FIG. 26A. SIAT8A BINDING SITE is a binding site found in an untranslated region of SIAT8A, corresponding to BINDING SITE of FIG. 26A. FIG. 26D illustrates the complementarity of the nucleotide sequence of SIAT8A BINDING SITE, designated SEQ ID:966899, to the nucleotide sequence of GAM26 RNA of FIG. 26A, designated SEQ ID:20604. A further function of GAM26 is therefore inhibition of (SIAT8A). Accordingly, utilities of GAM26 include diagnosis and treatment of diseases and clinical conditions with which SIAT8A is associated.

Reference is now made to SLC16A3 BINDING SITE. SLC16A3 is a target gene of GAM26, corresponding to GAM26-TARGET GENE of FIG. 26A. SLC16A3 BINDING SITE is a binding site found in an untranslated region of SLC16A3, corresponding to BINDING SITE of FIG. 26A. FIG. 26D illustrates the complementarity of the nucleotide sequence of SLC16A3 BINDING SITE, designated SEQ ID:968639, to the nucleotide sequence of GAM26 RNA of FIG. 26A, designated SEQ ID:20604. Yet a further function of GAM26 is therefore inhibition of (SLC16A3). Accordingly, utilities of GAM26 include diagnosis and treatment of diseases and clinical conditions with which SLC16A3 is associated.

Reference is now made to SLC21A11 BINDING SITE. SLC21A11 is a target gene of GAM26, corresponding to GAM26-TARGET GENE of FIG. 26A. SLC21A11 BINDING SITE is a binding site found in an untranslated region of SLC21A11, corresponding to BINDING SITE of FIG. 26A. FIG. 26D illustrates the complementarity of the nucleotide sequence of SLC21A11 BINDING SITE, designated SEQ ID:969275, to the nucleotide sequence of GAM26 RNA of FIG. 26A, designated SEQ ID:20604. Another function of GAM26 is therefore inhibition of (SLC21A11). Accordingly, utilities of GAM26 include diagnosis and treatment of diseases and clinical conditions with which SLC21A11 is associated.

Reference is now made to OATPRP4 BINDING SITE. OATPRP4 is a target gene of GAM26, corresponding to GAM26-TARGET GENE of FIG. 26A. OATPRP4 BINDING SITE is a binding site found in an untranslated region of OATPRP4, corresponding to BINDING SITE of FIG. 26A. FIG. 26D illustrates the complementarity of the nucleotide sequence of OATPRP4 BINDING SITE, designated SEQ ID:969284, to the nucleotide sequence of GAM26 RNA of FIG. 26A, designated SEQ ID:20604. Yet another function of GAM26 is therefore inhibition of (OATPRP4). Accordingly, utilities of GAM26 include diagnosis and treatment of diseases and clinical conditions with which OATPRP4 is associated.

Reference is now made to SLC21A11 BINDING SITE. SLC21A11 is a target gene of GAM26, corresponding to GAM26-TARGET GENE of FIG. 26A. SLC21A11 BINDING SITE is a binding site found in an untranslated region of SLC21A11, corresponding to BINDING SITE of FIG. 26A. FIG. 26D illustrates the complementarity of the nucleotide sequence of SLC21A11 BINDING SITE, designated SEQ ID:969284, to the nucleotide sequence of GAM26 RNA of FIG. 26A, designated SEQ ID:20604. An additional function of GAM26 is therefore inhibition of (SLC21A11). Accordingly, utilities of GAM26 include diagnosis and treatment of diseases and clinical conditions with which SLC21A11 is associated.

Reference is now made to SLC21A11 BINDING SITE. SLC21A11 is a target gene of GAM26, corresponding to GAM26-TARGET GENE of FIG. 26A. SLC21A11 BINDING SITE is a binding site found in an untranslated region of SLC21A11, corresponding to BINDING SITE of FIG. 26A. FIG. 26D illustrates the complementarity of the nucleotide sequence of SLC21A11 BINDING SITE, designated SEQ ID:969288, to the nucleotide sequence of GAM26 RNA of FIG. 26A, designated SEQ ID:20604. A further function of GAM26 is therefore inhibition of (SLC21A11).

Accordingly, utilities of GAM26 include diagnosis and treatment of diseases and clinical conditions with which SLC21A11 is associated.

Reference is now made to SLC21A11 BINDING SITE. SLC21A11 is a target gene of GAM26, corresponding to GAM26-TARGET GENE of FIG. 26A. SLC21A11 BINDING SITE is a binding site found in an untranslated region of SLC21A11, corresponding to BINDING SITE of FIG. 26A. FIG. 26D illustrates the complementarity of the nucleotide sequence of SLC21A11 BINDING SITE, designated SEQ ID:969292, to the nucleotide sequence of GAM26 RNA of FIG. 26A, designated SEQ ID:20604. Yet a further function of GAM26 is therefore inhibition of (SLC21A11). Accordingly, utilities of GAM26 include diagnosis and treatment of diseases and clinical conditions with which SLC21A11 is associated.

Reference is now made to SLC21A11 BINDING SITE. SLC21A11 is a target gene of GAM26, corresponding to GAM26-TARGET GENE of FIG. 26A. SLC21A11 BINDING SITE is a binding site found in an untranslated region of SLC21A11, corresponding to BINDING SITE of FIG. 26A. FIG. 26D illustrates the complementarity of the nucleotide sequence of SLC21A11 BINDING SITE, designated SEQ ID:969328, to the nucleotide sequence of GAM26 RNA of FIG. 26A, designated SEQ ID:20604. Another function of GAM26 is therefore inhibition of (SLC21A11). Accordingly, utilities of GAM26 include diagnosis and treatment of diseases and clinical conditions with which SLC21A11 is associated.

Reference is now made to SLC21A11 BINDING SITE. SLC21A11 is a target gene of GAM26, corresponding to GAM26-TARGET GENE of FIG. 26A. SLC21A11 BINDING SITE is a binding site found in an untranslated region of SLC21A11, corresponding to BINDING SITE of FIG. 26A. FIG. 26D illustrates the complementarity of the nucleotide sequence of SLC21A11 BINDING SITE, designated SEQ ID:969329, to the nucleotide sequence of GAM26 RNA of FIG. 26A, designated SEQ ID:20604. Yet another function of GAM26 is therefore inhibition of (SLC21A11). Accordingly, utilities of GAM26 include diagnosis and treatment of diseases and clinical conditions with which SLC2A11 is associated.

Reference is now made to SRF BINDING SITE. SRF is a target gene of GAM26, corresponding to GAM26-TARGET GENE of FIG. 26A. SRF BINDING SITE is a binding site found in an untranslated region of SRF, corresponding to BINDING SITE of FIG. 26A. FIG. 26D illustrates the complementarity of the nucleotide sequence of SRF BINDING SITE designated SEQ ID:979150, to the nucleotide sequence of GAM26 RNA of FIG. 26A, designated SEQ ID:20604. An additional function of GAM26 is therefore inhibition of (SRF). Accordingly, utilities of GAM26 include diagnosis and treatment of diseases and clinical conditions with which SRF is associated.

Reference is now made to SSBP3 BINDING SITE. SSBP3 is a target gene of GAM26, corresponding to GAM26-TARGET GENE of FIG. 26A. SSBP3 BINDING SITE is a binding site found in an untranslated region of SSBP3, corresponding to BINDING SITE of FIG. 26A. FIG. 26D illustrates the complementarity of the nucleotide sequence of SSBP3 BINDING SITE, designated SEQ ID:980403, to the nucleotide sequence of GAM26 RNA of FIG. 26A, designated SEQ ID:20604. A further function of GAM26 is therefore inhibition of (SSBP3). Accordingly, utilities of GAM26 include diagnosis and treatment of diseases and clinical conditions with which SSBP3 is associated.

Reference is now made to SSBP3 BINDING SITE. SSBP3 is a target gene of GAM26, corresponding to GAM26-TARGET GENE of FIG. 26A. SSBP3 BINDING SITE is a binding site found in an untranslated region of SSBP3, corresponding to BINDING SITE of FIG. 26A. FIG. 26D illustrates the complementarity of the nucleotide sequence of SSBP3 BINDING SITE, designated SEQ ID:980404, to the nucleotide sequence of GAM26 RNA of FIG. 26A, designated SEQ ID:20604. Yet a further function of GAM26 is therefore inhibition of (SSBP3). Accordingly, utilities of GAM26 include diagnosis and treatment of diseases and clinical conditions with which SSBP3 is associated.

Reference is now made to SSBP3 BINDING SITE. SSBP3 is a target gene of GAM26, corresponding to GAM26-TARGET GENE of FIG. 26A. SSBP3 BINDING SITE is a binding site found in an untranslated region of SSBP3, corresponding to BINDING SITE of FIG. 26A. FIG. 26D illustrates the complementarity of the nucleotide sequence of SSBP3 BINDING SITE, designated SEQ ID:980415, to the nucleotide sequence of GAM26 RNA of FIG. 26A, designated SEQ ID:20604. Another function of GAM26 is therefore inhibition of (SSBP3). Accordingly, utilities of GAM26 include diagnosis and treatment of diseases and clinical conditions with which SSBP3 is associated.

Reference is now made to SSBP4 BINDING SITE. SSBP4 is a target gene of GAM26, corresponding to GAM26-TARGET GENE of FIG. 26A. SSBP4 BINDING SITE is a binding site found in an untranslated region of SSBP4, corresponding to BINDING SITE of FIG. 26A. FIG. 26D illustrates the complementarity of the nucleotide sequence of SSBP4 BINDING SITE, designated SEQ ID:980450, to the nucleotide sequence of GAM26 RNA of FIG. 26A, designated SEQ ID:20604. Yet another function of GAM26 is therefore inhibition of (SSBP4). Accordingly, utilities of GAM26 include diagnosis and treatment of diseases and clinical conditions with which SSBP4 is associated.

Reference is now made to STIM2 BINDING SITE. STIM2 is a target gene of GAM26, corresponding to GAM26-TARGET GENE of FIG. 26A. STIM2 BINDING SITE is a binding site found in an untranslated region of STIM2, corresponding to BINDING SITE of FIG. 26A. FIG. 26D illustrates the complementarity of the nucleotide sequence of STIM2 BINDING SITE, designated SEQ ID:982983, to the nucleotide sequence of GAM26 RNA of FIG. 26A, designated SEQ ID:20604. An additional function of GAM26 is therefore inhibition of (STIM2). Accordingly, utilities of GAM26 include diagnosis and treatment of diseases and clinical conditions with which STIM2 is associated.

Reference is now made to STK39 BINDING SITE. STK39 is a target gene of GAM26, corresponding to GAM26-TARGET GENE of FIG. 26A. STK39 BINDING SITE is a binding site found in an untranslated region of STK39, corresponding to BINDING SITE of FIG. 26A. FIG. 26D illustrates the complementarity of the nucleotide sequence of STK39 BINDING SITE, designated SEQ ID:983798, to the nucleotide sequence of GAM26 RNA of FIG. 26A, designated SEQ ID:20604. A further function of GAM26 is therefore inhibition of (STK39). Accordingly, utilities of GAM26 include diagnosis and treatment of diseases and clinical conditions with which STK39 is associated.

Reference is now made to STK39 BINDING SITE. STK39 is a target gene of GAM26, corresponding to GAM26-TARGET GENE of FIG. 26A. STK39 BINDING SITE is a binding site found in an untranslated region of STK39, corresponding to BINDING SITE of FIG. 26A. FIG. 26D illustrates the complementarity of the nucleotide sequence of STK39 BINDING SITE, designated SEQ ID:983808, to the nucleotide sequence of GAM26 RNA of FIG. 26A, designated SEQ ID:20604. Yet a further function of GAM26 is therefore inhibition of (STK39). Accordingly, utilities of GAM26 include diagnosis and treatment of diseases and clinical conditions with which STK39 is associated.

Reference is now made to KIAA0995 BINDING SITE. KIAA0995 is a target gene of GAM26, corresponding to GAM26-TARGET GENE of FIG. 26A. KIAA0995 BINDING SITE is a binding site found in an untranslated region of KIAA0995, corresponding to BINDING SITE of FIG. 26A. FIG. 26D illustrates the complementarity of the nucleotide sequence of KIAA0995 BINDING SITE, designated SEQ ID:983814, to the nucleotide sequence of GAM26 RNA of FIG. 26A, designated SEQ ID:20604. Another function of GAM26 is therefore inhibition of (KIAA0995). Accordingly, utilities of GAM26 include diagnosis and treatment of diseases and clinical conditions with which KIAA0995 is associated.

Reference is now made to STK39 BINDING SITE. STK39 is a target gene of GAM26, corresponding to GAM26-TARGET GENE of FIG. 26A. STK39 BINDING SITE is a binding site found in an untranslated region of STK139, corresponding to BINDING SITE of FIG. 26A. FIG. 26D illustrates the complementarity of the nucleotide sequence of STK39 BINDING SITE, designated SEQ ID:983814, to the nucleotide sequence of GAM26 RNA of FIG. 26A, designated SEQ ID:20604. Yet another function of GAM26 is therefore inhibition of (STK39). Accordingly, utilities of GAM26 include diagnosis and treatment of diseases and clinical conditions with which STK39 is associated.

Reference is now made to STRBP BINDING SITE. STRBP is a target gene of GAM26, corresponding to GAM26-TARGET GENE of FIG. 26A. STRBP BINDING SITE is a binding site found in an untranslated region of STRBP, corresponding to BINDING SITE of FIG. 26A. FIG. 26D illustrates the complementarity of the nucleotide sequence of STRBP BINDING SITE, designated SEQ ID:984349, to the nucleotide sequence of GAM26 RNA of FIG. 26A, designated SEQ ID:20604. An additional function of GAM26 is therefore inhibition of (STRBP). Accordingly, utilities of GAM26 include diagnosis and treatment of diseases and clinical conditions with which STRBP is associated.

Reference is now made to SULT4A1 BINDING SITE. SULT4A1 is a target gene of GAM26, corresponding to GAM26-TARGET GENE of FIG. 26A. SULT4A1 BINDING SITE is a binding site found in an untranslated region of SULT4A1, corresponding to BINDING SITE of FIG. 26A. FIG. 26D illustrates the complementarity of the nucleotide sequence of SULT4A1 BINDING SITE, designated SEQ ID:985480, to the nucleotide sequence of GAM26 RNA of FIG. 26A, designated SEQ ID:20604. A further function of GAM26 is therefore inhibition of (SULT4A1). Accordingly, utilities of GAM26 include diagnosis and treatment of diseases and clinical conditions with which SULT4A1 is associated.

Reference is now made to SULT4A1 BINDING SITE. SULT4A1 is a target gene of GAM26, corresponding to GAM26-TARGET GENE of FIG. 26A. SULT4A1 BINDING SITE is a binding site found in an untranslated region of SULT4A1, corresponding to BINDING SITE of FIG. 26A. FIG. 26D illustrates the complementarity of the nucleotide sequence of SULT4A1 BINDING SITE, designated SEQ ID:985482, to the nucleotide sequence of GAM26 RNA of FIG. 26A, designated SEQ ID:20604. Yet a further function of GAM26 is therefore inhibition of (SULT4A1). Accordingly, utilities of GAM26 include diagnosis and treatment of diseases and clinical conditions with which SULT4A1 is associated.

Reference is now made to SULT4A1 BINDING SITE. SULT4A1 is a target gene of GAM26, corresponding to GAM26-TARGET GENE of FIG. 26A. SULT4A1 BINDING SITE is a binding site found in an untranslated region of SULT4A1, corresponding to BINDING SITE of FIG. 26A. FIG. 26D illustrates the complementarity of the nucleotide sequence of SULT4A1 BINDING SITE, designated SEQ ID:985499, to the nucleotide sequence of GAM26 RNA of FIG. 26A, designated SEQ ID:20604. Another function of GAM26 is therefore inhibition of (SULT4A1). Accordingly, utilities of GAM26 include diagnosis and treatment of diseases and clinical conditions with which SULT4A1 is associated.

Reference is now made to SULT4A1 BINDING SITE. SULT4A1 is a target gene of GAM26, corresponding to GAM26-TARGET GENE of FIG. 26A. SULT4A1 BINDING SITE is a binding site found in an untranslated region of SULT4A1, corresponding to BINDING SITE of FIG. 26A. FIG. 26D illustrates the complementarity of the nucleotide sequence of SULT4A1 BINDING SITE, designated SEQ ID:985516, to the nucleotide sequence of GAM26 RNA of FIG. 26A, designated SEQ ID:20604. Yet another function of GAM26 is therefore inhibition of (SULT4A1). Accordingly, utilities of GAM26 include diagnosis and treatment of diseases and clinical conditions with which SULT4A1 is associated.

Reference is now made to TBLR1 BINDING SITE. TBLR1 is a target gene of GAM26, corresponding to GAM26-TARGET GENE of FIG. 26A. TBLR1 BINDING SITE is a binding site found in an untranslated region of TBLR1, corresponding to BINDING SITE of FIG. 26A. FIG. 26D illustrates the complementarity of the nucleotide sequence of TBLR1 BINDING SITE, designated SEQ ID:989703, to the nucleotide sequence of GAM26 RNA of FIG. 26A, designated SEQ ID:20604. An additional function of GAM26 is therefore inhibition of (TBLR1). Accordingly, utilities of GAM26 include diagnosis and treatment of diseases and clinical conditions with which TBLR1 is associated.

Reference is now made to TIEG BINDING SITE. TIEG is a target gene of GAM26, corresponding to GAM26-TARGET GENE of FIG. 26A. TIEG BINDING SITE is a binding site found in an untranslated region of TIEG, corresponding to BINDING SITE of FIG. 26A. FIG. 26D illustrates the complementarity of the nucleotide sequence of TIEG BINDING SITE, designated SEQ ID:993412, to the nucleotide sequence of GAM26 RNA of FIG. 26A, designated SEQ ID:20604. A further function of GAM26 is therefore inhibition of (TIEG). Accordingly, utilities of GAM26 include diagnosis and treatment of diseases and clinical conditions with which TIEG is associated.

Reference is now made to TIEG BINDING SITE. TIEG is a target gene of GAM26, corresponding to GAM26-TARGET GENE of FIG. 26A. TIEG BINDING SITE is a binding site found in an untranslated region of TIEG, corresponding to BINDING SITE of FIG. 26A. FIG. 26D illustrates the complementarity of the nucleotide sequence of TIEG BINDING SITE, designated SEQ ID:993414, to the nucleotide sequence of GAM26 RNA of FIG. 26A, designated SEQ ID:20604. Yet a further function of GAM26 is therefore inhibition of (TIEG). Accordingly, utilities of GAM26 include diagnosis and treatment of diseases and clinical conditions with which TIEG is associated.

Reference is now made to FLJ20288 BINDING SITE. FLJ20288 is a target gene of GAM26, corresponding to GAM26-TARGET GENE of FIG. 26A. FLJ20288 BINDING SITE is a binding site found in an untranslated region of FLJ20288, corresponding to BINDING SITE of FIG. 26A. FIG. 26D illustrates the complementarity of the nucleotide sequence of FLJ20288 BINDING SITE, designated SEQ ID:993970, to the nucleotide sequence of GAM26 RNA of FIG. 26A, designated SEQ ID:20604. Another function of GAM26 is therefore inhibition of (FLJ20288). Accordingly, utilities of GAM26 include diagnosis and treatment of diseases and clinical conditions with which FLJ20288 is associated.

Reference is now made to TIP120A BINDING SITE. TIP120A is a target gene of GAM26, corresponding to GAM26-TARGET GENE of FIG. 26A. IP120A BINDING SITE is a binding site found in an untranslated region of TIP120A, corresponding to BINDING SITE of FIG. 26A. FIG. 26D illustrates the complementarity of the nucleotide sequence of TIP120A BINDING SITE, designated SEQ ID:993970, to the nucleotide sequence of GAM26 RNA of FIG. 26A, designated SEQ ID:20604. Yet another function of GAM26 is therefore inhibition of (TIP120A). Accordingly, utilities of GAM26 include diagnosis and treatment of diseases and clinical conditions with which TIP120A is associated.

Reference is now made to TIP120A BINDING SITE. TIP120A is a target gene of GAM26, corresponding to GAM26-TARGET GENE of FIG. 26A. TIP120A BINDING SITE is a binding site found in an untranslated region of TIP120A, corresponding to BINDING SITE of FIG. 26A. FIG. 26D illustrates the complementarity of the nucleotide sequence of TIP120A BINDING SITE, designated SEQ ID:993979, to the nucleotide sequence of GAM26 RNA of FIG. 26A, designated SEQ ID:20604. An additional function of GAM26 is therefore inhibition of (TIP120A). Accordingly, utilities of GAM26 include diagnosis and treatment of diseases and clinical conditions with which TIP120A is associated.

Reference is now made to TIP120A BINDING SITE. TIP120A is a target gene of GAM26, corresponding to GAM26-TARGET GENE of FIG. 26A. TIP120A BINDING SITE is a binding site found in an untranslated region of TIP120A, corresponding to BINDING SITE of FIG. 26A. FIG. 26D illustrates the complementarity of the nucleotide sequence of TIP120A BINDING SITE, designated SEQ ID:993980, to the nucleotide sequence of GAM26 RNA of FIG. 26A, designated SEQ ID:20604. A further function of GAM26 is therefore inhibition of (TIP120A). Accordingly, utilities of GAM26 include diagnosis and treatment of diseases and clinical conditions with which TIP120A is associated.

Reference is now made to TLK2 BINDING SITE. TLK2 is a target gene of GAM26, corresponding to GAM26-TARGET GENE of FIG. 26A. TLK2 BINDING SITE is a binding site found in an untranslated region of TLK2, corresponding to BINDING SITE of FIG. 26A. FIG. 26D illustrates the complementarity of the nucleotide sequence of TLK2 BINDING SITE, designated SEQ ID:994634, to the nucleotide sequence of GAM26 RNA of FIG. 26A, designated SEQ ID:20604. Yet a further function of GAM26 is therefore inhibition of (TLK2). Accordingly, utilities of GAM26 include diagnosis and treatment of diseases and clinical conditions with which TLK2 is associated.

Reference is now made to TPARL BINDING SITE. TPARL is a target gene of GAM26, corresponding to GAM26-TARGET GENE of FIG. 26A. TPARL BINDING SITE is a binding site found in an untranslated region of TPARL, corresponding to BINDING SITE of FIG. 26A. FIG. 26D illustrates the complementarity of the nucleotide sequence of TPARL BINDING SITE, designated SEQ ID:997782, to the nucleotide sequence of GAM26 RNA of FIG. 26A, designated SEQ ID:20604. Another function of GAM26 is therefore inhibition of (TPARL). Accordingly, utilities of GAM26 include diagnosis and treatment of diseases and clinical conditions with which TPARL is associated.

Reference is now made to TRIM28 BINDING SITE. TRIM28 is a target gene of GAM26, corresponding to GAM26-TARGET GENE of FIG. 26A. TRIM28 BINDING SITE is a binding site found in an untranslated region of TRIM28, corresponding to BINDING SITE of FIG. 26A. FIG. 26D illustrates the complementarity of the nucleotide sequence of TRIM28 BINDING SITE, designated SEQ ID:1000325, to the nucleotide sequence of GAM26 RNA of FIG. 26A, designated SEQ ID:20604. Yet another function of GAM26 is therefore inhibition of (TRIM28). Accordingly, utilities of GAM26 include diagnosis and treatment of diseases and clinical conditions with which TRIM28 is associated.

Reference is now made to TRIM28 BINDING SITE. TRIM28 is a target gene of GAM26, corresponding to GAM26-TARGET GENE of FIG. 26A. TRIM28 BINDING SITE is a binding site found in an untranslated region of TRIM28, corresponding to BINDING SITE of FIG. 26A. FIG. 26D illustrates the complementarity of the nucleotide sequence of TRIM28 BINDING SITE, designated SEQ ID:1000339, to the nucleotide sequence of GAM26 RNA of FIG. 26A, designated SEQ ID:20604. An additional function of GAM26 is therefore inhibition of (TRIM28). Accordingly, utilities of GAM26 include diagnosis and treatment of diseases and clinical conditions with which TRIM28 is associated.

Reference is now made to TRIM28 BINDING SITE. TRIM28 is a target gene of GAM26, corresponding to GAM26-TARGET GENE of FIG. 26A. TRIM28 BINDING SITE is a binding site found in an untranslated region of TRIM28, corresponding to BINDING SITE of FIG. 26A. FIG. 26D illustrates the complementarity of the nucleotide sequence of TRIM28 BINDING SITE, designated SEQ ID:1000350, to the nucleotide sequence of GAM26 RNA of FIG. 26A, designated SEQ ID:20604. A further function of GAM26 is therefore inhibition of (TRIM28). Accordingly, utilities of GAM26 include diagnosis and treatment of diseases and clinical conditions with which TRIM28 is associated.

Reference is now made to TRIM33 BINDING SITE. TRIM33 is a target gene of GAM26, corresponding to GAM26-TARGET GENE of FIG. 26A. TRIM33 BINDING SITE is a binding site found in an untranslated region of TRIM33, corresponding to BINDING SITE of FIG. 26A. FIG. 26D illustrates the complementarity of the nucleotide sequence of TRIM33 BINDING SITE, designated SEQ ID:1000528, to the nucleotide sequence of GAM26 RNA of FIG. 26A, designated SEQ ID:20604. Yet a further function of GAM26 is therefore inhibition of (TRIM33). Accordingly, utilities of GAM26 include diagnosis and treatment of diseases and clinical conditions with which TRIM33 is associated.

Reference is now made to TRIM33 BINDING SITE. TRIM33 is a target gene of GAM26, corresponding to GAM26-TARGET GENE of FIG. 26A. TRIM33 BINDING SITE is a binding site found in an untranslated region of TRIM33, corresponding to BINDING SITE of FIG. 26A. FIG. 26D illustrates the complementarity of the nucleotide sequence of TRIM33 BINDING SITE, designated SEQ ID:1000533, to the nucleotide sequence of GAM26 RNA of FIG. 26A, designated SEQ ID:20604. Another function of GAM26 is therefore inhibition of (TRIM33). Accordingly, utilities of GAM26 include diagnosis and treatment of diseases and clinical conditions with which TRIM33 is associated.

Reference is now made to TRIP10 BINDING SITE. TRIP10 is a target gene of GAM26, corresponding to GAM26-TARGET GENE of FIG. 26A. TRIP10 BINDING SITE is a binding site found in an untranslated region of TRIP10, corresponding to BINDING SITE of FIG. 26A. FIG. 26D illustrates the complementarity of the nucleotide sequence of TRIP10 BINDING SITE, designated SEQ ID:1001537, to the nucleotide sequence of GAM26 RNA of FIG. 26A, designated SEQ ID:20604. Yet another function of GAM26 is therefore inhibition of (TRIP10). Accordingly, utilities of GAM26 include diagnosis and treatment of diseases and clinical conditions with which TRIP10 is associated.

Reference is now made to ZDHHC3 BINDING SITE. ZDHHC3 is a target gene of GAM26, corresponding to GAM26-TARGET GENE of FIG. 26A. ZDHHC3 BINDING SITE is a binding site found in an untranslated region of ZDHHC3, corresponding to BINDING SITE of FIG. 26A. FIG. 26D illustrates the complementarity of the nucleotide sequence of ZDHHC3 BINDING SITE, designated SEQ ID:1001537, to the nucleotide sequence of GAM26 RNA of FIG. 26A, designated SEQ ID:20604. An additional function of GAM26 is therefore inhibition of (ZDHHC3). Accordingly, utilities of GAM26 include diagnosis and treatment of diseases and clinical conditions with which ZDHHC3 is associated.

Reference is now made to WBSCR21 BINDING SITE. WBSCR21 is a target gene of GAM26, corresponding to GAM26-TARGET GENE of FIG. 26A. WBSCR21 BINDING SITE is a binding site found in an untranslated region of WBSCR21, corresponding to BINDING SITE of FIG. 26A. FIG. 26D illustrates the complementarity of the nucleotide sequence of WBSCR21 BINDING SITE, designated SEQ ID:1012104, to the nucleotide sequence of GAM26 RNA of FIG. 26A, designated SEQ ID:20604. A further function of GAM26 is therefore inhibition of (WBSCR21). Accordingly, utilities of GAM26 include diagnosis and treatment of diseases and clinical conditions with which WBSCR21 is associated.

Reference is now made to WBSCR21 BINDING SITE. WBSCR21 is a target gene of GAM26, corresponding to GAM26-TARGET GENE of FIG. 26A. WBSCR21 BINDING SITE is a binding site found in an untranslated region of WBSCR21, corresponding to BINDING SITE of FIG. 26A. FIG. 26D illustrates the complementarity of the nucleotide sequence of WBSCR21 BINDING SITE, designated SEQ ID:1012156, to the nucleotide sequence of GAM26 RNA of FIG. 26A, designated SEQ ID:20604. Yet a further function of GAM26 is therefore inhibition of (WBSCR21). Accordingly, utilities of GAM26 include diagnosis and treatment of diseases and clinical conditions with which WBSCR21 is associated.

Reference is now made to ZDHHC5 BINDING SITE. ZDHHC5 is a target gene of GAM26, corresponding to GAM26-TARGET GENE of FIG. 26A. ZDHHC5 BINDING SITE is a biding site found in an untranslated region of ZDHHC5, corresponding to BINDING SITE of FIG. 26A. FIG. 26D illustrates the complementarity of the nucleotide sequence of ZDHHC5 BINDING SITE, designated SEQ ID:1016404, to the nucleotide sequence of GAM26 RNA of FIG. 26A, designated SEQ ID:20604. Another function of GAM26 is therefore inhibition of (ZDHHC5). Accordingly, utilities of GAM26 include diagnosis and treatment of diseases and clinical conditions with which ZDHHC5 is associated.

Reference is now made to ZDHHC5 BINDING SITE. ZDHHC5 is a target gene of GAM26, corresponding to GAM26-TARGET GENE of FIG. 26A. ZDHHC5 BINDING SITE is a binding site found in an untranslated region of ZDHHC5, corresponding to BINDING SITE of FIG. 26A. FIG. 26D illustrates the complementarity of the nucleotide sequence of ZDHHC5 BINDING SITE, designated SEQ ID:1016478, to the nucleotide sequence of GAM26 RNA of FIG. 26A, designated SEQ ID:20604. Yet another function of GAM26 is therefore inhibition of (ZDHHC5). Accordingly, utilities of GAM26 include diagnosis and treatment of diseases and clinical conditions with which ZDHHC5 is associated.

Reference is now made to ZER6 BINDING SITE. ZER6 is a target gene of GAM26, corresponding to GAM26-TARGET GENE of FIG. 26A. ZER6 BINDING SITE is a binding site found in an untranslated region of ZER6, corresponding to BINDING SITE of FIG. 26A. FIG. 26D illustrates the complementarity of the nucleotide sequence of ZER6 BINDING SITE, designated SEQ ID:1016788, to the nucleotide sequence of GAM26 RNA of FIG. 26A, designated SEQ ID:20604. An additional function of GAM26 is therefore inhibition of (ZER6). Accordingly, utilities of GAM26 include diagnosis and treatment of diseases and clinical conditions with which ZER6 is associated.

Reference is now made to ZER6 BINDING SITE. ZER6 is a target gene of GAM26, corresponding to GAM26-TARGET GENE of FIG. 26A. ZER6 BINDING SITE is a binding site found in an untranslated region of ZER6, corresponding to BINDING SITE of FIG. 26A. FIG. 26D illustrates the complementarity of the nucleotide sequence of ZER6 BINDING SITE, designated SEQ ID:1016846, to the nucleotide sequence of GAM26 RNA of FIG. 26A, designated SEQ ID:20604. A further function of GAM26 is therefore inhibition of (ZER6). Accordingly, utilities of GAM26 include diagnosis and treatment of diseases and clinical conditions with which ZER6 is associated.

Reference is now made to ZF BINDING SITE. ZF is a target gene of GAM26, corresponding to GAM26-TARGET GENE of FIG. 26A. ZF BINDING SITE is a binding site found in an untranslated region of ZF, corresponding to BINDING SITE of FIG. 26A. FIG. 26D illustrates the complementarity of the nucleotide sequence of ZF BINDING SITE, designated SEQ ID:1016945, to the nucleotide sequence of GAM26 RNA of FIG. 26A, designated SEQ ID:20604. Yet a further function of GAM26 is therefore inhibition of (ZF). Accordingly, utilities of GAM26 include diagnosis and treatment of diseases and clinical conditions with which ZF is associated.

Reference is now made to ZNF364 BINDING SITE. ZNF364 is a target gene of GAM26, corresponding to GAM26-TARGET GENE of FIG. 26A. ZNF364 BINDING SITE is a binding site found in an untranslated region of ZNF364, corresponding to BINDING SITE of FIG. 26A. FIG. 26D illustrates the complementarity of the nucleotide sequence of ZNF364 BINDING SITE, designated SEQ ID:1023294, to the nucleotide sequence of GAM26 RNA of FIG. 26A, designated SEQ ID:20604. Another function of GAM26 is therefore inhibition of (ZNF364). Accordingly, utilities of GAM26 include diagnosis and treatment of diseases and clinical conditions with which ZNF364 is associated.

Reference is now made to ZNF364 BINDING SITE. ZNF364 is a target gene of GAM26, corresponding to GAM26-TARGET GENE of FIG. 26A. ZNF364 BINDING SITE is a binding site found in an untranslated region of ZNF364, corresponding to BINDING SITE of FIG. 26A. FIG. 26D illustrates the complementarity of the nucleotide sequence of ZNF364 BINDING SITE, designated SEQ ID:1023303, to the nucleotide sequence of GAM26 RNA of FIG. 26A, designated SEQ ID:20604. Yet another function of GAM26 is therefore inhibition of (ZNF364). Accordingly, utilities of GAM26 include diagnosis and treatment of diseases and clinical conditions with which ZNF364 is associated.

Reference is now made to ZTL1 BINDING SITE. ZTL1 is a target gene of GAM26, corresponding to GAM26-TARGET GENE of FIG. 26A. ZTL1 BINDING SITE is a binding site found in an untranslated region of ZTL1, corresponding to BINDING SITE of FIG. 26A. FIG. 26D illustrates the complementarity of the nucleotide sequence of ZTL1 BINDING SITE, designated SEQ ID:1023979, to the nucleotide sequence of GAM26 RNA of FIG. 26A, designated SEQ ID:20604. An additional function of GAM26 is therefore inhibition of (ZTL1). Accordingly, utilities of GAM26 include diagnosis and treatment of diseases and clinical conditions with which ZTL1 is associated.

Reference is now made to ZTL1 BINDING SITE. ZTL1 is a target gene of GAM26, corresponding to GAM26-TARGET GENE of FIG. 26A. ZTL1 BINDING SITE is a binding site found in an untranslated region of ZTL1, corresponding to BINDING SITE of FIG. 26A. FIG. 26D illustrates the complementarity of the nucleotide sequence of ZTL1 BINDING SITE, designated SEQ ID:1023979, to the nucleotide sequence of GAM26 RNA of FIG. 26A, designated SEQ ID:20604. A further function of GAM26 is therefore inhibition of (ZTL1). Accordingly, utilities of GAM26 include diagnosis and treatment of diseases and clinical conditions with which ZTL1 is associated.

Reference is now made to CTCF BINDING SITE. CTCF is a target gene of GAM26, corresponding to GAM26-TARGET GENE of FIG. 26A. CTCF BINDING SITE is a binding site found in an untranslated region of CTCF, corresponding to BINDING SITE of FIG. 26A. FIG. 26D illustrates the complementarity of the nucleotide sequence of CTCF BINDING SITE, designated SEQ ID:1037665, to the nucleotide sequence of GAM26 RNA of FIG. 26A, designated SEQ ID:20604. Yet a further function of GAM26 is therefore inhibition of (CTCF). Accordingly, utilities of GAM26 include diagnosis and treatment of diseases and clinical conditions with which CTCF is associated.

Reference is now made to HRIHFB2122 BINDING SITE. HRIHFB2122 is a target gene of GAM26, corresponding to GAM26-TARGET GENE of FIG. 26A. HRIHFB2122 BINDING SITE is a binding site found in an untranslated region of HRIHFB2122, corresponding to BINDING SITE of FIG. 26A. FIG. 26D illustrates the complementarity of the nucleotide sequence of HRIHFB2122 BINDING SITE, designated SEQ ID:1065873, to the nucleotide sequence of GAM26 RNA of FIG. 26A, designated SEQ ID:20604. Another function of GAM26 is therefore inhibition of (HRIHFB2122). Accordingly, utilities of GAM26 include diagnosis and treatment of diseases and clinical conditions with which HRIHFB2122 is associated.

Reference is now made to KIAA0397 BINDING SITE. KIAA0397 is a target gene of GAM26, corresponding to GAM26-TARGET GENE of FIG. 26A. KIAA0397 BINDING SITE is a binding site found in an untranslated region of KIAA0397, corresponding to BINDING SITE of FIG. 26A. FIG. 26D illustrates the complementarity of the nucleotide sequence of KIAA0397 BINDING SITE, designated SEQ ID:1065873, to the nucleotide sequence of GAM26 RNA of FIG. 26A, designated SEQ ID:20604. Yet another function of GAM26 is therefore inhibition of (KIAA0397). Accordingly, utilities of GAM26 include diagnosis and treatment of diseases and clinical conditions with which KIAA0397 is associated.

Reference is now made to FUBP3 BINDING SITE. FUBP3 is a target gene of GAM26, corresponding to GAM26-TARGET GENE of FIG. 26A. FUBP3 BINDING SITE is a binding site found in an untranslated region of FUBP3, corresponding to BINDING SITE of FIG. 26A. FIG. 26D illustrates the complementarity of the nucleotide sequence of FUBP3 BINDING SITE, designated SEQ ID:1190283, to the nucleotide sequence of GAM26 RNA of FIG. 26A, designated SEQ ID:20604. An additional function of GAM26 is therefore inhibition of (FUBP3). Accordingly, utilities of GAM26 include diagnosis and treatment of diseases and clinical conditions with which FUBP3 is associated.

Reference is now made to H2AV BINDING SITE. H2AV is a target gene of GAM26, corresponding to GAM26-TARGET GENE of FIG. 26A. H2AV BINDING SITE is a binding site found in an untranslated region of H2AV, corresponding to BINDING SITE of FIG. 26A. FIG. 26D illustrates the complementarity of the nucleotide sequence of H2AV BINDING SITE, designated SEQ ID:1303366, to the nucleotide sequence of GAM26 RNA of FIG. 26A, designated SEQ ID:20604. A further function of GAM26 is therefore inhibition of (H2AV). Accordingly, utilities of GAM26 include diagnosis and treatment of diseases and clinical conditions with which H2AV is associated.

Reference is now made to FLJ20539 BINDING SITE. FLJ20539 is a target gene of GAM26, corresponding to GAM26-TARGET GENE of FIG. 26A. FLJ20539 BINDING SITE is a binding site found in an untranslated region of FLJ20539, corresponding to BINDING SITE of FIG. 26A. FIG. 26D illustrates the complementarity of the nucleotide sequence of FLJ20539 BINDING SITE, designated SEQ ID:1310953, to the nucleotide sequence of GAM26 RNA of FIG. 26A, designated SEQ ID:20604. Yet a further function of GAM26 is therefore inhibition of (FLJ20539). Accordingly, utilities of GAM26 include diagnosis and treatment of diseases and clinical conditions with which FLJ20539 is associated.

Reference is now made to KIAA1893 BINDING SITE. KIAA1893 is a target gene of GAM26, corresponding to GAM26-TARGET GENE of FIG. 26A. KIAA1893 BINDING SITE is a binding site found in an untranslated region of KIAA1893, corresponding to BINDING SITE of FIG. 26A. FIG. 26D illustrates the complementarity of the nucleotide sequence of KIAA1893 BINDING SITE, designated SEQ ID:1310953, to the nucleotide sequence of GAM26 RNA of FIG. 26A, designated SEQ ID:20604. Another function of GAM26 is therefore inhibition of (KIAA1893). Accordingly, utilities of GAM26 include diagnosis and treatment of diseases and clinical conditions with which KIAA1893 is associated.

Reference is now made to RINZF BINDING SITE. RINZF is a target gene of GAM26, corresponding to GAM26-TARGET GENE of FIG. 26A. RINZF BINDING SITE is a binding site found in an untranslated region of RINZF, corresponding to BINDING SITE of FIG. 26A. FIG. 26D illustrates the complementarity of the nucleotide sequence of RINZF BINDING SITE, designated SEQ ID:1310953, to the nucleotide sequence of GAM26 RNA of FIG. 26A, designated SEQ ID:20604. Yet another function of GAM26 is therefore inhibition of (RINZF). Accordingly, utilities of GAM26 include diagnosis and treatment of diseases and clinical conditions with which RINZF is associated.

Reference is now made to TIP120A BINDING SITE. TIP120A is a target gene of GAM26, corresponding to GAM26-TARGET GENE of FIG. 26A. TIP120A BINDING SITE is a binding site found in an untranslated region of TIP120A, corresponding to BINDING SITE of FIG. 26A. FIG. 26D illustrates the complementarity of the nucleotide sequence of TIP120A BINDING SITE, designated SEQ ID:1323750, to the nucleotide sequence of GAM26 RNA of FIG. 26A, designated SEQ ID:20604. An additional function of GAM26 is therefore inhibition of (TIP120A). Accordingly, utilities of GAM26 include diagnosis and treatment of diseases and clinical conditions with which TIP120A is associated.

Reference is now made to LOC146223 BINDING SITE. LOC146223 is a target gene of GAM26, corresponding to GAM26-TARGET GENE of FIG. 26A. LOC146223 BINDING SITE is a binding site found in an untranslated region of LOC146223, corresponding to BINDING SITE of FIG. 26A. FIG. 26D illustrates the complementarity of the nucleotide sequence of LOC146223 BINDING SITE, designated SEQ ID:94853, to the nucleotide sequence of GAM26 RNA of FIG. 26A, designated SEQ ID:20604. A further function of GAM26 is therefore inhibition of (LOC146223). Accordingly, utilities of GAM26 include diagnosis and treatment of diseases and clinical conditions with which LOC146223 is associated.

Reference is now made to LOC255426 BINDING SITE. LOC255426 is a target gene of GAM26, corresponding to GAM26-TARGET GENE of FIG. 26A. LOC255426 BINDING SITE is a binding site found in an untranslated region of LOC255426, corresponding to BINDING SITE of FIG. 26A. FIG. 26D illustrates the complementarity of the nucleotide sequence of LOC255426 BINDING SITE, designated SEQ ID:94853, to the nucleotide sequence of GAM26 RNA of FIG. 26A, designated SEQ ID:20604. Yet a further function of GAM26 is therefore inhibition of (LOC255426). Accordingly, utilities of GAM26 include diagnosis and treatment of diseases and clinical conditions with which LOC255426 is associated.

Reference is now made to LOC255426 BINDING SITE. LOC255426 is a target gene of GAM26, corresponding to GAM26-TARGET GENE of FIG. 26A. LOC255426 BINDING SITE is a binding site found in an untranslated region of LOC255426, corresponding to BINDING SITE of FIG. 26A. FIG. 26D illustrates the complementarity of the nucleotide sequence of LOC255426 BINDING SITE, designated SEQ ID:94853, to the nucleotide sequence of GAM26 RNA of FIG. 26A, designated SEQ ID:20604. Another function of GAM26 is therefore inhibition of (LOC255426). Accordingly, utilities of GAM26 include diagnosis and treatment of diseases and clinical conditions with which LOC255426 is associated.

Reference is now made to LOC255426 BINDING SITE. LOC255426 is a target gene of GAM26, corresponding to GAM26-TARGET GENE of FIG. 26A. LOC255426 BINDING SITE is a binding site found in an untranslated region of LOC255426, corresponding to BINDING SITE of FIG. 26A. FIG. 26D illustrates the complementarity of the nucleotide sequence of LOC255426 BINDING SITE, designated SEQ ID:94853, to the nucleotide sequence of GAM26 RNA of FIG. 26A, designated SEQ ID:20604. Yet another function of GAM26 is therefore inhibition of (LOC255426). Accordingly, utilities of GAM26 include diagnosis and treatment of diseases and clinical conditions with which LOC255426 is associated.

Reference is now made to LOC255426 BINDING SITE. LOC255426 is a target gene of GAM26, corresponding to GAM26-TARGET GENE of FIG. 26A. LOC255426 BINDING SITE is a binding site found in an untranslated region of LOC255426, corresponding to BINDING SITE of FIG. 26A. FIG. 26D illustrates the complementarity of the nucleotide sequence of LOC255426 BINDING SITE, designated SEQ ID:94853, to the nucleotide sequence of GAM26 RNA of FIG. 26A, designated SEQ ID:20604. An additional function of GAM26 is therefore inhibition of (LOC255426). Accordingly, utilities of GAM26 include diagnosis and treatment of diseases and clinical conditions with which LOC255426 is associated.

Reference is now made to LOC255426 BINDING SITE. LOC255426 is a target gene of GAM21, corresponding to GAM26-TARGET GENE of FIG. 26A. LOC255426 BINDING SITE is a binding site found in an untranslated region of LOC255426, corresponding to BINDING SITE of FIG. 26A. FIG. 26D illustrates the complementarity of the nucleotide sequence of LOC255426 BINDING SITE, designated SEQ ID:94853, to the nucleotide sequence of GAM26 RNA of FIG. 26A, designated SEQ ID:20604. A further function of GAM26 is therefore inhibition of (LOC255426). Accordingly, utilities of GAM26 include diagnosis and treatment of diseases and clinical conditions with which LOC255426 is associated.

Reference is now made to LOC255426 BINDING SITE. LOC255426 is a target gene of GAM26, corresponding to GAM26-TARGET GENE of FIG. 26A. LOC255426 BINDING SITE is a binding site found in an untranslated region of LOC255426, corresponding to BINDING SITE of FIG. 26A. FIG. 26D illustrates the complementarity of the nucleotide sequence of LOC255426 BINDING SITE, designated SEQ ID:94853, to the nucleotide sequence of GAM26 RNA of FIG. 26A, designated SEQ ID:20604. Yet a further function of GAM26 is therefore inhibition of (LOC255426). Accordingly, utilities of GAM26 include diagnosis and treatment of diseases and clinical conditions with which LOC255426 is associated.

Reference is now made to LOC122525 BINDING SITE. LOC122525 is a target gene of GAM26, corresponding to GAM26-TARGET GENE of FIG. 26A. LOC122525 BINDING SITE is a binding site found in an untranslated region of LOC122525, corresponding to BINDING SITE of FIG. 26A. FIG. 26D illustrates the complementarity of the nucleotide sequence of LOC122525 BINDING SITE, designated SEQ ID:173934, to the nucleotide sequence of GAM26 RNA of FIG. 26A, designated SEQ ID:20604. Another function of GAM26 is therefore inhibition of (LOC122525). Accordingly, utilities of GAM26 include diagnosis and treatment of diseases and clinical conditions with which LOC122525 is associated.

Reference is now made to LOC122525 BINDING SITE. LOC122525 is a target gene of GAM26, corresponding to GAM26-TARGET GENE of FIG. 26A. LOC122525 BINDING SITE is a binding site found in an untranslated region of LOC122525, corresponding to BINDING SITE of FIG. 26A. FIG. 26D illustrates the complementarity of the nucleotide sequence of LOC122525 BINDING SITE, designated SEQ ID:241978, to the nucleotide sequence of GAM26 RNA of FIG. 26A, designated SEQ ID:20604. Yet another function of GAM26 is therefore inhibition of (LOC122525). Accordingly, utilities of GAM26 include diagnosis and treatment of diseases and clinical conditions with which LOC122525 is associated.

Reference is now made to LOC146057 BINDING SITE. LOC146057 is a target gene of GAM26, corresponding to GAM26-TARGET GENE of FIG. 26A. LOC146057 BINDING SITE is a binding site found in an untranslated region of LOC146057, corresponding to BINDING SITE of FIG. 26A. FIG. 26D illustrates the complementarity of the nucleotide sequence of LOC146057 BINDING SITE, designated SEQ ID:264106, to the nucleotide sequence of GAM26 RNA of FIG. 26A, designated SEQ ID:20604. An additional function of GAM26 is therefore inhibition of (LOC146057). Accordingly, utilities of GAM26 include diagnosis and treatment of diseases and clinical conditions with which LOC146057 is associated.

Reference is now made to LOC203197 BINDING SITE. LOC203197 is a target gene of GAM26, corresponding to GAM26-TARGET GENE of FIG. 26A. LOC203197 BINDING SITE is a binding site found in an untranslated region of LOC203197, corresponding to BINDING SITE of FIG. 26A. FIG. 26D illustrates the complementarity of the nucleotide sequence of LOC203197 BINDING SITE, designated SEQ ID:317209, to the nucleotide sequence of GAM26 RNA of FIG. 26A, designated SEQ ID:20604. A further function of GAM26 is therefore inhibition of (LOC203197). Accordingly, utilities of GAM26 include diagnosis and treatment of diseases and clinical conditions with which LOC203197 is associated.

Reference is now made to LOC146223 BINDING SITE. LOC146223 is a target gene of GAM26, corresponding to GAM26-TARGET GENE of FIG. 26A. LOC146223 BINDING SITE is a binding site found in an untranslated region of LOC146223, corresponding to BINDING SITE of FIG. 26A. FIG. 26D illustrates the complementarity of the nucleotide sequence of LOC146223 BINDING SITE, designated SEQ ID:412156, to the nucleotide sequence of GAM26 RNA of FIG. 26A, designated SEQ ID:20604. Yet a further function of GAM26 is therefore inhibition of (LOC146223). Accordingly, utilities of GAM26 include diagnosis and treatment of diseases and clinical conditions with which LOC146223 is associated.

Reference is now made to LOC256905 BINDING SITE. LOC256905 is a target gene of GAM26, corresponding to GAM26-TARGET GENE of FIG. 26A. LOC256905 BINDING SITE is a binding site found in an untranslated region of LOC256905, corresponding to BINDING SITE of FIG. 26A. FIG. 26D illustrates the complementarity of the nucleotide sequence of LOC256905 BINDING SITE, designated SEQ ID:432644, to the nucleotide sequence of GAM26 RNA of FIG. 26A, designated. SEQ ID:20604. Another function of GAM26 is therefore inhibition of (LOC256905). Accordingly, utilities of GAM26 include diagnosis and treatment of diseases and clinical conditions with which LOC256905 is associated.

Reference is now made to LOC158301 BINDING SITE. LOC158301 is a target gene of GAM26, corresponding to GAM26-TARGET GENE of FIG. 26A. LOC158301 BINDING SITE is a binding site found in an untranslated region of LOC158301, corresponding to BINDING SITE of FIG. 26A. FIG. 26D illustrates the complementarity of the nucleotide sequence of LOC158301 BINDING SITE, designated SEQ ID:670361, to the nucleotide sequence of GAM26 RNA of FIG. 26A, designated SEQ ID:20604. Yet another function of GAM26 is therefore inhibition of (LOC158301). Accordingly, utilities of GAM26 include diagnosis and treatment of diseases and clinical conditions with which LOC158301 is associated.

Reference is now made to LOC158301 BINDING SITE. LOC158301 is a target gene of GAM26, corresponding to GAM26-TARGET GENE of FIG. 26A. LOC158301 BINDING SITE is a binding site found in an untranslated region of LOC158301, corresponding to BINDING SITE of FIG. 26A. FIG. 26D illustrates the complementarity of the nucleotide sequence of LOC158301 BINDING SITE, designated SEQ ID:670394, to the nucleotide sequence of GAM26 RNA of FIG. 26A, designated SEQ ID:20604. An additional function of GAM26 is therefore inhibition of (LOC158301). Accordingly, utilities of GAM26 include diagnosis and treatment of diseases and clinical conditions with which LOC158301 is associated.

Reference is now made to LOC254573 BINDING SITE. LOC254573 is a target gene of GAM26, corresponding to GAM26-TARGET GENE of FIG. 26A. LOC254573 BINDING SITE is a binding site found in an untranslated region of LOC254573, corresponding to BINDING SITE of FIG. 26A. FIG. 26D illustrates the complementarity of the nucleotide sequence of LOC254573 BINDING SITE, designated SEQ ID:683857, to the nucleotide sequence of GAM26 RNA of FIG. 26A, designated SEQ ID:20604. A further function of GAM26 is therefore inhibition of (LOC254573). Accordingly, utilities of GAM26 include diagnosis and treatment of diseases and clinical conditions with which LOC254573 is associated.

Reference is now made to LOC158301 BINDING SITE. LOC158301 is a target gene of GAM26, corresponding to GAM26-TARGET GENE of FIG. 26A. LOC158301 BINDING SITE is a binding site found in an untranslated region of LOC158301, corresponding to BINDING SITE of FIG. 26A. FIG. 26D illustrates the complementarity of the nucleotide sequence of LOC158301 BINDING SITE, designated SEQ ID:763022, to the nucleotide sequence of GAM26 RNA of FIG. 26A, designated SEQ ID:20604. Yet a further function of GAM26 is therefore inhibition of (LOC158301). Accordingly, utilities of GAM26 include diagnosis and treatment of diseases and clinical conditions with which LOC158301 is associated.

Reference is now made to LOC57795 BINDING SITE. LOC57795 is a target gene of GAM26, corresponding to GAM26-TARGET GENE of FIG. 26A. LOC57795 BINDING SITE is a binding site found in an untranslated region of LOC57795, corresponding to BINDING SITE of FIG. 26A. FIG. 26D illustrates the complementarity of the nucleotide sequence of LOC57795 BINDING SITE, designated SEQ ID:865556, to the nucleotide sequence of GAM26 RNA of FIG. 26A, designated SEQ ID:20604. Another function of GAM26 is therefore inhibition of (LOC57795). Accordingly, utilities of GAM26 include diagnosis and treatment of diseases and clinical conditions with which LOC57795 is associated.

Reference is now made to LOC122525 BINDING SITE. LOC122525 is a target gene of GAM26, corresponding to GAM26-TARGET GENE of FIG. 26A. LOC122525 BINDING SITE is a binding site found in an untranslated region of LOC122525, corresponding to BINDING SITE of FIG. 26A. FIG. 26D illustrates the complementarity of the nucleotide sequence of LOC122525 BINDING SITE, designated SEQ ID:969284, to the nucleotide sequence of GAM26

RNA of FIG. 26A, designated SEQ ID:20604. Yet another function of GAM26 is therefore inhibition of (LOC122525). Accordingly, utilities of GAM26 include diagnosis and treatment of diseases and clinical conditions with which LOC122525 is associated.

Reference is now made to LOC112609 BINDING SITE. LOC112609 is a target gene of GAM26, corresponding to GAM26-TARGET GENE of FIG. 26A. LOC112609 BINDING SITE is a binding site found in an untranslated region of LOC112609, corresponding to BINDING SITE of FIG. 26A. FIG. 26D illustrates the complementarity of the nucleotide sequence of LOC112609 BINDING SITE, designated SEQ ID:1024445, to the nucleotide sequence of GAM26 RNA of FIG. 26A, designated SEQ ID:20604. An additional function of GAM26 is therefore inhibition of (LOC112609). Accordingly, utilities of GAM26 include diagnosis and treatment of diseases and clinical conditions with which LOC112609 is associated.

Reference is now made to LOC121536 BINDING SITE. LOC121536 is a target gene of GAM26, corresponding to GAM26-TARGET GENE of FIG. 26A. LOC121536 BINDING SITE is a binding site found in an untranslated region of LOC121536, corresponding to BINDING SITE of FIG. 26A. FIG. 26D illustrates the complementarity of the nucleotide sequence of LOC121536 BINDING SITE, designated SEQ ID:1036323, to the nucleotide sequence of GAM26 RNA of FIG. 26A, designated SEQ ID:20604. A further function of GAM26 is therefore inhibition of (LOC121536). Accordingly, utilities of GAM26 include diagnosis and treatment of diseases and clinical conditions with which LOC121536 is associated.

Reference is now made to LOC121536 BINDING SITE. LOC121536 is a target gene of GAM26, corresponding to GAM26-TARGET GENE of FIG. 26A. LOC121536 BINDING SITE is a binding site found in an untranslated region of LOC121536, corresponding to BINDING SITE of FIG. 26A. FIG. 26D illustrates the complementarity of the nucleotide sequence of LOC121536 BINDING SITE, designated SEQ ID:1036334, to the nucleotide sequence of GAM26 RNA of FIG. 26A, designated SEQ ID:20604. Yet a further function of GAM26 is therefore inhibition of (LOC121536). Accordingly, utilities of GAM26 include diagnosis and treatment of diseases and clinical conditions with which LOC121536 is associated.

Reference is now made to LOC121536 BINDING SITE. LOC121536 is a target gene of GAM26, corresponding to GAM26-TARGET GENE of FIG. 26A. LOC121536 BINDING SITE is a binding site found in an untranslated region of LOC121536, corresponding to BINDING SITE of FIG. 26A. FIG. 26D illustrates the complementarity of the nucleotide sequence of LOC121536 BINDING SITE, designated SEQ ID:1036375, to the nucleotide sequence of GAM26 RNA of FIG. 26A, designated SEQ ID:20604. Another function of GAM26 is therefore inhibition of (LOC121536). Accordingly, utilities of GAM26 include diagnosis and treatment of diseases and clinical conditions with which LOC121536 is associated.

Reference is now made to LOC122525 BINDING SITE. LOC122525 is a target gene of GAM26, corresponding to GAM26-TARGET GENE of FIG. 26A. LOC122525 BINDING SITE is a binding site found in an untranslated region of LOC122525, corresponding to BINDING SITE of FIG. 26A. FIG. 26D illustrates the complementarity of the nucleotide sequence of LOC122525 BINDING SITE, designated SEQ ID:1036926, to the nucleotide sequence of GAM26 RNA of FIG. 26A, designated SEQ ID:20604. Yet another function of GAM26 is therefore inhibition of (LOC122525). Accordingly, utilities of GAM26 include diagnosis and treatment of diseases and clinical conditions with which LOC122525 is associated.

Reference is now made to LOC124944 BINDING SITE. LOC124944 is a target gene of GAM26, corresponding to GAM26-TARGET GENE of FIG. 26A. LOC124944 BINDING SITE is a binding site found in an untranslated region of LOC124944, corresponding to BINDING SITE of FIG. 26A. FIG. 26D illustrates the complementarity of the nucleotide sequence of LOC124944 BINDING SITE, designated SEQ ID:1041522, to the nucleotide sequence of GAM26 RNA of FIG. 26A, designated SEQ ID:20604. An additional function of GAM26 is therefore inhibition of (LOC124944). Accordingly, utilities of GAM26 include diagnosis and treatment of diseases and clinical conditions with which LOC124944 is associated.

Reference is now made to LOC125228 BINDING SITE. LOC125228 is a target gene of GAM26, corresponding to GAM26-TARGET GENE of FIG. 26A. LOC125228 BINDING SITE is a binding site found in an untranslated region of LOC125228, corresponding to BINDING SITE of FIG. 26A. FIG. 26D illustrates the complementarity of the nucleotide sequence of LOC125228 BINDING SITE, designated SEQ ID:1042173, to the nucleotide sequence of GAM26 RNA of FIG. 26A, designated SEQ ID:20604. A further function of GAM26 is therefore inhibition of (LOC125228). Accordingly, utilities of GAM26 include diagnosis and treatment of diseases and clinical conditions with which LOC125228 is associated.

Reference is now made to LOC125228 BINDING SITE. LOC125228 is a target gene of GAM26, corresponding to GAM26-TARGET GENE of FIG. 26A. LOC125228 BINDING SITE is a binding site found in an untranslated region of LOC125228, corresponding to BINDING SITE of FIG. 26A. FIG. 26D illustrates the complementarity of the nucleotide sequence of LOC125228 BINDING SITE, designated SEQ ID:1042179, to the nucleotide sequence of GAM26 RNA of FIG. 26A, designated SEQ ID:20604. Yet a further function of GAM26 is therefore inhibition of (LOC125228). Accordingly, utilities of GAM26 include diagnosis and treatment of diseases and clinical conditions with which LOC1125228 is associated.

Reference is now made to LOC126432 BINDING SITE. LOC126432 is a target gene of GAM26, corresponding to GAM26-TARGET GENE of FIG. 26A. LOC126432 BINDING SITE is a binding site found in an untranslated region of LOC126432, corresponding to BINDING SITE of FIG. 26A. FIG. 26D illustrates the complementarity of the nucleotide sequence of LOC126432 BINDING SITE, designated SEQ ID:1044359, to the nucleotide sequence of GAM26 RNA of FIG. 26A, designated SEQ ID:20604. Another function of GAM26 is therefore inhibition of (LOC126432). Accordingly, utilities of GAM26 include diagnosis and treatment of diseases and clinical conditions with which LOC126432 is associated.

Reference is now made to LOC126917 BINDING SITE. LOC126917 is a target gene of GAM26, corresponding to GAM26-TARGET. GENE of FIG. 26A. LOC126917 BINDING SITE is a binding site found in an untranslated region of LOC126917, corresponding to BINDING SITE of FIG. 26A. FIG. 26D illustrates the complementarity of the nucleotide sequence of LOC126917 BINDING SITE, designated SEQ ID:1045771, to the nucleotide sequence of GAM26 RNA of FIG. 26A, designated SEQ ID:20604. Yet another function of GAM26 is therefore inhibition of (LOC126917). Accordingly, utilities of GAM26 include diagnosis and treatment of diseases and clinical conditions with which LOC126917 is associated.

Reference is now made to LOC130367 BINDING SITE. LOC130367 is a target gene of GAM26, corresponding to GAM26-TARGET GENE of FIG. 26A. LOC130367 BINDING SITE is a binding site found in an untranslated region of LOC130367, corresponding to BINDING SITE of FIG. 26A. FIG. 26D illustrates the complementarity of the nucleotide sequence of LOC130367 BINDING SITE, designated SEQ ID:1051475, to the nucleotide sequence of GAM26 RNA of FIG. 26A, designated SEQ ID:20604. An additional function of GAM26 is therefore inhibition of (LOC130367). Accordingly, utilities of GAM26 include diagnosis and treatment of diseases and clinical conditions with which LOC130367 is associated.

Reference is now made to LOC143243 BINDING SITE. LOC143243 is a target gene of GAM26, corresponding to GAM26-TARGET GENE of FIG. 26A. LOC143243 BINDING SITE is a binding site found in an untranslated region of LOC143243, corresponding to BINDING SITE of FIG. 26A. FIG. 26D illustrates the complementarity of the nucleotide sequence of LOC143243 BINDING SITE, designated SEQ ID:1065873, to the nucleotide sequence of GAM26 RNA of FIG. 26A, designated SEQ ID:20604. A further function of GAM26 is therefore inhibition of (LOC143243). Accordingly, utilities of GAM26 include diagnosis and treatment of diseases and clinical conditions with which LOC143243 is associated.

Reference is now made to LOC143891 BINDING SITE. LOC143891 is a target gene of GAM26, corresponding to GAM26-TARGET GENE of FIG. 26A. LOC143891 BINDING SITE is a binding site found in an untranslated region of LOC143891, corresponding to BINDING SITE of FIG. 26A. FIG. 26D illustrates the complementarity of the nucleotide sequence of LOC143891 BINDING SITE, designated SEQ ID:1068561, to the nucleotide sequence of GAM26 RNA of FIG. 26A, designated SEQ ID:20604. Yet a further function of GAM26 is therefore inhibition of (LOC143891). Accordingly, utilities of GAM26 include diagnosis and treatment of diseases and clinical conditions with which LOC143891 is associated.

Reference is now made to LOC145173 BINDING SITE. LOC145173 is a target gene of GAM26, corresponding to GAM26-TARGET GENE of FIG. 26A. LOC145173 BINDING SITE is a binding site found in an untranslated region of LOC145173, corresponding to BINDING SITE of FIG. 26A. FIG. 26D illustrates the complementarity of the nucleotide sequence of LOC145173 BINDING SITE, designated SEQ ID:1077948, to the nucleotide sequence of GAM26 RNA of FIG. 26A, designated SEQ ID:20604. Another function of GAM26 is therefore inhibition of (LOC145173). Accordingly, utilities of GAM26 include diagnosis and treatment of diseases and clinical conditions with which LOC145173 is associated.

Reference is now made to LOC145173 BINDING SITE. LOC145173 is a target gene of GAM26, corresponding to GAM26-TARGET GENE of FIG. 26A. LOC145173 BINDING SITE is a binding site found in an untranslated region of LOC145173, corresponding to BINDING SITE of FIG. 26A. FIG. 26D illustrates the complementarity of the nucleotide sequence of LOC145173 BINDING SITE, designated SEQ ID:1077952, to the nucleotide sequence of GAM26 RNA of FIG. 26A, designated SEQ ID:20604. Yet another function of GAM26 is therefore inhibition of (LOC145173). Accordingly, utilities of GAM26 include diagnosis and treatment of diseases and clinical conditions with which LOC145173 is associated.

Reference is now made to LOC145581 BINDING SITE. LOC145581 is a target gene of GAM26, corresponding to GAM26-TARGET GENE of FIG. 26A. LOC145581 BINDING SITE is a binding site found in an untranslated region of LOC145581, corresponding to BINDING SITE of FIG. 26A. FIG. 26D illustrates the complementarity of the nucleotide sequence of LOC145581 BINDING SITE, designated SEQ ID:1081817, to the nucleotide sequence of GAM26 RNA of FIG. 26A, designated SEQ ID:20604. An additional function of GAM26 is therefore inhibition of (LOC145581). Accordingly, utilities of GAM26 include diagnosis and treatment of diseases and clinical conditions with which LOC145581 is associated.

Reference is now made to LOC145990 BINDING SITE. LOC145990 is a target gene of GAM26, corresponding to GAM26-TARGET GENE of FIG. 26A. LOC145990 BINDING SITE is a binding site found in an untranslated region of LOC145990, corresponding to BINDING SITE of FIG. 26A. FIG. 26D illustrates the complementarity of the nucleotide sequence of LOC145990 BINDING SITE, designated SEQ ID:1089127, to the nucleotide sequence of GAM26 RNA of FIG. 26A, designated SEQ ID:20604. A further function of GAM26 is therefore inhibition of (LOC145990). Accordingly, utilities of GAM26 include diagnosis and treatment of diseases and clinical conditions with which LOC145990 is associated.

Reference is now made to LOC145990 BINDING SITE. LOC145990 is a target gene of GAM26, corresponding to GAM26-TARGET GENE of FIG. 26A. LOC145990 BINDING SITE is a binding site found in an untranslated region of LOC145990, corresponding to BINDING SITE of FIG. 26A. FIG. 26D illustrates the complementarity of the nucleotide sequence of LOC145990 BINDING SITE, designated SEQ ID:1089148, to the nucleotide sequence of GAM26 RNA of FIG. 26A, designated SEQ ID:20604. Yet a further function of GAM26 is therefore inhibition of (LOC145990). Accordingly, utilities of GAM26 include diagnosis and treatment of diseases and clinical conditions with which LOC145990 is associated.

Reference is now made to LOC145990 BINDING SITE. LOC145990 is a target gene of GAM26, corresponding to GAM26-TARGET GENE of FIG. 26A. LOC145990 BINDING SITE is a binding site found in an untranslated region of LOC145990, corresponding to BINDING SITE of FIG. 26A. FIG. 26D illustrates the complementarity of the nucleotide sequence of LOC145990 BINDING SITE, designated SEQ ID:1089170, to the nucleotide sequence of GAM26 RNA of FIG. 26A, designated SEQ ID:20604. Another function of GAM26 is therefore inhibition of (LOC145990). Accordingly, utilities of GAM26 include diagnosis and treatment of diseases and clinical conditions with which LOC145990 is associated.

Reference is now made to LOC145990 BINDING SITE. LOC145990 is a target gene of GAM26, corresponding to GAM26-TARGET GENE of FIG. 26A. LOC145990 BINDING SITE is a binding site found in an untranslated region of LOC145990, corresponding to BINDING SITE of FIG. 26A. FIG. 26D illustrates the complementarity of the nucleotide sequence of LOC145990 BINDING SITE, designated SEQ ID:1089181, to the nucleotide sequence of GAM26 RNA of FIG. 26A, designated SEQ ID:20604. Yet another function of GAM26 is therefore inhibition of (LOC145990). Accordingly, utilities of GAM26 include diagnosis and treatment of diseases and clinical conditions with which LOC145990 is associated.

Reference is now made to LOC146057 BINDING SITE. LOC146057 is a target gene of GAM26, corresponding to GAM26-TARGET GENE of FIG. 26A. LOC146057 BINDING SITE is a binding site found in an untranslated region of LOC146057, corresponding to BINDING SITE of FIG. 26A. FIG. 26D illustrates the complementarity of the nucleotide sequence of LOC146057 BINDING SITE, designated SEQ ID:1089542, to the nucleotide sequence of GAM26 RNA of FIG. 26A, designated SEQ ID:20604. An additional function of GAM26 is therefore inhibition of (LOC146057). Accordingly, utilities of GAM26 include diagnosis and treatment of diseases and clinical conditions with which LOC146057 is associated.

Reference is now made to LOC146057 BINDING SITE. LOC146057 is a target gene of GAM26, corresponding to GAM26-TARGET GENE of FIG. 26A. LOC146057 BINDING SITE is a binding site found in an untranslated region of LOC146057, corresponding to BINDING SITE of FIG. 26A. FIG. 26D illustrates the complementarity of the nucleotide sequence of LOC146057 BINDING SITE, designated SEQ ID:1089568, to the nucleotide sequence of GAM26 RNA of FIG. 26A, designated SEQ ID:20604. A further function of GAM26 is therefore inhibition of (LOC146057). Accordingly, utilities of GAM26 include diagnosis and treatment of diseases and clinical conditions with which LOC146057 is associated.

Reference is now made to LOC146223 BINDING SITE. LOC146223 is a target gene of GAM26, corresponding to GAM26-TARGET GENE of FIG. 26A. LOC146223 BINDING SITE is a binding site found in an untranslated region of LOC146223, corresponding to BINDING SITE of FIG. 26A. FIG. 26D illustrates the complementarity of the nucleotide sequence of LOC146223 BINDING SITE, designated SEQ ID:1090768, to the nucleotide sequence of GAM26 RNA of FIG. 26A, designated SEQ ID:20604. Yet a further function of GAM26 is therefore inhibition of (LOC146223). Accordingly, utilities of GAM26 include diagnosis and treatment of diseases and clinical conditions with which LOC46223 is associated.

Reference is now made to LOC147057 BINDING SITE. LOC147057 is a target gene of GAM26, corresponding to GAM26-TARGET GENE of FIG. 26A. LOC147057 BINDING SITE is a binding site found in an untranslated region of LOC147057, corresponding to BINDING SITE of FIG. 26A. FIG. 26D illustrates the complementarity of the nucleotide sequence of LOC147057 BINDING SITE, designated SEQ ID:1102464, to the nucleotide sequence of GAM26 RNA of FIG. 26A, designated SEQ ID:20604. Another function of GAM26 is therefore inhibition of (LOC147057). Accordingly, utilities of GAM26 include diagnosis and treatment of diseases and clinical conditions with which LOC147057 is associated.

Reference is now made to LOC147409 BINDING SITE. LOC147409 is a target gene of GAM26, corresponding to GAM26-TARGET GENE of FIG. 26A. LOC147409 BINDING SITE is a binding site found in an untranslated region of LOC147409, corresponding to BINDING SITE of FIG. 26A. FIG. 26D illustrates the complementarity of the nucleotide sequence of LOC147409 BINDING SITE, designated SEQ ID:1105742, to the nucleotide sequence of GAM26 RNA of FIG. 26A, designated SEQ ID:20604. Yet another function of GAM26 is therefore inhibition of (LOC147409). Accordingly, utilities of GAM26 include diagnosis and treatment of diseases and clinical conditions with which LOC147409 is associated.

Reference is now made to LOC147808 BINDING SITE. LOC147808 is a target gene of GAM26, corresponding to GAM26-TARGET GENE of FIG. 26A. LOC147808 BINDING SITE is a binding site found in an untranslated region of LOC147808, corresponding to BINDING SITE of FIG. 26A. FIG. 26D illustrates the complementarity of the nucleotide sequence of LOC147808 BINDING SITE, designated SEQ ID:1108755, to the nucleotide sequence of GAM26 RNA of FIG. 26A, designated SEQ ID:20604. An additional function of GAM26 is therefore inhibition of (LOC147808). Accordingly, utilities of GAM26 include diagnosis and treatment of diseases and clinical conditions with which LOC147808 is associated.

Reference is now made to LOC150984 BINDING SITE. LOC150984 is a target gene of GAM26, corresponding to GAM26-TARGET GENE of FIG. 26A. LOC150984 BINDING SITE is a binding site found in an untranslated region of LOC150984, corresponding to BINDING SITE of FIG. 26A. FIG. 26D illustrates the complementarity of the nucleotide sequence of LOC150984 BINDING SITE, designated SEQ ID:1144920, to the nucleotide sequence of GAM26 RNA of FIG. 26A, designated SEQ ID:20604. A further function of GAM26 is therefore inhibition of (LOC150984). Accordingly, utilities of GAM26 include diagnosis and treatment of diseases and clinical conditions with which LOC150984 is associated.

Reference is now made to LOC151517 BINDING SITE. LOC151517 is a target gene of GAM26, corresponding to GAM26-TARGET GENE of FIG. 26A. LOC151517 BINDING SITE is a binding site found in an untranslated region of LOC151517, corresponding to BINDING SITE of FIG. 26A. FIG. 26D illustrates the complementarity of the nucleotide sequence of LOC151517 BINDING SITE, designated SEQ ID:1151083, to the nucleotide sequence of GAM26 RNA of FIG. 26A, designated SEQ ID:20604. Yet another function of GAM26 is therefore inhibition of (LOC151517). Accordingly, utilities of GAM26 include diagnosis and treatment of diseases and clinical conditions with which LOC151517 is associated.

Reference is now made to LOC152048 BINDING SITE. LOC152048 is a target gene of GAM26, corresponding to GAM26-TARGET GENE of FIG. 26A. LOC152048 BINDING SITE is a binding site found in an untranslated region of LOC152048, corresponding to BINDING SITE of FIG. 26A. FIG. 26D illustrates the complementarity of the nucleotide sequence of LOC152048 BINDING SITE, designated SEQ ID:1155173, to the nucleotide sequence of GAM26 RNA of FIG. 26A, designated SEQ ID:20604. Another function of GAM26 is therefore inhibition of (LOC152048). Accordingly, utilities of GAM26 include diagnosis and treatment of diseases and clinical conditions with which LOC152048 is associated.

Reference is now made to LOC154743 BINDING SITE. LOC154743 is a target gene of GAM26, corresponding to GAM26-TARGET GENE of FIG. 26A. LOC154743 BINDING SITE is a binding site found in an untranslated region of LOC154743, corresponding to BINDING SITE of FIG. 26A. FIG. 26D illustrates the complementarity of the nucleotide sequence of LOC154743 BINDING SITE, designated SEQ ID:1174818, to the nucleotide sequence of GAM26 RNA of FIG. 26A, designated SEQ ID:20604. Yet another function of GAM26 is therefore inhibition of (LOC154743). Accordingly, utilities of GAM26 include diagnosis and treatment of diseases and clinical conditions with which LOC154743 is associated.

Reference is now made to LOC154807 BINDING SITE. LOC154807 is a target gene of GAM26, corresponding to GAM26-TARGET GENE of FIG. 26A. LOC154807 BINDING SITE is a binding site found in an untranslated region of LOC154807, corresponding to BINDING SITE of FIG. 26A. FIG. 26D illustrates the complementarity of the nucleotide sequence of LOC154807 BINDING SITE, designated SEQ ID:1175671, to the nucleotide sequence of GAM26 RNA of FIG. 26A, designated SEQ ID:20604. An additional function of GAM26 is therefore inhibition of (LOC154807). Accordingly, utilities of GAM26 include diagnosis and treatment of diseases and clinical conditions with which LOC154807 is associated.

Reference is now made to LOC154807 BINDING SITE. LOC154807 is a target gene of GAM26, corresponding to GAM26-TARGET GENE of FIG. 26A. LOC154807 BINDING SITE is a binding site found in an untranslated region of LOC154807, corresponding to BINDING SITE of FIG. 26A. FIG. 26D illustrates the complementarity of the nucleotide sequence of LOC154807 BINDING SITE, designated SEQ ID:1175672, to the nucleotide sequence of GAM26 RNA of FIG. 26A, designated SEQ ID:20604. A further function of GAM26 is therefore inhibition of (LOC154807). Accordingly, utilities of GAM26 include diagnosis and treatment of diseases and clinical conditions with which LOC154807 is associated.

Reference is now made to LOC158301 BINDING SITE. LOC158301 is a target gene of GAM26, corresponding to GAM26-TARGET GENE of FIG. 26A. LOC158301 BINDING SITE is a binding site found in an untranslated region of LOC158301, corresponding to BINDING SITE of FIG. 26A. FIG. 26D illustrates the complementarity of the nucleotide sequence of LOC158301 BINDING SITE, designated SEQ ID:1190223, to the nucleotide sequence of GAM26 RNA of FIG. 26A, designated SEQ ID:20604. Yet a further function of GAM26 is therefore inhibition of (LOC158301). Accordingly, utilities of GAM26 include diagnosis and treatment of diseases and clinical conditions with which LOC158301 is associated.

Reference is now made to LOC158301 BINDING SITE. LOC158301 is a target gene of GAM26, corresponding to GAM26-TARGET GENE of FIG. 26A. LOC158301 BINDING SITE is a binding site found in an untranslated region of LOC158301, corresponding to BINDING SITE of FIG. 26A. FIG. 26D illustrates the complementarity of the nucleotide sequence of LOC158301 BINDING SITE, designated SEQ ID:1190283, to the nucleotide sequence of GAM26 RNA of FIG. 26A, designated SEQ ID:20604. Another function of GAM26 is therefore inhibition of (LOC158301). Accordingly, utilities of GAM26 include diagnosis and treatment of diseases and clinical conditions with which LOC158301 is associated.

Reference is now made to LOC158856 BINDING SITE. LOC158856 is a target gene of GAM26, corresponding to GAM26-TARGET GENE of FIG. 26A. LOC158856 BINDING is a binding site found in an untranslated region of LOC158856, corresponding to BINDING SITE of FIG. 26A. FIG. 26D illustrates the complementarity of the nucleotide sequence of LOC158856 BINDING SITE, designated SEQ ID:1195246, to the nucleotide sequence of GAM26 RNA of FIG. 26A, designated SEQ ID:20604. Yet another function of GAM26 is therefore inhibition of (LOC158856). Accordingly, utilities of GAM26 include diagnosis and treatment of diseases and clinical conditions with which LOC158856 is associated.

Reference is now made to LOC161635 BINDING SITE. LOC161635 is a target gene of GAM26, corresponding to GAM26-TARGET GENE of FIG. 26A. LOC161635 BINDING SITE is a binding site found in an untranslated region of LOC161635, corresponding to BINDING SITE of FIG. 26A. FIG. 26D illustrates the complementarity of the nucleotide sequence of LOC161635 BINDING SITE, designated SEQ ID:1199731, to the nucleotide sequence of GAM26 RNA of FIG. 26A, designated SEQ ID:20604. An additional function of GAM26 is therefore inhibition of (LOC161635). Accordingly, utilities of GAM26 include diagnosis and treatment of diseases and clinical conditions with which LOC161635 is associated.

Reference is now made to LOC162417 BINDING SITE. LOC162417 is a target gene of GAM26, corresponding to GAM26-TARGET GENE of FIG. 26A. LOC162417 BINDING SITE is a binding site found in an untranslated region of LOC162417, corresponding to BINDING SITE of FIG. 26A. FIG. 26D illustrates the complementarity of the nucleotide sequence of LOC162417 BINDING SITE, designated SEQ ID:1201175, to the nucleotide sequence of GAM26 RNA of FIG. 26A, designated SEQ ID:20604. A further function of GAM26 is therefore inhibition of (LOC162417). Accordingly, utilities of GAM26 include diagnosis and treatment of diseases and clinical conditions with which LOC162417 is associated.

Reference is now made to LOC162762 BINDING SITE. LOC162762 is a target gene of GAM26, corresponding to GAM26-TARGET GENE of FIG. 26A. LOC162762 BINDING SITE is a binding site found in an untranslated region of LOC162762, corresponding to BINDING SITE of FIG. 26A. FIG. 26D illustrates the complementarity of the nucleotide sequence of LOC162762 BINDING SITE, designated SEQ ID:1201432, to the nucleotide sequence of GAM26 RNA of FIG. 26A, designated SEQ ID:20604. Yet a further function of GAM26 is therefore inhibition of (LOC162762). Accordingly, utilities of GAM26 include diagnosis and treatment of diseases and clinical conditions with which LOC162762 is associated.

Reference is now made to LOC162762 BINDING SITE. LOC162762 is a target gene of GAM26, corresponding to GAM26-TARGET GENE of FIG. 26A. LOC162762 BINDING SITE is a binding site found in an untranslated region of LOC162762, corresponding to BINDING SITE of FIG. 26A. FIG. 26D illustrates the complementarity of the nucleotide sequence of LOC162762 BINDING SITE, designated SEQ ID:1201436, to the nucleotide sequence of GAM26 RNA of FIG. 26A, designated SEQ ID:20604. Another function of GAM26 is therefore inhibition of (LOC162762). Accordingly, utilities of GAM26 include diagnosis and treatment of diseases and clinical conditions with which LOC162762 is associated.

Reference is now made to LOC163126 BINDING SITE. LOC163126 is a target gene of GAM26, corresponding to GAM26-TARGET GENE of FIG. 26A. LOC163126 BINDING SITE a binding site found in an untranslated region of LOC163126, corresponding to BINDING SITE of FIG. 26A. FIG. 26D illustrates the complementarity of the nucleotide sequence of LOC163126 BINDING SITE, designated SEQ ID:1201784, to the nucleotide sequence of GAM26 RNA of FIG. 26A, designated SEQ ID:20604. Yet another function of GAM26 is therefore inhibition of (LOC163126). Accordingly, utilities of GAM26 include diagnosis and treatment of diseases and clinical conditions with which LOC163126 is associated.

Reference is now made to LOC163126 BINDING SITE. LOC163126 is a target gene of GAM26, corresponding to GAM26-TARGET GENE of FIG. 26A. LOC163126 BINDING SITE is a binding site found in an untranslated region of LOC163126, corresponding to BINDING SITE of FIG. 26A. FIG. 26D illustrates the complementarity of the nucleotide sequence of LOC163126 BINDING SITE, designated SEQ ID:1201817, to the nucleotide sequence of GAM26 RNA of FIG. 26A, designated SEQ ID:20604. An additional function of GAM26 is therefore inhibition of (LOC163126).

Accordingly, utilities of GAM26 include diagnosis and treatment of diseases and clinical conditions with which LOC163126 is associated.

Reference is now made to LOC165257 BINDING SITE. LOC165257 is a target gene of GAM26, corresponding to GAM26-TARGET GENE of FIG. 26A. LOC165257 BINDING SITE is a binding site found in an untranslated region of LOC165257, corresponding to BINDING SITE of FIG. 26A. FIG. 26D illustrates the complementarity of the nucleotide sequence of LOC165257 BINDING SITE, designated SEQ ID:1205008, to the nucleotide sequence of GAM26 RNA of FIG. 26A, designated SEQ ID:20604. A further function of GAM26 is therefore inhibition of (LOC165257). Accordingly, utilities of GAM26 include diagnosis and treatment of diseases and clinical conditions with which LOC165257 is associated.

Reference is now made to LOC165333 BINDING SITE. LOC165333 is a target gene of GAM26, corresponding to GAM26-TARGET GENE of FIG. 26A. LOC165333 BINDING SITE is a binding site found in an untranslated region of LOC165333, corresponding to BINDING SITE of FIG. 26A. FIG. 26D illustrates the complementarity of the nucleotide sequence of LOC165333 BINDING SITE, designated SEQ ID:1205096, to the nucleotide sequence of GAM26 RNA of FIG. 26A, designated SEQ ID:20604. Yet a further function of GAM26 is therefore inhibition of (LOC165333). Accordingly, utilities of GAM26 include diagnosis and treatment of diseases and clinical conditions with which LOC165333 is associated.

Reference is now made to LOC165552 BINDING SITE. LOC165552 is a target gene of GAM26, corresponding to GAM26-TARGET GENE of FIG. 26A. LOC165552 BINDING SITE is a binding site found in an untranslated region of LOC165552, corresponding to BINDING SITE of FIG. 26A. FIG. 26D illustrates the complementarity of the nucleotide sequence of LOC165552 BINDING SITE, designated SEQ ID:1205248, to the nucleotide sequence of GAM26 RNA of FIG. 26A, designated SEQ ID:20604. Another function of GAM26 is therefore inhibition of (LOC165552). Accordingly, utilities of GAM26 include diagnosis and treatment of diseases and clinical conditions with which LOC165552 is associated.

Reference is now made to LOC196549 BINDING SITE. LOC196549 is a target gene of GAM26, corresponding to GAM26-TARGET GENE of FIG. 26A. LOC196549 BINDING SITE is a binding site found in an untranslated region of LOC196549, corresponding to BINDING SITE of FIG. 26A. FIG. 26D illustrates the complementarity of the nucleotide sequence of LOC196549 BINDING SITE, designated SEQ ID:1213581, to the nucleotide sequence of GAM26 RNA of FIG. 26A, designated SEQ ID:20604. Yet another function of GAM26 is therefore inhibition of (LOC196549). Accordingly, utilities of GAM26 include diagnosis and treatment of diseases and clinical conditions with which LOC196549 is associated.

Reference is now made to LOC202020 BINDING SITE. LOC202020 is a target gene of GAM26, corresponding to GAM26-TARGET GENE of FIG. 26A. LOC202020 BINDING SITE is a binding site found in an untranslated region of LOC202020, corresponding to BINDING SITE of FIG. 26A. FIG. 26D illustrates the complementarity of the nucleotide sequence of LOC202020 BINDING SITE, designated SEQ ID:1240261, to the nucleotide sequence of GAM26 RNA of FIG. 26A, designated SEQ ID:20604. An additional function of GAM26 is therefore inhibition of (LOC202020). Accordingly, utilities of GAM26 include diagnosis and treatment of diseases and clinical conditions with which LOC202020 is associated.

Reference is now made to LOC203197 BINDING SITE. LOC203197 is a target gene of GAM26, corresponding to GAM26-TARGET GENE of FIG. 26A. LOC203197 BINDING SITE is a binding site found in an untranslated region of LOC203197, corresponding to BINDING SITE of FIG. 26A. FIG. 26D illustrates the complementarity of the nucleotide sequence of LOC203197 BINDING SITE, designated SEQ ID:1245216, to the nucleotide sequence of GAM26 RNA of FIG. 26A, designated SEQ ID:20604. A further function of GAM26 is therefore inhibition of (LOC203197). Accordingly, utilities of GAM26 include diagnosis and treatment of diseases and clinical conditions with which LOC203197 is associated.

Reference is now made to LOC203197 BINDING SITE. LOC203197 is a target gene of GAM26, corresponding to GAM26-TARGET GENE of FIG. 26A. LOC203197 BINDING SITE is a binding site found in an untranslated region of LOC203197, corresponding to BINDING SITE of FIG. 26A. FIG. 26D illustrates the complementarity of the nucleotide sequence of LOC203197 BINDING SITE, designated SEQ ID:1245218, to the nucleotide sequence of GAM26 RNA of FIG. 26A, designated SEQ ID:20604. Yet a further function of GAM26 is therefore inhibition of (LOC203197). Accordingly, utilities of GAM26 include diagnosis and treatment of diseases and clinical conditions with which LOC203197 is associated.

Reference is now made to LOC203197 BINDING SITE. LOC203197 is a target gene of GAM26, corresponding to GAM26-TARGET GENE of FIG. 26A. LOC203197 BINDING SITE is a binding site found in an untranslated region of LOC203197, corresponding to BINDING SITE of FIG. 26A. FIG. 26D illustrates the complementarity of the nucleotide sequence of LOC203197 BINDING SITE, designated SEQ ID:1245270, to the nucleotide sequence of GAM26 RNA of FIG. 26A, designated SEQ ID:20604. Another function of GAM26 is therefore inhibition of (LOC203197). Accordingly, utilities of GAM26 include diagnosis and treatment of diseases and clinical conditions with which LOC203197 is associated.

Reference is now made to LOC203668 BINDING SITE. LOC203668 is a target gene of GAM26, corresponding to GAM26-TARGET GENE of FIG. 26A. LOC203668 BINDING SITE is a binding site found in an untranslated region of LOC203668, corresponding to BINDING SITE of FIG. 26A. FIG. 26D illustrates the complementarity of the nucleotide sequence of LOC203668 BINDING SITE, designated SEQ ID:1249923, to the nucleotide sequence of GAM26 RNA of FIG. 26A, designated SEQ ID:20604. Yet another function of GAM26 is therefore inhibition of (LOC203668). Accordingly, utilities of GAM26 include diagnosis and treatment of diseases and clinical conditions with which LOC203668 is associated.

Reference is now made to LOC219333 BINDING SITE. LOC219333 is a target gene of GAM26, corresponding to GAM26-TARGET GENE of FIG. 26A. LOC219333 BINDING SITE is a binding site found in an untranslated region of LOC219333, corresponding to BINDING SITE of FIG. 26A. FIG. 26D illustrates the complementarity of the nucleotide sequence of LOC219333 BINDING SITE, designated SEQ ID:1253262, to the nucleotide sequence of GAM26 RNA of FIG. 26A, designated SEQ ID:20604. An additional function of GAM26 is therefore inhibition of (LOC219333).

Accordingly, utilities of GAM26 include diagnosis and treatment of diseases and clinical conditions with which LOC219333 is associated.

Reference is now made to LOC219333 BINDING SITE. LOC219333 is a target gene of GAM26, corresponding to GAM26-TARGET GENE of FIG. 26A. LOC219333 BINDING SITE is a binding site found in an untranslated region of LOC219333, corresponding to BINDING SITE of FIG. 26A. FIG. 26D illustrates the complementarity of the nucleotide sequence of LOC219333 BINDING SITE, designated SEQ ID:1253264, to the nucleotide sequence of GAM26 RNA of FIG. 26A, designated SEQ ID:20604. A further function of GAM26 is therefore inhibition of (LOC219333). Accordingly, utilities of GAM26 include diagnosis and treatment of diseases and clinical conditions with which LOC219333 is associated.

Reference is now made to LOC219654 BINDING SITE. LOC219654 is a target gene of GAM26, corresponding to GAM26-TARGET GENE of FIG. 26A. LOC219654 BINDING SITE is a binding site found in an untranslated region of LOC219654, corresponding to BINDING SITE of FIG. 26A. FIG. 26D illustrates the complementarity of the nucleotide sequence of LOC219654 BINDING SITE, designated SEQ ID:1256056, to the nucleotide sequence of GAM26 RNA of FIG. 26A, designated SEQ ID:20604. Yet a further function of GAM26 is therefore inhibition of (LOC219654). Accordingly, utilities of GAM26 include diagnosis and treatment of diseases and clinical conditions with which LOC219654 is associated.

Reference is now made to LOC219899 BINDING SITE. LOC219899 is a target gene of GAM26, corresponding to GAM26-TARGET GENE of FIG. 26A. LOC219899 BINDING SITE is a binding site found in an untranslated region of LOC219899, corresponding to BINDING SITE of FIG. 26A. FIG. 26D illustrates the complementarity of the nucleotide sequence of LOC219899 BINDING SITE, designated SEQ ID:1258777, to the nucleotide sequence of GAM26 RNA of FIG. 26A, designated SEQ ID:20604. Another function of GAM26 is therefore inhibition of (LOC219899). Accordingly, utilities of GAM26 include diagnosis and treatment of diseases and clinical conditions with which LOC219899 is associated.

Reference is now made to LOC219899 BINDING SITE. LOC219899 is a target gene of GAM26, corresponding to GAM26-TARGET GENE of FIG. 26A. LOC219899 BINDING SITE is a binding site found in an untranslated region of LOC219899, corresponding to BINDING SITE of FIG. 26A. FIG. 26D illustrates the complementarity of the nucleotide sequence of LOC219899 BINDING SITE, designated SEQ ID:1258810, to the nucleotide sequence of GAM26 RNA of FIG. 26A, designated SEQ ID:20604. Yet another function of GAM26 is therefore inhibition of (LOC219899). Accordingly, utilities of GAM26 include diagnosis and treatment of diseases and clinical conditions with which LOC219899 is associated.

Reference is now made to LOC220058 BINDING SITE. LOC220058 is a target gene of GAM26, corresponding to GAM26-TARGET GENE of FIG. 26A. LOC220058 BINDING is a binding site found in an untranslated region of LOC220058, corresponding to BINDING SITE of FIG. 26A. FIG. 26D illustrates the complementarity of the nucleotide sequence of LOC220058 BINDING SITE, designated SEQ ID:1261177, to the nucleotide sequence of GAM26 RNA of FIG. 26A, designated SEQ ID:20604. An additional function of GAM26 is therefore inhibition of (LOC220058).

Accordingly, utilities of GAM26 include diagnosis and treatment of diseases and clinical conditions with which LOC220058 is associated.

Reference is now made to LOC245726 BINDING SITE. LOC245726 is a target gene of GAM26, corresponding to GAM26-TARGET GENE of FIG. 26A. LOC245726 BINDING SITE is a binding site found in an untranslated region of LOC245726, corresponding to BINDING SITE of FIG. 26A. FIG. 26D illustrates the complementarity of the nucleotide sequence of LOC245726 BINDING SITE, designated SEQ ID:1287683, to the nucleotide sequence of GAM26 RNA of FIG. 26A, designated SEQ ID:20604. A further function of GAM26 is therefore inhibition of (LOC245726). Accordingly, utilities of include diagnosis and treatment of diseases and clinical conditions with which LOC245726 is associated.

Reference is now made to LOC253943 BINDING SITE. LOC253943 is a target gene of GAM26, corresponding to GAM26-TARGET GENE of FIG. 26A. LOC253943 BINDING SITE is a binding site found in an untranslated region of LOC253943, corresponding to BINDING SITE of FIG. 26A. FIG. 26D illustrates the complementarity of the nucleotide sequence of LOC253943 BINDING SITE, designated SEQ ID:1295954, to the nucleotide sequence of GAM26 RNA of FIG. 26A, designated SEQ ID:20604. Yet a further function of GAM26 is therefore inhibition of (LOC253943). Accordingly, utilities of GAM26 include diagnosis and treatment of diseases and clinical conditions with which LOC253943 is associated.

Reference is now made to LOC253943 BINDING SITE. LOC253943 is a target gene of GAM26, corresponding to GAM26-TARGET GENE of FIG. 26A. LOC253943 BINDING SITE is a binding site found in an untranslated region of LOC253943, corresponding to BINDING SITE of FIG. 26A. FIG. 26D illustrates the complementarity of the nucleotide sequence of LOC253943 BINDING SITE, designated SEQ ID:1295956, to the nucleotide sequence of GAM26 RNA of FIG. 26A, designated SEQ ID:20604. Another function of GAM26 is therefore inhibition of (LOC253943). Accordingly, utilities of GAM26 include diagnosis and treatment of diseases and clinical conditions with which LOC253943 is associated.

Reference is now made to LOC253943 BINDING SITE. LOC253943 is a target gene of GAM26, corresponding to GAM26-TARGET GENE of FIG. 26A. LOC253943 BINDING SITE is a binding site found in an untranslated region of LOC253943, corresponding to BINDING SITE of FIG. 26A. FIG. 26D illustrates the complementarity of the nucleotide sequence of LOC253943 BINDING SITE, designated SEQ ID:1295963, to the nucleotide sequence of GAM26 RNA of FIG. 26A, designated SEQ ID:20604. Yet another function of GAM26 is therefore inhibition of (LOC253943). Accordingly, utilities of GAM26 include diagnosis and treatment of diseases and clinical conditions with which LOC253943 is associated.

Reference is now made to LOC253943 BINDING SITE. LOC253943 is a target gene of GAM26, corresponding to GAM26-TARGET GENE of FIG. 26A. LOC253943 BINDING SITE is a binding site found in an untranslated region of LOC253943, corresponding to BINDING SITE of FIG. 26A. FIG. 26D illustrates the complementarity of the nucleotide sequence of LOC253943 BINDING SITE, designated SEQ ID:1295964, to the nucleotide sequence of GAM26 RNA of FIG. 26A, designated SEQ ID:20604. An additional function of GAM26 is therefore inhibition of (LOC253943).

Accordingly, utilities of GAM26 include diagnosis and treatment of diseases and clinical conditions with which LOC253943 is associated.

Reference is now made to LOC254102 BINDING SITE. LOC254102 is a target gene of GAM26, corresponding to GAM26-TARGET GENE of FIG. 26A. LOC254102 BINDING SITE is a binding site found in an untranslated region of LOC254102, corresponding to BINDING SITE of FIG. 26A. FIG. 26D illustrates the complementarity of the nucleotide sequence of LOC254102 BINDING SITE, designated SEQ ID:1298522, to the nucleotide sequence of GAM26 RNA of FIG. 26A, designated SEQ ID:20604. A further function of GAM26 is therefore inhibition of (LOC254102). Accordingly, utilities of GAM26 include diagnosis and treatment of diseases and clinical conditions with which LOC254102 is associated.

Reference is now made to LOC254102 BINDING SITE. LOC254102 is a target gene of GAM26, corresponding to GAM26-TARGET GENE of FIG. 26A. LOC254102 BINDING SITE is a binding site found in an untranslated region of LOC254102, corresponding to BINDING SITE of FIG. 26A. FIG. 26D illustrates the complementarity of the nucleotide sequence of LOC254102 BINDING SITE, designated SEQ ID:1298528, to the nucleotide sequence of GAM26 RNA of FIG. 26A, designated SEQ ID:20604. Yet a further function of GAM26 is therefore inhibition of (LOC254102). Accordingly, utilities of GAM26 include diagnosis and treatment of diseases and clinical conditions with which LOC254102 is associated.

Reference is now made to LOC254107 BINDING SITE. LOC254107 is a target gene of GAM26, corresponding to GAM26-TARGET GENE of FIG. 26A. LOC254107 BINDING SITE is a binding site found in an untranslated region of LOC254107, corresponding to BINDING SITE of FIG. 26A. FIG. 26D illustrates the complementarity of the nucleotide sequence of LOC254107 BINDING SITE, designated SEQ ID:1298621, to the nucleotide sequence of GAM26 RNA of FIG. 26A, designated SEQ ID:20604. Another function of GAM26 is therefore inhibition of (LOC254107). Accordingly, utilities of GAM26 include diagnosis and treatment of diseases and clinical conditions with which LOC254107 is associated.

Reference is now made to LOC254573 BINDING SITE. LOC254573 is a target gene of GAM26, corresponding to GAM26-TARGET GENE of FIG. 26A. LOC254573 BINDING SITE is a binding site found in an untranslated region of LOC254573, corresponding to BINDING SITE of FIG. 26A. FIG. 26D illustrates the complementarity of the nucleotide sequence of LOC254573 BINDING SITE, designated SEQ ID:1303366, to the nucleotide sequence of GAM26 RNA of FIG. 26A, designated SEQ ID:20604. Yet another function of GAM26 is therefore inhibition of (LOC254573). Accordingly, utilities of GAM26 include diagnosis and treatment of diseases and clinical conditions with which LOC254573 is associated.

Reference is now made to LOC255028 BINDING SITE. LOC255028 is a target gene of GAM26, corresponding to GAM26-TARGET GENE of FIG. 26A. LOC255028 BINDING SITE is a binding site found in an untranslated region of LOC255028, corresponding to BINDING SITE of FIG. 26A. FIG. 26D illustrates the complementarity of the nucleotide sequence of LOC255028 BINDING SITE, designated SEQ ID:1306373, to the nucleotide sequence of GAM26 RNA of FIG. 26A, designated SEQ ID:20604. An additional function of GAM26 is therefore inhibition of (LOC255028). Accordingly, utilities of GAM26 include diagnosis and treatment of diseases and clinical conditions with which LOC255028 is associated.

Reference is now made to LOC255056 BINDING SITE. LOC255056 is a target gene of GAM26, corresponding to GAM26-TARGET GENE of FIG. 26A. LOC255056 BINDING SITE is a binding site found in an untranslated region of LOC255056, corresponding to BINDING SITE of FIG. 26A. FIG. 26D illustrates the complementarity of the nucleotide sequence of LOC255056 BINDING SITE, designated SEQ ID:1307405, to the nucleotide sequence of GAM26 RNA of FIG. 26A, designated SEQ. ID:20604. A further function of GAM26 is therefore inhibition of (LOC255056). Accordingly, utilities of GAM26 include diagnosis and treatment of diseases and clinical conditions with which LOC255056 is associated.

Reference is now made to LOC255426 BINDING SITE. LOC255426 is a target gene of GAM26, corresponding to GAM26-TARGET GENE of FIG. 26A. LOC255426 BINDING SITE is a binding site found in an untranslated region of LOC255426, corresponding to BINDING SITE of FIG. 26A. FIG. 26D illustrates the complementarity of the nucleotide sequence of LOC255426 BINDING SITE, designated SEQ ID:1310952, to the nucleotide sequence of GAM26 RNA of FIG. 26A, designated SEQ ID:20604. Yet a further function of GAM26 is therefore inhibition of (LOC255426). Accordingly, utilities of GAM26 include diagnosis and treatment of diseases and clinical conditions with which LOC255426 is associated.

Reference is now made to LOC255426 BINDING SITE. LOC255426 is a target gene of GAM26, corresponding to GAM26-TARGET GENE of FIG. 26A. LOC255426 BINDING SITE is a binding site found in an untranslated region of LOC255426, corresponding to BINDING SITE of FIG. 26A. FIG. 26D illustrates the complementarity of the nucleotide sequence of LOC255426 BINDING SITE, designated SEQ ID:1310952, to the nucleotide sequence of GAM26 RNA of FIG. 26A, designated SEQ ID:20604. Another function of GAM26 is therefore inhibition of (LOC255426). Accordingly, utilities of GAM26 include diagnosis and treatment of diseases and clinical conditions with which LOC255426 is associated.

Reference is now made to LOC146223 BINDING SITE. LOC146223 is a target gene of GAM26, corresponding to GAM26-TARGET GENE of FIG. 26A. LOC146223 BINDING SITE is a binding site found in an untranslated region of LOC146223, corresponding to BINDING SITE of FIG. 26A. FIG. 26D illustrates the complementarity of the nucleotide sequence of LOC146223 BINDING SITE, designated SEQ ID:1310953, to the nucleotide sequence of GAM26 RNA of FIG. 26A, designated SEQ ID:20604. Yet another function of GAM26 is therefore inhibition of (LOC146223). Accordingly, utilities of GAM26 include diagnosis and treatment of diseases and clinical conditions with which LOC146223 is associated.

Reference is now made to LOC255426 BINDING SITE. LOC255426 is a target gene of GAM26, corresponding to GAM26-TARGET GENE of FIG. 26A. LOC255426 BINDING SITE is a binding site found in an untranslated region of LOC255426, corresponding to BINDING SITE of FIG. 26A. FIG. 26D illustrates the complementarity of the nucleotide sequence of LOC255426 BINDING SITE, designated SEQ ID:1310953, to the nucleotide sequence of GAM26 RNA of FIG. 26A, designated SEQ ID:20604. An additional function of GAM26 is therefore inhibition of (LOC255426).

Accordingly, utilities of GAM26 include diagnosis and treatment of diseases and clinical conditions with which LOC255426 is associated.

Reference is now made to LOC201780 BINDING SITE. LOC201780 is a target gene of GAM26, corresponding to GAM26-TARGET GENE of FIG. 26A. LOC201780 BINDING SITE is a binding site found in an untranslated region of LOC201780, corresponding to BINDING SITE of FIG. 26A. FIG. 26D illustrates the complementarity of the nucleotide sequence of LOC201780 BINDING SITE, designated SEQ ID:1317863, to the nucleotide sequence of GAM26 RNA of FIG. 26A, designated SEQ ID:20604. A further function of GAM26 is therefore inhibition of (LOC201780). Accordingly, utilities of GAM26 include diagnosis and treatment of diseases and clinical conditions with which LOC201780 is associated.

Reference is now made to LOC256160 BINDING SITE. LOC256160 is a target gene of GAM26, corresponding to GAM26-TARGET GENE of FIG. 26A. LOC256160 BINDING SITE is a binding site found in an untranslated region of LOC256160, corresponding to BINDING SITE of FIG. 26A. FIG. 26D illustrates the complementarity of the nucleotide sequence of LOC256160 BINDING SITE, designated SEQ ID:1317863, to the nucleotide sequence of GAM26 RNA of FIG. 26A, designated SEQ ID:20604. Yet a further function of GAM26 is therefore inhibition of (LOC256160). Accordingly, utilities of GAM26 include diagnosis and treatment of diseases and clinical conditions with which LOC256160 is associated.

Reference is now made to LOC256537 BINDING SITE. LOC256537 is a target gene of GAM26, corresponding to GAM26-TARGET GENE of FIG. 26A. LOC256537 BINDING SITE is a binding site found in an untranslated region of LOC256537, corresponding to BINDING SITE of FIG. 26A. FIG. 26D illustrates the complementarity of the nucleotide sequence of LOC256537 BINDING SITE, designated SEQ ID:1321461, to the nucleotide sequence of GAM26 RNA of FIG. 26A, designated SEQ ID:20604. Another ion of GAM26 is therefore inhibition of (LOC256537). Accordingly, utilities of GAM26 include diagnosis and treatment of diseases and clinical conditions with which LOC256537 is associated.

Reference is now made to LOC256586 BINDING SITE. LOC256586 is a target gene of GAM26, corresponding to GAM26-TARGET GENE of FIG. 26A. LOC256586 BINDING SITE is a binding site found in an untranslated region of LOC256586, corresponding to BINDING SITE of FIG. 26A. FIG. 26D illustrates the complementarity of the nucleotide sequence of LOC256586 BINDING SITE, designated SEQ ID:1321729, to the nucleotide sequence of GAM26 RNA of FIG. 26A, designated SEQ ID:20604. Yet another function of GAM26 is therefore inhibition of (LOC256586). Accordingly, utilities of GAM26 include diagnosis and treatment of diseases and clinical conditions with which LOC256586 is associated.

Reference is now made to LOC256812 BINDING SITE. LOC256812 is a target gene of GAM26, corresponding to GAM26-TARGET. GENE of FIG. 26A. LOC256812 BINDING SITE is a binding site found in an untranslated region of LOC256812, corresponding to BINDING SITE of FIG. 26A. FIG. 26D illustrates the complementarity of the nucleotide sequence of LOC256812. BINDING SITE, designated SEQ ID:1322939, to the nucleotide sequence of GAM26 RNA of FIG. 26A, designated SEQ ID:20604. An additional function of GAM26 is therefore inhibition of (LOC256812). Accordingly, utilities of GAM26 include diagnosis and treatment of diseases and clinical conditions with which LOC256812 is associated.

Reference is now made to LOC256905 BINDING SITE. LOC256905 is a target gene of GAM26, corresponding to GAM26-TARGET GENE of FIG. 26A. LOC256905 BINDING SITE is a binding site found in an untranslated region of LOC256905, corresponding to BINDING SITE of FIG. 26A. FIG. 26D illustrates the complementarity of the nucleotide sequence of LOC256905 BINDING SITE, designated SEQ ID:1323732, to the nucleotide sequence of GAM26 RNA of FIG. 26A, designated SEQ ID:20604. A further function of GAM26 is therefore inhibition of (LOC256905). Accordingly, utilities of GAM26 include diagnosis and treatment of diseases and clinical conditions with which LOC256905 is associated.

Reference is now made to LOC256905 BINDING SITE. LOC256905 is a target gene of GAM26, corresponding to GAM26-TARGET GENE of FIG. 26A. LOC256905 BINDING SITE is a binding site found in an untranslated region of LOC256905, corresponding to BINDING SITE of FIG. 26A. FIG. 26D illustrates the complementarity of the nucleotide sequence of LOC256905 BINDING SITE, designated SEQ ID:1323749, to the nucleotide sequence of GAM26 RNA of FIG. 26A, designated SEQ ID:20604. Yet a further function of GAM26 is therefore inhibition of (LOC256905). Accordingly, utilities of GAM26 include diagnosis and treatment of diseases and clinical conditions with which LOC256905 is associated.

Reference is now made to LOC256905 BINDING SITE. LOC256905 is a target gene of GAM26, corresponding to GAM26-TARGET GENE of FIG. 26A. LOC256905 BINDING SITE is a binding site found in an untranslated region of LOC256905, corresponding to BINDING SITE of FIG. 26A. FIG. 26D illustrates the complementarity of the nucleotide sequence of LOC256905 BINDING SITE, designated SEQ ID:1323750, to the nucleotide sequence of GAM26 RNA of FIG. 26A, designated SEQ ID:20604. Another function of GAM26 is therefore inhibition of (LOC256905). Accordingly, utilities of GAM26 include diagnosis and treatment of diseases and clinical conditions with which LOC256905 is associated.

Reference is now made to LOC257222 BINDING SITE. LOC257222 is a target gene of GAM26, corresponding to GAM26-TARGET GENE of FIG. 26A. LOC257222 BINDING SITE is a binding site found in an untranslated region of LOC257222, corresponding to BINDING SITE of FIG. 26A. FIG. 26D illustrates the complementarity of the nucleotide sequence of LOC257222 BINDING SITE, designated SEQ ID:1326885, to the nucleotide sequence of GAM26 RNA of FIG. 26A, designated SEQ ID:20604. Yet another function of GAM26 is therefore inhibition of (LOC257222). Accordingly, utilities of GAM26 include diagnosis and treatment of diseases and clinical conditions with which LOC257222 is associated.

Reference is now made to LOC257479 BINDING SITE. LOC257479 is a target gene of GAM26, corresponding to GAM26-TARGET GENE of FIG. 26A. LOC257479 BINDING SITE is a binding site found in an untranslated region of LOC257479, corresponding to BINDING SITE of FIG. 26A. FIG. 26D illustrates the complementarity of the nucleotide sequence of LOC257479 BINDING SITE, designated SEQ ID:1330681, to the nucleotide sequence of GAM26 RNA of FIG. 26A, designated SEQ ID:20604. An additional function of GAM26 is therefore inhibition of (LOC257479). Accordingly, utilities of GAM26 include diagnosis and treatment of diseases and clinical conditions with which LOC257479 is associated.

Reference is now made to LOC257479 BINDING SITE. LOC257479 is a target gene of GAM26, corresponding to GAM26-TARGET GENE of FIG. 26A. LOC257479 BINDING SITE is a binding site found in an untranslated region of LOC257479, corresponding to BINDING SITE of FIG. 26A. FIG. 26D illustrates the complementarily of the nucleotide sequence of LOC257479 BINDING SITE, designated SEQ ID:1330687, to the nucleotide sequence of GAM26 RNA of FIG. 26A, designated SEQ ID:20604. A further function of GAM26 is therefore inhibition of (LOC257479). Accordingly, utilities of GAM26 include diagnosis and treatment of diseases and clinical conditions with which LOC257479 is associated.

Reference is now made to LOC257479 BINDING SITE. LOC257479 is a target gene of GAM26, corresponding to GAM26-TARGET GENE of FIG. 26A. LOC257479 BINDING SITE is a binding site found in an untranslated region of LOC257479, corresponding to BINDING SITE of FIG. 26A. FIG. 26D illustrates the complementarity of the nucleotide sequence of LOC257479 BINDING SITE, designated SEQ ID:1330706, to the nucleotide sequence of GAM26 RNA of FIG. 26A, designated SEQ ID:20604. Yet a further function of GAM26 is therefore inhibition of (LOC257479). Accordingly, utilities of GAM26 include diagnosis and treatment of diseases and clinical conditions with which LOC257479 is associated.

Reference is now made to LOC257479 BINDING SITE. LOC257479 is a target gene of GAM26, corresponding to GAM26-TARGET GENE of FIG. 26A. LOC257479 BINDING SITE is a binding site found in an untranslated region of LOC257479, corresponding to BINDING SITE of FIG. 26A. FIG. 26D illustrates the complementarity of the nucleotide sequence of LOC257479 BINDING SITE, designated SEQ ID:1330708, to the nucleotide sequence of GAM26 RNA of FIG. 26A, designated SEQ ID:20604. Another function of GAM26 is therefore inhibition of (LOC257479). Accordingly, utilities of GAM26 include diagnosis and treatment of diseases and clinical conditions with which LOC257479 is associated.

Reference is now made to LOC51061 BINDING SITE. LOC51061 is a target gene of GAM26, corresponding to GAM26-TARGET GENE of FIG. 26A. LOC51061 BINDING is a binding site found in an untranslated region of LOC51061, corresponding to BINDING SITE of FIG. 26A. FIG. 26D illustrates the complementarity of the nucleotide sequence of LOC51061 BINDING SITE, designated SEQ ID:1335336, to the nucleotide sequence of GAM26 RNA of FIG. 26A, designated SEQ ID:20604. Yet another function of GAM26 is therefore inhibition of (LOC51061). Accordingly, utilities of GAM26 include diagnosis and treatment of diseases and clinical conditions with which LOC51061 is associated.

Reference is now made to LOC55829 BINDING SITE. LOC55829 is a target gene of GAM2, corresponding to GAM26-TARGET GENE of FIG. 26A. LOC55829 BINDING SITE is a binding site found in an untranslated region of LOC55829, corresponding to BINDING SITE of FIG. 26A. FIG. 26D illustrates the complementarity of the nucleotide sequence of LOC55829 BINDING SITE, designated SEQ ID:1343670, to the nucleotide sequence of GAM26 RNA of FIG. 26A, designated SEQ ID:20604. An additional function of GAM26 is therefore inhibition of (LOC55829). Accordingly, utilities of GAM26 include diagnosis and treatment of diseases and clinical conditions with which LOC55829 is associated.

Reference is now made to LOC55829 BINDING SITE. LOC55829 is a target gene of GAM26, corresponding to GAM26-TARGET GENE of FIG. 26A. LOC55829 BINDING SITE is a binding site found in an untranslated region of LOC55829, corresponding to BINDING SITE of FIG. 26A. FIG. 26D illustrates the complementarity of the nucleotide sequence of LOC55829 BINDING SITE, designated SEQ ID:1343683, to the nucleotide sequence of GAM26 RNA of FIG. 26A, designated SEQ ID:20604. A further function of GAM26 is therefore inhibition of (LOC55829). Accordingly, utilities of GAM26 include diagnosis and treatment of diseases and clinical conditions with which LOC55829 is associated.

Reference is now made to LOC57795 BINDING SITE. LOC57795 is a target gene of GAM26, corresponding to GAM26-TARGET GENE of FIG. 26A. LOC57795 BINDING SITE is a binding site found in an untranslated region of LOC57795, corresponding to BINDING SITE of FIG. 26A. FIG. 26D illustrates the complementarity of the nucleotide sequence of LOC57795 BINDING SITE, designated SEQ ID:1347000, to the nucleotide sequence of GAM26 RNA of FIG. 26A, designated SEQ ID:20604. Yet a further function of GAM26 is therefore inhibition of (LOC57795). Accordingly, utilities of GAM26 include diagnosis and treatment of diseases and clinical conditions with which LOC57795 is associated.

Reference is now made to LOC84548 BINDING SITE. LOC84548 is a target gene of GAM26, corresponding to GAM26-TARGET GENE of FIG. 26A. LOC84548 BINDING SITE is a binding site found in an untranslated region of LOC84548, corresponding to BINDING SITE of FIG. 26A. FIG. 26D illustrates the complementarity of the nucleotide sequence of LOC84548 BINDING SITE, designated SEQ ID:1349247, to the nucleotide sequence of GAM26 RNA of FIG. 26A, designated SEQ ID:20604. Another function of GAM26 is therefore inhibition of (LOC84548). Accordingly, utilities of include diagnosis and treatment of diseases and clinical conditions with which LOC84548 is associated.

Reference is now made to LOC84548 BINDING SITE. LOC84548 is a target gene of GAM26, corresponding to GAM26-TARGET GENE of FIG. 26A. LOC84548 BINDING SITE is a binding site found in an untranslated region of LOC84548, corresponding to BINDING SITE of FIG. 26A. FIG. 26D illustrates the complementarity of the nucleotide sequence of LOC84548 BINDING SITE, designated SEQ ID:1349248, to the nucleotide sequence of GAM26 RNA of FIG. 26A, designated SEQ ID:20604. Yet another function of GAM26 is therefore inhibition of (LOC84548). Accordingly, utilities of GAM26 include diagnosis and treatment of diseases and clinical conditions with which LOC84548 is associated.

Reference is now made to LOC84548 BINDING SITE. LOC84548 is a target gene of GAM26, corresponding to GAM26-TARGET GENE of FIG. 26A. LOC84548 BINDING SITE is a binding site found in an untranslated region of LOC84548, corresponding to BINDING SITE of FIG. 26A. FIG. 26D illustrates the complementarity of the nucleotide sequence of LOC84548 BINDING SITE, designated SEQ ID:1349283, to the nucleotide sequence of GAM26 RNA of FIG. 26A, designated SEQ ID:20604. An additional function of GAM26 is therefore inhibition of (LOC84548). Accordingly, utilities of 4M26 include diagnosis and treatment of diseases and clinical conditions with which LOC84548 is associated.

Reference is now made to LOC84548 BINDING SITE. LOC84548 is a target gene of GAM26, corresponding to GAM26-TARGET GENE of FIG. 26A. LOC84548 BINDING SITE is a binding site found in an untranslated region of LOC84548, corresponding to BINDING SITE of FIG. 26A. FIG. 26D illustrates the complementarity of the nucleotide sequence of LOC84548 BINDING SITE, designated SEQ ID:1349284, to the nucleotide sequence of GAM26 RNA of FIG. 26A, designated SEQ ID:20604. A further function of GAM26 is therefore inhibition of (LOC84548). Accordingly, utilities of GAM26 include diagnosis and treatment of diseases and clinical conditions with which LOC84548 is associated.

Reference is now made to LOC86010 BINDING SITE. LOC86010 is a target gene of GAM26, corresponding to GAM26-TARGET GENE of FIG. 26A. LOC86010 BINDING SITE is a binding site found in an untranslated region of LOC86010, corresponding to BINDING SITE of FIG. 26A. FIG. 26D illustrates the complementarity of the nucleotide sequence of LOC86010 BINDING SITE, designated SEQ ID:1349829, to the nucleotide sequence of GAM26 RNA of FIG. 26A, designated SEQ ID:20604. Yet a further function of GAM26 is therefore inhibition of (LOC86010). Accordingly, utilities of GAM26 include diagnosis and treatment of diseases and clinical conditions with which LOC86010 is associated.

Reference is now made to LOC86010 BINDING SITE. LOC86010 is a target gene of GAM26, corresponding to GAM26-TARGET GENE of FIG. 26A. LOC86010 BINDING SITE is a binding site found in an untranslated region of LOC86010, corresponding to BINDING SITE of FIG. 26A. FIG. 26D illustrates the complementarity of the nucleotide sequence of LOC86010 BINDING SITE, designated SEQ ID:1349832, to the nucleotide sequence of GAM26 RNA of FIG. 26A, designated SEQ ID:20604. Another function of GAM26 is therefore inhibition of (LOC86010). Accordingly, utilities of GAM26 include diagnosis and treatment of diseases and clinical conditions with which LOC86010 is associated.

Reference is now made to LOC90379 BINDING SITE. LOC90379 is a target gene of GAM26, corresponding to GAM26-TARGET GENE of FIG. 26A. LOC90379 BINDING SITE is a binding site found in an untranslated region of LOC90379, corresponding to BINDING SITE of FIG. 26A. FIG. 26D illustrates the complementarity of the nucleotide sequence of LOC90379 BINDING SITE, designated SEQ ID:1356590, to the nucleotide sequence of GAM26 RNA of FIG. 26A, designated SEQ ID:20604. Yet another function of GAM26 is therefore inhibition of (LOC90379). Accordingly, utilities of GAM26 include diagnosis and treatment of diseases and clinical conditions with which LOC90379 is associated.

Reference is now made to LOC90835 BINDING SITE. LOC90835 is a target gene of GAM26, corresponding to GAM26-TARGET GENE of FIG. 26A. LOC90835 BINDING SITE is a binding site found in an untranslated region of LOC90835, corresponding to BINDING SITE of FIG. 26A. FIG. 26D illustrates the complementarity of the nucleotide sequence of LOC90835 BINDING SITE, designated SEQ ID:1362330, to the nucleotide sequence of GAM26 RNA of FIG. 26A, designated SEQ ID:20604. An additional function of GAM26 is therefore inhibition of (LOC90835). Accordingly, utilities of GAM26 include diagnosis and treatment of diseases and clinical conditions with which LOC90835 is associated.

Reference is now made to LOC90835 BINDING SITE. LOC90835 is a target gene of GAM26, corresponding to GAM26-TARGET GENE of FIG. 26A. LOC90835 BINDING SITE is a binding site found in an untranslated region of LOC90835, corresponding to BINDING SITE of FIG. 26A. FIG. 26D illustrates the complementarity of the nucleotide sequence of LOC90835 BINDING SITE, designated SEQ ID:1362338, to the nucleotide sequence of GAM26 RNA of FIG. 26A, designated SEQ ID:20604. A further function of GAM26 is therefore inhibition of (LOC90835). Accordingly, utilities of GAM26 include diagnosis and treatment of diseases and clinical conditions with which LOC90835 is associated.

Reference is now made to LOC90874 BINDING SITE. LOC90874 is a target gene of GAM26, corresponding to GAM26-TARGET GENE of FIG. 26A. LOC90874 BINDING SITE is a binding site found in an untranslated region of LOC90874, corresponding to BINDING SITE of FIG. 26A. FIG. 26D illustrates the complementarity of the nucleotide sequence of LOC90874 BINDING SITE, designated SEQ ID:1362769, to the nucleotide sequence of GAM26 RNA of FIG. 26A, designated SEQ ID:20604. Yet a further function of GAM26 is therefore inhibition of (LOC90874). Accordingly, utilities of GAM26 include diagnosis and treatment of diseases and clinical conditions with which LOC90874 is associated.

Reference is now made to LOC91050 BINDING SITE. LOC91050 is a target gene of GAM26, corresponding to GAM26-TARGET GENE of FIG. 26A. LOC91050 BINDING SITE is a binding site found in an untranslated region of LOC91050, corresponding to BINDING SITE of FIG. 26A. FIG. 26D illustrates the complementarity of the nucleotide sequence of LOC91050 BINDING SITE, designated SEQ ID:1364688, to the nucleotide sequence of GAM26 RNA of FIG. 26A, designated SEQ ID:20604. Another function of GAM26 is therefore inhibition of (LOC91050). Accordingly, utilities of GAM26 include diagnosis and treatment of diseases and clinical conditions with which LOC91050 is associated.

Reference is now made to LOC91050 BINDING SITE. LOC91050 is a target gene of GAM26, corresponding to GAM26-TARGET GENE of FIG. 26A. LOC91050 BINDING SITE is a binding site found in an untranslated region of LOC91050, corresponding to BINDING SITE of FIG. 26A. FIG. 26D illustrates the complementarity of the nucleotide sequence of LOC91050 BINDING SITE, designated SEQ ID:1364726, to the nucleotide sequence of GAM26 RNA of FIG. 26A, designated SEQ ID:20604. Yet another function of GAM26 is therefore inhibition of (LOC91050). Accordingly, utilities of include diagnosis and treatment of diseases and clinical conditions with which LOC91050 is associated.

Reference is now made to LOC91050 BINDING SITE. LOC91050 is a target gene of GAM26, corresponding to GAM26-TARGET GENE of FIG. 26A. LOC91050 BINDING SITE is a binding site found in an untranslated region of LOC91050, corresponding to BINDING SITE of FIG. 26A. FIG. 26D illustrates the complementarity of the nucleotide sequence of LOC91050 BINDING SITE, designated SEQ ID:1364727, to the nucleotide sequence of GAM26 RNA of FIG. 26A, designated SEQ ID:20604. An additional function of GAM26 is therefore inhibition of (LOC91050). Accordingly, utilities of GAM26 include diagnosis and treatment of diseases and clinical conditions with which LOC91050 is associated.

Reference is now made to LOC91300 BINDING SITE. LOC91300 is a target gene of GAM26, corresponding to GAM26-TARGET GENE of FIG. 26A. LOC91300 BINDING SITE is a binding site found in an untranslated region of LOC91300, corresponding to BINDING SITE of FIG. 26A. FIG. 26D illustrates the complementarity of the nucleotide sequence of LOC91300 BINDING SITE, designated SEQ ID:1367936, to the nucleotide sequence of GAM26

RNA of FIG. 26A, designated SEQ ID:20604. A further function of GAM26 is therefore inhibition of (LOC91300). Accordingly, utilities of GAM6 include diagnosis and treatment of diseases and clinical conditions with which LOC91300 is associated.

Reference is now made to LOC91300 BINDING SITE. LOC91300 is a target gene of GAM26, corresponding to GAM26-TARGET GENE of FIG. 26A. LOC91300 BINDING SITE is a binding site found in an untranslated region of LOC91300, corresponding to BINDING SITE of FIG. 26A. FIG. 26D illustrates the complementarity of the nucleotide sequence of LOC91300 BINDING SITE, designated SEQ ID:1367936, to the nucleotide sequence of GAM26 RNA of FIG. 26A, designated SEQ ID:20604. Yet a further function of GAM26 is therefore inhibition of (LOC91300). Accordingly, utilities of GAM26 include diagnosis and treatment of diseases and clinical conditions with which LOC91300 is associated.

Reference is now made to LOC91978 BINDING SITE. LOC91978 is a target gene of GAM26, corresponding to GAM26-TARGET GENE of FIG. 26A. LOC91978 BINDING SITE is a binding site found in an untranslated region of LOC91978, corresponding to BINDING SITE of FIG. 26A. FIG. 26D illustrates the complementarity of the nucleotide sequence of LOC91978 BINDING SITE, designated SEQ ID:1375053, to the nucleotide sequence of GAM26 RNA of FIG. 26A, designated SEQ ID:20604. Another function of GAM26 is therefore inhibition of (LOC91978). Accordingly, utilities of include diagnosis and treatment of diseases and clinical conditions with which LOC91978 is associated.

Reference is now made to LOC92181 BINDING SITE. LOC92181 is a target gene of GAM26, corresponding to GAM26-TARGET GENE of FIG. 26A. LOC92181 BINDING SITE is a binding site found in an untranslated region of LOC92181, corresponding to BINDING SITE of FIG. 26A. FIG. 26D illustrates the complementarity of the nucleotide sequence of LOC92181 BINDING SITE, designated SEQ ID:1376487, to the nucleotide sequence of GAM26 RNA of FIG. 26A, designated SEQ ID:20604. Yet another function of GAM26 is therefore inhibition of (LOC92181). Accordingly, utilities of GAM26 include diagnosis and treatment of diseases and clinical conditions with which LOC92181 is associated.

Reference is now made to LOC92299 BINDING SITE. LOC92299 is a target gene of GAM26, corresponding to GAM26-TARGET GENE of FIG. 26A. LOC92299 BINDING SITE is a binding site found in an untranslated region of LOC92299, corresponding to BINDING SITE of FIG. 26A. FIG. 26D illustrates the complementarity of the nucleotide sequence of LOC92299 BINDING SITE, designated SEQ ID:1377998, to the nucleotide sequence of GAM26 RNA of FIG. 26A, designated SEQ ID:20604. An additional function of GAM26 is therefore inhibition of (LOC92299). Accordingly, utilities of GAM26 include diagnosis and treatment of diseases and clinical conditions with which LOC92299 is associated.

Figures 27A, 27B, 27C:
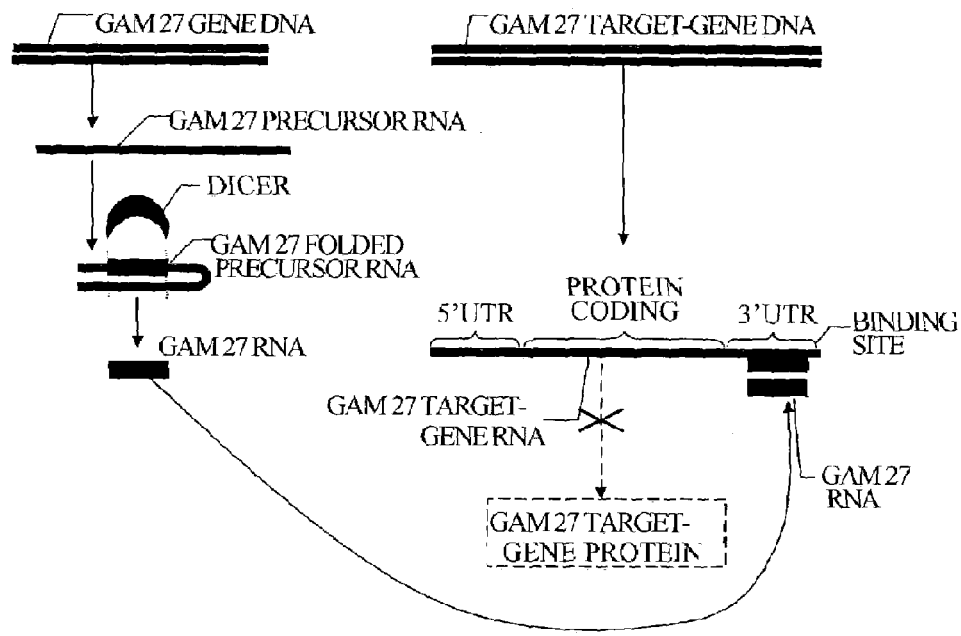

Reference is now made to FIG. 27A, which is a simplified diagram providing a conceptual explanation of the mode by which a novel bioinformatically detected gene, referred to here as GAM27 modulates expression of target genes thereof, the function and utility of which target genes is known in the art.

GAM27 (Genomic Address Messenger 27) is a novel bioinformatically detected regulatory, non protein coding, micro RNA (miRNA) gene. The method by which GAM27 was detected is described hereinabove with reference to FIGS. 6-15.

GAM27 GENE and GAM27-TARGET GENE are two human genes contained in the human genome.

GAM27 GENE encodes a GAM27 PRECURSOR RNA. Similar to other miRNA genes, and unlike most ordinary genes, the RNA transcribed by GAM27, GAM27 PRECURSOR RNA, does not encode a protein.

GAM27 PRECURSOR RNA folds onto itself, forming GAM27 FOLDED PRECURSOR RNA. As FIG. 27 illustrates, GAM27 FOLDED PRECURSOR RNA forms a 'hairpin structure', folding onto itself. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof. By "inversed-reversed" is meant a sequence which is reversed and wherein each nucleotide is replaced by a complimentary nucleotide, as is well known in the art (e.g. ATGGC is the inversed-reversed sequence of GCCAT).

An enzyme complex designated DICER COMPLEX, 'dices' the GAM27 FOLDED PRECURSOR RNA into a single stranded ~22 nt long RNA segment, designated GAM27 RNA. As is known in the art, 'dicing' of a hairpin structured RNA precursor product into short a ~22 nt RNA segment is catalyzed by an enzyme complex comprising an enzyme called Dicer together with other necessary proteins.

GAM27-TARGET GENE encodes a corresponding messenger RNA, designated GAM27-TARGET RNA. GAM27-TARGET RNA comprises three regions, as is typical of mRNA of a protein coding gene: a 5' untranslated region, a protein coding region and a 3' untranslated region, designated 5'UTR, PROTEIN CODING and 3'UTR respectively.

GAM27 RNA binds complimentarily to a BINDING SITE, located on an untranslated region of GAM27-TARGET RNA. This complimentarily binding is due to the fact that the nucleotide sequence of GAM27 RNA is an accurate or a partial inversed-reversed sequence of the nucleotide sequence of BINDING SITE. It is appreciated that while FIG. 27A depicts the BINDING SITE on the 3'UTR region, this is meant as an example only—the BINDING SITE nay be located on the 5'UTR region as well.

The complimentary binding of GAM27 RNA to BINDING SITE inhibits translation of GAM27-TARGET RNA into GAM27-TARGET PROTEIN. GAM27-TARGET PROTEIN is therefore outlined by a broken line.

It is appreciated that GAM27-TARGET GENE in fact represents a plurality of target genes of GAM27. The mRNA of each of this plurality of target genes of GAM27 comprises a BINDING SITE, having a nucleotide sequence which is at least partly complementary to GAM27 RNA, and which when bound by GAM27 RNA causes inhibition of translation of one of a plurality of target proteins of GAM27. The plurality of target genes of GAM27 and their respective binding sites, are described hereinbelow with reference to FIG. 27D.

It is appreciated by one skilled in the art that the mode of translational inhibition illustrated by FIG. 27 with specific reference to translational inhibition exerted by GAM27 on one or more target genes of GAM27, is in fact common to other known miRNA genes. As mentioned hereinabove with reference to the background section, although a specific complimentary binding site has been demonstrated only for miRNA genes Lin-4 and Let-7, all other recently discovered miRNA genes are also believed by those skilled in the art to modulate expression of other genes by complimentary binding, although specific complimentary binding sites of these genes have not yet been found (Ruvkun G., 'Perspective: Glimpses of a tiny RNA world', Science 294, 779 (2001)).

Reference is now made to FIG. 27B which shows the nucleotide sequence of GAM27 PRECURSOR RNA of FIG. 27A, designated SEQ ID:4, and a probable nucleotide sequence of GAM27 RNA of FIG. 27A, designated SEQ ID:20605. The nucleotide sequence of SEQ ID:20605, which is highly likely (over 0.887508%) to be identical or highly similar to that of GAM27, is marked by an underline within the sequence of GAM27 PRECURSOR RNA.

Reference is now made to FIG. 27C, which shows the secondary folding of GAM27 PRECURSOR RNA forming a 'hairpin structure' designated GAM27 FOLDED PRECURSOR RNA, both of FIG. 27A. A probable (>0.887508%) nucleotide sequence of GAM27 RNA, designated SEQ ID:20605 of FIG. 27B, is marked by an underline on GAM27 FOLDED PRECURSOR RNA. It is appreciated that the complimentary base-paring is not perfect, with 'bulges', as is well known in the art with respect to the RNA folding of all known miRNA genes.

Reference is now made to FIG. 27D, which is a table showing binding sites found in untranslated regions of a plurality of target genes of GAM27, each binding site corresponding to BINDING SITE of FIG. 27A, and their complementarity to SEQ ID:20605, which is highly likely (>0.887508%) to be identical or highly similar to the nucleotide sequence of GAM27 RNA of FIG. 27A.

It is appreciated that the functions, and accordingly the utilities, of GAM27 correlate with, and may be deduced from, the identity of the target genes which GAM27 binds and inhibits, and the function of these target genes, as elaborated hereinbelow.

Reference is now made to DEC1 BINDING SITE. Deleted in esophageal cancer 1 (DEC1) is a target gene of GAM27, corresponding to GAM27-TARGET GENE of FIG. 27A. DEC1 BINDING SITE is a binding site found in an untranslated region of DEC1, corresponding to BINDING SITE of FIG. 27A. FIG. 27D illustrates the complementarity of the nucleotide sequence of DEC1 BINDING SITE, designated SEQ ID:131107, to the nucleotide sequence of GAM27 RNA of FIG. 27A, designated SEQ ID:20605.

A function of GAM27 is therefore inhibition of deleted in esophageal cancer 1 (DEC1), a gene which encodes a protein that acts as a tumor suppressor associated with esophageal cancer, and is associated with esophageal cancer. Accordingly, utilities of GAM27 include diagnosis and treatment of the abovementioned diseases and clinical conditions.

The function of DEC1 has been established by previous studies. Loss of heterozygosity (LOH) is often shown at 9q31 in esophageal squamous cell carcinomas (133239) as well as in squamous cell carcinomas of developmentally related tissues such as bladder (109800), lung (211980), and head and neck. Miura et al. (1996) delineated a region commonly deleted in esophageal squamous cell carcinomas to a 200-kb segment at 9q32. Nishiwaki et al. (2000) sequenced overlapping clones in this commonly deleted region and identified a possible candidate gene, which they named 'deleted in esophageal cancer-1' (DEC1). The DEC1 gene encodes a deduced 70-amino acid protein. Northern blot analysis detected a 1.4-kb DEC1 transcript in all tissues tested, with highest expression in prostate and testis. DEC1 expression was lower than normal and often absent in more than half of the esophageal carcinomas examined. Furthermore, DEC1 cDNA was able to exert growth suppressive activity in vitro. Although expression was reduced, no genetic alteration was detected in the DEC1 gene in any of the cancers examined.

Full details of the abovementioned studies are described in the following publications, the disclose of which are hereby incorporated by reference:

Miura, K.; Suzuki, K.; Tokino, T.; Isomura, M.; Inazawa, J.; Matsuno, S.; Nakamura, Y.: Detailed deletion mapping in squamous cell carcinomas of the esophagus narrows a region containing a putative tumor suppressor gene to about 200 kilobases on distal chromosome 9q. Cancer Res. 56: 1629-1634, 1996. PubMed ID: 8603412 2.

Nishiwaki, T.; Daigo, Y.; Kawasoe, T.; Nakamura, Y.: Isolation and mutational analysis of a novel human cDNA, DEC1 (deleted in esophageal cancer 1), derived from the tumor suppressor locus in 9q32. Genes Chromosomes Cancer 27: 169-176, 2000.

Further studies establishing the function and utilities of DEC1 are found in John Hopkins OMIM database record ID 604767, and in references numbered 1604-1605 listed hereinbelow.

Reference is now made to HD BINDING SITE. Huntingtin (Huntington disease) (HD) is a target gene of GAM27, corresponding to GAM27-TARGET GENE of FIG. 27A. HD BINDING SITE is a binding site found in an untranslated region of HD, corresponding to BINDING SITE of FIG. 27A. FIG. 27D illustrates the complementarity of the nucleotide sequence of HD BINDING SITE, designated SEQ ID:193353, to the nucleotide sequence of GAM27 RNA of FIG. 27A, designated SEQ ID:20605.

Yet another function of GAM27 is therefore inhibition of huntingtin (Huntington disease) (HD), a gene which encodes an enzyme that is associated with Huntington disease (HD). Accordingly, utilities of GAM27 include diagnosis and treatment of the abovementioned diseases and clinical conditions.

The function of HD has been established by previous studies. Relative to the mechanisms by which the mutant huntingtin protein cause neurodegeneration, Panov et al. (2002) showed that lymphoblast mitochondria from patients with HD have a lower membrane potential and depolarize at lower calcium loads than do mitochondria from controls. They found a similar defect in brain mitochondria from transgenic mice expressing full-length mutant huntingtin, and this defect preceded the onset of pathologic or behavioral abnormalities by months. By electron microscopy, they identified N-terminal mutant huntingtin on neuronal mitochondrial membranes, and by incubating normal mitochondria with a fusion protein containing an abnormally long polyglutamine repeat, they reproduced the mitochondrial calcium defect seen in human patients and transgenic animals. Thus, mitochondrial calcium abnormalities occur early in HD pathogenesis and may be a direct effect of mutant huntingtin on the organelle.

Animal model experiments lend further support to the function of HD. To distinguish between 'loss-of-function' and 'gain-of-function' models of HD, Duyao et al. (1995) inactivated the mouse Hdh by gene targeting. Mice heterozygous for Hdh inactivation were phenotypically normal, whereas homozygosity resulted in embryonic death. Homozygotes displayed abnormal gastrulation at embryonic day 7.5 and were resorbing by day 8.5. Thus, they concluded that huntingtin is critical early in embryonic development, before the emergence of the nervous system. That Hdh inactivation does not mimic adult HD neuropathology suggested to the authors that the human disease involves a gain of function.

It is appreciated that the abovementioned animal model for HD is acknowledged by those skilled in the art as a scientifically valid animal model, as can be further appreciated from the publications sited hereinbelow.

Full details of the abovementioned studies are described in the following publications, the disclosure of which are hereby incorporated by reference:

Duyao, M. P.; Auerbach, A. B.; Ryan, A.; Persichetti, F.; Barnes, G. T.; McNeil, S. M.; Ge, P.; Vonsattel, J. -P.; Gusella, J. F.; Joyner, A. L.; MacDonald, M. E.: Inactivation of the mouse Huntington's disease gene homolog Hdh. Science 269: 407-410, 1995. PubMed ID: 7618107 204. Panov, A. V.; Gutekunst, C. -A.; Leavitt, B. R.; Hayden, M. R.; Burke, J. R.; Strittmatter, W. J.; Greenamyre, J. T.: Early mitochondrial calcium defects in Huntington's disease are a direct effect of polyglutamines. Nature Neurosci. 5: 731-736, 2002.

Further studies establishing the function and utilities of HD are found in John Hopkins OMIM database record ID 143100, and in references numbered 1606-1704 listed hereinbelow.

Reference is now made to HPN BINDING SITE. hepsin (transmembrane protease, serine 1) (HPN) is a target gene of GAM27, corresponding to GAM27-TARGET GENE of FIG. 27A. HPN BINDING SITE is a binding site found in an untranslated region of HPN, corresponding to BINDING SITE of FIG. 27A. FIG. 27D illustrates the complementarity of the nucleotide sequence of HPN BINDING SITE, designated SEQ ID:201170, to the nucleotide sequence of GAM27 RNA of FIG. 27A, designated SEQ ID:20605.

An additional function of GAM27 is therefore inhibition of hepsin (transmembrane protease, serine 1) (HPN), a gene which encodes an enzyme that is a cell surface serine protease. Accordingly, utilities of GAM27 include diagnosis and treatment of the abovementioned diseases and clinical conditions.

The function of HPN has been established by previous studies. Hepsin is a cell surface serine protease. From cDNA libraries prepared from human liver and hepatoma cell line mRNA, Leytus et al. (1988) isolated cDNA clones coding for a serine protease called hepsin. The proteolytic enzymes of the serine protease family exist as single- or 2-chain zymogenes that are activated by a specific and limited proteolytic cleavage. They contain 3 principal active-site amino acids, his, asp, and ser, that participate in peptide bond hydrolysis. Among the best-studied serine proteases are those found in plasma. These enzymes are involved in processes such as blood coagulation, fibrinolysis, and complement activation. Tsuji et al. (1991) showed that the hepsin mRNA is 1.85 kb in size and present in most tissues, with the highest level in liver. It is present in the plasma membrane in a molecular orientation of type II membrane associated proteins, with its catalytic subunit (C-terminal half) at the cell surface and its N terminus facing the cytosol. Hepsin is not found in cytosol. See also TMPRSS2 (602060), a related serine protease.

Animal model experiments lend further support to the function of HPN. To determine the functional importance of hepsin, Wu et al. (1998) generated hepsin-deficient mice by homologous recombination. The homozygous deficient mice were viable and fertile, and grew normally. In functional assays, including tail bleeding time, plasma clotting times, and tissue factor- or LPS-induced disseminated intravascular coagulation models, no significant difference was found between hepsin −/− and wildtype littermates. Liver weight and serum concentrations of liver-derived proteins and enzymes were similar. Serum concentrations of bone-derived alkaline phosphatase were approximately 2-fold higher in hepsin −/− mice of both sexes when compared with wildtype littermates. No obvious abnormalities were found in major organs in hepsin −/− mice on histologic examination. The results indicated that hepsin is not essential for embryonic development and normal hemostasis.

It is appreciated that the abovementioned animal model for HPN is acknowledged by those skilled in the art as a scientifically valid animal model, as can be further appreciated from the publications sited hereinbelow.

Full details of the abovementioned studies are described in the following publications, the disclosure of which are hereby incorporated by reference:

Leytus, S. P.; Loeb, K. R.; Hagen, F. S.; Kurachi, K.; Davie, E. W.: A novel trypsin-like serine protease (hepsin) with a putative transmembrane domain expressed by human liver and hepatoma cells. Biochemistry 27: 1067-1074, 1988. PubMed ID: 2835076 3. Tsuji, A.; Torres-Rosado, A.; Arai, T.; Le Beau, M. M.; Lemons, R. S.; Chou, S. -H.; Kurachi, K.: Hepsin, a cell membrane-associated protease: characterization, tissue distribution, and gene localization J. Biol. Chem. 266: 16948-16953, 1991.

Further studies establishing the function and utilities of HPN are found in John Hopkins OMIM database record ID 142440, and in references numbered 1074 and 1705-1707 listed hereinbelow.

Reference is now made to C20orf11 BINDING SITE. C20orf11 is a target gene of GAM27, corresponding to GAM27-TARGET GENE of FIG. 27A. C20orf11 BINDING SITE is a binding site found in an untranslated region of C20orf11, corresponding to BINDING SITE of FIG. 27A. FIG. 27D illustrates the complementarity of the nucleotide sequence of C20orf11 BINDING SITE, designated SEQ ID:468069, to the nucleotide sequence of GAM27 RNA of FIG. 27A, designated SEQ ID:20605. A further function of GAM27 is therefore inhibition of (C20orf11). Accordingly, utilities of GAM27 include diagnosis and treatment of diseases and clinical conditions with which C20orf11 is associated.

Reference is now made to FAF1 BINDING SITE. FAF1 is a target gene of GAM27, corresponding to GAM27-TARGET GENE of FIG. 27A. FAF1 BINDING SITE is a binding site found in an untranslated region of FAF1, corresponding to BINDING SITE of FIG. 27A. FIG. 27D illustrates the complementarity of the nucleotide sequence of FAF1 BINDING SITE, designated SEQ ID:552947, to the nucleotide sequence of GAM27 RNA of FIG. 27A, designated SEQ ID:20605. Yet a further function of GAM27 is therefore inhibition of (FAF1). Accordingly, utilities of GAM27 include diagnosis and treatment of diseases and clinical conditions with which FAF1 is associated.

Reference is now made to FLJ23878 BINDING SITE. FLJ23878 is a target gene of GAM27 corresponding to GAM27-TARGET GENE of FIG. 27A. FLJ23878 BINDING SITE is a binding site found in an untranslated region of FLJ23878, corresponding to BINDING SITE of FIG. 27A. FIG. 27D illustrates the complementarity of the nucleotide sequence of FLJ23878 BINDING SITE, designated SEQ ID:662582, to the nucleotide sequence of GAM27 RNA of FIG. 27A, designated SEQ ID:20605. Another function of GAM27 is therefore inhibition of (FLJ23878). Accordingly, utilities of GAM27 include diagnosis and treatment of diseases and clinical conditions with which FLJ23878 is associated.

Reference is now made to ODZ2 BINDING SITE. ODZ2 is a target gene of GAM27, corresponding to GAM27-TARGET GENE of FIG. 27A. ODZ2 BINDING SITE is a binding site found in an untranslated region of ODZ2, corresponding to BINDING SITE of FIG. 27A. FIG. 27D illustrates the complementarity of the nucleotide sequence of ODZ2 BINDING SITE, designated SEQ ID:900303, to the nucleotide sequence of GAM27 RNA of FIG. 27A, designated SEQ ID:20605. Yet another function of GAM27 is therefore inhibition of (ODZ2). Accordingly, utilities of GAM27 include diagnosis and treatment of diseases and clinical conditions with which ODZ2 is associated.

Reference is now made to LOC144231 BINDING SITE. LOC144231 is a target gene of GAM27, corresponding to GAM27-TARGET GENE of FIG. 27A. LOC144231 BINDING SITE is a binding site found in an untranslated region of LOC144231, corresponding to BINDING SITE of FIG. 27A. FIG. 27D illustrates the complementarity of the nucleotide sequence of LOC144231 BINDING SITE, designated SEQ ID:1069942, to the nucleotide sequence of GAM27 RNA of FIG. 27A, designated SEQ ID:20605. An additional function of GAM27 is therefore inhibition of (LOC144231). Accordingly, utilities of GAM27 include diagnosis and treatment of diseases and clinical conditions with which LOC144231 is associated.

Reference is now made to LOC158156 BINDING SITE. LOC158156 is a target gene of GAM27, corresponding to GAM27-TARGET GENE of FIG. 27A. LOC158156 BINDING SITE is a binding site found in an untranslated region of LOC158156, corresponding to BINDING SITE of FIG. 27A. FIG. 27D illustrates the complementarity of the nucleotide sequence of LOC158156 BINDING SITE, designated SEQ ID:1187897, to the nucleotide sequence of GAM27 RNA of FIG. 27A, designated SEQ ID:20605. A further function of GAM27 is therefore inhibition of (LOC158156). Accordingly, utilities of GAM27 include diagnosis and treatment of diseases and clinical conditions with which LOC158156 is associated.

GR1 GENE (Genomic Record 1 Gene) is a novel bioinformatically detected viral regulatory, non protein coding, RNA gene. The method by which GR1 was detected is described hereinabove with reference to FIGS. 6-15.

GR1 GENE encodes an RNA molecule, typically several hundred nucleotides long, designated GR1 PRECURSOR RNA.

GR1 PRECURSOR RNA folds spatially, as illustrated by GR1 FOLDED PRECURSOR RNA, into a plurality of what is known in the art as 'hair-pin' structures. The nucleotide sequence of GR1 PRECURSOR RNA comprises a plurality of segments, the first half of each such segment having a nucleotide sequence which is at least a partial inversed-reversed sequence of the second half thereof, thereby causing formation of a plurality of 'hairpin' structures, as is well known in the art.

GR1 FOLDED PRECURSOR RNA is naturally processed by cellular enzymatic activity, into at least 2 separate hairpin shaped RNA segments, each corresponding to GAM PRECURSOR RNA, designated GAM27 PRECURSOR and GAM26 PRECURSOR respectively.

The above mentioned GAM precursors are diced by Dicer of FIG. 8, yielding short RNA segments of about 22 nucleotides in length, each corresponding to GAM RNA of FIG. 8, designated GAM27 and GAM26 respectively.

GAM26 binds complimentarily to a binding site located in an untranslated region of GAM26-TARGET RNA, which binding site corresponds to BINDING SITE of FIG. 26A, thereby inhibiting translation of GAM26-TARGET RNA into GAM26-TARGET PROTEIN, both of FIG. 26A. The target genes of GAM26 and their respective functions, and accordingly the function and utility of GAM26 are described hereinabove with reference to FIG. 26D.

GAM27 in complimentarily to a binding site located in an untranslated region of GAM27-TARGET RNA, which binding site corresponds to BINDING SITE of FIG. 27A, thereby inhibiting translation of GAM27-TARGET RNA into GAM27-TARGET PROTEIN, both of FIG. 27A. The target genes of GAM27 and their respective functions, and accordingly the function and utility of GAM27 are described hereinabove with reference to FIG. 27D.

Reference is now made to FIG. 28A, which is a simplified diagram providing a conceptual explanation of the mode by which a novel bioinformatically detected gene, referred to here as Genomic Address Messenger 12026 (GAM12026) modulates expression of target genes thereof, the function and utility of which target genes is known in the art.

GAM12026 is a novel bioinformatically detected regulatory, non protein coding, micro RNA (miRNA) gene. The method by which GAM12026 was detected is described hereinabove with reference to FIGS. 6-15.

GAM12026 GENE and GAM12026-TARGET GENE are human genes contained in the human genome.

GAM12026 GENE encodes a GAM12026 PRECURSOR RNA. Similar to other miRNA genes, and unlike most ordinary genes, the RNA transcribed by GAM12026, GAM12026 PRECURSOR RNA, does not encode a protein.

GAM12026 PRECURSOR RNA folds onto itself, forming a 'hairpin structure' designated GAM12026 FOLDED PRECURSOR RNA. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof. By "inversed-reversed" is meant a sequence which is reversed and wherein each nucleotide is replaced by a complementary nucleotide, as is well known in the art (e.g. ATGGC is the inversed-reversed sequence of GCCAT).

An enzyme complex designated DICER COMPLEX, 'dices' the GAM12026 FOLDED PRECURSOR RNA into a single stranded ~22 nt long RNA segment, designated GAM12026 RNA. As is known in the art, 'dicing' of a hairpin structured RNA precursor product into a short ~22 nt RNA segment is catalyzed by an enzyme complex comprising an enzyme called Dicer together with other necessary proteins.

GAM12026-TARGET GENE encodes a corresponding messenger RNA, designated GAM12026-TARGET RNA. GAM12026-TARGET RNA comprises three regions, as is typical of mRNA of a protein coding gene: a 5' untranslated region, a protein coding region and a 3' untranslated region, designated 5'UTR PROTEIN CODING and 3'UTR respectively.

GAM12026 RNA binds complementarily to one or more binding sites located in untranslated regions of GAM12026-TARGET RNA. This complementary binding is due to the fact that the nucleotide sequence of GAM12026 RNA is an accurate or a partial inversed-reversed sequence of the nucleotide sequence of each of the binding sites. As an illustration, FIG. 28A shows 3 such binding sites, designated BINDING SITE-I, BINDING SITE-II and BINDING SITE-III respectively. It is appreciated that the number of binding sites shown in FIG. 28A is meant as an illustration only, and is not meant to be limiting—GAM12026 may have a different number of binding sites in untranslated regions of a GAM12026-TARGET RNA. It is further appreciated that while FIG. 28A depicts the binding sites in the 3'UTR region, this is meant as an example only—the binding sites may be located in the 3'UTR region, the 5'UTR region, or in both 3'UTR and 5'UTR regions.

The complementary binding of GAM12026 RNA to target gene binding sites such as BINDING SITE-I, BINDING SITE-II and BINDING SITE-III inhibits translation of GAM12026-TARGET RNA into GAM12026-TARGET PROTEIN. GAM12026-TARGET PROTEIN is therefore outlined by a broken line.

It is appreciated that GAM12026-TARGET GENE in fact represents a plurality of target genes of GAM12026. The mRNA of each of this plurality of target genes of GAM12026 comprises one more binding sites, each having a nucleotide sequence which is at least partly complementary to GAM12026 RNA, and which when bound by GAM12026 RNA causes inhibition of translation of one of a plurality of target proteins of GAM12026. Target genes of GAM12026 and their respective binding sites, are described hereinbelow with reference to FIG. 28D.

It is further appreciated by one skilled in the art that the mode of translational inhibition illustrated by FIG. 28A with specific reference to translational inhibition exerted by GAM12026 on one or more target genes of GAM12026, is in fact common to other known miRNA genes. As mentioned hereinabove with reference to the background section, although a specific complementary binding site has been demonstrated only for miRNA genes Lin-4 and Let-7, all other recently discovered miRNA genes are also believed by those skilled in the art to modulate expression of other genes by complementary binding, although specific complementary binding sites of these genes have not yet been found (Ruvkun G., 'Perspective: Glimpses of a tiny RNA world', Science 294, 779 (2001)).

It is yet further appreciated that specific functions, and accordingly utilities, of GAM12026 correlate with, and may be deduced from, the identity of the target genes which GAM12026 binds and inhibits, and the function of these target genes, as elaborated hereinbelow with reference to FIG. 28D.

Reference is now made to FIG. 28B which shows the nucleotide sequence of GAM12026 PRECURSOR RNA of FIG. 28A, designated SEQ ID:12003, and a probable (over 0.833813%) nucleotide sequence of GAM12026 RNA of FIG. 28A, designated SEQ ID:42079. The nucleotide sequence of SEQ ID:42079 is marked by an underline within the sequence of GAM12026 PRECURSOR RNA.

Reference is now made to FIG. 28C, which shows the secondary folding of GAM12026 PRECURSOR RNA, forming a 'hairpin structure' designated GAM12026 FOLDED PRECURSOR RNA, both of FIG. 28A. The nucleotide sequence of SEQ ID:42079, which is highly likely (>0.833813%) to be identical or highly similar to the nucleotide sequence of GAM12026 RNA is marked on GAM12026 FOLDED PRECURSOR RNA by a solid underline. It is appreciated that the complementary basepairing is not perfect, with 'bulges', as is well the art with respect to the RNA folding of all known miRNA genes.

Reference is now made to FIG. 28D, which is a table showing complementarity of binding sites of GAM12026, found in untranslated regions of target genes of GAM12026, to SEQ ID:42079, which is highly likely (>0.833813%) to be identical or highly similar to the nucleotide sequence of GAM12026 RNA of FIG. 28A. Each of the binding sites described hereinbelow corresponds to a binding site, such as BINDING SITE-I, BINDING SITE-II or BINDING SITE-III all of FIG. 28A, and each of the target genes of GAM12026 described hereinbelow corresponds to GAM TARGET GENE of FIG. 28A.

As mentioned hereinabove with reference to FIG. 28A a function of GAM12026 is inhibition of expression of target genes. It is appreciated that specific functions, and accordingly utilities, of GAM12026 correlate with, and may be deduced from, the identity of the target genes which GAM12026 binds and inhibits, and the function of these target genes, as elaborated hereinbelow.

Reference is now made to DDEF2 BINDING SITE. development and differentiation enhancing factor 2 (DDEF2 Accession NM_003887) is a target gene of GAM12026, corresponding to GAM12026-TARGET GENE of FIG. 28A. DDEF2 BINDING SITE is a binding site found in the 3 untranslated region of DDEF2, corresponding to a binding site such as BINDING SITE-I, BINDING SITE-II or BINDING SITE-III, all of FIG. 28A. FIG. 28D illustrates the complementarity of the nucleotide sequence of DDEF2 BINDING SITE, designated SEQ ID:228939, to the nucleotide sequence of GAM12026 RNA of FIG. 28A, designated SEQ ID:42079.

Accordingly, utilities of GAM12026 include diagnosis, prevention and treatment of diseases and clinical conditions associated with DDEF2. The function of DDEF2 and its association with various diseases and clinical conditions, has been established by previous studies, as described hereinabove with reference to FIG. 29D.

Reference is now made to ELK4 BINDING SITE. ELK4, ETS-domain protein (SRF accessory protein 1) (Accession NM_001973) is a target gene of GAM12026, corresponding to GAM12026-TARGET GENE of FIG. 28A. ELK4 BINDING SITE is a binding site found in the 3' untranslated region of ELK4, corresponding to a binding site such as BINDING SITE-I, BINDING SITE-II or BINDING SITE-III, all of FIG. 28A. FIG. 28D illustrates the complementarity of the nucleotide sequence of ELK4 BINDING SITE, designated SEQ ID:228939, to the nucleotide sequence of GAM12026 RNA of FIG. 28A, designated SEQ ID:42079.

Accordingly, utilities of GAM12026 include diagnosis, prevention and treatment of diseases and clinical conditions associated with ELK4. The function of ELK4 and its association with various diseases and clinical conditions, has been established by previous studies, as described hereinabove with reference to FIG. 22SD.

Reference is now made to MEF2C BINDING SITE. MADS box transcription enhancer factor 2, polypeptide C (myocyte enhancer factor 2C) (MEF2C, Accession NM_002397) is a target gene of GAM12026, corresponding to GAM12026-TARGET GENE of FIG. 28A. MEF2C BINDING SITE is a binding site found in the 3' untranslated region of MEF2C, corresponding to binding site such as BINDING SITE-I, BINDING SITE-II or BINDING SITE-III, all of FIG. 28A. FIG. 28D illustrates the complementarity of the nucleotide sequence of MEF2C BINDING SITE, designated SEQ ID:228939, to the nucleotide sequence of GAM12026 RNA of FIG. 28A, designated SEQ ID:42079.

Accordingly, utilities of GAM12026 include diagnosis, prevention and treatment of diseases and clinical conditions associated with MEF2C. The function of MEF2C and its association with various diseases and clinical conditions, has been established by previous studies, as described hereinabove with reference to FIG. 31D.

Reference is now made to MRE11A BINDING SITE. MRE11 meiotic recombination 11 homolog A (S. cerevisiae) (MRE11A, Accession NM_005590) is a target gene of GAM12026, corresponding to GAM12026-TARGET GENE of FIG. 28A. MRE11A BINDING SITE is a binding site found in the 3' untranslated region of MRE11A, corresponding to a binding site such as BINDING SITE-I, BINDING SITE-II or BINDING SITE-III, all of FIG. 28A. FIG. 28D illustrates the complementarity of the nucleotide sequence of MRE11A BINDING SITE, designated SEQ ID:228939, to the nucleotide sequence of GAM12026 RNA of FIG. 28A, designated SEQ ID:42079.

Accordingly, utilities of GAM12026 include diagnosis, prevention and treatment of diseases and clinical conditions associated with MRE11A. The function of MRE11A and its association with various diseases and clinical conditions, has been established by previous studies, as described hereinabove with reference to FIG. 225D.

Reference is now made to NEU3 BINDING SITE. sialidase 3 (membrane sialidase) (NEU3, Accession NM_006656) is a target gene of GAM12026, corresponding to GAM12026-TARGET GENE of FIG. 28A. NEU3 BINDING SITE is a binding site found in the 3' untranslated region of NEU3, corresponding to a binding site such as BINDING SITE-I, BINDING SITE-II or BINDING SITE-III, all of FIG. 28A FIG. 28D illustrates the complementarity of the nucleotide sequence of NEU3 BINDING SITE, designated SEQ ID:228939, to the nucleotide sequence of GAM12026 RNA of FIG. 28A, designated SEQ ID:42079.

Accordingly, utilities of GAM12026 include diagnosis, prevention and treatment of diseases and clinical conditions associated with NEU3. The function of NEU3 and its association with various diseases and clinical conditions, has been established by previous studies, as described hereinabove with reference to FIG. 225D.

Reference is now made to NLGN1 BINDING SITE. neuroligin 1 (NLGN1, Accession NM_014932) is a target gene of GAM12026, corresponding to GAM12026-TARGET GENE of FIG. 28A. NLGN1 BINDING SITE is a binding site found in the 3' untranslated region of NLGN1, corresponding to a binding site such as BINDING SITE-I, BINDING SITE-II or BINDING SITE-III, all of FIG. 28A. FIG. 28D illustrates the complementarity of the nucleotide sequence of NLGN1 BINDING SITE, designated SEQ ID:228939, to the nucleotide sequence of GAM12026 RNA of FIG. 28A, designated SEQ ID:42079.

Accordingly, utilities of GAM12026 include diagnosis, prevention and treatment of diseases and clinical conditions associated with NLGN1. The function of NLGN1 and its association with various diseases and clinical conditions, has been established by previous studies, as described hereinabove with reference to FIG. 136D.

Reference is now made to PODXL BINDING SITE. podocalyxin-like (PODXL, Accession NM_005397) is target gene of GAM12026, corresponding to GAM12026-TARGET GENE of FIG. 28A. PODXL BINDING SITE is a binding site found in the 3' untranslated region of PODXL, corresponding to a binding site such as BINDING SITE-I, BINDING SITE-II or BINDING SITE-III, all of FIG. 28A. FIG. 28D illustrates the complementarity of the nucleotide sequence of PODXL BINDING SITE, designated SEQ ID:228939, to the nucleotide sequence of GAM12026 RNA of FIG. 28A, designated SEQ ID:42079.

Accordingly, utilities of GAM12026 include diagnosis, prevention and treatment of diseases and clinical conditions associated with PODXL. The function of PODXL and its association with various diseases and clinical conditions, has been established by previous studies, as described hereinabove with reference to FIG. 160D.

Reference is now made to TDE1 BINDING SITE. tumor differentially expressed 1 (TDE1, Accession NM_006811) is a target gene of GAM12026, corresponding to GAM12026-TARGET GENE of FIG. 28A. TDE1 BINDING SITE is a binding site found in the 3' untranslated region of TDE1, corresponding to a binding site such as BINDING SITE-I, BINDING SITE-II or BINDING SITE-III, all of FIG. 28A. FIG. 28D illustrates the complementarity of the nucleotide sequence of TDE1 BINDING SITE, designated SEQ ID:228939, to the nucleotide sequence of GAM12026 RNA of FIG. 28A, designated SEQ ID:42079.

Accordingly, utilities of GAM12026 include diagnosis, prevention and treatment of diseases and clinical conditions associated with TDE1. The function of TDE1 and its association with various diseases and clinical conditions, has been established by previous studies, as described hereinabove with reference to FIG. 116D.

Reference is now made to AD-020 BINDING SITE. AD-020 (Accession XM_002161) is a target gene of GAM12026, corresponding to GAM12026-TARGET GENE of FIG. 28A. AD-020 BINDING SITE is a binding site found in the Three' untranslated region of AD-020, corresponding to a binding site such as BINDING SITE-I, BINDING SITE-II or BINDING SITE-III, all of FIG. 28A. FIG. 28D illustrates the complementarity of the nucleotide sequence of AD-020 BINDING SITE, designated SEQ ID:228939, to the nucleotide sequence of GAM12026 RNA of FIG. 28A, designated SEQ ID:42079.

A further function of GAM12026 is therefore inhibition of (AD-020). Accordingly, utilities of GAM12026 include diagnosis and treatment of diseases and clinical conditions with which AD-020 is associated.

Reference is now made to AKL3L BINDING SITE. AKL3L (Accession NM_016282) is a target gene of GAM12026, corresponding to GAM12026-TARGET GENE of FIG. 28A. AKL3 BINDING SITE is a binding site found in the Three' untranslated region of AKL3L, corresponding to a binding site such as BINDING SITE-I, BINDING SITE-II or BINDING SITE-III, all of FIG. 28A. FIG. 28D illustrates the complementarity of the nucleotide sequence of AKL3L BINDING SITE, designated SEQ ID:228939, to the nucleotide sequence of GAM12026 RNA of FIG. 28A, designated SEQ ID:42079.

Yet a further function of GAM12026 is therefore inhibition of (AKL3L). Accordingly, utilities of GAM12026 include diagnosis and treatment of diseases and clinical conditions with which AKL3L is associated.

Reference is now made to B3GNT1 BINDING SITE. UDP-GlcNAc:betaGal beta-1,3-N-acetylglucosaminyltransferase 1 (B3GNT1, Accession NM_006577) is a target gene of GAM12026, corresponding to GAM12026-TARGET GENE of FIG. 28A. B3GNT1 BINDING SITE is a binding site found in the Three' untranslated region of B3GNT1, corresponding to a binding site such as BINDING SITE-I, BINDING SITE-II or BINDING SITE-III, all of FIG. 28A. FIG. 28D illustrates the complementarity of the nucleotide sequence of B3GNT1 BINDING SITE, designated SEQ ID:228939, to the nucleotide sequence of GAM12026 RNA of FIG. 28A, designated SEQ ID:42079.

Another function of GAM12026 is therefore inhibition of UDP-GlcNAc:betaGal beta-1,3-N-acetylglucosaminyltransferase 1 (B3GNT1). Accordingly, utilities of GAM12026 include diagnosis and treatment of diseases and clinical conditions with which B3GNT1 is associated.

Reference is now made to CDC14B BINDING SITE. CDC14 cell division cycle 14 homolog B (*S. cerevisiae*) (CDC14B, Accession NM_003671) is a target gene of GAM12026, corresponding GAM12026-TARGET GENE of FIG. 28A. CDC14B BINDING SITE is a binding site found in the Three' untranslated region of CDC14B, corresponding to a binding site such as BINDING SITE-I, BINDING SITE-II or BINDING SITE-III, all of FIG. 28A. FIG. 28D illustrates the complementarity of the nucleotide sequence of CDC14B BINDING SITE designated SEQ ID:228939, to the nucleotide sequence of GAM12026 RNA of FIG. 28A, designated SEQ ID:42079.

Yet another function of GAM12026 is therefore inhibition of CDC14 cell division cycle 14 homolog B (S. cerevisiae) (CDC14B). Accordingly, utilities of GAM12026 include diagnosis and treatment of diseases and clinical conditions with which CDC14B is associated.

Reference is now made to DKFZP434J214 BINDING SITE. DKFZP434J214 (Accession XM_027639) is a target gene of GAM12026, corresponding to GAM12026-TARGET GENE of FIG. 28A. DKFZP434J214 BINDING SITE is a binding site found in the Three' untranslated region of DKFZP434J214, corresponding to a binding site such as BINDING SITE-I, BINDING SITE-II or BINDING SITE-III, all of FIG. 28A. FIG. 28D illustrates the complementarity of the nucleotide sequence of DKFZP434J214 BINDING SITE, designated SEQ ID:228939, to the nucleotide sequence of GAM12026 RNA of FIG. 28A, designated SEQ ID:42079.

An additional function of GAM12026 is therefore inhibition of (DKFZP434J214). Accordingly, utilities of GAM12026 include diagnosis and treatment of diseases and clinical conditions with which DKFZP434J214 is associated.

Reference is now made to DKFZP434N161 BINDING SITE. DKFZP434N161 (Accession XM_085920) is a target gene of GAM12026, corresponding to GAM12026-TARGET GENE of FIG. 28A. DKFZP434N161 BINDING SITE is a binding site found in the Three' untranslated region of DKFZP434N161, corresponding to a binding site such as BINDING SITE-I, BINDING SITE-II or BINDING SITE-III, all of FIG. 28A. FIG. 28D illustrates the complementarity of the nucleotide sequence of DKFZP434N161 BINDING SITE, designated SEQ ID:28939, to the nucleotide sequence of GAM12026 RNA of FIG. 28A, designated SEQ ID:42079.

A further function of GAM12026 is therefore inhibition of (DKFZP434N161). Accordingly, utilities of GAM12026 include diagnosis and treatment of diseases and clinical conditions with which DKFZP434N161 is associated.

Reference is now made to FLJ10103 BINDING SITE. FLJ10103 (Accession NM_017996) is a target gene of GAM12026, corresponding to GAM12026-TARGET GENE of FIG. 28A. FLJ10103 BINDING SITE is a binding site found in the Three' untranslated region of FLJ10103, corresponding to a binding site such as BINDING SITE-I, BINDING SITE-II or BINDING SITE-III, all of FIG. 28A. FIG. 28D illustrates the complementarity of the nucleotide sequence of FLJ10103 BINDING SITE, designated SEQ ID:228939, to the nucleotide sequence of GAM12026 RNA of FIG. 28A, designated SEQ ID:42079.

Yet a further function of GAM12026 is therefore inhibition of (FLJ10103). Accordingly, utilities of GAM12026 include diagnosis and treatment of diseases and clinical conditions with which FLJ10103 is associated.

Reference is now lade to HSPC195 BINDING SITE. HSPC195 (Accession XM_087785) is a target gene of GAM12026, corresponding to GAM12026-TARGET GENE of FIG. 28A. HSPC195 BINDING SITE is a binding site found in the Three' untranslated region of HSPC195, corresponding to a binding site such as BINDING SITE-I, BINDING SITE-II or BINDING SITE-III, all of FIG. 28A. FIG. 28D illustrates the complementarity of the nucleotide sequence of HSPC195 BENDING SITE, designated SEQ ID:228939, to the nucleotide sequence of GAM12026 RNA of FIG. 28A, designated SEQ ID:42079.

Another function of GAM12026 is therefore inhibition of (HSPC195). Accordingly, utilities of GAM12026 include diagnosis and treatment of diseases and clinical conditions with which HSPC195 is associated.

Reference is now made to KIAA0210 BINDING SITE. KIAA0210 (Accession NM_014744) is a target gene of GAM12026, corresponding to GAM12026-TARGET GENE of FIG. 28A. KIAA0210 BINDING SITE is a binding site found in the Three' untranslated region of KIAA0210, corresponding to a binding site such as BINDING SITE-I, BINDING SITE-II or BINDING SITE-III, all of FIG. 28A. FIG. 28D illustrates the complementarity of the nucleotide sequence of KIAA0210 BINDING SITE, designated SEQ ID:228939, to the nucleotide sequence of GAM12026 RNA of FIG. 28A, designated SEQ ID:42079.

Yet another function of GAM12026 is therefore inhibition of (KIAA0210). Accordingly, utilities of GAM12026 include diagnosis and treatment of diseases and clinical conditions with which KIAA0210 is associated.

Reference is now made to KIAA0747 BINDING SITE. KIAA0747 (Accession NM_015292) is a target gene of GAM12026, corresponding to GAM12026-TARGET GENE of FIG. 28A. KIAA0747 BINDING SITE is a binding site found in the Three' untranslated region of KIAA0747, corresponding to a binding site such as BINDING SITE-I, BINDING SITE-II or BINDING SITE-III, all of FIG. 28A. FIG. 28D illustrates the complementarity of the nucleotide sequence of KIAA0747 BINDING SITE, designated SEQ ID:228939, to the nucleotide sequence of GAM12026 RNA of FIG. 28A, designated SEQ ID:42079.

An additional function of GAM12026 is therefore inhibition of (KIAA0747). Accordingly, utilities of GAM12026 include diagnosis and treatment of diseases and clinical conditions with which KIAA0747 is associated.

Reference is now made to KIAA0977 BINDING SITE. KIAA0977 (Accession NM_014900) is a target gene of GAM12026, corresponding to GAM12026-TARGET GENE of FIG. 28A. KIAA0977 BENDING SITE is a binding site found in the Three' untranslated region of KIAA0977, corresponding to a binding site such as BINDING SITE-I, BINDING SITE-II or BINDING SITE-III, all of FIG. 28A. FIG. 28D illustrates the complementarity of the nucleotide sequence of KIAA0977 BINDING SITE, designated SEQ ID:228939, to the nucleotide sequence of GAM12026 RNA of FIG. 28A, designated SEQ ID:42079.

A further function of GAM12026 is therefore inhibition of (KIAA0977). Accordingly, utilities of GAM12026 include diagnosis and treatment of diseases and clinical conditions with which KIAA0977 is associated.

Reference is now made to MIC2L1 BINDING SITE. MIC2 like 1 (MIC2L1, Accession NM_031462) is a target gene of GAM12026, corresponding to GAM12026-TARGET GENE of FIG. 28A. MIC2L1 BINDING SITE is a binding site found in the Three' untranslated region of MIC2L1, corresponding to a binding site such as BINDING SITE-I, BINDING SITE-II or BINDING SITE-III, all of FIG. 28A. FIG. 28D illustrates the complementarity of the nucleotide sequence of MIC2L1 BINDING SITE, designated SEQ ID:228939, to the nucleotide sequence of GAM12026 RNA of FIG. 28A, designated SEQ ID:42079.

Yet a further function of GAM12026 is therefore inhibition of MIC2 like 1 (MIC2L1). Accordingly, utilities of GAM12026 include diagnosis and treatment of diseases and clinical conditions with which MIC2L1 is associated.

Reference is now made to LOC143187 BINDING SITE. LOC143187 (Accession NM_145206) is a target gene of GAM12026, corresponding to GAM12026-TARGET GENE of FIG. 28A. LOC143187 BINDING SITE is a binding site found in the Three' untranslated region of LOC143187, corresponding to a binding site such as BINDING SITE-I, BINDING SITE-II or BINDING SITE-III, all of FIG. 28A. FIG. 28D illustrates the complementarity of the nucleotide sequence of LOC143187 BINDING SITE, designated SEQ ID:228939, to the nucleotide sequence of GAM12026 RNA of FIG. 28A, designated SEQ ID:42079.

Another function of GAM12026 is therefore inhibition of (LOC143187). Accordingly, utilities of a GAM12026 include diagnosis and treatment of diseases and clinical conditions with which LOC143187 is associated.

Reference is now made to LOC148604 BINDING SITE. LOC148604 (Accession XM_086249) is a target gene of GAM12026, corresponding to GAM12026-TARGET GENE of FIG. 28A. LOC148604 BINDING SITE is a binding site found in the Three' untranslated region of LOC148604, corresponding to a binding site such as BINDING SITE-I, BINDING SITE-II or BINDING SITE-III, all of FIG. 28A. FIG. 28D illustrates the complementarity of the nucleotide sequence of LOC148604 BINDING SITE, designated SEQ ID:228939, to the nucleotide sequence of GAM12026 RNA of FIG. 28A, designated SEQ ID:42079.

Yet another function of GAM12026 is therefore inhibition of (LOC148604). Accordingly, utilities of GAM12026 include diagnosis and treatment of diseases and clinical conditions with which LOC148604 is associated.

Reference is now made to LOC151248 BINDING SITE. LOC151248 (Accession XM_087143) is a target gene of GAM12026, corresponding to GAM12026-TARGET GENE of FIG. 28A. LOC151248 ENDING SITE is a binding site found in the Three' untranslated region of LOC151248, corresponding to a binding site such as BINDING SITE-I, BINDING SITE-II or BINDING SITE-III, all of FIG. 28A. FIG. 28D illustrates the complementarity of the nucleotide sequence of LOC151248 BINDING SITE, designated SEQ ID:228939, to the nucleotide sequence of GAM12026 RNA of FIG. 28A, designated SEQ ID:42079.

An additional function of GAM12026 is therefore inhibition of (LOC151248). Accordingly, utilities of GAM12026 include diagnosis and treatment of diseases and clinical conditions with which LOC151248 is associated.

Reference is now made to LOC253221 BINDING SITE. LOC253221 (Accession XM_173010) is a target gene of GAM12026, corresponding to GAM12026-TARGET GENE of FIG. 28A. LOC253221 BINDING SITE is a binding site found in the Three' untranslated region of LOC253221, corresponding to a binding site such as BINDING SITE-I, BINDING SITE-II or BINDING SITE-III, all of FIG. 28A. FIG. 28D illustrates the complementarity of the nucleotide sequence of LOC253221 BINDING SITE, designated SEQ ID:228939, to the nucleotide sequence of GAM12026 RNA of FIG. 28A, designated SEQ ID:42079.

A further function GAM12026 is therefore inhibition of (LOC253221). Accordingly, utilities of GAM12026 include diagnosis and treatment of diseases and clinical conditions with which LOC253221 is associated.

Reference is now made to LOC253927 BINDING SITE. LOC253927 (Accession XM_170785) is a target gene of GAM12026, corresponding to GAM12026-TARGET GENE of FIG. 28A. LOC253927 BINDING SITE is a binding site found in the Three' untranslated region of LOC253927, corresponding to a binding site such as BINDING SITE-I, BINDING SITE-II or BINDING SITE-III, all of FIG. 28A. FIG. 28D illustrates the complementarity of the nucleotide sequence of LOC253927 BINDING SITE, designated SEQ ID:228939, to the nucleotide sequence of GAM12026 RNA of FIG. 28A, designated SEQ ID:42079.

Yet a further function of GAM12026 is therefore inhibition of (LOC253927). Accordingly, utilities of GAM12026 include diagnosis and treatment of diseases and clinical conditions with which LOC253927 is associated.

It is appreciated by persons skilled in the art that the present invention is not limited by what has been particularly shown and described hereinabove. Rather the scope of the present invention includes both combinations and sub-combinations of the various features describe hereinabove as well as variations and modifications which would occur to persons skilled in the art upon reading the specifications and which are not in the prior art.

SEQUENCE LISTING (1388411 sequences)

SEQ ID NO: 1 - RNA, 81 nt, Human
acuguggaaugccugcggggugauguugauauucuaauggaguuccugcucaaugucaccacagcaccagaauuucgucgu

SEQ ID NO: 2 - RNA, 65 nt, Human
ccaccaguccuugcacuguucugacacuuuccccaggaggaaaacaaguacaaagguuacggugg

SEQ ID NO: 3 - RNA, 119 nt, Human
cggccgccgaguuccgcggcuccgggagcgaagcgcgcaccugugaggcagacggcaccuccugcgaccgucgccgccaccgccgccgccgccgccgggcgccgaggggcuggcgggcg

SEQ ID NO: 4 - RNA, 109 nt, Human
cugcggagcccgcgucgcagcagcccggacaggaagauuggucuggauguggguccggucuuacagucgcgggccaggaugagggcagguugcgacagcgcgcacccgg

SEQ ID NO: 5 - RNA, 90 nt, Human
cugcagccaaguggaggugacugggugaugaauacaauguggaaagcauugauggucagccaggugccuucaccugcuauuuggaugcag

SEQ ID NO: 6 - RNA, 72 nt, Human
cggcgcuuccgcaaguuccugguguuguggcaaacuucgaugagaaugaccccaagaccuuugagggcguug

SEQ ID NO: 7 - RNA, 80 nt, Human
cuucuuaauucuuaauaaagcauuucuguguaaaagggucauuuccaaguacaagaaaaccuccacugaaagcuaagaag

SEQ ID NO: 8 - RNA, 67 nt, Human
augguaguaugagaaccguuugugauaauagaaacccagacugugcuuaaaugugcuagacuaccau

SEQ ID NO: 9 - RNA, 91 nt, Human
gguccgagcgcaggcagaacuugcccuggcccugggucuagggcgcugggcucugaggcugagagcugggugggaagugccuggcggggcc

SEQ ID NO: 10 - RNA, 66 nt, Human
cccagcuugagugaacugcacugugacaagcuugcauguggauccugagaacuucaagcuccuggg

SEQ ID NO: 11 - RNA, 63 nt, Human
gaaggugcugacuuccuugggagaugccauaaagcaccugggaugaucucaaggggcaccuuu

SEQ ID NO: 12 - RNA, 66 nt, Human
gcuggaggagaaacccugggaaggcuccugguugucuacccauggacccagagguucuuugacagc

SEQ ID NO: 13 - RNA, 66 nt, Human
cucuuaggccuaacaugagaucagguaagcaauauagaauaaaaccuuucucuuagccccaaagag

SEQ ID NO: 14 - RNA, 70 nt, Human
gagggaaaguaugcacaguccgugucaggguuagaaaacccugaaagagguaccugaguauagagaacuc

SEQ ID NO: 15 - RNA, 90 nt, Human
cacauauucauacaaaugacuuaguaaucuaauaugagaagugguccuucacuuauauuaggaacuugguaaauauuuguugaaugaaug

SEQ ID NO: 16 - RNA, 77 nt, Human
cuagaguaucaaacauuguuccaguaagaaguucaagaguacauuuagggcuaucuuaagaaauaugaauacuuugg

SEQ ID NO: 17 - RNA, 71 nt, Human
guagaaaaauaagagagugucuuuaaaaaaaauaaucaaaugcuuuuugaaagaccuguucucuucacugc

SEQ ID NO: 18 - RNA, 76 nt, Human
caguucauggaggggauacaagacggaauauuugguagacaauaaaguucacgcaagaagacccuuugguauacug

SEQ ID NO: 19 - RNA, 92 nt, Human
ggaagcuaaaccaggcacaguaacugacaccauguagguugauuauauuuugcaucucccugcaagucuguuuuauguuauuuauagcuucc

SEQ ID NO: 20 - RNA, 80 nt, Human
ugucacugagcgaguacagccccuggaaguggcuuuggaaacauugucuucugcagaggucugugcugggaucuaugaca

SEQ ID NO: 21 - RNA, 82 nt, Human
caaacuaguagacugaugagcuggauugcuuagauugauaacauuuacaaauaggaguccaguugacaugcuauuaauguug

SEQ ID NO: 22 - RNA, 95 nt, Human
gccaauggaauccagguaaaguacaaaaacgccaccuuuuauuguccugucuuauuucucgggaaggaggguucuacuuuacacauuucaugagc

SEQ ID NO: 23 - RNA, 72 nt, Human
agucugaagcuaacugacgauugcagcuaguuuaugauuauaucaguaguuguuccuuaguaagcuagggcu

SEQ ID NO: 24 - RNA, 66 nt, Human
gcugugaaacuggaggugaagccaaguuuaucaggucugaggcagggcgaccucaaguuacauggu

SEQ ID NO: 25 - RNA, 79 nt, Human
caccagccucucaccaccagagaugaccggaaauauguuuucucuucuuccuuccgugcaucaggggaagaggcuggug

SEQ ID NO: 26 - RNA, 101 nt, Human
uuuuuuuuuuuuuuuuuuuuuuuuuuuuuuucagaaaaaauaccaugccacuuuauguauuauuauguuggggaggaauauaacagggaacaagaagagaa

SEQ ID NO: 27 - RNA, 63 nt, Human
acgguuacggaugaucacacggaugcucauacgguuaugcggacacacacucacacgaacggu

SEQ ID NO: 28 - RNA, 74 nt, Human
cacggaugcucacacgcucacauggccacucaauaccgguauugaguggccaugugauugggaguucauucaug

SEQ ID NO: 29 - RNA, 75 nt, Human
gacggucacacggaagcucacacggacagucacacgcucacacggacggucacagggaugcucacacggacgguc

SEQ ID NO: 30 - RNA, 66 nt, Human
guuucagaaagaggaacagauaaccucaguccaacaugauuggagguuggcaaaaucuacugaagc

SEQ ID NO: 31 - RNA, 104 nt, Human
uuguuuuuuguuuauuugucuuuuugaaauagaguuucgcucuuguugcccaggccggagugugagacugcuucucaaaaacacaaaaccaaaccaaaaaacaa

SEQ ID NO: 32 - RNA, 76 nt, Human
ucuucuuuuuguauuuggcaucuauuuggcugcgguauucaggccucaucaacauagcugcgaagcugaaagcaga

SEQ ID NO: 33 - RNA, 67 nt, Human
uucuucaggccugcccugugacacucaaucacaguugacgucaggauggguacaaugucugcaagag

SEQ ID NO: 34 - RNA, 70 nt, Human
uguuaauuucuguaguacgauuuaaauguuuuacuucuuugauaaagcagaguacaauagaaaaaaaaca

SEQ ID NO: 35 - RNA, 73 nt, Human
aauaauugaaaaugucaaaauuauaugccauauacauuucugugggcuugaaaaugauaccauauagguuguu

SEQ ID NO: 36 - RNA, 84 nt, Human
gagaaucacuugaacccgggaggcagagguugcagugagccaagauugugccacugcacuccagccugggugacagccaaucuc

SEQ ID NO: 37 - RNA, 77 nt, Human
gcauauucuuacauauauuaacaguauuuuacaugcuuaaaaccuuaaaaauaauugaaaaugucaaaauuauaugc

SEQ ID NO: 38 - RNA, 86 nt, Human
uuugggaggcuaaggcaggcagaucaccugaggucaggaguucaagaccaaccuggucaacauggugaaacccugccccuacuaaa

SEQ ID NO: 39 - RNA, 65 nt, Human
guggcccacgugggcgggacggccgcaggcaugggguggcugugcugguccgacaccugggcuac

SEQ ID NO: 40 - RNA, 94 nt, Human
uaccuggaggaaaugagucaucggugauaagcaaagccacacacaauauuguugguucuuauugacugaauuuacuuugguugccuuuuaggug

SEQ ID NO: 41 - RNA, 111 nt, Human
ccccggcuggaucaggaggcgaccauauggcuuuucuuguuucacgugaagaaucuguugcgcugagagcaccaggagcagguagaagacccgggcagccauccugcgggg

SEQ ID NO: 42 - RNA, 65 nt, Human
uguaauaaaagcagcuuguuuucugcuugaacaauagcucugagagcaagaaggcuggaaaugca

SEQ ID NO: 43 - RNA, 61 nt, Human
cagaauucuugaucuugaaaacaagcaaauguaugccuuaaaaaaugaagagggaguucug

SEQ ID NO: 44 - RNA, 78 nt, Human
aggugcuauuuaacaugggaggagagcgugugcggcuccagcccagcccgcugcucacuuuccacccucucuccaccu

SEQ ID NO: 45 - RNA, 85 nt, Human
cucugaaacccuccuccacagcugcagcccauccucccggcucccuccuagucuguccugcguccucuguccccggguuucagag

SEQ ID NO: 46 - RNA, 89 nt, Human
cagcagugccacugcgucgggccagcgcucccccgacaaccccagguugcgggaaaagcagaguugacccagccaagaacagacugcug

SEQ ID NO: 47 - RNA, 83 nt, Human
ggagacugauccccucugaguccucugcccuuccaaggacacuaaugagccugggaggguggcagggaggaggggacagcuuc

SEQ ID NO: 48 - RNA, 65 nt, Human
uugugguuucuguuuguaauuuaagaagagcuauucaucacuguaauuauuauuauuuucuacaa

SEQ ID NO: 49 - RNA, 67 nt, Human
ccgguguaaauguugagccuuuuuggccuggcuuguuugcaaaggcccuggcaaacgucaacauugg

SEQ ID NO: 50 - RNA, 66 nt, Human
ucuccgagcucgccugcaucuacucggcccucauucugcacgacgaugaggugacagucacggagg

SEQ ID NO: 51 - RNA, 76 nt, Human
augcuuacaaagccaaauaaucgcagggcaaggcagauaaaggcaggcaggauagugacaguggcucggugagcau

SEQ ID NO: 52 - RNA, 72 nt, Human
uccuaaauuauugacagauagauagauagugaccaacuuaaggguaaucauauaugugacuaacauuuggga

SEQ ID NO: 53 - RNA, 88 nt, Human
guauugcuggguugauucuaguuguguguguccuaacucuggcucuuuuccuuacugugacgaaguaacugaaacaaccuggugcuac

SEQ ID NO: 54 - RNA, 80 nt, Human
ucucaagcucucgaccucacgaucugccugccucuaugucauuuucgaggcagguggaucacgaggucaggaguucgaga

SEQ ID NO: 55 - RNA, 64 nt, Human
auauacagauaaaugagaaguuucgauucugcaucaagcauuauucaaucucaccuucugauau

SEQ ID NO: 56 - RNA, 87 nt, Human
gaccuuugugaguuccagugguguucuuggcacucagagguucagcugaagucccgacuggugaggacaaguggagccacaaggguc

SEQ ID NO: 57 - RNA, 75 nt, Human
gggucuacgugugugauccuuaucguaagaacaauucacaguaucacauuuucacagaugaggacacugaggccc

SEQ ID NO: 58 - RNA, 78 nt, Human
cuuuggucuugggggugcagggcuuggugacgcggauggucuccuggcacugagcauuguagcgcgccuucuccaggg

SEQ ID NO: 59 - RNA, 83 nt, Human
caaaacaaaacaaaaaacuccccuuccucacugcccaauauaaaaggcaaauguguacauggcagaguuuguguguugucuug

SEQ ID NO: 60 - RNA, 92 nt, Human
ggugcagaggaaguggaaggcaucagacccuauguauuugcaguacaccugcacuuaaggcacucuguuauuuagacucaucuuacuguacc

SEQ ID NO: 61 - RNA, 60 nt, Human
uccauaaugcuacugucucacugaaacauuuaaauuuuacccuuuagacuguagccugga

SEQ ID NO: 62 - RNA, 77 nt, Human
aaauucugcauccacauugucauguccuucaaaaggauacagggcuugauuggaggacucuauaucuguaagaauuu

SEQ ID NO: 63 - RNA, 74 nt, Human
ggcagcagcagauccaauugcguuuucuuuuucauaagccuaaaagcaucgcgguguguuucagagcugcuucc

SEQ ID NO: 64 - RNA, 86 nt, Human
caggcuagucagcgccugguuccggugcugcaagcuccgcaaccucccucuccagcucggcacagcgcaggcgcucauccucccug

SEQ ID NO: 65 - RNA, 67 nt, Human
cugcauucucuugcgccaggcucugcuucuccucugacaggagcaucagcugccgcuccagauccag

SEQ ID NO: 66 - RNA, 74 nt, Human
ucuccagccugaaguucuccuccugcaacugcuccagcugggauugcagcagcagcagcuucuuggcagugaga

SEQ ID NO: 67 - RNA, 77 nt, Human
ccuguggacgaggcagaccacaacgugaaagaaggaccagccccuugaccguucuggcuggggaauuguccacgagg

SEQ ID NO: 68 - RNA, 72 nt, Human
ggcaagcagugacuccugagagacauuccccacucacuuugugugcucuuaaccuucugagugcugcuagcc

SEQ ID NO: 69 - RNA, 60 nt, Human
ucagguguugagacugagaugcguguucguauuuuuccacuuaucugucuugucagcugg

SEQ ID NO: 70 - RNA, 67 nt, Human
gaagauggauguggcugacuucgagugggugaugugguacaccuccuuucgcaacgucaucaucuuu

SEQ ID NO: 71 - RNA, 63 nt, Human
uccuccucccccuccuccucccgcugucaccacucaccgcucauaaccucaagggggugggga

SEQ ID NO: 72 - RNA, 74 nt, Human
uugagaagcgccgacgagaccggaucaauaacaguuugucugagcugagaaggcugguacccagugcuuuugag

SEQ ID NO: 73 - RNA, 79 nt, Human
guacauaagugucaugcagcaggacgucacuguuggaagaagucuccucaugaccauaucccuguuguccauuguguau

SEQ ID NO: 74 - RNA, 75 nt, Human
gagauguccucuauucuugaagagcguauucuuggagcugauaccucuguugaucuugaagaaacugggcguguc

SEQ ID NO: 75 - RNA, 73 nt, Human
gcugcggcugcagaaguaccgccugcggaguaacugcaaagaugcuguccgugcgcguugcugcggccguggu

SEQ ID NO: 76 - RNA, 87 nt, Human
guccuugaacuuggaaccugacaauguugguguugucguguuuggaaaugauaaacuaauuaaggaaggagauauagugaagaggac

SEQ ID NO: 77 - RNA, 71 nt, Human
ugcccgcguacaugggcugaggaauguucaagcagaagaaaugguagaguuuucuucaggcuuaaagggua

SEQ ID NO: 78 - RNA, 72 nt, Human
uaucgccuucguucccuauucauuuacauuuuugaaucaauagucuugugaaagggcacgaauaugggggua

SEQ ID NO: 79 - RNA, 76 nt, Human
ugaaugccgugcagcacgcuguugugaaaauggaugcgguuaaaucucaaacagacggacucugcaaggcauugca

SEQ ID NO: 80 - RNA, 65 nt, Human
ccaagcacauuacaggggaccugauugcuacacguucagaaugcguuugcugucauccugcuugg

SEQ ID NO: 81 - RNA, 69 nt, Human
gcaggccuggcacagccuuggcuuccacgccugagcgugagagcacgaguuaguuguaguccggcuugc

SEQ ID NO: 82 - RNA, 60 nt, Human
ggcacgugccugcugcuuccugagagcccggccucucccuccaguacuucuguuugugcc

SEQ ID NO: 83 - RNA, 80 nt, Human
gcagauuuguguuuuguuuucuuguuaucacugucacacagcuuauaacauguaugcuuuucagaauacaguugucuagc

SEQ ID NO: 84 - RNA, 71 nt, Human
aaugaguuaggcugcagaggacugguccgucuccucggcauaaacccuuugaaguuccuuuuccacucguu

SEQ ID NO: 85 - RNA, 122 nt, Human
guuuaguggcuucacgcagaaguuggcaggagcaugggcuucggaggccuauagcccgcagggauuaaagccugugguuuccacagaagcaccaccuaucauauuugccacaccaacuaaac

SEQ ID NO: 86 - RNA, 66 nt, Human
uccagaaagcugauggugugcccgucuaccugaaacgaggccugccugaccaaaugcuuuaccgga

SEQ ID NO: 87 - RNA, 73 nt, Human
aguauugccuauuugcaugggagaaaugauuucugaaguccgucuccugaaacaugcccuuaugcucuuugcu

SEQ ID NO: 88 - RNA, 68 nt, Human
cuaccuugccugcguuggcaucacacaagacguucgagcaguccauuuguaacgcauacuaaguguag

SEQ ID NO: 89 - RNA, 63 nt, Human
uauacuuuugcugcaagaaaauaaaaguuuucucuuuaucucuucauggcagaccuaagugug

SEQ ID NO: 90 - RNA, 70 nt, Human
agaaaauuauguguauccacaaccuaguuauuuuaaaaauuauguugacuaaauacaaaguuuguuuucu

SEQ ID NO: 91 - RNA, 91 nt, Human
auguaaagcaaaucuuagcuauauuuuaaaucauaaauaacauguucaagauacuuaacaauuuauuuaaaaucuaagauugcucuaacgu

SEQ ID NO: 92 - RNA, 63 nt, Human
guaugguacagaggaggccauuacagaagcaagcaccaagauggaauuuucugggccgaauac

SEQ ID NO: 93 - RNA, 79 nt, Human
ccuggccugcaacuucagccuuucucaaaaucggggcacggucaucguggagcgcugguggaagguaccgcuggccggg

SEQ ID NO: 94 - RNA, 70 nt, Human
gggccggaagccgcgccugcaccggcgacaucgcgucuauaagcugguggaggacacgaagcaucggccc

SEQ ID NO: 95 - RNA, 88 nt, Human
caggacccagugaggcacgacgugguuuacuagaaguggccgguuuccuggcagcuuuguaaauggacucuaaccucaguggaaucug

SEQ ID NO: 96 - RNA, 65 nt, Human; identical to SEQ ID NO: 42

SEQ ID NO: 97 - RNA, 79 nt, Human
guaucggcuaaacauccacugagcaccuccucuugcaguuagcauuagacuaagugcuuaaggacaaguaguuugaugc

SEQ ID NO: 98 - RNA, 66 nt, Human
ggaccuuguugcaccucguggcugcuuuguucacccgcagggcggccugugggcaccccgggguuc

SEQ ID NO: 99 - RNA, 78 nt, Human
cugggguguuuauggcaagucacuuugacagacauuauuguggcaaauguugucugacuuacuguuucaacaaaccag

SEQ ID NO: 100 - RNA, 80 nt, Human
ucuuguguugagacuucgugguggugcuaagaaaaggaagaagaagucuuacaccacucccaagaagaauaagcacaaga

SEQ ID NO: 101 - RNA, 74 nt, Human
gagcggacauuuaggaacuggaugaacuccuuggguguuaacccucgagucaaucauuuguacagugacuuauc

SEQ ID NO: 102 - RNA, 85 nt, Human
ggaugacauccagagggcagaaugcaugcugcagcaggcggagaggcugggcugccggcaguugucacagccacagauguugucc

SEQ ID NO: 103 - RNA, 62 nt, Human
ggcauggggagguucccggguaucuccgacacugggggggcccaggccgagcuccuugugcc

SEQ ID NO: 104 - RNA, 80 nt, Human
cuggcccgacgccgacggccucucaguggcucccggaggacccggcgggcccaguguuggagagcugaaggucaggccag

SEQ ID NO: 105 - RNA, 106 nt, Human
ggagcugaccgggagcugggggccacgggccuaggagcacccuggucagggcuaaggccauggccccgcccccagcgccacuggcugccagcaccccgucuccucc

SEQ ID NO: 106 - RNA, 78 nt, Human
cugggguguauauggcaagucacuuugacagacauuauaguggcaaauguugucugacuuacuguuucaacaaaccag

SEQ ID NO: 107 - RNA, 80 nt, Human; identical to SEQ ID NO: 100

SEQ ID NO: 108 - RNA, 117 nt, Human
gguauuucccaagucucugggugguuggaaggcuguggcuggucucaguuggguuacucaaugcccaggaggggcugagcaccagccauaucuuugcuugguucacaugaugauacc

SEQ ID NO: 109 - RNA, 62 nt, Human
ccauacugguauguguuucuccuggacaagacaucauggaacaaccacuccuaucuguaugg

SEQ ID NO: 110 - RNA, 90 nt, Human
gacuagccuugcuggucugagcacuggggugugcugcuguugacuccucagcugguuccugcccuuuugauguucagaucauuggcuguc

SEQ ID NO: 111 - RNA, 84 nt, Human
ggagcgggggcucagcucucuggaccggaaauaccuugaugggcuggaugugugccgcuuccccuugcuggaugcccuacgccc

SEQ ID NO: 112 - RNA, 64 nt, Human
ggccuuucagcuaacauucauggaugcaaaccacuacuggucuguggacggucugcugaaugcc

SEQ ID NO: 113 - RNA, 77 nt, Human
ggggcucugguucccggaucuccgugucccgcuccaccagcuucaggggcggcaugggguccgggggccuggccacc

SEQ ID NO: 114 - RNA, 104 nt, Human
uucaccaccauggagaaggcuggggcucauuugcaggggggagccaaaagggucaucaucucugcccccucugcugaugcccccauguucgucaugggugugaa

SEQ ID NO: 115 - RNA, 65 nt, Human
cuggccaacagccuugccugucaaggaaaguacacuccgagcggucaggcuggggcugcugccag

SEQ ID NO: 116 - RNA, 61 nt, Human
agaaagaccggguggcccugaaccaggaggugauggcuccagaggccaccaagaacuuuuu

SEQ ID NO: 117 - RNA, 76 nt, Human
gagaaacaaggcgaggaggaggaugcagaaaucauugucaagaucuuuguggaguuuuccauagccucugagacuc

SEQ ID NO: 118 - RNA, 63 nt, Human
gucucuggcagcuaaaggagaaggaagacgaggagcuguuucccgagucagagcggcagagau

SEQ ID NO: 119 - RNA, 82 nt, Human
ggggaccggucucaccgaaugcauccugucgggcaucaugucugugaacgggaagaaggugcugcacauggaccggaacccc

SEQ ID NO: 120 - RNA, 60 nt, Human
aggcuuagacugugggaaggauaaauugcaaaugcuucuuuaugguacccugguuggccu

SEQ ID NO: 121 - RNA, 62 nt, Human
auugaugccacuaggagucaauauugguguauauauuaaugauaggcucuuggggcaucgau

SEQ ID NO: 122 - RNA, 60 nt, Human
ggacuguucuacucagccucuguggaagaaaacuucccacagggcugcacuagcacagcc

SEQ ID NO: 123 - RNA, 63 nt, Human
auuucuggagggagacgggcacacacaaaguccaccuucaccauguccagaauuuccagaagu

SEQ ID NO: 124 - RNA, 91 nt, Human
ggcccgauuuacagggagaagcucggcaacguggagucgguuuaugucaucgacccugaagauguggcccuucucuuuaaguccgagggcc

SEQ ID NO: 125 - RNA, 61 nt, Human
auggagaguucaaagaccuaagccuugaugacuuuaagggaaauauuggugcuuucucuau

SEQ ID NO: 126 - RNA, 78 nt, Human
gcacucuugucagacuuaacuaagcagauucccgagauacggugugcuguuagaagguucuggucugcacuaagaggc

SEQ ID NO: 127 - RNA, 82 nt, Human
ggcugcuguaggacgguugcuccgagcgucgguugcccgacaugugagugccauuccuuggggcauuucugccacugcagcc

SEQ ID NO: 128 - RNA, 76 nt, Human
caaacaagaggacuguguuguggucuggggagaauguaaucauuccuuccacaacugcugcaugucccugugggug

SEQ ID NO: 129 - RNA, 89 nt, Human
ggggaugaauucuucaaauaggagccgauggaucugugguccuuugggacucaucaaagccuugguuuagcauuugucaguuuaucuuc

SEQ ID NO: 130 - RNA, 63 nt, Human
gagaguauuugugcgcgcauauacgguggguauaugugauguauugugggacaaaauauuuuu

SEQ ID NO: 131 - RNA, 73 nt, Human
uauaauguggggacaaaaaauauaccuauagaggagaaauuuauaagagccuuauaggggguaacauauuaua

SEQ ID NO: 132 - RNA, 88 nt, Human
caacucuauagaaagaaaggagauuauuacccagaauucacauguagugauuauuaaggacaauuuuuuuuuuuaacuaaaaaaguug

SEQ ID NO: 133 - RNA, 70 nt, Human
uccauugaaagugcuucaaggguaaucuuggguuucuagcaccuuaucuaugauguuucuuugcaaugga

SEQ ID NO: 134 - RNA, 69 nt, Human
uugaacucugauggcuguuaucaaaggaacuuuucuuguuuaaauugcugaugcaggaauuaaguuuaa

SEQ ID NO: 135 - RNA, 84 nt, Human
gcagagcuggggcugcgcggggccgggcgagcgggaccaggcgggagccauggaccgcuagggcccggccuagccccgcgaugc

SEQ ID NO: 136 - RNA, 61 nt, Human
gccggcgaguggccccagcguccucgcgcggcuguugccgcugcuggggcugcugcucggc

SEQ ID NO: 137 - RNA, 61 nt, Human
gcggggagcuggugccccuggcccgggccucaguggacuguguuugggaaccggacucugc

SEQ ID NO: 138 - RNA, 66 nt, Human
gcuugggcaccugggugcuggucacugcugcccgcccuggcuuccucaccaacucugugcccuggc

SEQ ID NO: 139 - RNA, 60 nt, Human
cccgacccgcgcccgggccugcgggcgacucgagcgggcccugcuggcugcggcugaggg

SEQ ID NO: 140 - RNA, 82 nt, Human
ugaauaccaacaauaucacugagcuagugacuauugggaaaugaacuaguuuugaugaagcuuagucugauaacugauuuca

SEQ ID NO: 141 - RNA, 74 nt, Human
ugguccgugaaaucugaaaaguucuaggguccgcaacaggaccuuuccgaggacgacauugggcgcguaggcca

SEQ ID NO: 142 - RNA, 65 nt, Human
uguguucccccuuauaaaguuugccaaaaggggggcugacccccuauuuuauaagaggccgcaca

SEQ ID NO: 143 - RNA, 61 nt, Human
ccuccaggcucaugaugguguugcuaaggaaucacagacaccuaaggugaguucugggcgg

SEQ ID NO: 144 - RNA, 67 nt, Human
gcagccgcuuuggaugcucuucggccugcacgggaccaucacgcagauccgcauccucggugagugc

SEQ ID NO: 145 - RNA, 60 nt, Human
gggcguaugccuuuccuggaggcggggacgauccggguaggagacaaagggcgagcuccc

SEQ ID NO: 146 - RNA, 70 nt, Human
agcccagaaagaguuaagaaggugcugggcgugguggcucauaccgguaaucccagcacuuuaggaggcu

SEQ ID NO: 147 - RNA, 65 nt, Human
agguggguggaucacuugcggucaggaguucgagaccagccuggccaacauggugaaaccugucu

SEQ ID NO: 148 - RNA, 61 nt, Human
agacaguagcucccuuaaaacacacacacacucuucaugguaugucacagaacuacagucu

SEQ ID NO: 149 - RNA, 71 nt, Human
uuguugcccaggcuggagugcaauggcacgaucuuagcucacugcaaccucugccucauggguugaagcaa

SEQ ID NO: 150 - RNA, 110 nt, Human
gguuccgucacccccucccagggaagcaggucugagcagcuuguccuggcuguguccaugucagagcaacggcccaagucugggucuggggggggaagugucauggagcc

SEQ ID NO: 151 - RNA, 64 nt, Human
gucauccucguccuccucugccuguggcugcugcgguggcggcagaggaggggaugagucugac

SEQ ID NO: 152 - RNA, 87 nt, Human
ccguguacaggcugcuauccacaccaccaaagacaaccguuccuccgcuggaacccugcugguggcugaaguagacgcuuaaaacgg

SEQ ID NO: 153 - RNA, 63 nt, Human
gccuggccgccgaugaggaacucuucaaugccaaucugccaguagaguuccugggugacaggc

SEQ ID NO: 154 - RNA, 91 nt, Human
ggcgguugaaggcguuguaggcugacuccaggucgaacagcaucugacgcaccugugagucguccagcucaucugacgccgacaugccgcu

SEQ ID NO: 155 - RNA, 72 nt, Human
guauauauaugauaaaugauuauaacgugugugucagugacaauauguagucuuugguuguuaguuauauac

SEQ ID NO: 156 - RNA, 72 nt, Human
cagaggaggcgacuguugauuugaaauuccuaaaaaugacguaguagucccggauccuuaguuggcuuccug

SEQ ID NO: 157 - RNA, 63 nt, Human
ccucaugggcugaugguuaucguggcucuuuccugccuucucuuuagcuauggaccagugagg

SEQ ID NO: 158 - RNA, 87 nt, Human
gagcauuuguuggaguauuuaggauuuaaucuccaaggcuaccauccagucuuggagugggguuuagccaacuccacacuggugcuc

SEQ ID NO: 159 - RNA, 65 nt, Human
ccuauauuaaacaaaucaauuagccaaacagaaaaaccuucaaaaauuauugauaaauuuauagg

SEQ ID NO: 160 - RNA, 79 nt, Human
ccuggggugaggggcccggguugcgggccguuccccuccuccgggguuggacuucgggcccggagccuccuccccuagg

SEQ ID NO: 161 - RNA, 65 nt, Human
gccggagaugggcccggcggauacuccucuuuuggggaagagguucaagcuggcccauggccggu

SEQ ID NO: 162 - RNA, 71 nt, Human
gcgagcuacagcuucaccaccacggcgagcgggaaaucgugcgcgacaucacaggggaagcugugguacgu

SEQ ID NO: 163 - RNA, 73 nt, Human
gcauggaagaggagcucgggaggacaggguuggggccuccagggucugacaccaccccacuccucuuccuagc

SEQ ID NO: 164 - RNA, 67 nt, Human
ggacaggcagcuuugaacagaggaaacaaaacuccaacuuccuccaaacuccuaugcaggcaggucc

SEQ ID NO: 165 - RNA, 66 nt, Human
ugagccucuccuggcucugucugcuggucuaggccaggguggggcugaucaagggcagagagcuca

SEQ ID NO: 166 - RNA, 61 nt, Human
ugggggaagaggaagagaggacagagaggccaaacaggccucuuccccuccucuucaccca

SEQ ID NO: 167 - RNA, 97 nt, Human
ccgcuugguuuuuuuugguaauuaaauauuguaugauuuaucugguucaaggaagaugcacuauucaguuaucuauugagaaauuauuuugcagugg

SEQ ID NO: 168 - RNA, 68 nt, Human
auaguauucuuugcaaaugugaaagcgagacauuauaucuucucuugcuugguguaacuaaucacugu

SEQ ID NO: 169 - RNA, 64 nt, Human
guggucaacaucgguacucuuggcaggaaagaaacacuguccuuccuucuccacauaaggccac

SEQ ID NO: 170 - RNA, 62 nt, Human
acuggacaaccccaaaaguggcgcuugaugccgauggcuaccgcgucuccaagggucacagu

SEQ ID NO: 171 - RNA, 72 nt, Human
gggguggggggcccaauaaggccuuagggaaaggacaggugccgagcccugcauguggagcccucccacccc

SEQ ID NO: 172 - RNA, 87 nt, Human
uccgccggucccaguccaggucucgcuggcgcuuuucuuccuggagccucagcuucuccuggauuugcugcuucuggacuaggcgga

SEQ ID NO: 173 - RNA, 71 nt, Human
uguauuaaauugugugaaauagucucccguggguugauuuguauagacuucauucauauauuuuuucugca

SEQ ID NO: 174 - RNA, 80 nt, Human
ccaagggagugcaauuuuucaucuuccaauggcggccucaaccuugaggcgaauccacuggcgaaagaugccuuucuagg

SEQ ID NO: 175 - RNA, 64 nt, Human
gcuaagauaguucagauugaucuuaggucaaugguaagaccuauguaguucaugaagucuuggc

SEQ ID NO: 176 - RNA, 65 nt, Human
uuucggcgcuggguccccaaagcagaauggagacggauagagugguggcucccagaaucccgaag

SEQ ID NO: 177 - RNA, 62 nt, Human
gaucacauuuuauuucauuacacuagaucacauuuugauuacugcauuuugaaaauguauuc

SEQ ID NO: 178 - RNA, 62 nt, Human
gugacaccacccaucuccaacauucagaugcccaggaugguaauggagguaaagugugucau

SEQ ID NO: 179 - RNA, 78 nt, Human
guucucaguuagguacaaaaugaacuaaauuaagccaaaaagggcagugcuaguguaaacaguaugaaacaugaagac

SEQ ID NO: 180 - RNA, 86 nt, Human
aggucuccuuaccuucugcuucccuuucugccugugacugaaugggcaugucaaggucuaguaggggauccaggaggaggaagccu

SEQ ID NO: 181 - RNA, 104 nt, Human
gggucagcaggaaguugcggcugaugagcagcucccggagcgguggggcggggccuccucuucuccaguuccaguacgcucaucagucguccuccugcugauuu

SEQ ID NO: 182 - RNA, 82 nt, Human
guuguucucagauaucaguucuucccaggugaacagcagugaaucugugacuucaccaaauggauuaaagucaaugagccac

SEQ ID NO: 183 - RNA, 79 nt, Human
cgugucuuaugagaucuagauacugauacucgccauguguuccuucacauggcucuggucuggucacauauucugcaug

SEQ ID NO: 184 - RNA, 62 nt, Human
gguaauuuuaucagcuauauauauauauaugagaauauauauauauuuuguuguuuuguacc

SEQ ID NO: 185 - RNA, 76 nt, Human
gcccugccaagcacagcguagaucuggaaagagcagaaugcuuuccuuuucagauguggcuggucauggaaggggc

SEQ ID NO: 186 - RNA, 62 nt, Human
ugcuacuauuuuauugcaggagguggggguguaugcaccgcacaccggggcuaugagaagca

SEQ ID NO: 187 - RNA, 75 nt, Human
agugccaucuagaugagauaccagggcauuucugaggauguuuuugccccgggccaccucacucuccguggcacu

SEQ ID NO: 188 - RNA, 65 nt, Human
cuggcauucaccuccgcaauccggcuuucccauucagccagggggaugcggcggccauaggucag

SEQ ID NO: 189 - RNA, 83 nt, Human
guuauuuuaugagccccaaauuuaggauuuacucuguuuucauccuagagggaggagaguucuauccagacucauguguugac

SEQ ID NO: 190 - RNA, 84 nt, Human
cauugauaguuuucaugaaucguggaaugauuuaucuuuucagaaacagauaaaugguuccgugauucaugaaaacuaccagug

SEQ ID NO: 191 - RNA, 63 nt, Human
guccuuugugguagacuacaugucauuuuguaguuuaacauaucauuuuuccauuuauaggau

SEQ ID NO: 192 - RNA, 100 nt, Human
aaacagacugggccaauguccacaaagaauuccuggucagcaccaccgauguccaaaggugcaauaucaaggaagggcaggcgugauggcuuauuuguuu

SEQ ID NO: 193 - RNA, 106 nt, Human
aaauggaaggauucagcuuucaguuaaaaaagaagaagaagaaauggcaaagagaaaaguuuuucaaauuucuuucuuuuuuaauuuagauugaguucauuuauuu

SEQ ID NO: 194 - RNA, 70 nt, Human
auuuuuauuuugguuuucuuacaaagguugacauuuuccauaacagguguaagaguguugaaaaaaaaau

SEQ ID NO: 195 - RNA, 77 nt, Human
cuaggggucuguaccgggcuggccugugccuaucaccucuuaugcacaccucccaaccccuguauucccaccccugg

SEQ ID NO: 196 - RNA, 93 nt, Human
gugcggcgugcacuggacuuugccgucggcgaguacaacaaagccagcaacgacauguaccacagccgcgcgcugcagguggugcgcgcccgc

SEQ ID NO: 197 - RNA, 75 nt, Human
uuggacguggagcugggccgaaccacguguaccaagacccagcccaacuuggacaacugccccuuccaugaccag

SEQ ID NO: 198 - RNA, 83 nt, Human
gcgauccagugcguagcguauugccuauccauugugaugcguacgcccaucauaacauuaggagaucgaaacgauaagaucgc

SEQ ID NO: 199 - RNA, 77 nt, Human
acagaaugcugucuuggaccaguauucaacuuguggggcaaccuaaauuugggaguauugcuuuuucuguauucugu

SEQ ID NO: 200 - RNA, 61 nt, Human
aucaauguagaacucagccuucuuggaaagaaaaaaaagaggcuccggguugacaaauggu

SEQ ID NO: 201 - RNA, 81 nt, Human
auccuugaaggaaaugacauugagcuuguuucaaauucagcggcuuugauucagcaagccacaacaguuaaaaacaaggau

SEQ ID NO: 202 - RNA, 101 nt, Human
gcuccgcccggugcccagcguuuucgcgccccaagagcaggaauaccagcaggccuuguugcugguggcggccuuggcggugccugggcuugggccugagc

SEQ ID NO: 203 - RNA, 62 nt, Human
uaugagaaugauccagaauuaggauccgaagagagaggaacuacuccuggauggacaucaua

SEQ ID NO: 204 - RNA, 77 nt, Human
uuaugaagacauacuggauggcaguggguacuucgaugugagggacaaggaggaccaguggauccggaucuucaugg

SEQ ID NO: 205 - RNA, 66 nt, Human
cugguuaacuucuugagcuauuucguggaacuuggaacacagccugccacccagugaaguguccag

SEQ ID NO: 206 - RNA, 62 nt, Human
gacuauggcaaggaccugauggagaaggucaagagcccagagcuucaggccgaggccaaguc

SEQ ID NO: 207 - RNA, 93 nt, Human
ucaccaucugcagccuugaaggagcuuugguucggagacaggcaaaggagccauguguggagagccugguuucucaguacuuccagaccguga

SEQ ID NO: 208 - RNA, 116 nt, Human
acugguuaacuucuugagcuauuucguggaacuuggaacacagccugccacccagugaaguguccagaccauugucuuccaaccccagcuggccucuagaacacccacuggccagu

SEQ ID NO: 209 - RNA, 62 nt, Human; identical to SEQ ID NO: 206

SEQ ID NO: 210 - RNA, 93 nt, Human; identical to SEQ ID NO: 207

SEQ ID NO: 211 - RNA, 116 nt, Human; identical to SEQ ID NO: 208

SEQ ID NO: 212 - RNA, 62 nt, Human; identical to SEQ ID NO: 206

SEQ ID NO: 213 - RNA, 93 nt, Human; identical to SEQ ID NO: 207

SEQ ID NO: 214 - RNA, 84 nt, Human
cagcucuucucuuuggacacaugggccuucuuagaggguucagucuaggacccggcucuccuggcccuguguugaggguagcug

SEQ ID NO: 215 - RNA, 79 nt, Human
uuuuucuuucuuuuuuaaaagaagaugguuucacuuuaauauaaugcuauuaucuuaagacuuaaaaaaaaaaaaaaaa

SEQ ID NO: 216 - RNA, 87 nt, Human
agggagaggggggggggggggggggcggagaaaaaagaaggugguuuguuuuuuuuuuuccccccccccaccccucccccuuuucuu

SEQ ID NO: 217 - RNA, 74 nt, Human
ggaggggaguuuguuuuuuuuuuuuucccccccggccccccccccggggaaaaaaaaaaaaagaaacccccccc

SEQ ID NO: 218 - RNA, 91 nt, Human
aagaugcuguccgugcgcguugcugcggccgugguccgcgcccuuccucggcgggccggacuggucuccagaaaugcuuuggguucaucuu

SEQ ID NO: 219 - RNA, 75 nt, Human; identical to SEQ ID NO: 74

SEQ ID NO: 220 - RNA, 87 nt, Human; identical to SEQ ID NO: 76

SEQ ID NO: 221 - RNA, 71 nt, Human; identical to SEQ ID NO: 77

SEQ ID NO: 222 - RNA, 60 nt, Human
guacuuaaucuuaaauacgcugaguacuaaaaaguguuuauuucuuauuucaguaagugc

SEQ ID NO: 223 - RNA, 68 nt, Human
gcuuuuggaauaccuaucagaguauauacacaugagguaguaacacucugguacagaucuccagaagu

SEQ ID NO: 224 - RNA, 73 nt, Human
uugcuggggucagcucguuacucaacuccaguugacauuuggaguauaggcaccauauuugcugaacuagcaa

SEQ ID NO: 225 - RNA, 72 nt, Human
ccaccaaaaugcuuacauccguguguaauaucccgagaaauuauggaaaauuauaacauagcauuaaggugg

SEQ ID NO: 226 - RNA, 80 nt, Human
gcuuuauuugagaacaggugaaucagcugaauuuguguguaaacggggauaucgucuuucaucacguucucacacauugc

SEQ ID NO: 227 - RNA, 69 nt, Human
gaccaauuuguucuaccuagcauuuuaacuaguuuuucugccagcuauguugaaugcacaaauucuguc

SEQ ID NO: 228 - RNA, 68 nt, Human
gcauguucauucauugcuacauaauuugguucuucuggaauauuuuuauguagcucuuggaguacagc

SEQ ID NO: 229 - RNA, 61 nt, Human
acucguuggaagggauguggccuggggcuggagugagcaggccgugucccugagucagagu

SEQ ID NO: 230 - RNA, 74 nt, Human
gccuagagugaugugccgccugcaggaccagggccucauccuguaccaccagcaccagcacagcugcugugagu

SEQ ID NO: 231 - RNA, 60 nt, Human
cccgccaggccuccauagagcugcccagcauggcuguggccaguaccaagagucgguggg

SEQ ID NO: 232 - RNA, 76 nt, Human
cgggcaugggaaguaugagaaggugcuugugggggggcccggcucccuaggcgucccaucucgcuuccugggucug

SEQ ID NO: 233 - RNA, 84 nt, Human
cgggugagguacaggcucagucugcggccaagacuccguccugcaaggauauuguggcuggagacaugagcaagaccccaucug

SEQ ID NO: 234 - RNA, 69 nt, Human
cucauuuuaauccugcagggcugccugccaguggaucuauccagcugcuuccuuguagccaagaaugag

SEQ ID NO: 235 - RNA, 91 nt, Human
uccugcucugugccucaaccuauucuccauaauagggagucuaauccuauuccuucccugccugaugaggauggugugaggaugaggagga

SEQ ID NO: 236 - RNA, 71 nt, Human
uguuuucagggagacugguauuuuugaagcugcuaucauuuucuauuucuuuauuaauuucuuuguaauca

SEQ ID NO: 237 - RNA, 79 nt, Human
acugauguucuucuacauuugaagaguucuccguaguacuacuuuauggaucugaacugaaguccuguagaauaucagu

SEQ ID NO: 238 - RNA, 61 nt, Human
cguacuguacuuacuagaacugcgcuagcuauauguuagauacugucgguaagacucuacg

SEQ ID NO: 239 - RNA, 89 nt, Human
uggccucaggcgagauagggugugacuucaaguccgguagacuauugacuggccgguccuuauacaguaaauucucgucucugugguca

SEQ ID NO: 240 - RNA, 68 nt, Human
gcaaaaucacucguuuuguagggaaagguugcuuuguuaaucaugcccuauggugggugauuaacugc

SEQ ID NO: 241 - RNA, 62 nt, Human
gcgcugaaugaugucacggcagucguugaacacacggcggauguucucaguguccacagcgc

SEQ ID NO: 242 - RNA, 72 nt, Human
uuuccuuuuucuguaggccgccuuaagcuuucuaaauuuggaacaucuaagcaagcugaagggaaaaggggg

SEQ ID NO: 243 - RNA, 85 nt, Human
agaggacagacuuaucuucagaacauuucagucauuccucaaaguggcuagaaacuugucagcaugaaucagaugagcagccucu

SEQ ID NO: 244 - RNA, 77 nt, Human
ccauuuccuuagaggggagucuucacccaaauuccccgugucuugaacaaguacacuuggguccccaggggagcugg

SEQ ID NO: 245 - RNA, 61 nt, Human
uuugaggcccguuuagauaccauggcagagacaaacagcauaucuuuaaauggaccuuuga

SEQ ID NO: 246 - RNA, 78 nt, Human; identical to SEQ ID NO: 99

SEQ ID NO: 247 - RNA, 65 nt, Human
gaagguuaagcuggcuguccugaaauauuauaagguggaugagaauggcaaaauuagucgccuuc

SEQ ID NO: 248 - RNA, 80 nt, Human; identical to SEQ ID NO: 100

SEQ ID NO: 249 - RNA, 90 nt, Human
ugaucaugacuuucaaaaauucaacuaccuagaaauaguuaccuccaguuuagcacauuuagguauuuggacauuuaaaguacuauuuca

SEQ ID NO: 250 - RNA, 74 nt, Human
uguguuuauagugacugaguaugaugcuuauagaaaauuaugccauauaugaucaacuauuaccauuaaacaua

SEQ ID NO: 251 - RNA, 79 nt, Human
gcugaucuccugccugauguuucugucucagagccaaggccaagaggcccagacagaguugccccaggcccggaucagc

SEQ ID NO: 252 - RNA, 78 nt, Human
guuuuuuuuuuuuuuuuuuuuuuuuuuuuugaaaaaugcccuuuuucuuuagggggaaaaaaacggggaaaaaaaaau

SEQ ID NO: 253 - RNA, 76 nt, Human
uugggauucuuuucacaaaaagggagguauugggaaauugguauugaagaacccuucuuggggggagaaaucccaa

SEQ ID NO: 254 - RNA, 112 nt, Human
auaugauguagaaauaccucgguggacaacauugcuaaaauggagauugccaccaaggagccaaugaaucccauuaaacaauauguccacaggauggaaagcuacgcuaugu

SEQ ID NO: 255 - RNA, 102 nt, Human
gauacaggagagucagaaacaaacuuauagugaugcguuggaagguuaaucgaaaacauccuuacgccuauuuaauguaguuaaccugauuuaucugauauu

SEQ ID NO: 256 - RNA, 65 nt, Human
ggagaagcuagaggaggaggccaagcuaaaggaacuuuuagagaaaggcugauuccaaucucucc

SEQ ID NO: 257 - RNA, 66 nt, Human
ggggaaaagcccgggaaaaaaccgggugcuaaaacgcguggugagaaaguccccgggaggugcucc

SEQ ID NO: 258 - RNA, 75 nt, Human
uacccuauagcuuguuuuauuagcauuccggauauucuuguccauauuucuaauauaaccggugcuauuaaggug

SEQ ID NO: 259 - RNA, 85 nt, Human
gcuaaugagguggaacaacuuguugcggaagaggaauuuuuacaagaagcuagaguugcaucuucccaaguucuccauuucuggc

SEQ ID NO: 260 - RNA, 71 nt, Human
ggagacgcaaccguguuuuucauucucccuaaccaaggcaaaaugagggagauugaagagguucugacucc

SEQ ID NO: 261 - RNA, 100 nt, Human
gauuccccuguccaugguggucggaaacugcgcauugaacagggugugcaagucauccuggacccagugcacagcguucggcucuuugacugguggcauc

SEQ ID NO: 262 - RNA, 125 nt, Human
ucccuugggggcagccucgaguguaguccauuaguaaucagauuccaguuuggacaggguggcuggauuguauaucucguuaguaauguacaugcucuucagguucuagggcuccuguuagggga

SEQ ID NO: 263 - RNA, 77 nt, Human
gaggaggaaauaagaugaucauugaggaggcgaaacgaucccuucacgaugcuuugugugucauccggaaccuccuc

SEQ ID NO: 264 - RNA, 86 nt, Human
ugauugugcaccacaggcguggacaaaaauagauaugcaagcaagcagcgauguggcacugaagaacaccugugagugggcgauca

SEQ ID NO: 265 - RNA, 71 nt, Human
ggcacaugcaggugguggagaccuugcugaagcacggagcaaacauccaugaccaacuuuaugauggagcc

SEQ ID NO: 266 - RNA, 63 nt, Human
ggugaugcugcugcgcggaccgaccgcgacgcugcgggaaacgaugggcacaacagcauuauu

SEQ ID NO: 267 - RNA, 72 nt, Human
cggucauaucgagacagaaaaagaccauuccucaucccagaagagggggucugauaagccauccuaugaccg

SEQ ID NO: 268 - RNA, 60 nt, Human
augugcagaggagaagaucccaccgagcacacugguugagauccaucugacugcugccau

SEQ ID NO: 269 - RNA, 103 nt, Human
aacauacagaagaagcaaggaaauuacaguuagaggucacaacugcccgaagccaguucuaaauuuuuaugaagccaauuucccugcaaaugucauggauguu

SEQ ID NO: 270 - RNA, 84 nt, Human
cacagaaucagaccaugacuaccuucaccuggaacaucaaccacgcccggcugauggugguggaggaacgauguguuuacugug

SEQ ID NO: 271 - RNA, 90 nt, Human
ccaagaccaacaggaugccacgcugggccgagcgacuauuuccugccaauguugcucacucgguguacguccuggaggacucuauugugg

SEQ ID NO: 272 - RNA, 81 nt, Human
ucuggcagcgguacccgaaucccuauagcaaacaugucuugacggaagacauaguacaccgggaggugaccccugaccaga

SEQ ID NO: 273 - RNA, 76 nt, Human
acugugaaaaagauauuuguugguggcauuaaagaagacacugaagaacaucaccuaagagauuauuuugaacagu

SEQ ID NO: 274 - RNA, 77 nt, Human
ggucgaaagugguucuuggaaaacuuuggugggugguccguggagggugguuucgguggggaaugacaaauucgguc

SEQ ID NO: 275 - RNA, 76 nt, Human
ggccaguugcucuaaguggauuggauaugguuggaguggcacagacuggaucugggcuagagagaggcgaugggcc

SEQ ID NO: 276 - RNA, 113 nt, Human
guggaaacauacagaagaagcaaggaaauuacaguuagaggucacaacugcccgaagccaguucuaaauuuuuaugaagccaauuucccugcaaaugucauggauguuauugc

SEQ ID NO: 277 - RNA, 78 nt, Human
uaguuaaaaagaaguggaaucuugaugagcugccuaaauuugagaagaauuuuuaucaagagcacccugauuuggcua

SEQ ID NO: 278 - RNA, 68 nt, Human
gacgaggaagaggaggagcaguugguucugguggaauuaucaggaauuauugauucagacuuccucuc

SEQ ID NO: 279 - RNA, 67 nt, Human
uuauauuugaagaaaauguugaacaugcugauacagaaggcaauaauaaaacagugcuaaaauauaa

SEQ ID NO: 280 - RNA, 61 nt, Human
acugugauagucaugauuuaaaguuaugaaacuuccauugcaaaauuacaacugagacagu

SEQ ID NO: 281 - RNA, 79 nt, Human
gauauauuuauuggaaaauacccaaauaauaaauuaucuauuauuuaauuuaauaugacuuuauauucuaaauuauguc

SEQ ID NO: 282 - RNA, 131 nt, Human
uaugacuuuauauucuaaauuauguccaguuggucuauaaguauuuaucccauuacauuuaccuaguuauuuuauuaauuguuuaccuagauuauuuauaaaaacugugauagucaugauuuaaaguuaug

SEQ ID NO: 283 - RNA, 77 nt, Human
gaguaacauacaaagcuauaauuaagaugaaguaaugaaagccaaaacauuaaaauuuuaaaacuugcuuguuacuu

SEQ ID NO: 284 - RNA, 72 nt, Human
uguggucuuaaacuucuguuuuacaaaauccaaaagguaaauacagaagaaaucaauacaauagagauuaua

SEQ ID NO: 285 - RNA, 76 nt, Human
gucacacagguuuuaagacuuugcaagaauugucaucaaaugauaugcuuuuacuucaacuuagaacuggaaugac

SEQ ID NO: 286 - RNA, 84 nt, Human
aaaagaaaaccaaagugguccacaaaacauucuccuuuccuucugaagguuuuacgaugcauuguuaucauuaaccagucuuuu

SEQ ID NO: 287 - RNA, 64 nt, Human
acuuuuuuaaugggucucaaaauucugugacaaauuuuuggucaaguuguuuccauuaaaaagu

SEQ ID NO: 288 - RNA, 89 nt, Human
ggccaauugaaacaaacaguucugagaccguucuuccaccacugauuaagagugggguggcagguauuagggauaauauucauuuagcc

SEQ ID NO: 289 - RNA, 92 nt, Human
caaaaucccuugacaaaagcgcauagguuauuucaaaccaggcauuguuuuuuauguaaccuguuuuaccgcaucuucucaggcagguuuug

SEQ ID NO: 290 - RNA, 67 nt, Human
cucaugagacucuucauuuuguccacuuugacaggaaaagugggaauguaugcagagcucucaaaag

SEQ ID NO: 291 - RNA, 62 nt, Human
cagugauguuuauaauguucugccagcagcuccuggaggcucuggcugaaggucugcagcug

SEQ ID NO: 292 - RNA, 69 nt, Human
gccuguccaaucagaggauccauuuuaugguugaugcgaauacaacgguaacccgaucccuugcauggc

SEQ ID NO: 293 - RNA, 87 nt, Human
guugcggcccggguuuagaagggauucaugggggccgggcugccggugcggcccgggcggccggggcuucugggcgugggccccaac

SEQ ID NO: 294 - RNA, 103 nt, Human
cuuaaauggccaauugaaacaaacaguucugagaccguucuuccaccacugauuaagagugggguggcagguauuagggauaauauucauuuagccuucugag

SEQ ID NO: 295 - RNA, 66 nt, Human
gggagucaaaaauuuuuagcuacuuuaacacuaaagucaaacuaaaguagcuucaaaaagacuucu

SEQ ID NO: 296 - RNA, 72 nt, Human
guuggagaguagaguuaagacaaggcccaguuuguguuagccgaccgucuuggcccaccucuaugacccagc

SEQ ID NO: 297 - RNA, 95 nt, Human
uacgcagguacacacguguaccugaguguguucaugagggcaucugguguccaugugucugaguguagccuuuguaucaugugugugugugugug

SEQ ID NO: 298 - RNA, 66 nt, Human
cgguggcugggcugacgcugcuggcugucggggucuacucagccaagaaugcgacagccgucacug

SEQ ID NO: 299 - RNA, 65 nt, Human
ggcuggcaccuuguuucggggaaggauuccgugccuuugugacagaccgggacaaagugacagcc

SEQ ID NO: 300 - RNA, 65 nt, Human
gugacagugcuggcuagugacggcagcuccacuccugcucgagcaacgguuaccaucaaugucac

SEQ ID NO: 301 - RNA, 68 nt, Human
guguauuuaucugagaaagauccugucaauacaaagauugcccuaauuacaguuucagauaaggacac

SEQ ID NO: 302 - RNA, 63 nt, Human
ucuuugcuuuaaauaauacuacugggcugauuacaguucagagguccuuagauagagaggaga

SEQ ID NO: 303 - RNA, 64 nt, Human
gggggugggcuuuggcaguggcggggguagcagcuccagcgucaaauuugucuccaccaccucc

SEQ ID NO: 304 - RNA, 60 nt, Human
ccaaaaccugaggcagaaaguggauaauuugugucaacacaucuggacaagcaggaaugg

SEQ ID NO: 305 - RNA, 94 nt, Human
ggaugaacaauagucugcaauuuccccuaagccaggccuugggauucggacuuuugaggaccuggguaguaguuaguugacaugcuauuuaucu

SEQ ID NO: 306 - RNA, 77 nt, Human
cgcugaacucaugcagacgcuccgauuucuuggacucuacagagaugagcaucaggauuuuauggaugagcaaaacg

SEQ ID NO: 307 - RNA, 65 nt, Human
gaggaguauaacccggaggugggcuacugcagggaccugaaccacaucgccgccuuguccuccuc

SEQ ID NO: 308 - RNA, 72 nt, Human
uuccugagggaggaugcauucugggcacuggugcaagcugcuggccagugagaagcacuccccugcaaggga

SEQ ID NO: 309 - RNA, 78 nt, Human; identical to SEQ ID NO: 99

SEQ ID NO: 310 - RNA, 80 nt, Human; identical to SEQ ID NO: 100

SEQ ID NO: 311 - RNA, 102 nt, Human
ccucucucugguguuggaugcuuugugugaguuugccuuuugaaguucccaucucuugcggauucuuccucuguccauuuagcacuuugucuggaggggagg

SEQ ID NO: 312 - RNA, 103 nt, Human
gcagaaaagcauggauccuugcacugcuucacacggaagauucuugguauguucuuuuggaaaucuccuuacugauccguaggcacgacucuucauuuucugu

SEQ ID NO: 313 - RNA, 63 nt, Human
gccgguuuggcaccauuugcucuuuauccaccuccuucugaaguuguaaugccaauaaccugu

SEQ ID NO: 314 - RNA, 70 nt, Human
gaugggcgucccaguucccuuucccauuccugagccugaugguuguaagaguggaauuaacugcccuauc

SEQ ID NO: 315 - RNA, 60 nt, Human
gucaaugucaccuucaccagcaauauucagucuaaaagcagcaaggccguggugcauggc

SEQ ID NO: 316 - RNA, 83 nt, Human
auucaucacauuggguugaaaaguuggaagauuuugcaucuuauugaaaagaauuuuucaaaaauguuucuguacaaaugaau

SEQ ID NO: 317 - RNA, 63 nt, Human
cgcuggcuggggucgggcuccaugcucuggaugggacugggccgucgcacacgccagccggug

SEQ ID NO: 318 - RNA, 70 nt, Human
uccuuuaaacugagucaucaucuuaguccaacuuaaugcaguucgauuacaauggcguaggauagaagga

SEQ ID NO: 319 - RNA, 60 nt, Human
uuagaaugcaucgucuuuuauuuuccaggcuuccugggaucagauaugacauugcacuaa

SEQ ID NO: 320 - RNA, 68 nt, Human
aagaggaaacagccccacugcauuugagaagguuaccauuuccuucgaaguuccugcuguugccccuu

SEQ ID NO: 321 - RNA, 78 nt, Human
gcuuugcuuuauaguuuuauuaauguguuuguguuggcuuugcauguuuucaaauauaugaaugaaaucaugcagagu

SEQ ID NO: 322 - RNA, 66 nt, Human
ugccuuuucacuuggauuauguuccugagauguauccgggauuauuguguguaggcuguaugggca

SEQ ID NO: 323 - RNA, 63 nt, Human
gucagccccccccgaccccgccuccuugaugaaggaagguugugauugguccggagaggcugc

SEQ ID NO: 324 - RNA, 62 nt, Human
ucggauccuggcucuuugcggucugggagggugggccuuaccuagacgccggaggggaccga

SEQ ID NO: 325 - RNA, 60 nt, Human
aucagcucuugaugccuuucuuuuaaauuaauuauagacagagagaggcauuuagcugau

SEQ ID NO: 326 - RNA, 69 nt, Human
cguuauccucucaggauucuuaucugggcacuaauuuauaaaccauuauauuuauucaggaggaccaug

SEQ ID NO: 327 - RNA, 93 nt, Human
gcggcgaacuucugcacacagcuccaguguuugcucuggaucucgaugacuuucucuagcguggccacugcguugauguugggcuuuugcugc

SEQ ID NO: 328 - RNA, 68 nt, Human
acauaagcauuucccaaguugcuauuaucuguuaauaacagugguuugauuaauuggauuggcugugu

SEQ ID NO: 329 - RNA, 87 nt, Human
uuuuuuuuuuuuuuuuuuuuuuguuuuuauaauguuuuauuauaaaaguaauauaugaucuuuauagaaaaauaaagaaaauaaaaa

SEQ ID NO: 330 - RNA, 81 nt, Human
cuguaugucuugugaugggacaguucauaauguaguugcuagaccacuuuacaaauuguucuugucaccagauguguucag

SEQ ID NO: 331 - RNA, 97 nt, Human
ugugacuuuggugccguuacuugugaaaaaucuauucuguugucuuugauguguccaagaaaauucguguaguuuacguaaaaauaucugacucaca

SEQ ID NO: 332 - RNA, 65 nt, Human
gaagagccuaaacaugguguucaauagucuacuaugaauuaaacaaucguguggagaagcuuuuc

SEQ ID NO: 333 - RNA, 81 nt, Human
gggacuguuuaacuuuagagacacuuuaaguuacgauacuggaggucuacuuugaaaccgauauuacagauuauuuuuccc

SEQ ID NO: 334 - RNA, 99 nt, Human
uggaaaagguguucaucuguacuauguugguggagagguguaugcggaaugccucagugacagcagcauauuuguacagaguaggaacugcaacuuuca

SEQ ID NO: 335 - RNA, 67 nt, Human
gggccagguccggacaagacagcacuccugaagcagaugggcaggaggugaucgaggagccuggccu

SEQ ID NO: 336 - RNA, 78 nt, Human
uggaugcagugacacaccagugggagcugcuggcugccccuugcagcccacuccccaaacuggcuacccaggcaucca

SEQ ID NO: 337 - RNA, 76 nt, Human
guucugggagcucugcaaaaucaguagcaagugcuggaaaaggcacaugccgaagauacucaagagcucccaagau

SEQ ID NO: 338 - RNA, 61 nt, Human
ugaccccauccauccaugaccagaggauuauuuuccugccuuggcagaggaggaggaguca

SEQ ID NO: 339 - RNA, 82 nt, Human
aaugugaacauuuauucauauuguuuugauuacccucguguuacuacaagauggcaauaaauacuaugggauuguuuguauu

SEQ ID NO: 340 - RNA, 60 nt, Human
gaucaugcuaaaaggagauaauauuacucugcuacaaagugucuccaacuagaaaugauc

SEQ ID NO: 341 - RNA, 61 nt, Human
guccugaaaaaauaagcaauuaucauaacaauuuguuauugauacuggagguuucauugac

SEQ ID NO: 342 - RNA, 78 nt, Human
uaaaagucuucaacaucuaauuuauaagcuuuacaaguauuuauuuuauaaggcuuagacagaauuauuggaguuuua

SEQ ID NO: 343 - RNA, 86 nt, Human
cugccucuggaguccuagagacccggauuuacucagcuaggagagaggauggaucacagggucuaaggguggccauucagagguag

SEQ ID NO: 344 - RNA, 69 nt, Human
uuucuucagcuuuuaaaaugccuguccaaguugcuuacugggauuagaagcagaaggcugacaaagaaa

SEQ ID NO: 345 - RNA, 75 nt, Human
guaaauauuuaacaaauauguuuguauucuucuauuuuuauacaaugaauauuaauacauauugcauuuauuuau

SEQ ID NO: 346 - RNA, 71 nt, Human
guucaauuguacaaaaccuaauuuguugucaaaaguaucaagcaauaaauuuuaaauauuguacagggaau

SEQ ID NO: 347 - RNA, 61 nt, Human
ccaguggaagaugcucaacaccuccuccuugcuggagcagcugaacgagcaguuuaacugg

SEQ ID NO: 348 - RNA, 60 nt, Human
cugugacggucccuguagaagucuccaggaagaacccuauauuuauggagaccguggcgg

SEQ ID NO: 349 - RNA, 69 nt, Human
aaacaucuccaggcuuugauuuuuguaccauggaaauuguauuuaaccauacaggguuuugguauguuu

SEQ ID NO: 350 - RNA, 72 nt, Human
cccuuuuuccccuuuaaaaaauuuuugugaaaaguuucuuaaaaaaaaaaaaaagugggaauuguuuguggg

SEQ ID NO: 351 - RNA, 67 nt, Human
gcaucagaguaaucuucaguguggaauguuaaauaacgcuuuuauacuguauuuuguacuaugaugu

SEQ ID NO: 352 - RNA, 62 nt, Human
auucaugaaaacauugaagccuauaauauaaauuuuuauuaccacuuucaauagucauuaau

SEQ ID NO: 353 - RNA, 80 nt, Human
gcaggugcaaccugggagugcgugaaugcguccacccacaggaggagcgcuccucaugcucugacaguucugcgacaagc

SEQ ID NO: 354 - RNA, 108 nt, Human
gcgcugcucaggcgucauggcucccgacgggcgcugcucccuggcgcgcucuguugaggcgccggccggcuggcgcaguccugugggcggcguggcgcuugcaagcgc

SEQ ID NO: 355 - RNA, 77 nt, Human
gaaagccuacugaauccgcucugcagaaucacaguguuuacucugaaauucauuuagugaaguaguggaaggcuauc

SEQ ID NO: 356 - RNA, 62 nt, Human
guuuucauccucuaguacugaagugcccucaaggggguaggcacuguauagcaggagaaaac

SEQ ID NO: 357 - RNA, 84 nt, Human
ucauguacaagaguucacaccugaugaauguagacacauuccuagagaacauuuaucaaugugaaaauuucuuuaauacacuga

SEQ ID NO: 358 - RNA, 70 nt, Human
ucauuuuacagaugaguuuaugcuagcugugccuuugcucagagaucauaaauuuaugugugaucuuuga

SEQ ID NO: 359 - RNA, 63 nt, Human
ccuuucaguucuguaccuaggccuccaaagcacuuuagccuguggggcuugccagaacucggg

SEQ ID NO: 360 - RNA, 93 nt, Human
cugcaggaagaagaugaucugauggccgugggugucugggaagcucuucguggccucaaugcccuccuuuauccucaucuuucuucuaugcag

SEQ ID NO: 361 - RNA, 60 nt, Human
gcuuacucguaaugaucuaguggggaaacaugauucauucacuuaaaauacugauuaagc

SEQ ID NO: 362 - RNA, 91 nt, Human
aagcugggggcacuggcuucugcucuugcucuuucuucuggaaacauuauucuguuccuuuggacaugggcaaggguccugucccuaacuu

SEQ ID NO: 363 - RNA, 62 nt, Human
cccugguacuccuuauguagugagugauagaugcucauggaaaauggggagaaaacuaaggg

SEQ ID NO: 364 - RNA, 81 nt, Human
uugaucuuaaccaguuucacuuguaccaagaccaaacuuucuuaccuuuccaugcagggaaacaggcaccaucaagaucaa

SEQ ID NO: 365 - RNA, 74 nt, Human
cugaucaauccuucuuuuucucuuuugcccacaauuuaagcaaguagaugugcagaagaaauggaaggauucag

SEQ ID NO: 366 - RNA, 64 nt, Human
guuaaaaaagaagaaaaaagaaauggcacaaagaaaguuuuuucaaauuucuuucuuuuuuaau

SEQ ID NO: 367 - RNA, 80 nt, Human
uuucaauuuuuauuuugguuuucuuacaaagguugacauuuuccauaacagguguaagaguguugaaaaaaaaauucaaa

SEQ ID NO: 368 - RNA, 75 nt, Human
acgugugucugugugugcguauccacacuaggggugcaagccucugggugugugugugugugugcgugcgugugu

SEQ ID NO: 369 - RNA, 90 nt, Human
agcaccagcucuugccccuaugcuggguaccaagggaguucuccuagcuguggcuucucuagguucuaggggugcaagccucuguguguu

SEQ ID NO: 370 - RNA, 68 nt, Human
uacuuaccaagguucuccacugcuuaccuuuuccagugggacaguacagugugagcccccgggaagua

SEQ ID NO: 371 - RNA, 92 nt, Human
uuugguuugguaacuuuuucauccauggcugagguugaugcugccauggcugcaagaccucauucaauugaugggagaguaguugagccaaa

SEQ ID NO: 372 - RNA, 67 nt, Human
ccucuucucucuucccuccaccagaucuggcauuuaagggcacgaugggagcgggagacaggagggg

SEQ ID NO: 373 - RNA, 82 nt, Human
uagugcacaaugguggaaggaggcgguucguauguccccaggggcggcaucccaaugccagaccuuccucccaugggcucug

SEQ ID NO: 374 - RNA, 84 nt, Human
acguaaauucuguuuguuauagaguuucuucaguuguuacccaagugucauccuagagaagucagaagaaucagaauccaucgu

SEQ ID NO: 375 - RNA, 63 nt, Human
auggugauuucaaucgcaauauuuuaaauugaugagaaugauuuguaaacaugaaguuacuau

SEQ ID NO: 376 - RNA, 78 nt, Human
uauuuguauuuuacuaugauaguugagaaauuuagccucuuagucauuuuuagcuguuauuguggaagaccucaaaua

SEQ ID NO: 377 - RNA, 88 nt, Human
gacggcaaauauucuggggugaaggaggucauaauggggaaacacuuuuuuuuccccuuuuuaacuuccugugcccaagcuugccuuc

SEQ ID NO: 378 - RNA, 77 nt, Human
uguugcuaucuaucacuuucauguaacaauggacuuaguguccauuaaacugccugagaagugguuugagccugaca

SEQ ID NO: 379 - RNA, 88 nt, Human
acuagcaucacuccuaaauaaugugaacuuguuuugauuuuuuguuugaggcagagucucucacaguguuccuaggcuggagugcagu

SEQ ID NO: 380 - RNA, 66 nt, Human
auggucuuggcucauucugggcucaagcaauccuuucgccuuagcccucucaguagcugggacuau

SEQ ID NO: 381 - RNA, 62 nt, Human
ccaugcucggcuaauuuuuaaaauauuuguagagauggggucuugcuauguugccgggcugg

SEQ ID NO: 382 - RNA, 64 nt, Human
gggcaccccagugucccgcuggcccagcaggagucacuguuggccucuggacacucaucggccu

SEQ ID NO: 383 - RNA, 62 nt, Human
guguauuugaaugacuauuuuauucguauuuaaaauaauacuauuaaguaagcauuuugcac

SEQ ID NO: 384 - RNA, 84 nt, Human
agcucuuccgccuggcgcggcuugaggaccagugcacugaguacauggccaaggucauugagaagcugguggagcgggaggacu

SEQ ID NO: 385 - RNA, 89 nt, Human
cguggaggcggugaaggaggaggcagcggcuguggcagcccggcaggagacggacucuaucccgcugguggacgacauccgcuuccacg

SEQ ID NO: 386 - RNA, 63 nt, Human
acaagucuugggaaguccaucugacucucugaaacaguuugucucugaccucccaggaagugu

SEQ ID NO: 387 - RNA, 61 nt, Human
uggcacauauaauaauuaacaacagcaaagaugcuugguuucuuguuucauguaauggcca

SEQ ID NO: 388 - RNA, 125 nt, Human
gccaaggcucugaguuugagguguccugugcccugacccuacaagaugccaagagaagaugcucacuucaucuaugguuaccccaagaaggggcacggccacucuuacaccacggcugaagaggc

SEQ ID NO: 389 - RNA, 63 nt, Human
ggguuugaucaucgggacagcaaagugucucuucaagagaaaaacugugaaccugugguuccc

SEQ ID NO: 390 - RNA, 67 nt, Human
auccucacaggcacuggacaauucaaaaaacguaaaguuguuuguuagaauacuggugcuuuuggau

SEQ ID NO: 391 - RNA, 62 nt, Human
aacugggcggagguggaggugcagugucaacuguggcucuguaacucuucaaaggcccaguu

SEQ ID NO: 392 - RNA, 99 nt, Human
ccagugggaguacucaaguccuaucuccauguuaguucuucaaucuaauauuaacuauauuuuggcaaguaauaugacuauaggguuugguuuccgggg

SEQ ID NO: 393 - RNA, 60 nt, Human
gccccagccaccauauaccccugcaguuugcacuuuaauugaugguaguucaguuggggu

SEQ ID NO: 394 - RNA, 63 nt, Human
ugcugugaucugauuggaggagggacaguuucugguacccauccucugauuuauacauaugca

SEQ ID NO: 395 - RNA, 91 nt, Human
uugcagugguuuuagugggugaaaaugucccaucugcaccaguacacaggcaggcauuaucauucuucaccuacuuuuuaaauaguggcaa

SEQ ID NO: 396 - RNA, 63 nt, Human
uuuuuauaaguauacugcauuuuuugagccuaucauuaauuagcuuaguaugaaagauaagaa

SEQ ID NO: 397 - RNA, 88 nt, Human
cugugggaugauugccacauacauggaacaccugggagugcuggaaauguacugggaucgaagugacaaaguguguuuucauucacag

SEQ ID NO: 398 - RNA, 66 nt, Human
uucagugacguacauggcucugguucuggacacaaaaucuguacuggagaggaaaugacugcugaa

SEQ ID NO: 399 - RNA, 75 nt, Human
ggcaguggcugauugacacccucuaugccuucaacaguggaaaacguagagcgguuccagacucugaagacugcc

SEQ ID NO: 400 - RNA, 68 nt, Human
ggggccagcagccugauuuagcagcuaaugaagccagcuucugagggaaaauucaguuguugugccuc

SEQ ID NO: 401 - RNA, 74 nt, Human
ggggcuagcaggacuucucggcgagggaguuuuuaacuuuggagaacuccucaugcacccugugcuggaguccc

SEQ ID NO: 402 - RNA, 69 nt, Human
aguuauggguauguauuauaauuucuaaaaugcaaauaaauauaaagaaaauaaauauaacccauaauu

SEQ ID NO: 403 - RNA, 63 nt, Human; identical to SEQ ID NO: 123

SEQ ID NO: 404 - RNA, 65 nt, Human
ccccacgcucaguccuggucaaaggcugccagaccuuucugagugcccccagggaggggcugggg

SEQ ID NO: 405 - RNA, 91 nt, Human; identical to SEQ ID NO: 124

SEQ ID NO: 406 - RNA, 66 nt, Human
gcggcugcagaauaccgccugcggaguaacugcaaagaugcuguccgugcgcguugcugcggccgu

SEQ ID NO: 407 - RNA, 87 nt, Human; identical to SEQ ID NO: 76

SEQ ID NO: 408 - RNA, 64 nt, Human
ucguaggccuucucgaugcacccagcgaucucaucccugauagugucgagcaggaugucaauga

SEQ ID NO: 409 - RNA, 72 nt, Human
ugaagaagguguagcucucggcggggauguuacccuuggccaggaacacuuuguuguagcugcccuccauca

SEQ ID NO: 410 - RNA, 91 nt, Human
uuguuggggcccaggacccacccucgcuucuuggcguagucugucaucuuuugggguguguugaagaagaggauccggguggccucaguga

SEQ ID NO: 411 - RNA, 101 nt, Human
agagggugggagccuaaggaagcgugggguagcagauggaguaauggucacgagguccagacccacucccaaagcucagacuugccaggcucccuuucucu

SEQ ID NO: 412 - RNA, 68 nt, Human
cuacgugccagcucuaguuuucagccuugggagguuuuauucugacuuccucugauuuuggcaugugg

SEQ ID NO: 413 - RNA, 68 nt, Human
caggcucgugggacuguacguggacccgcaaggccggagggcacgcgcgcaggagcucauguggccug

SEQ ID NO: 414 - RNA, 69 nt, Human
gagcaucgcaggcggaggggcagccucuagaccgugguaaaucccaaugaccccucgcuugcguuccuc

SEQ ID NO: 415 - RNA, 103 nt, Human
gccucuuguggucggaagcaccgagugugcuacuucuauccguggucguaccuugauggagcggaaggcagauuagacaucgaggcuuccggaaaacaaaggc

SEQ ID NO: 416 - RNA, 112 nt, Human
uccagagaacgaagccauuccacagagaguucacugagauuguguggucccggcagcgugcagggccuggcggugcucaugggacaggcucuguguaggcuacccuucuggg

SEQ ID NO: 417 - RNA, 104 nt, Human
ccaaaaccuggguguccucacugcugcccugaguccagccaugguuuucagggggacaguggacagggacucagaaauguggugggagggccucccuggcuugg

SEQ ID NO: 418 - RNA, 86 nt, Human
guguugcugagguguaucuagaggaucccgguaagagcgucugugauuacgggacagccugcugagaaauugcacugaagagaugc

SEQ ID NO: 419 - RNA, 64 nt, Human
cugguugauuaaugagggcaugggguggucccucaagaccuuccccuaccuuuuguggaaccag

SEQ ID NO: 420 - RNA, 88 nt, Human
gcugggugccaggggcaggggauccucaguauagccggugaacccugauaccaggagccugggccucccugaaccccuggcuuccagc

SEQ ID NO: 421 - RNA, 88 nt, Human
guggcucggcucagcugccuggguuguggccgcccuagcauccuguaugcccacagcuacuguaauccccgcugcugcuccgggccac

SEQ ID NO: 422 - RNA, 79 nt, Human
agugggggugaauucauguguaguacaagccgauagacagaccaguccuugcuugacgcacaagucugaaugcuccacu

SEQ ID NO: 423 - RNA, 72 nt, Human
gcaggaccccagcuuagugagcuccuugaugcugcuuacaugucucgaucccacuuaacuaucuugggcugu

SEQ ID NO: 424 - RNA, 74 nt, Human
gcucuugcaaucaagucugugauguauuaauaaugccuuauauauuguuuguagucauuuuaaguagcaugagc

SEQ ID NO: 425 - RNA, 99 nt, Human
guguuuuugcacauaauccauauuugcuguucaaguuaaucuagaaauuuauucaauucuguaugaacaccuggaagcaaaaucauagugcaaaaauac

SEQ ID NO: 426 - RNA, 67 nt, Human
auguauuuaacaaucaucugguugacaaaaaauguaucuuuaauacagucagcuuuaaauuacgcau

SEQ ID NO: 427 - RNA, 110 nt, Human
guccuggcaaagaugacaugccguucacacucauucaucacgcugcgugccuucugauugucauagaguggcauaggcguugaugugaccgucuccacaucuauugggac

SEQ ID NO: 428 - RNA, 67 nt, Human
uugauacggagucuugcucuguugcccgggcuggagugcagugggugacagagugagacccuguuga

SEQ ID NO: 429 - RNA, 88 nt, Human
caggagcuguaggggaggucucugccagugcgggcuggcccucagcccgucgcgagggggaagacagcuccccagccugcagcaccug

SEQ ID NO: 430 - RNA, 83 nt, Human
auaggcacguuuccauaacucccuguucccaagguuuggauaaccuaugcucauuuagcaggaacacuacacuacgugcuugu

SEQ ID NO: 431 - RNA, 83 nt, Human
gcccuuuucccacuuuuuuugcuuguuuaauuuuagagugacaaaacucagauccagcuuguggaugcucuuggggaaacagc

SEQ ID NO: 432 - RNA, 69 nt, Human
gcuggcgaucuuuuuuuuuuuuuuuuuuuuuuuuuuuuuuuuaaaaaaaaauuccccgaaauugcccgc

SEQ ID NO: 433 - RNA, 66 nt, Human
agguugaaagauuuauucaagaucccaaagcuggcaguugauggaucugggauuucaauccagccu

SEQ ID NO: 434 - RNA, 70 nt, Human
cauaguuuauauguauaugcacacauacauacauauauguuguguauaaauguacacuuuuuuagacaug

SEQ ID NO: 435 - RNA, 70 nt, Human; identical to SEQ ID NO: 434

SEQ ID NO: 436 - RNA, 64 nt, Human
gcaccagcacaggccuccaggguagcaucuuucuugcucuugcccaugagguucagguaggugc

SEQ ID NO: 437 - RNA, 73 nt, Human
ucaccuccgggaacaccugguuccccaucacucugugcagcagaggguggcgggacauguugcucaggaggga

SEQ ID NO: 438 - RNA, 60 nt, Human
agugaauaccacauuucaauugcugccaaugacacagccccugaaguuauuaauucuacu

SEQ ID NO: 439 - RNA, 73 nt, Human
ccacugaaaagaaauggagaaugaaaaauuuaccaaugaaauaauacauuauucauuaucuuucucagguugg

SEQ ID NO: 440 - RNA, 63 nt, Human
ggacauuggaaaugacauuaauaucuucuacuugauuagaaaaaguggaucuuuuccaaugcc

SEQ ID NO: 441 - RNA, 75 nt, Human
auuguggacuggcuggcucuguuauaacucuguccaaaaaguguauggaauauaacuuguaaagcuucccacaau

SEQ ID NO: 442 - RNA, 83 nt, Human
uaugcauguguuuaaaccaaauaccagaauagcuuuaacaauagagcuagcauaauaguauuuauuaaagaaucacaucugua

SEQ ID NO: 443 - RNA, 82 nt, Human
gauccaucuguguaguuucugaacagucagcgauuccagguuuuaaauaguuuguaaauuuucaguuucuacacacuuuauc

SEQ ID NO: 444 - RNA, 70 nt, Human
ggguggcauggggagcagcuagaacagugcagauucauccauaaucccuuucugcuguucaccaccaccc

SEQ ID NO: 445 - RNA, 130 nt, Human
auaguuuaugcuguaauaguuuaugcuguaauaguuuaugcuguaauaguuuaugcuauaauaguuuaugcuguaauaguuuaugcuguauaguuaugcuguaauaguuuaugcuguagcauaaacuauu

SEQ ID NO: 446 - RNA, 91 nt, Human
uuuguugaugcaacucuucuggaaggaaaaaaagagccaaaugaucagccucaucaauacugaccuggcuaaaaacaaaauucccaacaaa

SEQ ID NO: 447 - RNA, 75 nt, Human
cagggagaggcucuucugcguguagugguugugcagagccucaugcaucacggagcaugagaagacguuccccug

SEQ ID NO: 448 - RNA, 75 nt, Human
gccgucggaguccagcacgggaggcguggucuuguaguuguucuccggcugcccauugcucucccacuccacggc

SEQ ID NO: 449 - RNA, 66 nt, Human
acauugaagaguggaaguguucaagaacaguggcucacagacuuacauuuacugcuuuuaacgugu

SEQ ID NO: 450 - RNA, 77 nt, Human
cuuguugcuacagucuucuuuauuuucugcucacuauagagaaaggggaagcagaacaucuaagaaagagggacaag

SEQ ID NO: 451 - RNA, 114 nt, Human
gaguccucagguugaugcugcagagccugcgggugaacagaguugggccugaggagcugccuguugugggccagcugcuucgacugcugcuucagcaugcaccccucaggacuc

SEQ ID NO: 452 - RNA, 94 nt, Human
uuuuuuuuuuuuuuuuucaaaaagaauguuuauuuuaagcucuauguacagaagaacagaguauaaacguaaaaaggaacaaaggaaacaaaaa

SEQ ID NO: 453 - RNA, 68 nt, Human
auagcuuuacagcguaggaucauaccacuaccaaaagagcaguggacaauaagacuauacugagcuau

SEQ ID NO: 454 - RNA, 62 nt, Human
ggcucccauacuuagaauguuucuaguuaagguaauaaauuaggcaacccaagugugacucc

SEQ ID NO: 455 - RNA, 70 nt, Human
aaaacaagccaacaacugaauuguaccuauggccaguggguggcacuaaaauacauuugaggcuuguuuu

SEQ ID NO: 456 - RNA, 97 nt, Human
uuaaaacuuuguugcaaaacauguuugugacuacucuuaugcugcuuucauauaguaaaguuauaagaaaaacaaucauauauaugcaggguuuuaa

SEQ ID NO: 457 - RNA, 66 nt, Human
acauagugaaaccccaucucuacuaaaaauacaaaaaauuagcagggcgugguggugggcacaugu

SEQ ID NO: 458 - RNA, 86 nt, Human
gagaaucacuugaaccggagaggcggagguugcagugagccaaaaucaugccacugcacuccagcuugggagacagagugagacuu

SEQ ID NO: 459 - RNA, 94 nt, Human
gaggcagaaucgcuugaacccuggaggcggagguugcagugagcugagaucgcgccacugcacuccagcuugagugacagagugagacugucuc

SEQ ID NO: 460 - RNA, 86 nt, Human
aauuauuucacugauguuuucuucucucuucauuucuuucuuucuagaaauccauguucuaauucagaggcauuaauucauuaauu

SEQ ID NO: 461 - RNA, 68 nt, Human
gcuauuuaauuccuuuguauaugauauccucucuccucuccgggagcuuguacgaucucuuuguuagc

SEQ ID NO: 462 - RNA, 70 nt, Human
uuuucuccauuuuacugggaacucaguuuccuuucagucuaggaacccaguuccuuuuauccucagaaaa

SEQ ID NO: 463 - RNA, 66 nt, Human
cacggugaaaccccgucucuacuaaaacuacaaaaaauuagccgggcacaguggcgggcgccugug

SEQ ID NO: 464 - RNA, 65 nt, Human
gugaacccgggaggcagagcuugcagugagccaagaucaugccacugcacuccagccugggugac

SEQ ID NO: 465 - RNA, 95 nt, Human
uggccgggcgcgguggcucaagccuguaaucccagcacuuugggaggccgagguggguggaucacaagguccggagauugagaccauccuggcua

SEQ ID NO: 466 - RNA, 63 nt, Human
ccucccacuaccacccaaucugccugccacagcaaagugcaggcacccugggcccccuggagg

SEQ ID NO: 467 - RNA, 65 nt, Human
gcagggccugguuucucuuccuugaaggccuuuuacagauuucagcuuucacugggccuccaugc

SEQ ID NO: 468 - RNA, 71 nt, Human
gugaggaguuuuuuuaaaguuuucuuuuuuaaaaaaaaaaaaagaaaguuaaggacaaacggcaaacucac

SEQ ID NO: 469 - RNA, 67 nt, Human
uuaacuacuauuuagauuuuggggauaaaguuuuccugucuuuuuacauuaauacaauaauaguuaa

SEQ ID NO: 470 - RNA, 131 nt, Human
guugaauccguugacagugagcgguugcaauccgcuugacagugagcgguugcaauccgcuugacagugagcgguugcaauccguugacagugagcgguugcaauccgcuugacagugagcgguugcaauc

SEQ ID NO: 471 - RNA, 130 nt, Human
ugcaauccgcuugacagugagcgguugcaauccgcuugacagugagcgguugcaauccgcuugacagugagcgguugcaaauccgcuugacagugagcgguugcaauccgcuugacagugagcgguugca

SEQ ID NO: 472 - RNA, 130 nt, Human
ugcaauccgcuugacagugagcgguugcaauccgcuugacagugagcgguugcaauccgcuugacagugagcgguugcaauccgcuugacagugagcgguugcaaauccgcuugacagugagcgguugca

SEQ ID NO: 473 - RNA, 79 nt, Human
gcuugguuuuagggauugagaacuugccuugcagguuuccuuccucaaaaggagcagggcaguccuuucccuguugagu

SEQ ID NO: 474 - RNA, 109 nt, Human
ugauuaaucacacgcuaauauagauuacugccucuaacuuuguaaguguggcaaugacuucuuaauuaaagaaagaugcaggaguuaugucuaagcguucaguuuuuca

SEQ ID NO: 475 - RNA, 69 nt, Human
uguguauggccauguuucauucucaaauuuaauucuauaaauacaaauccuaaauacauggcuacagca

SEQ ID NO: 476 - RNA, 65 nt, Human
ccaccugccccugagggagaggaaaggugaaguauuccugccaccucucccuccaagggaagggg

SEQ ID NO: 477 - RNA, 69 nt, Human
uggcugaugggcaagggggcaaaguaaggacauuuuuggugcaaagacucccccugacccaccaggcca

SEQ ID NO: 478 - RNA, 110 nt, Human
cguaagucguguaucguuaagugcgugaucguugaaugacgugcaucuguugaaugguugaucgcugaaguacguugcaucgcuuaaguacguugcaucgcuuaaguacg

SEQ ID NO: 479 - RNA, 66 nt, Human
ugugccgccgcgcccagcccccacaaaaaaguuaaaaaaaccauaggugggggccgcggccccaca

SEQ ID NO: 480 - RNA, 74 nt, Human
cugaauccuuccauuucuucugcacaucuacuugcuuaaauugugggcaaaagagaaaaagaaggauugaucag

SEQ ID NO: 481 - RNA, 73 nt, Human
guagauggcugcucuaaaaagacaaaugaauggggaaagacaaucauugaauacaaaacaaauaagccaucac

SEQ ID NO: 482 - RNA, 64 nt, Human
cacaaucuucaaaauucuugcaacauuaaacauaguaaaaugccagaauauaaaaugaggugug

SEQ ID NO: 483 - RNA, 71 nt, Human
ggucacaggauugaggccagcauuacaguuuggggugauuuuucuuuuauuugcucccucacuuuguuucc

SEQ ID NO: 484 - RNA, 62 nt, Human
cgccucuuaucaagucagcacacaccuuuuccaaggauuuuacguugcggcuuguuagggug

SEQ ID NO: 485 - RNA, 68 nt, Human
uuaagcaucugcaauggugacuuccaccucaacuccuggcucaauacugauggaaguaaucugcuuaa

SEQ ID NO: 486 - RNA, 64 nt, Human
uguuuuguuguugugcacuguucgagguguaguuguggguuuuaguugguguagcagugggaua

SEQ ID NO: 487 - RNA, 73 nt, Human
aaucauguagcugccuuauaaucuuuggcuccagucuuuaggcugccaacacauuauauaugccuuacugauu

SEQ ID NO: 488 - RNA, 75 nt, Human
ugacacagucucuaagccucaagucauguuccuaccuacuuuaucauacuuuauguaggcaaauuguuuguguua

SEQ ID NO: 489 - RNA, 76 nt, Human
guucuaaaauguaauuaggauuauauugugauggcauaguauauuuuccuuccuuaaucuugaucuuauuaagagc

SEQ ID NO: 490 - RNA, 78 nt, Human
gauuucauaggugucuguuuucuuguacuguuagcagauucugacagaugugaugagaagaagaaugcauuggagauc

SEQ ID NO: 491 - RNA, 63 nt, Human
uugcuaaaguugaacaaucccgguacuguaccauaucaguccuuuguggguaguagguagcaa

SEQ ID NO: 492 - RNA, 60 nt, Human
gccaucccacaguuguuacugguuugucaagcauaagccaugcccuaacgacaggcuggc

SEQ ID NO: 493 - RNA, 74 nt, Human
agcaacccccagccuggagcauaagagaucaagauccaaugcuaaacuccaaugguucagugacugugguugcu

SEQ ID NO: 494 - RNA, 81 nt, Human
gaggagcaacucauggugccuccgcuuuguuuuaguucaucaaauuucuacgacucauuaggcacuuugccacugcucuuc

SEQ ID NO: 495 - RNA, 75 nt, Human
gcgugauggcagccuugcagagcuagaccugcacuuaacuugcagcugccucccgagccuccaagauguccacgc

SEQ ID NO: 496 - RNA, 70 nt, Human
ggcggcagggcgcugcaccgugcucccccggcucugcucgacagcagcacgcagugagagccucgccgcc

SEQ ID NO: 497 - RNA, 124 nt, Human
uuucccacgacacgauguucccuuucuacagcugcuggaggacuggacugcuacuacuacuccuggcuguggcagugagagaauccuggcagacagaagaaaaaacuugcgacuugguaggaga

SEQ ID NO: 498 - RNA, 75 nt, Human
guaugcaauuccugucuucaaaaaaguuaccucaucagguagaugagacuuauuaugaauaaaaggaaucaauac

SEQ ID NO: 499 - RNA, 73 nt, Human
gggaagugcaguacagucgugaugcuccucugcccccccggcaagaccucaacgccccugaccucuauauccc

SEQ ID NO: 500 - RNA, 97 nt, Human
gggcugcuguucggcagcgauggcuacuacguggcgcuggccuggaccucaucggcgcucauguacuucauugugcgcucuuugcggacagcagccc

SEQ ID NO: 501 - RNA, 82 nt, Human
cagaaaagaggguuugaugauaaggauggcuauaccuuggggagaacuuaguggaguugaagaucagccagaucccucucug

SEQ ID NO: 502 - RNA, 75 nt, Human; identical to SEQ ID NO: 74

SEQ ID NO: 503 - RNA, 71 nt, Human; identical to SEQ ID NO: 77

SEQ ID NO: 504 - RNA, 89 nt, Human
uguccuugaacuuggaaccugacaauguugguguugucguguuuggaaaugauaaacuaauuaaggaaggagauauagugaagaggaca

SEQ ID NO: 505 - RNA, 75 nt, Human
cugcaaagaugcuguccgugcgcguugcugcggcgugguccgcgcccuuccucggcgggccggacuggucuccag

SEQ ID NO: 506 - RNA, 75 nt, Human; identical to SEQ ID NO: 74

SEQ ID NO: 507 - RNA, 87 nt, Human; identical to SEQ ID NO: 76

SEQ ID NO: 508 - RNA, 71 nt, Human; identical to SEQ ID NO: 77

SEQ ID NO: 509 - RNA, 80 nt, Human
cugggcuucaaggaaggacaaaccaucaaguuguguaucgggaacauuacaaacaagaaaggaggugcuucuaagcccag

SEQ ID NO: 510 - RNA, 71 nt, Human
uucaaguggguaaagcaggaaucugagauuuccaaggaaucucaagaaauggaugcucguccuaaguugga

SEQ ID NO: 511 - RNA, 72 nt, Human
gcaccccgccccucacuugcuggcuaguaugcagcugcagaaacuuaauagccaguaucaggggauggcugc

SEQ ID NO: 512 - RNA, 92 nt, Human
gccccuggcggaggggccgcaggucaccggccccaucgagguccccgcggcccgagcagaggagcggaaggcgagcggccccccgaaggggc

SEQ ID NO: 513 - RNA, 105 nt, Human
ugggcaaggauuggcaccggcccugccugcgcugcgagcgcugcgggaagacacugacccccggcgggcacgcggagcacgacggccaugcccuuacuugccaca

SEQ ID NO: 514 - RNA, 68 nt, Human
cuguggucagucucaguguucccuucaggguccgccggcucacgcugggagaaugagagggacuucag

SEQ ID NO: 515 - RNA, 69 nt, Human
uggauaacuaacgcgugcuuaagccucugaggaccucauucacuaagaggacgaggcggcgcaagucca

SEQ ID NO: 516 - RNA, 85 nt, Human
uccucaaauacuacacauuuaaaggaacuguuaaacugaaaaagacuugacaauuuuugguaaauccguagcacagaaaugagga

SEQ ID NO: 517 - RNA, 60 nt, Human
aguaccgaucuccugaacagaacugcuguaauaaagcuucauauucaccagguccguauu

SEQ ID NO: 518 - RNA, 83 nt, Human
ccgaagcgugcaaggaaaaauaaaaacaaagauaaccuguaaaaauauaacaaaucuucacuaugcauauuacaacacuuugg

SEQ ID NO: 519 - RNA, 75 nt, Human
gccgucggaguccagcacgggaggcguggucuuguaguuguucuccggcuacccauugcucucccacuccacggc

SEQ ID NO: 520 - RNA, 63 nt, Human
ugugucauuuuuuaauauagcugauugacuucacagaaagcagcuuuuuugaauucuaauaca

SEQ ID NO: 521 - RNA, 74 nt, Human
gccgggggucuggcaggaaugggaggcauccagaacgagaaggagaccaugcaaagccugaacgaccgccuggc

SEQ ID NO: 522 - RNA, 93 nt, Human
ucguucugcagauugacaaugcccgucuugcugcugaugacuuuagagucaaguaugagacagagcuggcaugcgccagucuguggagaacga

SEQ ID NO: 523 - RNA, 90 nt, Human
uuuggggggaccgccaggguccagacacggagaacggucaaaaaagaaaaaaccggccuucggggacagaaaaaaggcauuuccccuaag

SEQ ID NO: 524 - RNA, 73 nt, Human
caccgcgcugcucgccccacaugcccucauggcuguuguuccagggggggcaguggggugggccggccuggug

SEQ ID NO: 525 - RNA, 73 nt, Human
ccucgaacuggcuguuccaggcggcgucgggcugguuguuccagggcgcgucgcguggccguuccagccgggg

SEQ ID NO: 526 - RNA, 128 nt, Human
gguggcugcucuggcggcugcugcuggccccaaggagccacggggugaggcuggucaaaccaaaggggcuuguuuggugggaucuggucguguggcccggggcccggggcggacagcugcaggauucu

SEQ ID NO: 527 - RNA, 63 nt, Human
aagauagaggcagaacugcaggacaucugcaaugauguucuggagcuguuggacaaauaucuu

SEQ ID NO: 528 - RNA, 69 nt, Human
ugaaggcagucacagaacaggggcaugaacucuccaacgaagagagaaaucugcucucuguugccuaca

SEQ ID NO: 529 - RNA, 102 nt, Human
gagcgcaagaggacacauggcguggcaaggugacgagugacggugcuccuguccaucaucucguguaccucagccgugccgcucccugugagaucuuggcuc

SEQ ID NO: 530 - RNA, 69 nt, Human
gcaaggcugaacuucccuagaccuaagagugccuuggagcgccuguacucaggggaucaccagcgaggc

SEQ ID NO: 531 - RNA, 87 nt, Human
ggcagagggcucucaggguccacgucaaggguccagcagucgucaccauugcucccuacgucacacuccggagggugucucaaugcc

SEQ ID NO: 532 - RNA, 61 nt, Human
acgcuuaacuguuguguaucuuuuuuguucuuuacaagaagugcagagggguuuuuugugu

SEQ ID NO: 533 - RNA, 79 nt, Human
gcuuuauugccuugcauucuaaugcaguuuguucuguaacucgagagccaguagcauuggauugauggaaguguagggu

SEQ ID NO: 534 - RNA, 74 nt, Human
cucagcuagguccugaaauugucgugcuguucuauggaacacagauggggagcugauuuucauagucccuugag

SEQ ID NO: 535 - RNA, 81 nt, Human
ggugucuugguucuagcuucugggccucuuguuuucuagaauuauuugauacaagaaaguucuggcacaaccacaggcacu

SEQ ID NO: 536 - RNA, 78 nt, Human
ggcugaguguaugauggcaugacuauagcucacuguaaccuugaacuccugggcucaagcaauccuccuaccucagcu

SEQ ID NO: 537 - RNA, 92 nt, Human
ugccucagccucccaaagcaccauuaaucuuuucaagcagggccucaaggaguaaggacaaagcuaauggguuaauggguggggggcaggca

SEQ ID NO: 538 - RNA, 60 nt, Human
gauaauaaauaugauauuuaaacgaugaaacuaaauggugaaaaucucuuguuuuuuauu

SEQ ID NO: 539 - RNA, 86 nt, Human
ucuguggccccaggcaaucuuuucauuaacauuauauccuaaaaauuauuaugcuaauguuaaaaauaaagaaauugggacucaga

SEQ ID NO: 540 - RNA, 69 nt, Human
acuuuugauagauacugaguuuuugcucauuugcuacaugaagcagaggcagaguauucuguguggggu

SEQ ID NO: 541 - RNA, 60 nt, Human
ggacaggaacacugaccccugaagucgagccugggggucuaacauaguggucauuugucc

SEQ ID NO: 542 - RNA, 80 nt, Human
uuagaaaagugcugccagaaacauccuugccaugcuucuguauguacuggugcuaguguuucuaucagauaaauuuuuag

SEQ ID NO: 543 - RNA, 63 nt, Human
gguccccugccccuggaggugcuuuaagagcagcguccagaugaagcucggacauuggggacc

SEQ ID NO: 544 - RNA, 61 nt, Human
caccagcuucccaucacgugucucgaucuucuucacaaccacggcccuggaggagcuggug

SEQ ID NO: 545 - RNA, 131 nt, Human
gccucaggugggucuccuguucccagugcuacccugcauagcggccuccuucccaggcucuggggcagcgcaggagggguaggcugggaggggcugccgcagcuguucacuugggcaggacgucagaggac

SEQ ID NO: 546 - RNA, 82 nt, Human
ugggagggcaagagaggaagagauggcagcuuuuuaagugaaauuuuaaucuuaucuaucuuuuguucauuuugagucccca

SEQ ID NO: 547 - RNA, 75 nt, Human
uuucuuaaucacuauugucagcuugguugcuacacauuuaauuacaauauaaaguugacauugaggaugaagaaa

SEQ ID NO: 548 - RNA, 68 nt, Human
gccugcauaggcuguagcaaaguuugcaccauaaaacagugggccagcguaauggggcuucauaaggc

SEQ ID NO: 549 - RNA, 107 nt, Human
ugaagaauuuaauuacuuuaccaaaggaggggucuaccuuguaacuagccagguucaaaguuaaaaguagggcaacuucaguucggguuaagugaucugaauucuca

SEQ ID NO: 550 - RNA, 103 nt, Human
cuuagauggccaauugaaacaaacaguucugagaccguucuuccaccacugauuaagagugggguggcagguauuagggauaauauucauuuagccuucugag

SEQ ID NO: 551 - RNA, 74 nt, Human
uauucuaaguauuccaaauaaguugacucauacaguguuuauucuuuuaugucuggcuuauuucacuuagcgua

SEQ ID NO: 552 - RNA, 64 nt, Human
agaaguuccuuauauauuauguauauuaaccccuuaucagauauaugauuuguaauuauuuucu

SEQ ID NO: 553 - RNA, 109 nt, Human
ggugucuuaccauguugccuaggcugguaggcuggucucacacuccugagcugaaaugaugcuccugacucagccuccacaacuagcugggauuacauagugagucacu

SEQ ID NO: 554 - RNA, 61 nt, Human
gugcccuaagcccagcuuuuaaccacuaaacuguaguuucuggcaucaaguauuagggcac

SEQ ID NO: 555 - RNA, 85 nt, Human
ggcuugcgauuccacuccgggcaggcuucaggcuaucugggacggagacugccaggcugaagccuguuccugcggaacgcaggcc

SEQ ID NO: 556 - RNA, 77 nt, Human
uuauucugauuuuuucauaaucaaaggucauaugauacuguauagacaagcuuuguagugaaguauaguagcaauaa

SEQ ID NO: 557 - RNA, 65 nt, Human
uuuauugcagccuuucuuuuccuauuucuuuuuuuuaaggguuaguauuaacaaauggcaaugag

SEQ ID NO: 558 - RNA, 69 nt, Human
uaagguguauaccuagucugugcugauuaguaaaaaaauaacacagccuuucagagugguagaucuuua

SEQ ID NO: 559 - RNA, 130 nt, Human
gaacgugcccugugcuaugucgugccugcagggacacgucggaucccgugggccucacaugccaggucaccaggucaccgucuccuuccaccccugcagugugcuguugugcacgucagggacgcuguuc

SEQ ID NO: 560 - RNA, 65 nt, Human
gcagacucaugcagcccuauggccgcucagaccaaggcgcagagaggcuaucagggcggcucugc

SEQ ID NO: 561 - RNA, 66 nt, Human
ggcccagcaguauugcucacgggggcuccagccgccggcguggcccucaugagcuacgccuggguc

SEQ ID NO: 562 - RNA, 111 nt, Human
gccgcucgccuccuccugccguccgcucggcucaggcgcgggcccuggcuaucuggcgguccucggucuccgcccugcccccggccggcggcagguaagggaggcggcggc

SEQ ID NO: 563 - RNA, 66 nt, Human
cgcuguuacuagaaccuacuacccugccuuugaacauuagagcauacuuuguaggacucugcagug

SEQ ID NO: 564 - RNA, 77 nt, Human
cucuucccuguaagaauuuaccuuccaaauguggcuuuuccaucaaaguucaaaagcacuguucaaacuggggagag

SEQ ID NO: 565 - RNA, 63 nt, Human
gauuagcacaugacuuaaaaggugcuguugcauaauaaaaagucaacaaagcaugugcaaauc

SEQ ID NO: 566 - RNA, 78 nt, Human
cugguuuguugaaacaguaagucagacaacauuugccacaauaaugucugucaaagugacuugccauaaacaccccag

SEQ ID NO: 567 - RNA, 94 nt, Human
uucuuucucuugugcuuauucuucuugggagugguguaagacuucuucuuccuuuucuuagcaccaccacgaagucucgacgcgagaugaagag

SEQ ID NO: 568 - RNA, 68 nt, Human
cugccaaucaggaagcuccccaagccucacuguccagaguuuuuauugggguuucuuuacauaggcag

SEQ ID NO: 569 - RNA, 84 nt, Human; identical to SEQ ID NO: 286

SEQ ID NO: 570 - RNA, 81 nt, Human
ggcgagccgcagguggauugucugaaaagcucucaacagacaugggcuuagcacgaaccauauauccauuggcggaucgcc

SEQ ID NO: 571 - RNA, 80 nt, Human
agaggcaaagcuagggcagcucuggggucugggugggaaaggggcaucugaucucaguugcugcucaaggcacagcugcu

SEQ ID NO: 572 - RNA, 64 nt, Human
gcuucauucuuuuagaggaaaaaguacauagaaaacuguugcuguucucuacaaagaugacggc

SEQ ID NO: 573 - RNA, 66 nt, Human
uguuuaaaugauaaauuaggauauguuucugaauaugaaauuaagaaacauccuucagauuaaaua

SEQ ID NO: 574 - RNA, 68 nt, Human
agccauccugucaagcgcugggauuguucugaucucugggagccuccagggcugacuccaguauggcu

SEQ ID NO: 575 - RNA, 102 nt, Human
uaggucccaacaguuuguguuuuccuuacugucccaguuuuauaucauuauucuuaguacuaaacagagugacaacagggagugacauuuguugaggaccua

SEQ ID NO: 576 - RNA, 87 nt, Human
uccuccugucuuggucuaaacauguugagauuacaggcuugagccaccaugcccagccugaaaaacuuuuaagacaagacauuagga

SEQ ID NO: 577 - RNA, 63 nt, Human
ucaacugucaccauagaaucuagugcauggucuaccugacgaccagacaauguugacuacuga

SEQ ID NO: 578 - RNA, 82 nt, Human
aggagacguccucuacauaaaagcuccaugugaaaagcuacuccuagucuuaacauuugcaguccuugugucacugucuucu

SEQ ID NO: 579 - RNA, 77 nt, Human
ggcuuagcugugagaagugguucucuuccucuggucccuucuggggacucuguuuccccauuucuugcugcuguguc

SEQ ID NO: 580 - RNA, 62 nt, Human
ccuuagacuauagacauaacuacaaagccagugcagcuuuguuuucuguauguuguuggggg

SEQ ID NO: 581 - RNA, 68 nt, Human
gauuuuaagaacuaauaacaucuugaguuauuuuuaauucagggggauguggaaagguuugcaauguc

SEQ ID NO: 582 - RNA, 79 nt, Human
ucaccauugcguuacagcuacccacaguauucagcacaacaacgugcuuuacagguuuggggcccaguagcaaagguga

SEQ ID NO: 583 - RNA, 70 nt, Human
uuaagugaugcgugaccguaaauauauauagugcuaaguccuuauuauuugaauucauaaaaucacuuaa

SEQ ID NO: 584 - RNA, 75 nt, Human
augcacagaguuagguaacaaaaauuccuaucagaguaaaaugacaaagcacagaaaaaccagauucuaaugcau

SEQ ID NO: 585 - RNA, 74 nt, Human
uuuauugacuacuuuaaguagaacaaacuaaauacauauuuaacaguuuugguucauuuauacaguacauuaaa

SEQ ID NO: 586 - RNA, 65 nt, Human
cagggacagaaggcagcucccuucccccaggaagggcaagaggagcaggugccuggcugucccug

SEQ ID NO: 587 - RNA, 61 nt, Human
gcaacagacucuuuauuuaaugugguuuaaaauacaucaaaaucaagucccuggcuguugu

SEQ ID NO: 588 - RNA, 72 nt, Human
ugugcaaggcggaaaggcuggggcagcagcuggagaaucagcucagcaggccuuggcccucccccguggaca

SEQ ID NO: 589 - RNA, 86 nt, Human
gguccggcugcccuugaccgguccgaccuggcguccuccccgauaagccgccccacgggccggucccccgggccacaccgccggcc

SEQ ID NO: 590 - RNA, 64 nt, Human
ucugguuuaaacagaucaugaacuaacugaaacucagcuagccagaaugaacaacacaaccgga

SEQ ID NO: 591 - RNA, 60 nt, Human
uguacugacaacagcaaaauguucacuguuacacaggaauauuacuguaguccaugugca

SEQ ID NO: 592 - RNA, 81 nt, Human
gugcugucuuaugguugcguggcgaguuucugcuucagaugcagagcacuguccagagcuuccuccaguggacaauagcau

SEQ ID NO: 593 - RNA, 113 nt, Human
uucugauuuccugucguaagauuuuuucuuuucauuuucuccagggaggguaaaucaauauaaccucuucucuagagaggaggugguuagguuggucuuaagcaguguuagaa

SEQ ID NO: 594 - RNA, 81 nt, Human; identical to SEQ ID NO: 592

SEQ ID NO: 595 - RNA, 113 nt, Human; identical to SEQ ID NO: 593

SEQ ID NO: 596 - RNA, 69 nt, Human
ggggccuuugaauuugaggucuaugggcgggucgaggaccaggaucugcucgugcuucgccguggcccc

SEQ ID NO: 597 - RNA, 69 nt, Human
ugggucaauaauuccacuguugggccucacacaguaccggugaggcacgguagucuucacuuugaaaca

SEQ ID NO: 598 - RNA, 66 nt, Human
auucagaaggagguuguucaguuuucaugaguugugugguucugagugaguuucuuaauccugagu

SEQ ID NO: 599 - RNA, 84 nt, Human
auucuuuuacauuugcugaagaaugcuuuauuuccaacuauguggucaauuuuggcagaagugugauuuggugcugagaagaau

SEQ ID NO: 600 - RNA, 94 nt, Human
acaaguuauugccacugcuacgguauauuucaagagauucuaugccagguauucucugaaaaguauagauccuguauuaauggcuccuacaugu

SEQ ID NO: 601 - RNA, 85 nt, Human
uuugaucgaggagcgcgguuaccggacgggcugggucuauggucgcuccgcgggccgcuccgccggcuggugcuuuuuuaucagg

SEQ ID NO: 602 - RNA, 76 nt, Human
guaugcuaugcuaauuuuuaaaaaguaacauaacacuaagaucacugaauuuuaaguauuagauuuucuggugugc

SEQ ID NO: 603 - RNA, 92 nt, Human
uauauuuuaugaaagccuguuuuuuuuuuuuaacaaaagugaucuauaugggcuauucaguuuuaguagaagaguaaagguaauaagauaug

SEQ ID NO: 604 - RNA, 82 nt, Human
uuauauuuucuauguaccucucuaaacuaaguucucaaaauucaaaugagcuaaaauaaaaggagggaaauugugaauguaa

SEQ ID NO: 605 - RNA, 89 nt, Human
gaggaacagccgguaaugcccucauggauggagcaucucagcugaugggagaaaacaggaccaugaccauucacaacggcauguucuuc

SEQ ID NO: 606 - RNA, 62 nt, Human
uuacuguggcuuaccaggugaauauuggauagaaauggaggacuggaaaggagacaaaguaa

SEQ ID NO: 607 - RNA, 72 nt, Human
auggacaguauuagccaucauugaggcacucugucgcacucaacauagggcguguuggcugagauuguccau

SEQ ID NO: 608 - RNA, 70 nt, Human
cggugauugcugguaugagggacaucuaaucuugguucgacuuuaaauuugcucucggaacccauuaccg

SEQ ID NO: 609 - RNA, 90 nt, Human
gugagcgcacauagugucucacgugacuacuaguaugccaccugcaugaggcauuaacuuuaaacauggucugcgggacaugccgcucau

SEQ ID NO: 610 - RNA, 88 nt, Human
acagcugccuguacaucaacaucuucucagaaugacccagaaguuaucaucgugggagcuggcgugcuuggcucugcuuggcagcugu

SEQ ID NO: 611 - RNA, 79 nt, Human
cugccuuucauggcuucuucugggccaaaucccccccugaaucagaaaauaaggagcagcucgaggccaggaggcgcag

SEQ ID NO: 612 - RNA, 70 nt, Human
ugcagccggugguaucauguacucaagaccuggcuuggagauacacggcaggucugaugccccgguugua

SEQ ID NO: 613 - RNA, 74 nt, Human
ccugaauauagggucuccuuaaacacaucugagcacugaccuggaugagugcacuugggagaccuggugacagg

SEQ ID NO: 614 - RNA, 83 nt, Human
gagcaacaccguguugagaacuggaggaagacaggguucuggugccagaagcucuucuccaaucuuuaaagccaggcuugcuc

SEQ ID NO: 615 - RNA, 83 nt, Human
guggaauaucaaagguagaggggugauucugugagacugauaggccugacuauucucaauucuccccacugcaguguucacgc

SEQ ID NO: 616 - RNA, 73 nt, Human
gcugguucagguaagggguccccgccuaccagauucacuguacacugggacgucagcaaacaccugaaccugu

SEQ ID NO: 617 - RNA, 62 nt, Human
gaagacagaccugaaauccaaugacugauguuuucuguugguggugguggugguuuuuuuuu

SEQ ID NO: 618 - RNA, 77 nt, Human
gucagguuggauuccaggaggaaugugaugauugccaugagaggcaaacacacauuauuuuaggagcccaaccugau

SEQ ID NO: 619 - RNA, 63 nt, Human
augacuguuggagaggagaauaaaaucaaaacugcaagaacccauuuuugucuucauaagcau

SEQ ID NO: 620 - RNA, 71 nt, Human
gagggcuugaagacuucucagaagagacacucacuacuggaguuaaaguuauaugaagucccugagcccuu

SEQ ID NO: 621 - RNA, 63 nt, Human
gauuaaugcagguguuauagaagccagaagagaaacugugucacccuaaagaagcauauaauc

SEQ ID NO: 622 - RNA, 63 nt, Human
ggugcugcugguaccaaaugugauuuuagcuccauucagggcccagggguaaccagcagugcc

SEQ ID NO: 623 - RNA, 63 nt, Human
auugagacgacauuguuccacaaaguccuuuaggaggggcgauugaacgagagucgucugaau

SEQ ID NO: 624 - RNA, 116 nt, Human
cagguaggucugucgcuucgaucggcaccuugucgcguacuuuuuccacacucugcgccagcagcgcgggggacgaaaggguggcgauaaacgccaacgauagauggcugagccug

SEQ ID NO: 625 - RNA, 75 nt, Human
acuacuauguuaucucagcaaauuaagcgaugguuuuaaacauaaccuucuuaaagcuauucaggauuuaguagu

SEQ ID NO: 626 - RNA, 60 nt, Human
ugaaaaugaaagcguccuuaacaccucauuacuuagagggguaacucuuucagaaauuca

SEQ ID NO: 627 - RNA, 66 nt, Human
auaaguaauaccugauuguuuccuuuucuguucuaguaacucacaggagauacguguuuuauuugu

SEQ ID NO: 628 - RNA, 92 nt, Human
cuaagaagaagcgaggugguugaauuuuggaagcacuucuugaaucggauuaacccaugcucuuauugaauuuuuucaucugcucuguuuag

SEQ ID NO: 629 - RNA, 79 nt, Human
cuauuaugaacacaugagaaugauuuuuuucucuuaaucauuauuaaggaaauauuuuaauuucauggucauauaaugg

SEQ ID NO: 630 - RNA, 84 nt, Human
cucuguuuaguuugauauuaaagcaaaauuaagaggucuuaguuuuuccuauagaacuuuuaauaugucaauucagaaauagag

SEQ ID NO: 631 - RNA, 87 nt, Human
auuuacacuuucccauguuacagcacaauauuucaauggaauauuucuugccauaaauaauaucuugcugauuuguagaagugaaau

SEQ ID NO: 632 - RNA, 74 nt, Human
guuuauguucuucaagguaaagaaaaaugacauaguaaaugauuguuuaaaauuuuuaaaauccagacauaaac

SEQ ID NO: 633 - RNA, 91 nt, Human
agugggccuaauccuuaugcgcguacccguucucccuuuggucagggcuauacccaaccugagaccugguuaucgauaaggagggcucucu

SEQ ID NO: 634 - RNA, 93 nt, Human
gauguaccaacaguaccagcaacaggccggcuauggugcacagcagccgcaggcuccaccucagcagccucaacaguaugguauucaguauuc

SEQ ID NO: 635 - RNA, 68 nt, Human
cuugaaucuuugaaugacuauuccaaguaagauucaacauuuuuacagaauuguucuucaucauuaag

SEQ ID NO: 636 - RNA, 79 nt, Human
aggccaaauuuccacuuucagcaguuuuauuucagcuguuagcccgaagaaagaagcugcugaaaacagaaguucaccu

SEQ ID NO: 637 - RNA, 77 nt, Human
gcaguacaugauuuuuaucuaacaacguuugauucuuucccagaauuaaaugcugcauuuaagaaagaugccacugc

SEQ ID NO: 638 - RNA, 68 nt, Human
uuguuuucccuaacaucaagaaugugagagaaccaccaccaauuugccuugauguuagacaaaaacag

SEQ ID NO: 639 - RNA, 91 nt, Human
uuugugaaugcuguguaugauaccuuacuuaauacuccucaagacguucagaagacaguauuaaagggaaucauuaacagccuguuacgag

SEQ ID NO: 640 - RNA, 67 nt, Human
cgccucacgcgaagucuacaaaugcaucaagaaagcggugaagcagaagcagauucggcgcggggug

SEQ ID NO: 641 - RNA, 75 nt, Human
gugugaggaccgaaauuugcccuaugucuauauccccucuaagacggaccugggugcagccgcacguccaagcgc

SEQ ID NO: 642 - RNA, 60 nt, Human
caggucgcgcugccgccgccacugcugccgcucaaacagcaggguggcgcgagcccccug

SEQ ID NO: 643 - RNA, 69 nt, Human
guauuaaauugugugaaauagucucccguggguugauuuguauagacuucauucauauauuuuuucugc

SEQ ID NO: 644 - RNA, 87 nt, Human; identical to SEQ ID NO: 172

SEQ ID NO: 645 - RNA, 81 nt, Human
gcugcuugagucaugcugaagagauaggcuucauagauuauauuuaagaaguugucaucauucugaaugagguacagcagu

SEQ ID NO: 646 - RNA, 130 nt, Human
cuauaaaaccauccagaccucucgauggccacuucugaaaacauccacggugaagggcagggcaggccuggcuguggagugggccagcugaguaccugggcgucacaagggaaaugguuggggauuaugg

SEQ ID NO: 647 - RNA, 71 nt, Human
uuuuuuuuguauguggauaauauuuauuuguaucuuaucuauagaacaaauauuuacagauacaaacggaa

SEQ ID NO: 648 - RNA, 87 nt, Human
gcuggcccucacucccgcuaggaugaucacuuuucaugguuauugcuccauuuagggucucuagaaggcagguaguguggugccggc

SEQ ID NO: 649 - RNA, 68 nt, Human
auguuuauugauuuggucuuggcuuauuguguaaaccauuuaauagccaaaagucagaauuuaaacau

SEQ ID NO: 650 - RNA, 74 nt, Human
cugaguagcagugaacucaggagcgggacagguccauucacccugaaauuccuccuuggucacugccuucucag

SEQ ID NO: 651 - RNA, 98 nt, Human
gcagaccagucuuccguggcaggcugagcgcuccagucuucaguagggaauugcugaauaggcacagagggcaccuguacaccuucagaccagucugc

SEQ ID NO: 652 - RNA, 78 nt, Human
ccaggggugggaauacagggggugggagguguacauaagaggugauaggcacaggccagcccgguacagaccccuagg

SEQ ID NO: 653 - RNA, 80 nt, Human
gcaagaagguaggagggagggcagagcguugucugagcaacaaaggccgccugcugccuucucugucugucuccuggugc

SEQ ID NO: 654 - RNA, 93 nt, Human
ggucauugugcccugccaagcacagcguagaucuggaaagagcagaauguuauccuuuucagauguggcuggucauggaaggggcaguugucc

SEQ ID NO: 655 - RNA, 68 nt, Human
cgggugguaaaguggcaacgcgaauuuggguaucuggucucccaaaaguacuugccgcucuaccccug

SEQ ID NO: 656 - RNA, 89 nt, Human
gcccuccuucuugagggggccagccugcgaugauggauuccgccaucaggucuuccgguaucguaaaacaucuccuuaaggaggcuggc

SEQ ID NO: 657 - RNA, 97 nt, Human
ggugccuuaacugagucaucuuuuuuccauuccauucaugaaagcaacauaagaaagccaagagugaaagggguaaaagaucacaguauaaaggucu

SEQ ID NO: 658 - RNA, 64 nt, Human
ucuuguuucucauugggacggugacuguguauaguggaaagcacagagccaaugagggacagga

SEQ ID NO: 659 - RNA, 94 nt, Human
agucggcggaagcccugcgcgcgcucagccugcagcugguggaugcgcugcaccagcguccggaucggggcgucuuuccagggccacgccggcu

SEQ ID NO: 660 - RNA, 78 nt, Human
cugcugagguucuggaguggcacaggaacaggaggagcaaaugacacugggucuuugugcugaggcaggacacagcgg

SEQ ID NO: 661 - RNA, 63 nt, Human
gggcccugcgccugaugagcugccaugaaaguggccgccucucacacuggcaggcgguggcuc

SEQ ID NO: 662 - RNA, 63 nt, Human
caggugcggaugcaggcggcggcgcgcgugcgccacagcgcuguccaccugcagcugcgccug

SEQ ID NO: 663 - RNA, 66 nt, Human
gggcgucacguugcaaugacuauccuagggugacaacagaauagaaacacagcauuaacggcgccc

SEQ ID NO: 664 - RNA, 64 nt, Human
cagcacaggagcguccaggcacugcagcucgucuggguagucggcgccagagcucccaguguug

SEQ ID NO: 665 - RNA, 73 nt, Human
ggcuuuuucuucuggggacagcaucaccccaggaaacaacuccuuggagcuguccauugcagaccacagggcc

SEQ ID NO: 666 - RNA, 62 nt, Human
gaaguccggguucaaauuccccgaauucggaauuggcggaaauuggccccgggaagggcuuc

SEQ ID NO: 667 - RNA, 75 nt, Human
cugggacuauaggugugugccacgaugcuggcuaauuuuuuuguauuagagaugugguuucaccacguugcccag

SEQ ID NO: 668 - RNA, 87 nt, Human
ucuuuugcuuuaaauuuaucuuuuuauacaagauauugauggauuaaacaauauccaagauaagaaucugaauuuuaauacagaaga

SEQ ID NO: 669 - RNA, 86 nt, Human
cgagauugagcaauaacaggucugugaugcccuuaguuguccggcccggacaacgacaggauugacagauugauagcucuuucucg

SEQ ID NO: 670 - RNA, 73 nt, Human
gacaguucaaaauuggccugauccauggccaucagguuauuccauggggagauauggccaguuuagcccuguu

SEQ ID NO: 671 - RNA, 68 nt, Human
guugcaaaggcaauuugauguggacauucuuaucucggaacacacacacaaauuugaagcauuugagc

SEQ ID NO: 672 - RNA, 65 nt, Human
ucuggcuggggauguucauauugugagaggagacuucgaugagaaucugaauuauccagaccaga

SEQ ID NO: 673 - RNA, 69 nt, Human
gcuaagugacacgugaaugauaaugugauagccggcuaucacauuaucaugguggagcugucaucuggu

SEQ ID NO: 674 - RNA, 76 nt, Human
ggaugugguugaugaagguuucccauaugguuucagggccaaaccaaggaagaaucuaacuuucagccucaugucc

SEQ ID NO: 675 - RNA, 74 nt, Human
guugaucuccagugaacucagauacuuguuuccacguccaggaaaccacaaacuaagcucuuugaagcaucagc

SEQ ID NO: 676 - RNA, 130 nt, Human
ccaggugugacaggauccaacccgcuggcaggaggaaggucacgaagcaggagguaagcccaacggccaauuccaugaucccaagcuuccccuccgggggcaacgaauggaucuuggcgcgcgggacugg

SEQ ID NO: 677 - RNA, 79 nt, Human
ggucaugauugcagaagaggugacuggaauugaaugacaugauccaggggaggccggccacaaaugcaguaacaugacc

SEQ ID NO: 678 - RNA, 78 nt, Human
ggaucauuuuauucucauuuaugcuuaaaauaaagauacaauucaaguuuuacaauucaguaugauuagacgugauuu

SEQ ID NO: 679 - RNA, 86 nt, Human
gcugauuuugggucccuuugugguacgugcuuuccuucguaguucaacaagugaagguuuauuacugaagauugauccauuguugc

SEQ ID NO: 680 - RNA, 64 nt, Human
gccgcgccauguccugcuuggcccgcugcagggcggccuccagcucggacaacuaggcguuggc

SEQ ID NO: 681 - RNA, 67 nt, Human
augucuuuaauuccucauaugcugacuuggcaauccauaugcagccuaaaaggugguugaaagaugu

SEQ ID NO: 682 - RNA, 64 nt, Human
aaauugugggagcuggaagagguagggggagacccagccauccuguucugacuucuagcaauuu

SEQ ID NO: 683 - RNA, 68 nt, Human
cauagcuauuuggcccuggccaugacuacaagcaaaagugggugcagauggcugggccaagggcugug

SEQ ID NO: 684 - RNA, 75 nt, Human
ggaguuaaacauuaugaggcugaugaauuugagauggcuaucaggcacuucgaacaagccuuaagagaauauuuc

SEQ ID NO: 685 - RNA, 69 nt, Human
cuuggccgcugcuuguaaucuuggaccagaacgcgauaguacccuuagagguuaccgagagccgccgag

SEQ ID NO: 686 - RNA, 81 nt, Human
gcucuugacgcguccgggcuauagcaguguggauuuuggauacacuuuccgauuccccugcucgcucauuagccuuauggc

SEQ ID NO: 687 - RNA, 73 nt, Human
ucaaaguugccguaacgggagcuggucucgggaaugacauuacguuucaaccagccuccgcaagcauauuuga

SEQ ID NO: 688 - RNA, 74 nt, Human
ucucuguugacuuuuucauuucauucauuauauuuuucaauuguauauuuaaaaaaugaacauauuaagagaga

SEQ ID NO: 689 - RNA, 81 nt, Human
agaguguaaguuagcaaaguauuaaauaaaauuucagggagccccuaaauuuauuuuuaagaacuuuagaacuaauucucu

SEQ ID NO: 690 - RNA, 75 nt, Human
augcaaacacugauuaacucaaauaucuuguaaguucauucauacauggccuuauuugaggcaguguauuuguau

SEQ ID NO: 691 - RNA, 82 nt, Human
uuucuauugaagccuaagcuuugaaugaagacaugcuucugaaaauaaagcagguuuucucuagucugcuuauuaauagaaa

SEQ ID NO: 692 - RNA, 79 nt, Human
gccucugccgcuccgccgucgccuccuccgcccgggccguucgcugcugcgcggggagagcgaggcggggcgccggggc

SEQ ID NO: 693 - RNA, 89 nt, Human
gcccggaugguggucaccuugcucauuacacguaaaccaggaguuaaauuugcgaaugcaccaugaguuagagugaagucuaucugagc

SEQ ID NO: 694 - RNA, 112 nt, Human
cagccaggccaggacccgggcuugccaagagcagaggcccucccagcaaccaggauaccaccacuuugggggcuuuguguacagagguccgggucugagaccucauaggcug

SEQ ID NO: 695 - RNA, 69 nt, Human
uccuggaaggcagcaagguuuuguggaucuagauucauuaggaaugucuucuugucagccaggccagga

SEQ ID NO: 696 - RNA, 64 nt, Human
caagaaagcucagcugguggugauugcacacgacguggaucccaucgagcugguugucuucuug

SEQ ID NO: 697 - RNA, 70 nt, Human
cacccgcuuugugaaauggccccgcuauaucagguugcagcggcagagagccauccucuauaagcggcug

SEQ ID NO: 698 - RNA, 100 nt, Human
ggcccuggaccgccaaacagcuacucagcugcuuaagcuggcccacaaguacagaccagagacaaagcaagagaagaagcagagacuguuggcccgggcc

SEQ ID NO: 699 - RNA, 60 nt, Human
cugcugcgcccuguccuccgucggcucugcgggcucccgggccuacagcggcugcggcag

SEQ ID NO: 700 - RNA, 62 nt, Human
gccuacuuggccuacaugccuucugcccgugaagcgauguuuccccucgaaaggccguaggc

SEQ ID NO: 701 - RNA, 93 nt, Human
uccgacccaagggggguacaugcaaggcuuccucuaguaaacaauuguagaaaguccaccugcccucguucacuuuuuaaacaucuggccgga

SEQ ID NO: 702 - RNA, 76 nt, Human
auuuuuaagaagaugccaauauaauuuuuguaagaaggcaguaaccuuucaucaugaucauaggcaguugaaaaau

SEQ ID NO: 703 - RNA, 70 nt, Human
uuuucuuaaaaaauaccagcaguuacucauggaauauauucugcguuuauaaaacuaguuuuuaagaaga

SEQ ID NO: 704 - RNA, 78 nt, Human
gcuaugcuaugaacacuaugggaucaggcugcccaagaaggggaagccugagccaaaccaugaguggacauuauuggc

SEQ ID NO: 705 - RNA, 82 nt, Human
guggucuucauaaacuauacugccuugugaugccucccuagaaaugagaggucucaauaccagcucagaccauguggaccgc

SEQ ID NO: 706 - RNA, 66 nt, Human
ugccgcaggagacauccucaaugauagccaugcugaggucauagccagaaggaguuuccaaaggua

SEQ ID NO: 707 - RNA, 75 nt, Human; identical to SEQ ID NO: 74

SEQ ID NO: 708 - RNA, 71 nt, Human; identical to SEQ ID NO: 77

SEQ ID NO: 709 - RNA, 71 nt, Human; identical to SEQ ID NO: 77

SEQ ID NO: 710 - RNA, 108 nt, Human
aguaacugcaaagaugcuguccgugcgcguugcugcggccgugguccgcgcccuuccucggcgggccggacuggucuccagaaaugcuuggguucaucuuucauugcu

SEQ ID NO: 711 - RNA, 75 nt, Human; identical to SEQ ID NO: 74

SEQ ID NO: 712 - RNA, 87 nt, Human; identical to SEQ ID NO: 76

SEQ ID NO: 713 - RNA, 67 nt, Human
agacugcaggugccgcacauugucaaguuagaaauacuccagguggguguuagcacugugguggucu

SEQ ID NO: 714 - RNA, 70 nt, Human
cugggacucagguguuuaaagaguuugugcuauagcuagguguggauagcuucugaucccuggguucugg

SEQ ID NO: 715 - RNA, 97 nt, Human
ggaaaaaaugcagauguauuucacucuccccggucagcucugcaucagguguuuucugagcaaaccaaggggguuuauagucaucugucgcauugcc

SEQ ID NO: 716 - RNA, 100 nt, Human
guaccaggccaguuauaaccagagcuuuucuagucagccucaccaaguagaacaaacagagcuucagcaagaacagcuucaaacagugguuggcacuuac

SEQ ID NO: 717 - RNA, 60 nt, Human
cccaauucggucguggguccagggugaacugacuuauucggguggaccgacagaccuggg

SEQ ID NO: 718 - RNA, 108 nt, Human
aguaacugcaaagaugcuguccgugcgcguugcugcggcgugguccgcgcccuuccucggcgggccggacuggucuccagaaaugcuuuggguucaucuuucauugcu

SEQ ID NO: 719 - RNA, 75 nt, Human; identical to SEQ ID NO: 74

SEQ ID NO: 720 - RNA, 71 nt, Human; identical to SEQ ID NO: 77

SEQ ID NO: 721 - RNA, 73 nt, Human
cggcgcuuccgcaaguuccugguguuuguggcaaacuucgaugagaaugaccccaagaccuuugagggcguug

SEQ ID NO: 722 - RNA, 63 nt, Human
ucuacaaagugccguccacugagacugaggccuuggcuuccaaucugaugggcauguuugaga

SEQ ID NO: 723 - RNA, 60 nt, Human
uguauacagaggugacucgcuaccuggacuucaaggugguggagggcagcuuugucuaca

SEQ ID NO: 724 - RNA, 63 nt, Human
ccccugcccucggccauugaacacugcacccuccacaggagccgcagaggcccgaggcaccgg

SEQ ID NO: 725 - RNA, 77 nt, Human
cgcuggagacccugcgccccugcccagcaccuccuccgugggcagcuccucggguggggccugcgggguucccugcg

SEQ ID NO: 726 - RNA, 76 nt, Human
aagaugcugcgugaaguacugagcagggugauaccgccagaccagcacccgggcgccguaaucacagcuguguuuu

SEQ ID NO: 727 - RNA, 63 nt, Human
guugcccaggcuggagugcaggggcucaaucugggcucaugcaacucugccuccgggguucac

SEQ ID NO: 728 - RNA, 79 nt, Human
uagccugggcgcucuccagaaaagcuacacuugagcugacacacaauuggggcacugaagaugaugcgacccagaguua

SEQ ID NO: 729 - RNA, 73 nt, Human
uucagacccucgaggauucggucauauuggaauugcuguuccugauguauacagugcuuguaaaagguuugaa

SEQ ID NO: 730 - RNA, 63 nt, Human
cagcucuucaagaccgagaggaaaaaagcaacggcuucuucccugacuuggugaaacaugcug

SEQ ID NO: 731 - RNA, 64 nt, Human
ggccagcccuggggccugcuucaagcucuuccaggaaaagcagaaguguggccacgggagggcc

SEQ ID NO: 732 - RNA, 106 nt, Human
ucaaccaggugcucuccaauaaagaccucaucaacuacaauaaguuugugcagagcugcaucgacuggaaccgugaggugcugaagcgggagcugggccuggcaga

SEQ ID NO: 733 - RNA, 82 nt, Human
ucaucaauggcgugcuguugccuggaggagaagguugcgguccugcuggagccgugcgccuccacugcaccuucauugauga

SEQ ID NO: 734 - RNA, 60 nt, Human
gguccagauuuacaaguguccucuggguacaugagagaggugucugugaaguuuuuggcc

SEQ ID NO: 735 - RNA, 90 nt, Human
uaucuguguuuugucccacaccgaccgacuggcagagagagaaagggacaucuuucaaugcagucaccgugguaugggcgaucacugaug

SEQ ID NO: 736 - RNA, 75 nt, Human
aauauggggauauuuaccuuuauuaagaaauuauacuaaacauugauguccuugaucauuuuauguucucauauu

SEQ ID NO: 737 - RNA, 72 nt, Human
gggcgggggacgauggcgagaggggagggggagcgaguucgcaucucuccuuuuccugguuagacucuguuc

SEQ ID NO: 738 - RNA, 76 nt, Human
uugauuuuuagagcaccaucacuuucacauuccugauucugauuuuguuugguuuguuggguuuucugaaacuuaa

SEQ ID NO: 739 - RNA, 83 nt, Human
uuguguucugaaagccuccgugcugcuggaucuuuggggggaaauacaggauccuucagcacugagguguuuaagauuugcaa

SEQ ID NO: 740 - RNA, 98 nt, Human
cccucucccggccagggagacggagcccauccacagugucagcuauggccauguggccgccugccagcuaaugggcccccacacccuggccuugaggg

SEQ ID NO: 741 - RNA, 83 nt, Human
gccaagaggucacgacuucccuccugccugcagccugggccaggacugcucugagauuugagggaaacauggacccuuuuggc

SEQ ID NO: 742 - RNA, 61 nt, Human
gccagacaccuccccucccagccagcgcccgggccuggacgagccccagggacagucuggc

SEQ ID NO: 743 - RNA, 78 nt, Human
ggaagagaucaugcagcuggugaaugccuacuuggccaaccccucccccgagaggcccugcagcagcucuucuccucc

SEQ ID NO: 744 - RNA, 60 nt, Human
cuuguuaagaguuauuuauaccaaauccuacaggggauuguguuugucacucuagaagag

SEQ ID NO: 745 - RNA, 76 nt, Human
cucuguguaccagaagaccaaugccgugucugagauuaaaaggguugguaaagacagcuucugggccaaagcagag

SEQ ID NO: 746 - RNA, 77 nt, Human
gcaccauggccagcuuccugaagggggcccaugugaccaucaacgcacgggccgaggaggauguggagccugagugc

SEQ ID NO: 747 - RNA, 61 nt, Human
ucuggacugcccaaauuuguccucaucaacuggacaggcgagggcgugaacgaugugcgga

SEQ ID NO: 748 - RNA, 120 nt, Human
cugaaagaccaaccacauuggccacacaggcuaucugaaccacgguugacugucucuccagauggaucccucugugcuucuggacggcaaggauggccaggcauguuauugggaucucag

SEQ ID NO: 749 - RNA, 83 nt, Human
gggcaacacccuuacacgcuagaugguuggggcacucaucacgcccugugcuucaaacccuaacggcuauggugugugugccc

SEQ ID NO: 750 - RNA, 94 nt, Human
gagugggaacacaggggagaguucaggacaccugguccccagcuccccauugccuggggcagcagcccucaauuucuccuugugcccuccccuc

SEQ ID NO: 751 - RNA, 80 nt, Human
uccaggugccaaauagccauaaccucgucuuggaacuguuauguggccucucugggguccagguuucuggucagccuggg

SEQ ID NO: 752 - RNA, 89 nt, Human
cguggcaauuucuuagagaucaagaauaaauuucuagcucgaagguuuaagcucuuagaacaagcucuggugauugaggaacagcugcg

SEQ ID NO: 753 - RNA, 84 nt, Human
gagacccccaaggaccugaaugaugagaaacagaagaaaaauauuaaacaacguuucauguuuaacauugcagauggugguuuu

SEQ ID NO: 754 - RNA, 69 nt, Human
agccugagauggggaugagggcagagagaggggagcccccucuuccacucaguuguuccuacucagacu

SEQ ID NO: 755 - RNA, 63 nt, Human
cagcguuagaugcccccacccaccuguacucuggagagacugugcugggaacauguaccacug

SEQ ID NO: 756 - RNA, 70 nt, Human
cuaucugucuuuaacaacugcugccaguugccuuuugugggguagcauacuuuuguuagcaaccgggugg

SEQ ID NO: 757 - RNA, 63 nt, Human
uguaggcaaccuucccucucuccuuggugaagaacaucccaagccagaaagaaguuaacuaca

SEQ ID NO: 758 - RNA, 76 nt, Human
gcccacugugacgaugucaccgaucuggacgucccugaagcagggggacagguguacagacauguucuuguggcgc

SEQ ID NO: 759 - RNA, 71 nt, Human
ugcaucuucaucuuggucaccacgccagagaggauccgaccucgaauggacacauuaccagugaaggggca

SEQ ID NO: 760 - RNA, 88 nt, Human
agauugucggacacgcgguaauugaugaacggcaggugagggagagcucugaucagccugguguucauuguccagaguccggcuguuu

SEQ ID NO: 761 - RNA, 75 nt, Human
uugguguagacuccaggccuguucuucugggcacagcauagccccaggagacaauuccuuggagcucuccauugg

SEQ ID NO: 762 - RNA, 83 nt, Human
aaagaaaaccaaagugguccacaaaacauucuccuuuccuucugaagguuuuacgaugcauuguuaucauuaacccagucuuu

SEQ ID NO: 763 - RNA, 66 nt, Human
gaagucaugauggaguuccaggggcccaugcccgccggcaugcugauugagcgcuccucagacuuc

SEQ ID NO: 764 - RNA, 101 nt, Human
gaauguggcuucauccuccggccccaugcgcugguggcagucacagaaugaugugaacccugucucucugcagcuggaccuggacaggagauuccagcuuc

SEQ ID NO: 765 - RNA, 85 nt, Human
ggcagaacacacagcaaggaaagguccuuucuggggaucaccccauuggcugaagaugagaccauucuuccucuuguguuuugcc

SEQ ID NO: 766 - RNA, 83 nt, Human
cccaccacugcgggcaucgaggacagcgccgccuaggaccacgaugcacaugggcgugcuccucacacccccgggaugguggg

SEQ ID NO: 767 - RNA, 73 nt, Human
cuaauaccugaaauauggaguaaccaaguaacaaauuuuuaaauuuaaaacugauacucauuucaguuauugg

SEQ ID NO: 768 - RNA, 78 nt, Human; identical to SEQ ID NO: 99

SEQ ID NO: 769 - RNA, 65 nt, Human; identical to SEQ ID NO: 247

SEQ ID NO: 770 - RNA, 80 nt, Human; identical to SEQ ID NO: 100

SEQ ID NO: 771 - RNA, 72 nt, Human
cccugccugcuagcuggggaccgcuccuuggcagaugucaucauccaugagaucucccacaguugguuuggg

SEQ ID NO: 772 - RNA, 89 nt, Human
ggcucaaugaagguuucaccauguacgcccagaggaggaucuccaccauccucuuuggcguugacccggacgacaccuauaaugagacc

SEQ ID NO: 773 - RNA, 64 nt, Human
ucaaaaacuaugcuuuaaaggaauuaaagucuuaugauccaaauuacuuucaggauguuuuuga

SEQ ID NO: 774 - RNA, 84 nt, Human; identical to SEQ ID NO: 286

SEQ ID NO: 775 - RNA, 89 nt, Human; identical to SEQ ID NO: 288

SEQ ID NO: 776 - RNA, 61 nt, Human
uuuuuuaaugggucucaaaauucugugacaaauuuuuggucaaguuguuuccauuaaaaag

SEQ ID NO: 777 - RNA, 61 nt, Human
gacggggucagcggaugguguaucggacauagggaaccucgacauccucgccgcucucguc

SEQ ID NO: 778 - RNA, 85 nt, Human
gguagaaggcaguggcaagagggguucagguagggggaugaugagggaacaccagacuuggcuaguugggccacugcuagaagcc

SEQ ID NO: 779 - RNA, 74 nt, Human
ucaugugauagugcaacaguuuggcuuugcggaaaaauuuuaaacaguccacaacuuugcaucuaaacuuaugg

SEQ ID NO: 780 - RNA, 75 nt, Human
uucuuuggcuucacucucacaaacuccuugaauuucuucucuuuauucuuuuccuugucuuuuguaguuggggaa

SEQ ID NO: 781 - RNA, 72 nt, Human
gaguugcugcagaggacaugacccccagcagaugucccguaggcaucaguccaguuauauccgcaguaucuc

SEQ ID NO: 782 - RNA, 87 nt, Human
gcucagcgcauggcucagcggauggggcacgacagcuagcaacaguuauugucuccagucuugucugcuguuucuaggcgcuugagu

SEQ ID NO: 783 - RNA, 130 nt, Human
agggggaccuugacuuuguuggccaccucucggaucagggccucugacaccgcguuugaagcauagcguugcuugcuguucaccuugaucacggggcccuuguggaauaaaggccggugguucuccucau

SEQ ID NO: 784 - RNA, 64 nt, Human
auugugaauagugccgcaauaaacauacgugugcaugugucuuuauagcagcaugauuuauaau

SEQ ID NO: 785 - RNA, 60 nt, Human
gagaaugaugguuuccaguuucauccaugucccuacaaaggacaugaacucaucauuuuu

SEQ ID NO: 786 - RNA, 69 nt, Human; identical to SEQ ID NO: 528

SEQ ID NO: 787 - RNA, 64 nt, Human; identical to SEQ ID NO: 287

SEQ ID NO: 788 - RNA, 80 nt, Human
cuucuucagugagacgggcgcuggcaagcacgugccccgggcuguguuuguagacuuggaacccacagucauugaugaag

SEQ ID NO: 789 - RNA, 84 nt, Human; identical to SEQ ID NO: 286

SEQ ID NO: 790 - RNA, 64 nt, Human; identical to SEQ ID NO: 287

SEQ ID NO: 791 - RNA, 89 nt, Human; identical to SEQ ID NO: 288

SEQ ID NO: 792 - RNA, 73 nt, Human
agugaggggcaggaugaaaucaucuaggguagguauuuagagggagggcgccgugcaaaauaaaauccucacu

SEQ ID NO: 793 - RNA, 62 nt, Human
gacguaccgugcggacgaguggaaggagaaauuuggccauuacaaagacacaggaauauguu

SEQ ID NO: 794 - RNA, 80 nt, Human
ggcugcguuagguggaagcagcggaggaaggagacgaaagggauugucauuuucaugucguggcuuuuuagaagacagcc

SEQ ID NO: 795 - RNA, 70 nt, Human
ugcaugagguuugguaacaggcaaagucaucugguuaacgugacugaugcaaaaaguccaggccugggca

SEQ ID NO: 796 - RNA, 77 nt, Human
uaggcaugugauuucagguuuuucguacugagaacauugagauuucaguuggaagacacccugaaaucuuaugagua

SEQ ID NO: 797 - RNA, 67 nt, Human
ccccaccgggaggggccacaaggaccugggccucggccaccaagcuuuguccccucucgcugugggg

SEQ ID NO: 798 - RNA, 61 nt, Human
acagcauuaaucuccuuguacaacugcagcagagcucuuaguguacagguacaugggcugu

SEQ ID NO: 799 - RNA, 73 nt, Human
agcuuugaagccagauauugaccucucucuagcugugaaauuucuagauggagucuucuuccaauuuaaggcu

SEQ ID NO: 800 - RNA, 71 nt, Human
gguuuaggauuuuuggaaugguauaugagcauugucuucaaccucaaguuccagcuucaucagccuuuacc

SEQ ID NO: 801 - RNA, 116 nt, Human
uuuuguuuuuguccaguaggucccaacagcgggcuuaaaauauucagcaaaucaugguguaaacagaugugcuuuccuccaggcuuuguuguuccauuuauguagcaaaggcagag

SEQ ID NO: 802 - RNA, 72 nt, Human
aaacaucauuuuaaaaugucuucagcauuuuuugaauagacguauucaaacauauucugaacauugauguuu

SEQ ID NO: 803 - RNA, 67 nt, Human
auuguaggcaaccuucccucucuccuuggugaagaacaucccaagccagaaagaaguuaacuacagu

SEQ ID NO: 804 - RNA, 85 nt, Human
cuucaguuugagaaacuaagcaguggucagcgucugugugagccagugggugauaggguggcaugacccuggagaguagcugagg

SEQ ID NO: 805 - RNA, 61 nt, Human
uggacuggcagucuuuaaagguugguacccuaacuugaugaaagaagauugucuuagucca

SEQ ID NO: 806 - RNA, 95 nt, Human
cuagcuuguuuguauagguagaaugauucaucucuccauuuuagauggcuagauguuuuguggaagaucuuagaauugccugccucauuugcugg

SEQ ID NO: 807 - RNA, 94 nt, Human
gguucuugcagauucccaaggaaaugucagaaaggcaaaauggccagcauuauccauuugcuuuuuuggguuuacugggugaauagcacuuucc

SEQ ID NO: 808 - RNA, 77 nt, Human
gagauuagggguacuggcucugaagacaaagcuuagauucaagcucagcucaccauuuauaccaguccccugauuuu

SEQ ID NO: 809 - RNA, 112 nt, Human
uuaugaaguucaaacagcaccacugguaaacgaaguucagauuucagagguggagacuguguacgcagccucacagcugaguggaugccguggugaaauguuuagaucauag

SEQ ID NO: 810 - RNA, 63 nt, Human
cugcaagugccguaagugggccugugacgucacaccgaccggcccgagguaucgcaugugcgg

SEQ ID NO: 811 - RNA, 98 nt, Human
ucuuaucaaaugcccuaaaauuauuaccacccaagagaaacaggaaaaagguuacauguuuuuguuuacugagaguaagaucaccugcaucuggaaga

SEQ ID NO: 812 - RNA, 77 nt, Human
uuucaauaaaaguuaugcacaaaugugaacaccugagauggagcugaacauuucuucacuuuguucuuuuucugaag

SEQ ID NO: 813 - RNA, 68 nt, Human
ccuguccuuacucccucuuuaagauugcguacccacugcagagugcugaagacgggguagccacgagg

SEQ ID NO: 814 - RNA, 85 nt, Human
uauucccagaggaugucagucccaaggaccaguagcugccaucaguuuggauucugaaaacuaacuggcaucaacacugggugua

SEQ ID NO: 815 - RNA, 75 nt, Human
uuggagccaggagccugccaugagguuuugagaacagagugcuguuuuagagcuggcagcagcaucucagcccaa

SEQ ID NO: 816 - RNA, 67 nt, Human
gauacccguuguacccuuacuugaaaguuucuaaucuuaaguuuuaugaaaugcaauaauauguauc

SEQ ID NO: 817 - RNA, 99 nt, Human
ggcccaggcugcccguuccucuccuucuccgccagucugcgcugcggcugccacggcucacaccagagggaugggguaggaggcgcaggcagccaggcc

SEQ ID NO: 818 - RNA, 85 nt, Human
uauguggaaaguagcccuucuggacagaaagaauauucgugguccaugugguuugagucuguuaagaaggacacuaaggcacaug

SEQ ID NO: 819 - RNA, 75 nt, Human
acuuacuucaaucuuguugagcucagaauaaacagauaucugagauuuuacaagcuuguaaaagauuuaucaagu

SEQ ID NO: 820 - RNA, 66 nt, Human
gagcuccagcacuucaauugaauauaauccucuauuauucuuuucuugauuuaauuucuguagcuc

SEQ ID NO: 821 - RNA, 81 nt, Human
cuccacuuccccaucccccuaagcccccacugccuuccuuagugauagcagucauaaaucucagggcaccguggaguggag

SEQ ID NO: 822 - RNA, 65 nt, Human
ggggaagggcauggguuaagguuaaggcuguaccauguacugcuucuccucacuauuacuucccu

SEQ ID NO: 823 - RNA, 61 nt, Human
auuugagaaggaggcugcugagaugggaaagggcuccuucaaguaugccugggucuuggau

SEQ ID NO: 824 - RNA, 80 nt, Human
aauuugcaacaguucuuuccccaggccacucgcagucuugcugugacucuccuguggggucccaugaacccuuccaaguu

SEQ ID NO: 825 - RNA, 68 nt, Human
cacaggccccguugcccauggcugucagccgggggcuccccccgcagcagccacagcagccgcuucug

SEQ ID NO: 826 - RNA, 68 nt, Human
gcagcagcagcuccagcagcagcaauugcagcagcagcaguuacugcagcuccagcagcugcuccagc

SEQ ID NO: 827 - RNA, 63 nt, Human
ggcugcucagaaaaggauaagaagugguuucuccuccccucuucccuuccucauccugcagcc

SEQ ID NO: 828 - RNA, 75 nt, Human; identical to SEQ ID NO: 74

SEQ ID NO: 829 - RNA, 87 nt, Human; identical to SEQ ID NO: 76

SEQ ID NO: 830 - RNA, 71 nt, Human; identical to SEQ ID NO: 77

SEQ ID NO: 831 - RNA, 109 nt, Human
aguaacugcaaagaugcuguccgugcgcguugcugcggccgugguccgcgcccuuccucggcgggccggacuggucuccagaaaugcuuuggguucaucuuucauugcu

SEQ ID NO: 832 - RNA, 75 nt, Human; identical to SEQ ID NO: 74

SEQ ID NO: 833 - RNA, 72 nt, Human
ggucugaaagcccccgguaucauuccucgaauuucagugcgggaaccaaugcagacugggcauuuaaaggcc

SEQ ID NO: 834 - RNA, 87 nt, Human; identical to SEQ ID NO: 76

SEQ ID NO: 835 - RNA, 71 nt, Human; identical to SEQ ID NO: 77

SEQ ID NO: 836 - RNA, 67 nt, Human
gcggcugcagaaguaccgccugcggaguaacugcaaagaugcuguccgugcgcguugcugcggccgu

SEQ ID NO: 837 - RNA, 87 nt, Human; identical to SEQ ID NO: 76

SEQ ID NO: 838 - RNA, 87 nt, Human
ucucuaggcaaaugccuucaaguuuuccaguucugagguaacuaguucaguuuguugggauggaagcaugaaggaaagggcuagaga

SEQ ID NO: 839 - RNA, 65 nt, Human
ccgucucguacugucgccgucaccgccgcggcuccggcccuggccccgauggcucugugcaacgg

SEQ ID NO: 840 - RNA, 130 nt, Human
cugcgugguguuucauccauuccuagaugagauucucauugggaagaucaaaggcugcagcccagaaggagugcacgucucucuaggcuucuucgaugacauucucauccccccagagucacugcagcag

SEQ ID NO: 841 - RNA, 87 nt, Human
gaagcggagcaggugugggugugggaguacgagacggaggaaggagcacacgaccucuacauggacaccggcgaggagauccgcuuc

SEQ ID NO: 842 - RNA, 84 nt, Human
gagggacucgcuggcagcagccccagccugaccgcucggaguguacuuuccuugacaggcaaggcuguuggccagggcucgcuu

SEQ ID NO: 843 - RNA, 61 nt, Human
ggucgccauggcaaucuccucaugagaaaacuucuguaugcaagcuuggccuggggugacc

SEQ ID NO: 844 - RNA, 128 nt, Human
ugacauacuccuccugcgcagccuucagguucuccuucuucccgccccaggccuucagggcagaggccugcagggcucggccguaggagaaggucagggcccagggcuucagcagggggcacuuguua

SEQ ID NO: 845 - RNA, 121 nt, Human
ccccgcugcgggcuagcuguuguguuuuuuguuuuuuucccccgggcgggcccgggcgguuggcguacugggcuggugggacggggaagugaacgccccaagcgacgcgguugcagcgggg

SEQ ID NO: 846 - RNA, 76 nt, Human
gcuggagccacagaauucguccugcaggaaucacggcgggacaucgucuccuguguggcagauggaucucuccggc

SEQ ID NO: 847 - RNA, 70 nt, Human
gcugggaagagcagaaccgggggcggagcaccugcaggcgcgggcgcgggccccaccagggcgauucggc

SEQ ID NO: 848 - RNA, 82 nt, Human
auguacgucguaguaacuucaggucuccaguuguguuaucauucagaacauaaucaucacaaagguaacaaaaaacguacau

SEQ ID NO: 849 - RNA, 93 nt, Human
gucauguaagaaauaagaaucaucaccuguacccauggaccguaaaaaccucccacuacgaguugugcagugauaauuuugacuuuugauggc

SEQ ID NO: 850 - RNA, 61 nt, Human
ccagggaccaccgcgcagaacaggaggaugaucccccucgcugugaugauucgguucuugg

SEQ ID NO: 851 - RNA, 108 nt, Human
cugggugcacagcaggcgggggcagccuggcaggaguaggggugucacggcuucuccagcuggacaucuccuauguugaggcugcccacauccugguaggugcccugg

SEQ ID NO: 852 - RNA, 61 nt, Human
cgaggggagcucguccuccuccaugaggcgcggcuuccgcuugggguugcgggccuccucg

SEQ ID NO: 853 - RNA, 104 nt, Human
gggugcugguggucgggguggaggagccggcgucgcugucucgcuugcgcuuccgugaugauuucuucugccggaccuccucuucgaucuccuccagcgugccc

SEQ ID NO: 854 - RNA, 74 nt, Human
uggccuugagccacugcuucuccgucagugagucgcuguaguccaccuccuugcgguggcgggagccacggccg

SEQ ID NO: 855 - RNA, 68 nt, Human
gcccaggcagagucucugcguuacaaacuccuaggagggcuugcugugcggagggccugcuauggugu

SEQ ID NO: 856 - RNA, 72 nt, Human
gccgaucaaauagccuagugagagucagugaagaaucccguucauaugcuuugccuaggacagguuuucggu

SEQ ID NO: 857 - RNA, 72 nt, Human
uacgggacuggccucuggaaagggugguagcccuggaaaagguaccucccacacuggagccgucuguccgug

SEQ ID NO: 858 - RNA, 71 nt, Human
ggcgugcacaccuucccggcuguccuacaguccucaggacucuacucccucagcagcguggugaccgugcc

SEQ ID NO: 859 - RNA, 81 nt, Human
ccugcaguaucucugagugugccuguacauauacauauaaaaaauuguaucauaaggaauuaacucaugagauuauggagg

SEQ ID NO: 860 - RNA, 68 nt, Human
cuucccuuuccuauucaguacacaccagucuuucuuugguguuuaccuaaugggcugaggaagggagg

SEQ ID NO: 861 - RNA, 112 nt, Human
ggagcuugagaaaucaccuagggcagccaagcuggggaagggaaguggcugugcauugcuguguguccuuuaaggcucuuugguccugguugauuuccucuuagaagguucc

SEQ ID NO: 862 - RNA, 72 nt, Human
gcuggcuuuggaucugaacuaauggguugucuaaguguugacauuucucauaauacauuacacauugcuagc

SEQ ID NO: 863 - RNA, 68 nt, Human
ggucuacgccaucuguuauuguccccugccucgccuggcagaucuggaggcgcugaaaguggcagacu

SEQ ID NO: 864 - RNA, 62 nt, Human
guucgccugugcccgcggugugccgcaaggagccuugcguccugggcgucgaugaggcgggc

SEQ ID NO: 865 - RNA, 101 nt, Human
uauaugccugauucauaguaaaauaccucuaauaaacacuguuuuauagaaaaccugacuucagugaauauuuuuguauuuuacaugggccaguuuauaua

SEQ ID NO: 866 - RNA, 85 nt, Human
uuaccagcuuaaaacacuucuuagggauuaaauauagauguaauuuuucaaaaucguuuuuaauuuaaacuguguuuuaguguaa

SEQ ID NO: 867 - RNA, 65 nt, Human
gaguacgggcugcaggcauacacugaagugaaaacugucacagucaaagugccucagaagaacuc

SEQ ID NO: 868 - RNA, 63 nt, Human
gauggaaaguucagcaagaucagcaacaaaaccaagaaaaaugauccuugcgugcugaauauc

SEQ ID NO: 869 - RNA, 71 nt, Human
ugagggccugggacucgucuuuacacuuucagaaucccugugugugccugaaaaaauauccuuugugcuca

SEQ ID NO: 870 - RNA, 73 nt, Human
acuggacuguuuguacgugaaacagaagaggcuaagcuuccuuuuuuuacacuuaugagacaaaaagugcagu

SEQ ID NO: 871 - RNA, 79 nt, Human
gauuaauuggauuugaggauaauuauuauuauuugguuuuuagauuugaaaaguagaauuuccauugagacaauugauu

SEQ ID NO: 872 - RNA, 74 nt, Human
gcagcuuaagguuuuuuuuuuuucuuuaaaaaaaauaggaauacaaggauuuacaaaaaaaccucacacagugc

SEQ ID NO: 873 - RNA, 91 nt, Human
ucuuguucaugggcaaaaggaggaagggaggugaggucuggguagagugcuuuucccaguccccugcuggcacuucuccaugaugacaagg

SEQ ID NO: 874 - RNA, 78 nt, Human
gcccuugcaaucucuaggucacuuucuccgcuuguagauuuugcgcgcaagccccagaaagacgcugggggcaggggu

SEQ ID NO: 875 - RNA, 62 nt, Human; identical to SEQ ID NO: 206

SEQ ID NO: 876 - RNA, 61 nt, Human
agagugacaaaauggugacagguagcugggaccuaggcuaucuuaccaugaagguuguuuu

SEQ ID NO: 877 - RNA, 79 nt, Human
cuccucacuggacucgccucucuccucuccuccccccaggaggaacuugaaaggaggguaaaaagacuaaaaugagggg

SEQ ID NO: 878 - RNA, 90 nt, Human
uccaucccuuccggcucccuaccccucacuuccaaggguucucucuccugcuugcgcuuaguguccuacaugggguugugaagcgaugga

SEQ ID NO: 879 - RNA, 78 nt, Human
gauacagccuugcucuguugcucaggcugaagugcacuggcgcaaucucccgucugggcgacagagcaagacucuguc

SEQ ID NO: 880 - RNA, 103 nt, Human
uugugcuugcuuaauagggccauuucucccuccuuggcaucaucaagcuguuuuugaagaaccuaagaaagauuaaauagccauuguuaaaaugcaggaauaa

SEQ ID NO: 881 - RNA, 70 nt, Human
ugacauucagaauuugggcauuuaagauguuaacugaccuagaaacaaaugcacuaagaaacaaauguca

SEQ ID NO: 882 - RNA, 64 nt, Human
augaaugagaucuguuuucuguggaguguacauacacaaacgcauugcaacauguuucauugau

SEQ ID NO: 883 - RNA, 67 nt, Human
ugcgcucuuagguagaauaucugugccagcccaugcuagcaccgguaugugcgacccuaauagcgca

SEQ ID NO: 884 - RNA, 87 nt, Human
gguaguugaugccaaccuugaagccaguggggcaccaauccacaagacuggaugcugcgcuugguuucgaugguggcaauggcagcc

SEQ ID NO: 885 - RNA, 105 nt, Human
uugugguccauggcgagcccaggccucagacaauggcugugguguugcucagacaugcacacagcucucuguaccuugagccaggucuccaccauggcaccacag

SEQ ID NO: 886 - RNA, 104 nt, Human
ccuggccgcccucuggcccuuccugggcaucguggcugaggugcuggugcuggucaccaucaucuucaucuacgagaagcgccggaagcccgaggacguccugg

SEQ ID NO: 887 - RNA, 80 nt, Human
cggcuccgagagcagguucuucgugaguuccucgcagggccggucagagcuacacauugagaaccugaacauggaggccg

SEQ ID NO: 888 - RNA, 65 nt, Human
accaugaaggcacccuugaaccauccaugauugcacagucugguguucuuggcuucccauuaggu

SEQ ID NO: 889 - RNA, 67 nt, Human
gcaaucgucaguaucaaaagcuccaaggccucuaugauagccuuaggcuacgaaacaucacuauugc

SEQ ID NO: 890 - RNA, 60 nt, Human
uggauauguugccaucaaugaccccuucauugaccucaacuacaugguuuacauguucca

SEQ ID NO: 891 - RNA, 82 nt, Human
ccagaagacuguggauggcccuccgggaaacuguggcgugauggccgcggggcucuccagaacaucaucccugcucuacugg

SEQ ID NO: 892 - RNA, 64 nt, Human
gcugugggcaggucaucccugagcugaacgggaagcucacuggauggcuuccgugucccacugc

SEQ ID NO: 893 - RNA, 65 nt, Human
ggcgucggaggggccccucaaggccuccugggguacacugagcaccacgggguuccucugacuuc

SEQ ID NO: 894 - RNA, 60 nt, Human
gggcucauuugcaggggggagccaaaagggucaucaucucugcccccucugcugaugccc

SEQ ID NO: 895 - RNA, 61 nt, Human
gucaagcgccuuuccugguugagaaaccacuuggguccccaaccagggggggcccucgggc

SEQ ID NO: 896 - RNA, 110 nt, Human
ugaauacacaacaaaggagguuuaccggaagaacuucuucaaugacuggcgaaaggaaauggcgguggaagaagagggaagucaucaagagccuggacaagugugauuca

SEQ ID NO: 897 - RNA, 72 nt, Human
gcggccaccgucaacaggagcacucggugccggagaacaugguagaggcaccucugucgggcagguggccgu

SEQ ID NO: 898 - RNA, 71 nt, Human
ggccgacguccgugagcucugcuccaaguaugccucccgcgaugaggcacgccgagcagggggcggcggcc

SEQ ID NO: 899 - RNA, 63 nt, Human
gucuuccagcagaccaucuccugcccggagggccugcggcuggugggguccgaagugggagac

SEQ ID NO: 900 - RNA, 71 nt, Human
cgggccacuuucucagccuccuucugcccguaauuuuccuucaggaucugguacuguucuggaguggcccg

SEQ ID NO: 901 - RNA, 108 nt, Human
gucagugccaauuuugccggucacacugggguccccaaagaagucaagguaaucauccugaaucugaaagaacucccccaucuccagcaggaucuucuuggcauuggc

SEQ ID NO: 902 - RNA, 61 nt, Human
accaucuuuccugcaauauaucgaaucucagguaagcacaucaugagaucaggaaagcggu

SEQ ID NO: 903 - RNA, 66 nt, Human
gagcucgaagugggccccagcccagacugccccccugccuguugccccugagcccaccuacugcuc

SEQ ID NO: 904 - RNA, 73 nt, Human
ggcggggacagcaguugcauggacagcuuuccuugugagccacaggucccucuggacauacugcugccuggcc

SEQ ID NO: 905 - RNA, 70 nt, Human
gggcuuggagcauuaaggccacgcccauagcugcauucuaugggggcccuaguuaugccuccucgggcuc

SEQ ID NO: 906 - RNA, 91 nt, Human
guuaacuuaaacauguuccccuuaaaugcacuugauggguguugaaauggucaaccuucuuaaaauuuuuaagaugaacuuaguucuuaac

SEQ ID NO: 907 - RNA, 65 nt, Human
ugauuugcuuggugaccgaauuacuagugacuaguuuacuaacuaggucauucaccgcaagguca

SEQ ID NO: 908 - RNA, 97 nt, Human
agaauuaggcagcuggacucaguuuagaugaucccaauuuuguuggcaacauccaaagcaucguaaucaggagccagucuaacauaugccuucuucu

SEQ ID NO: 909 - RNA, 104 nt, Human
ggccgucuccggagucgcaguguccucggccgccgaagagugggugaagugcggaacuuccuccuuuuguggcuguggacaccuuccacaccggcuuccuggcc

SEQ ID NO: 910 - RNA, 72 nt, Human
ggcuguggguggggccguggcugcgcaucucauacuuaucucccgggcacagcucggcccccucccgcagcc

SEQ ID NO: 911 - RNA, 63 nt, Human
gguguguggagaagaucaucuguguuauacuguaauaguugcuagaguaaucucacacacacc

SEQ ID NO: 912 - RNA, 75 nt, Human
uaccagagcauacauauaucaacaguaagauguaauuuuucauuacaucacugcuagaauauuuagcuuugugua

SEQ ID NO: 913 - RNA, 78 nt, Human
ggcugacaccagcugucgccaggagccggaccacagacgguaauguggugaucacagccagguggagcggugucugcc

SEQ ID NO: 914 - RNA, 68 nt, Human
gugagcuacaguaauguacgggcgccagguccgacgugccggggggugcgcugugcagcgaggcucgc

SEQ ID NO: 915 - RNA, 66 nt, Human
gggaacuuaggaagugagaagucagauuacccuaguccucuagggugcuuaaagcuaacuaguccc

SEQ ID NO: 916 - RNA, 75 nt, Human
uagauuugagaaaguaggagagacagauuucacauaguagagaacacuaacacucuucuuaguauuucaaauuua

SEQ ID NO: 917 - RNA, 88 nt, Human
guauuuaccucaaaccucuccucuugcacaaccaacccccguuauaaaaggaagugcaaaauggaauaaacugauuuuaagugaauac

SEQ ID NO: 918 - RNA, 88 nt, Human
caaggguguaguauuucauaccgccugaaaugaucagcauuggcacaaaucaaaauucagccgccuuugaaaugcaaaaauaccuuug

SEQ ID NO: 919 - RNA, 131 nt, Human
uugauugggucaaccuuugccuacgaaugcaguccuugaagucuugcagucucuuguuauguucauauucuuucuugacaaggguaguaaggaggucaugccuucuuagggcuucuucuauuucaucuugg

SEQ ID NO: 920 - RNA, 70 nt, Human
uuuguacaucucgcuuuucuucuggcauaguuacuuaggucucguaaucuuugcuuuagcaauguauaaa

SEQ ID NO: 921 - RNA, 69 nt, Human
accacgggguccaggccugugggccaaccaccaggaagcugugcaugcccacagcccgaggccccuggu

SEQ ID NO: 922 - RNA, 119 nt, Human
aggccgcagggagagggggaaagguccaaagcuguggagaaagaaggggcucccugucuccaggguuuguuuaagguuuucuccauggccuagggcccagccacuucccucacuggccu

SEQ ID NO: 923 - RNA, 76 nt, Human
aaagacaagcugucauugcaauaggauguuacaacauuauauugcauuaaaaaugauaccuaaaagcuugcucuuu

SEQ ID NO: 924 - RNA, 73 nt, Human
aagaaauaugcaaagaaaaaaagaaaaaugcagcaauugcguuaacacgacuuauuuucuuccuuauacucuu

SEQ ID NO: 925 - RNA, 88 nt, Human
ggaugggagugguggcucgugucuguaaucccaacaccucgggaggccaaagugcugggaccacaggcaggagccuucaugcccggac

SEQ ID NO: 926 - RNA, 71 nt, Human
gggccggugugagggcagguacagccgggucugggcuaugugcagagguuccuccuuguccuugauggccu

SEQ ID NO: 927 - RNA, 69 nt, Human
cucugaggcucauuuugcaguuguugaaauuguccccgcaguuuucaaucaugucugaaccaaucagag

SEQ ID NO: 928 - RNA, 95 nt, Human
cugcaagacugugcccuuccccuccugaaagaugucaucgcaacagauaaagaagacguugccuucaaagaccugggauguggccauucuugugg

SEQ ID NO: 929 - RNA, 87 nt, Human; identical to SEQ ID NO: 631

SEQ ID NO: 930 - RNA, 73 nt, Human
guuuauguucuucaagguaaagaaaaaugacauaguaaaugauuguuuaaaauuuuuaaauccagacauaaac

SEQ ID NO: 931 - RNA, 64 nt, Human
uauacagauaaaugagaaguuucgauucugcaucaagcauuauucaaucucaccuucugauaua

SEQ ID NO: 932 - RNA, 78 nt, Human
ugcgccuccggaugacaucugauucauucgugggaggaaauggauuguagaguaagguuuugucauuuggaaggggca

SEQ ID NO: 933 - RNA, 94 nt, Human
cacugugggggcggugagaacgcuguggacacugaggacgcugugggggcggugagggcgcuguggacgcggugaggacgcugugggggcggug

SEQ ID NO: 934 - RNA, 75 nt, Human
cgcugucggggccgugagacgcugucggggcggugaggacacugucggggcggugaggacgcuguggggacggug

SEQ ID NO: 935 - RNA, 106 nt, Human
ugaagaucgacauuuaaaaaaugagggugaagaaaagcuauaguggcauagaaaaaguuaaagcucaguuaguuuuuuuuuauuauuauuauuaaaaguuaauuca

SEQ ID NO: 936 - RNA, 85 nt, Human
ggauggggcagagcugagaagccaaggggggaagaguuggggcugaccucuucuucaccucgggccuuaaucacugaccaagucc

SEQ ID NO: 937 - RNA, 73 nt, Human
guauguauaagcaucagcccaagcaaagggucaaggaaauuagugcaugaaaggcuaaugcucauaaauauac

SEQ ID NO: 938 - RNA, 77 nt, Human
uucacucaggcgcgcuacuuggagaaagaagagaagugucucccuccucccagcauucggguaguggucacggugga

SEQ ID NO: 939 - RNA, 90 nt, Human
uggucuccuucaauucucauaccaccacuaauaucugagauguuauuacucauacuuuacagauaagcaaacugaggcuuggagagauua

SEQ ID NO: 940 - RNA, 60 nt, Human
caauugagaauuguugccugaaaaccaugugggagauuuaaauguauuaguuuuuauuug

SEQ ID NO: 941 - RNA, 68 nt, Human
uuucuucugugacauaaagacauuuugauaucguagaaccaauuuuuuauugugguaacggacaggaa

SEQ ID NO: 942 - RNA, 68 nt, Human
cugcagagcgagggcaugggccuaccguggggcuucugcugagccgaggggccagccccacucugcgg

SEQ ID NO: 943 - RNA, 63 nt, Human
uaagagauucuguugugauuauuugaauagcuuuauauuaauaaaagaagacaaaauuuuuua

SEQ ID NO: 944 - RNA, 96 nt, Human
uuucuuaucuaccuguuauauugugcuaauuuuucuauguaugugaugugaaaugaagacuauauauauggaauggaggugacagaaagaaagaaa

SEQ ID NO: 945 - RNA, 63 nt, Human; identical to SEQ ID NO: 527

SEQ ID NO: 946 - RNA, 63 nt, Human
ccggagcggaaguggcgaucggagcggaaguggagcuaccgccaccgccgccgccgauuccgg

SEQ ID NO: 947 - RNA, 69 nt, Human; identical to SEQ ID NO: 528

SEQ ID NO: 948 - RNA, 92 nt, Human
uucccaaugcuacacaaccagaaaguaagguguucuacuugaaaaugaaaggagauuauuuuagguaucuuucugaaguggcaucuggagaa

SEQ ID NO: 949 - RNA, 81 nt, Human
cgagcacaugauggcgauacgggagcucaaagugugccuucucggggacacugggguugggaaaucaagcaucgugugucg

SEQ ID NO: 950 - RNA, 61 nt, Human
gccggcggggcgcgggcgcggcggccccggaggaugcugcugagccccggcacugccuggc

SEQ ID NO: 951 - RNA, 115 nt, Human
cuaugggugcgguaucaucuaagagaauaagcauucuugaauauucuggacauguggcauggccuucuguaccaacucuucuagaugugcuugccuggugugccauggacccugg

SEQ ID NO: 952 - RNA, 78 nt, Human
gacugauacagucuguaagaucucuucgagagagcuguccaauuacagaucuauauacuuuucuucagaaggucaguc

SEQ ID NO: 953 - RNA, 78 nt, Human
cuuaugaguuagcuuucuugcuagcccccuagucggucaccaaacuaguaacuaguggggcuuaaugaaggucauaag

SEQ ID NO: 954 - RNA, 67 nt, Human
uguauagguaacuagguaacuuauuguggcccagauaaggcuuuaggaugccucagugcuuauguca

SEQ ID NO: 955 - RNA, 73 nt, Human
uuuuagguaagaauuagauuccuuauaaagaaguagugauaaaucuucauucuuguuuuguuuuuauuugaaa

SEQ ID NO: 956 - RNA, 78 nt, Human
gcggcacgcuguccagcagccugcuucgccccgucgucaacuuugagcuggaggagaagcaacuuuggcaguggccgc

SEQ ID NO: 957 - RNA, 96 nt, Human
gcucgccaagucgcugggguuagguggggcaagaguuucgccggcgcaucagcgcugcuucggacuguuugcaacguguuccagcgagcugggagc

SEQ ID NO: 958 - RNA, 69 nt, Human
gguugugacugcgagucgucugggggagggggacuuguuuucuuuccucuagagaccucgguugcaacu

SEQ ID NO: 959 - RNA, 77 nt, Human
gagggaggccaggcagcuggcugggcgguuauguuaaccgcugcaccaugacagcauuuagcagguuggcuuccuuc

SEQ ID NO: 960 - RNA, 75 nt, Human
ggucugggucucaucaaccaagcucuuuguucgggaaaguagucaugaggauaaaagcuggugggagccauggcu

SEQ ID NO: 961 - RNA, 98 nt, Human
uccacgaugaaaauucggaugucgcugaucccgugggcgggguaaaauucuuggacaagcuucccgccguuggaaaccggaauuugaauguuguugga

SEQ ID NO: 962 - RNA, 108 nt, Human
uuuuuuuuuuggugauauuccuucaauuuuuuugguuguuuuuauuuuuuuuuucauuaaaguccauugaucaucacaaaaacccaggaaaugcaacuaaggagaaaa

SEQ ID NO: 963 - RNA, 63 nt, Human
ccucugcucagaaauggaagaauuagccgaacauggcauauuucucccuccuaauaugcaagg

SEQ ID NO: 964 - RNA, 94 nt, Human
gcagccggggccuucucaacgccucaguaccucggcgggaccgccaugguucugcugcacgugaagcggggcggcgagagccaguuccugcugc

SEQ ID NO: 965 - RNA, 60 nt, Human
gggauucccggacugugagcggcuguuagugcgucgcagcugcuggcgauccggcgaccc

SEQ ID NO: 966 - RNA, 62 nt, Human
caauaauaaauccaaagaggagccaguuaccaugacucauccaggcacuggagauauuauug

SEQ ID NO: 967 - RNA, 64 nt, Human
ccguggcucucuagucuucgugucaauauccuuauuggugugaugauuauuucuucagccaugg

SEQ ID NO: 968 - RNA, 82 nt, Human
gauugccuugcugcagaggggaaacugcacguuuaaagagaaaauaucacgggccgcuuuccacaaugcaguugcuguaguc

SEQ ID NO: 969 - RNA, 60 nt, Human
gcaucgaccgcgggcgcuacgggcuugacucccccaaggccgagguccgcggccaggugc

SEQ ID NO: 970 - RNA, 63 nt, Human
ggcucgccgcgcuagcccugcugaccugcagccuguggccggcacgggcagacaacgcgagcc

SEQ ID NO: 971 - RNA, 129 nt, Human
cgggccgcuuuccacaaugcaguugcuguagucaucuacaauaauaaauccaaagaggagccaguuaccaugacucauccaggcacuggagauauuauugcugucaugauaacagaauugagggguacg

SEQ ID NO: 972 - RNA, 60 nt, Human; identical to SEQ ID NO: 969

SEQ ID NO: 973 - RNA, 90 nt, Human
gaaugucucaaagaaaauguccuugauuuaauuaugguccaagguggcugcuuugcacaagcuugucagugacaugaacuugaagacuuc

SEQ ID NO: 974 - RNA, 83 nt, Human
gcgagcagaccaugcguacgaguugaaaggauccuaaagaagucacuggauuuuuuauacuagacguucuuuggaaugagcgc

SEQ ID NO: 975 - RNA, 73 nt, Human
ucagaaccucgaggauucggucacuauuggaauugcuguuccugauguauaccgugcuugugacagguuugga

SEQ ID NO: 976 - RNA, 72 nt, Human
ccgugcgcguugcugcggccgugguccgcgcccuuccucggcgggccggacuggucuccagaaaugcuuugg

SEQ ID NO: 977 - RNA, 77 nt, Human
aagaguaggaugucugcugaagucauccaucagguugaagaagcacuugauacagaugagaaggagaugcugcucuu

SEQ ID NO: 978 - RNA, 109 nt, Human
cuuguuucggacuauagagugcugauggcagagauuggugaggauuuggauaacaucugauguguccucauuaauuuuccucaugaaggauuacaugggccgaggcaag

SEQ ID NO: 979 - RNA, 105 nt, Human
aauugauaaagccagaguggagacacagaaccacugguucaccuacaaugagacaaugacaguggagagugugacccaagcuguguccaaucuggcuuugcaguu

SEQ ID NO: 980 - RNA, 61 nt, Human
ucugggaccuuuguacagugugaugcucgagcaauuggcucugcuucagagggugcccaga

SEQ ID NO: 981 - RNA, 63 nt, Human
agcuaggauucucaaauggaaguguuauauauaauauguuaaaaacauuuugcuuuccuggcu

SEQ ID NO: 982 - RNA, 90 nt, Human
gaucccuuuaaauucaaauuugaaucauuugucauguaugauuauuucuguuaaguguacacaguauuuaagauggauauuugggggguc

SEQ ID NO: 983 - RNA, 103 nt, Human
guggcccucauccuucagaauguggaucugccgaauugaagaggccugauuucagcuccaccagaugcagauuuguguuuuguuuucuuguuaucacugucac

SEQ ID NO: 984 - RNA, 65 nt, Human
ccgcguuuccuuccaucccaaaguagaaagccguacucaggguacacggauagaacgagauccgg

SEQ ID NO: 985 - RNA, 73 nt, Human
cuuugugcuccagucgcuccuaacgcucccuggcccggcggggccgcgcaguuagggcaucugaggcggggag

SEQ ID NO: 986 - RNA, 82 nt, Human
gaauuggcaccuggauccaacaggcauuuagucaagcagaaagcaugugugaucgaagcccuuuagacgucgaggcaaauuc

SEQ ID NO: 987 - RNA, 83 nt, Human
gccggggccucauuuccaggucagccccgggccugacgcggcguugcgucccccgggagcugcgcuaggcgaacggcugcggc

SEQ ID NO: 988 - RNA, 69 nt, Human
ccagaaaggacaucacagguaaacugaaggacccugcgaacuuucaguauccugccgagucuguucugg

SEQ ID NO: 989 - RNA, 73 nt, Human
gagcccagccaaucagcgccccggacugcaccagagccauggucggcagaagagcacuugaucguacuggcuc

SEQ ID NO: 990 - RNA, 72 nt, Human
ggagaguuugcuuacacuuacgcugccauguaugacaaaggacccuuccggaguaagaaggcagugcuuucc

SEQ ID NO: 991 - RNA, 69 nt, Human
agaaugaauuuuggauauuguugagugguuuuucugcaucaauugggauaucauauggguuuucauuuu

SEQ ID NO: 992 - RNA, 62 nt, Human
gauguccuuuuauaaaguugaggaacuucucuucuguuccuacuuugcugagagucuccauc

SEQ ID NO: 993 - RNA, 69 nt, Human
ggauuacagcuaggaccuccagaacacugacaaaaagaaguggugcaguggaaauccuugccuuguucc

SEQ ID NO: 994 - RNA, 69 nt, Human
aggaaaggaggaagaaauguuuucuuaggggaauucgcuagguuuuaacgauuuguuucuccugcuccu

SEQ ID NO: 995 - RNA, 79 nt, Human
aguugguugcgggggagaggggagaauggaguagagucccuugguacaagcuccucuccccccucuuuucccaccaacu

SEQ ID NO: 996 - RNA, 61 nt, Human
cucucgggggcggagggggugccugugagcucucagccacuucccucccaacccuggugag

SEQ ID NO: 997 - RNA, 64 nt, Human; identical to SEQ ID NO: 175

SEQ ID NO: 998 - RNA, 67 nt, Human
agacgcucguuuucucaggacccaaggaaccaaaauugcuucugauggucucaagggucguguguuu

SEQ ID NO: 999 - RNA, 70 nt, Human
cugccugacuaacuuccauggcauggaucuuacccgugacaaaauguguuccauggucaaaaaauggcag

SEQ ID NO: 1000 - RNA, 80 nt, Human
cacgguauuguacacggucaucuguugaaacagauuucuuuuuuaacagaucuuaguuuaaaaaagucauagguacugug

SEQ ID NO: 1001 - RNA, 73 nt, Human
guucuguauaaacugguggacaguaaguuaguuccuuuguuuuaacuuauaagcccccacuucaccgcagaau

SEQ ID NO: 1002 - RNA, 73 nt, Human
guggcucggccaucaugcccaggaucugagcccacaucuggcaccagcucuaccaagggccugguugggccac

SEQ ID NO: 1003 - RNA, 130 nt, Human
auuacauggauccagcccaguucuccaauuccuucaugucgucguccuccucuucuuucuucuuggcggguuuugaugguagggcuauagagggaacauuugguagagggacuguuucggguccacugau

SEQ ID NO: 1004 - RNA, 69 nt, Human
cugccugccccacacacgcacacgccugcucgcugcgcaggccaccacagucugucugggcccagccag

SEQ ID NO: 1005 - RNA, 67 nt, Human
agucuuguauagcaauaugcuuggagaggagaauacuuaucucuggcgcacaucacuauauuuggcu

SEQ ID NO: 1006 - RNA, 71 nt, Human
ggauguccuccgagaggaagugagugagaucuuagaugaaaugagucacaaacugcgucuuggagccauuc

SEQ ID NO: 1007 - RNA, 71 nt, Human
aacuugaaagugaacaguaugacuuuccugauccagaacaguuuggcccacaucuguuuaaucuuccaguu

SEQ ID NO: 1008 - RNA, 66 nt, Human
uagaauaaauuaacaaguauuuuuucaaaaaaauguuuuguacaaaaauacugucaaaauuuccua

SEQ ID NO: 1009 - RNA, 73 nt, Human
uggagggaacauucugcuuuucaggcaccagcugugaagaagaaaccaacaguaacuaaaggcagaucuucua

SEQ ID NO: 1010 - RNA, 69 nt, Human
uuucaguacugacuguugguuuuggccuugcaagagcagaaaaucagaagcuggauuucaguacuggaa

SEQ ID NO: 1011 - RNA, 61 nt, Human
acuagaauguugaccucgagccgaggccuacuugcagcgcaccggaggagaggucucuagu

SEQ ID NO: 1012 - RNA, 80 nt, Human
gcuccgccuuuucuggguacuuacgguccugagucucaaguucgucuucgagaugcuguugugccagaagcuggcggagc

SEQ ID NO: 1013 - RNA, 78 nt, Human
gucugccccagccuuguuuuacucccugcauuccauauucuguuguuccggcuugcagcccacagggcuggagaagau

SEQ ID NO: 1014 - RNA, 84 nt, Human
ugucugucucuuuucggaagcggaauuuccucagcuuuucuguuagcucugggucuaccucgcacaccaccagggagucagaca

SEQ ID NO: 1015 - RNA, 97 nt, Human
agggcuaccaaguuccuccaggagccacauauacugccauugaggcucccaagggagagucugggguguaccuggugucugauggagaggcggcucu

SEQ ID NO: 1016 - RNA, 66 nt, Human
aucuggcugguuggacaagaugucuaagggacacaugucggcagaugucguugccaaucaauaggu

SEQ ID NO: 1017 - RNA, 88 nt, Human
gauaugguauugggagaaguagaucggugagcaggggagcaggguuugauccaccccugcuaucagacuucuucuguggagccauguu

SEQ ID NO: 1018 - RNA, 75 nt, Human
auagcaagucugaaaaauagaagauagucaaauauuguuuaugcuaagaacuguuuuuaauuuucagcuugaugu

SEQ ID NO: 1019 - RNA, 66 nt, Human
gaaagcauguagagcaguugugauuaguagaaaauacacugacaagaagauauuugcauuuauuuc

SEQ ID NO: 1020 - RNA, 86 nt, Human
ggugucuuuaguucaagcauguuaggaaauccucuuuauucuuaaauauagauacaugucugcauauaugauugaauuuuagagcc

SEQ ID NO: 1021 - RNA, 65 nt, Human
uagaaguaguuucugauuucccugaaugaaagauagugaucuuuuaggccuucauauaucuucua

SEQ ID NO: 1022 - RNA, 131 nt, Human
ugcagugaugcugccuacaccuccaccuccuuccccuucucccucaggcaaccccgacagacaguggcacuccugguccugcugucuugguuuugucuuggcucugggaggacucugaggggcagugcuca

SEQ ID NO: 1023 - RNA, 61 nt, Human
gccauccucuccuguaccuggguacagggucugcucugugucccgugugucaaccaauggc

SEQ ID NO: 1024 - RNA, 75 nt, Human; identical to SEQ ID NO: 74

SEQ ID NO: 1025 - RNA, 87 nt, Human; identical to SEQ ID NO: 76

SEQ ID NO: 1026 - RNA, 89 nt, Human
ggagaaucacuuaaauccagaaggcagagguugcagugagccaagaucacgccacugcucuccagcugggugacagugagugagacucc

SEQ ID NO: 1027 - RNA, 81 nt, Human
gggcaauggcucacaccuguaaucccagcacuuugggagacugaggcagagggaucacuugaggugaaagaguucaagucc

SEQ ID NO: 1028 - RNA, 93 nt, Human
acugggacugcugagauguccucuauucuugaagagcguauucuuggagcugauaccucuguugaucuugaagaaacugggcgugucuuaagu

SEQ ID NO: 1029 - RNA, 108 nt, Human; identical to SEQ ID NO: 710

SEQ ID NO: 1030 - RNA, 95 nt, Human
ggagccauuguggacguuccaguuggugaggagcugugggucguguaguugaugcccuugguaaugcuauugauggaaaggguccaauugguucc

SEQ ID NO: 1031 - RNA, 87 nt, Human; identical to SEQ ID NO: 76

SEQ ID NO: 1032 - RNA, 77 nt, Human
gcugauuucgaaugguaaacaaaucauacauauuaauguugcuuugaaacauuuuuuuguuguuguuuugagacggc

SEQ ID NO: 1033 - RNA, 76 nt, Human
ucacucuguugcccaggcuggagugcaguggcacuaucuugacucacugcaaccuccaccuccuggguuccaguga

SEQ ID NO: 1034 - RNA, 60 nt, Human
aagauccuucugcaagaaaucucuuuaccuaucaacucauuuauuugcccacuugaucuu

SEQ ID NO: 1035 - RNA, 74 nt, Human
agagaauccagcauccacuguucugcccaguauuuauccauugaccugugcucugucuggauccuaucuucucu

SEQ ID NO: 1036 - RNA, 65 nt, Human
ccauucuauucucuuagauuuuuugcuguaauuuuuagaacacuuccucuaggaguuucuaaugg

SEQ ID NO: 1037 - RNA, 66 nt, Human
ugccuagccuuaucaugaacuugagguucaaagaguuaaucccucuguucauuauugcuuuuugca

SEQ ID NO: 1038 - RNA, 83 nt, Human
cuguucccaugcuugagcuuccauggggaggaugcugagugagcaguuuccuaccccguggaucuagcaagccauggagacag

SEQ ID NO: 1039 - RNA, 75 nt, Human
cugaagacuccuggggcgcaaggcuaugggucagagaaaaacugggcuguggccggaccccaccugguucuuugg

SEQ ID NO: 1040 - RNA, 86 nt, Human
ggucauggcuggaguccugcaucuggucuaaggcuuugaugcuucagaaggcucauauuguagagcgggugugggaagcuguggcu

SEQ ID NO: 1041 - RNA, 79 nt, Human
gugcuggcuccugggugggcaggcccaggaccuucacaacaucugugaucuuggcaggcucugacaggcggagcagcau

SEQ ID NO: 1042 - RNA, 62 nt, Human
gcuccgauuuggcagccagaucuucaucgagcacguggccgauguggacaccuuguuggagu

SEQ ID NO: 1043 - RNA, 70 nt, Human
gcuggagccgucuacaucugcacggaagacgccuucccgcacaagcgccugcagcagcucauggcccagc

SEQ ID NO: 1044 - RNA, 82 nt, Human
gugccuucagagcccugugcugugcucacccggugccgaggcauggcggaccuggcgcagcacacggagccgauggagguac

SEQ ID NO: 1045 - RNA, 71 nt, Human
cagugagaccaguguccugaaucgacucugccggcucggcacagacuauauucgcuucacugaguucauug

SEQ ID NO: 1046 - RNA, 65 nt, Human
ccgugggaaugauccacgaacugcucuuggcucugagcggguacccuggguccauuuucaccugg

SEQ ID NO: 1047 - RNA, 125 nt, Human
gcgaccccuucccagcuucccguccgcuccgccgcagcgauugucucgguggguugauucggcacaaaccgcccgacccagggccggugcgcguguggaaggggaagcacuccccucguggucgc

SEQ ID NO: 1048 - RNA, 87 nt, Human; identical to SEQ ID NO: 76

SEQ ID NO: 1049 - RNA, 75 nt, Human
gcgugaccuggcagcuguagcuucugugggacuuccacugcucaggcgucaggcucagauagcugcuggccgcgu

SEQ ID NO: 1050 - RNA, 71 nt, Human
gggagaagggcuugaugccuuggggugggaggagagaccccuccccugggauccugcagcucuagucuccc

SEQ ID NO: 1051 - RNA, 63 nt, Human
cgucaggcuccugcaaccccaggcaugaaccaagguuucugaacuacugggcgggagccaacg

SEQ ID NO: 1052 - RNA, 103 nt, Human
gagaagaucaaagguggaauccacacagcagauaccaagacagcagggagugugugccucuugaugcaggucucaaugccguguguucucuuugcugcuucuc

SEQ ID NO: 1053 - RNA, 64 nt, Human
gaucggagccggccggagcacgccaggccugaggccucaacauuuaucuggacuggaaaugauu

SEQ ID NO: 1054 - RNA, 63 nt, Human
gugacauuaaaacaaggggauauuacccaaaaggggugggugaagugaugguucgaaugucac

SEQ ID NO: 1055 - RNA, 86 nt, Human
cuucccaggcccguggccaacccagcaguccuucccucagcugccuaggaggaagggacccagcugggucugggccacaagggagg

SEQ ID NO: 1056 - RNA, 62 nt, Human
ggagugagggcaggcgagccccaccccggccccggccccuccuggacucgccugcucgcuuc

SEQ ID NO: 1057 - RNA, 75 nt, Human
uaccuggaggccauucacaacuucguggaggucuuaaacgaauauuuccacaaugucugugaacuggaccuggug

SEQ ID NO: 1058 - RNA, 71 nt, Human
gcugguuuccuggccgaggcggagcugcugaaccugaggaagaucagcuccgacuuggacgggcacccggu

SEQ ID NO: 1059 - RNA, 61 nt, Human
gcugugcaagccuuggcaagccagcaccagcaacagccaucauugccaaggacuucaaggc

SEQ ID NO: 1060 - RNA, 63 nt, Human
guaugggaggccauggccuucgccagcaucuauaagcuggacaaccuuguggccauucuagac

SEQ ID NO: 1061 - RNA, 109 nt, Human
cugugcaccucgugguagaacucuuugggguucgccagcuguagcucauauuucauguuggggucaugccgaacacccaugaaguuguaguuccacgaggacugggcag

SEQ ID NO: 1062 - RNA, 65 nt, Human
gaaggucagauaugcagaugaacuucuuaagcacauucuugggaaggauguagguguagacaguc

SEQ ID NO: 1063 - RNA, 68 nt, Human
gcaggaggcagggaaacggucaggcauacagguccucccgauccgcagaguaaaccucccccuccugc

SEQ ID NO: 1064 - RNA, 103 nt, Human
acuguauauagggaguaauuagggaccuaaucuaguuucagugaagaaagaucccuuuacguuaauuuaggugcaucuaauaauucuuguucuguauaaaagu

SEQ ID NO: 1065 - RNA, 74 nt, Human
ggcucggugcuaaauauggagauauagcagugucaacacacaaguggucccuccauguugucacagcugauguc

SEQ ID NO: 1066 - RNA, 77 nt, Human
gcugacugcccgcccuuggcuccaucugcagaugucuucagagacgagauguacuuggaccagaaggagcagucggc

SEQ ID NO: 1067 - RNA, 122 nt, Human
gggugagguuuuuggggagcucaagggcuggucacuugcuguaggucuuagagccugguuccuggaggcuuaggagaucuucucuuagcccagauccagccgucaacuccuccucuucacuc

SEQ ID NO: 1068 - RNA, 61 nt, Human
uuuuuuuuucaccgcauguagauacuuuauugaagguaaguggcuauuuuagagaaaaaga

SEQ ID NO: 1069 - RNA, 60 nt, Human
aaaguuguucagaaacugauuccacaacucccaacucuggagaauuugcugaacaucuuu

SEQ ID NO: 1070 - RNA, 64 nt, Human
gcauuucuaugugauguggucaguaaaauuuauauugcaacugauaguacuccgguggauaugc

SEQ ID NO: 1071 - RNA, 72 nt, Human
uccuucuguaaauacccguuaccauauuuauccauuuguaauuaaauuaugguauuaacuugcuacagagga

SEQ ID NO: 1072 - RNA, 60 nt, Human
aguaucuauuuauuaaaugaaugcacaauugaaagagugaagauugaaugucuagauauu

SEQ ID NO: 1073 - RNA, 63 nt, Human
aacagugcuuuguaccggaucugcugaagcaucuguccagcugguauccugugaaaguuuguu

SEQ ID NO: 1074 - RNA, 80 nt, Human
acgagcuuuaguuuguuuucugguuuaaaaaauaaaaagguuucucuuaacaguauuuccagugacaaugcaagguaagu

SEQ ID NO: 1075 - RNA, 88 nt, Human
uuaugggauauugauuucuuguuuuuuuuccguaacauugucugcugcaauuuaaauaaaaauuacgacauuuuaagauauuucauag

SEQ ID NO: 1076 - RNA, 64 nt, Human
aggcugagagacugcuccccauugcagauuagcguauagucagaugggcuacaguuuuucuccu

SEQ ID NO: 1077 - RNA, 82 nt, Human
cugugaguuauaugugaugaaaaaguauagcuuucuugaauucaaauaagcaauggcaaagaucacauuuagaauuugacag

SEQ ID NO: 1078 - RNA, 99 nt, Human
aagucugcagauuuuuuuauuauggugcagcuuuuuuuuaauuauguuuuuaaaauuauacaguugaaaaauaugccauuucauaaagucugaggauuu

SEQ ID NO: 1079 - RNA, 84 nt, Human
cacuggugcuuucaucaucagaggucaaauuauuaugauaacuauuccauuaaguuugccaaacauuugucgugguuaccagug

SEQ ID NO: 1080 - RNA, 81 nt, Human
aggcuuguacauuaucucuaggugaagggauuccagguuaguuugcuuguaggaugauuucacagaagauaacagaggucu

SEQ ID NO: 1081 - RNA, 62 nt, Human
cccuaccacugaagaugaguuucuccucuguuacuacagcacagucugcgucuguggugggg

SEQ ID NO: 1082 - RNA, 92 nt, Human
cuguacaagguggggcugcgggacguuaaugacuacguguccuaugccugggucggggacagcaaggucuccugcagcgacaacugaaccag

SEQ ID NO: 1083 - RNA, 92 nt, Human
uaguaugugggguuuuuugguuuuguguuuuguuugguuucaacuuggaccaauucagaaauguauacggaaaaaaaugucuucacaaccua

SEQ ID NO: 1084 - RNA, 97 nt, Human
gcuacuuugcugguaaccuggcguccgguggggccgcuggggccaccucccuuugcuuugucuacccgcuggacuuugcuaggaccagguuggcugc

SEQ ID NO: 1085 - RNA, 81 nt, Human
gggcucuguaugggaggccauggccuucgccagcaucuauaagcuggacaaccuuguggccauucuagacaucaaucgccu

SEQ ID NO: 1086 - RNA, 61 nt, Human
ggggcaaacuuacucugggcaccuauaucucccuuauugccgagaacuccacaaaugcucc

SEQ ID NO: 1087 - RNA, 71 nt, Human
guaguauggcaucgaggagaauggagaccaaaccugugauaaccugucucaaaacccuccucaucaucuac

SEQ ID NO: 1088 - RNA, 65 nt, Human
uaugugcucaucggaacuggcaccacuauuguugucuuuggccuguuuggaugcuuugcuacaug

SEQ ID NO: 1089 - RNA, 76 nt, Human
accaguggaucgagcaggacauggagaaguacauccugagaggggaugagacguuugcuguccugagccgccuggu

SEQ ID NO: 1090 - RNA, 65 nt, Human
ccaccauuaagcaguucauggacaucuucucgcuaccggagaugcucugcuguccuguguggugg

SEQ ID NO: 1091 - RNA, 82 nt, Human
gggaaagaaugccaagaugguauuuucuuuuggcaagaugcuuugguugugcagucauugaagauacuuggcacuauuuucu

SEQ ID NO: 1092 - RNA, 61 nt, Human
ugaaagugucagcaucuuuaguucagcauccuuggcuguggaauauguagauucacuuuua

SEQ ID NO: 1093 - RNA, 92 nt, Human
uuucuuauucuguuuaccuggauuuuuauuucaauuuauaccuuauaugaaaaaauacaaaauucaaaaggauaagccagagacaugggaaa

SEQ ID NO: 1094 - RNA, 69 nt, Human
ucuuguguauggauauguguaaauguuaugacuccuugauaaaaaauuuauuauguccauuauucaaga

SEQ ID NO: 1095 - RNA, 71 nt, Human
gaaaauaauuggagauuuaugguaguaucagugguauuuuuuccauuuuuuuucucuccaacuauguuuuc

SEQ ID NO: 1096 - RNA, 75 nt, Human
gaauguuucuugaaauuggcgucaaacugucuuguauuucauuucuuuugcgaugccuaauugaaucgaaacuuc

SEQ ID NO: 1097 - RNA, 70 nt, Human
gguccacauagcuauaugauagacagccaccgcaacugucucgucucauaucacgaacagcaaagcgacc

SEQ ID NO: 1098 - RNA, 63 nt, Human
ucuuggugacaaaauauguuguguagaguucaggggagagugcgucauauguuguuccuagga

SEQ ID NO: 1099 - RNA, 77 nt, Human
gucgauuuaaaccauguagaaauaaguaugcaaaaagucugcauaacaaaacauacuuuuaacauguuuaaguagau

SEQ ID NO: 1100 - RNA, 60 nt, Human
agccgagccugaggcuggggaugguggcucaugccuguaaucccagcaccuugggaggcu

SEQ ID NO: 1101 - RNA, 84 nt, Human; identical to SEQ ID NO: 286

SEQ ID NO: 1102 - RNA, 103 nt, Human; identical to SEQ ID NO: 294

SEQ ID NO: 1103 - RNA, 79 nt, Human
ggcaacuucaggaugacaaaaaccaaagucucuucugcugggaaaucccaguacagaucguuucucaucucuaagugcc

SEQ ID NO: 1104 - RNA, 71 nt, Human
caguagccccauuucagacucccauuccaacauuuuucccaugcaggaugaacugacaguuguugcugcug

SEQ ID NO: 1105 - RNA, 63 nt, Human
ccuuucuauaugauuucaggaguucuugggucacagcaagaaucugauccuuguauacagagg

SEQ ID NO: 1106 - RNA, 94 nt, Human
aggugggcggcggccccuccaugcgcccgccgcugccguagcacguggcgcugaugcccgaguuacugcugggggggcaugggccguccuaccu

SEQ ID NO: 1107 - RNA, 97 nt, Human
cgcagccccagcccggccccccuggggacccuagagaggguguccuuucuguuuauccuucucuuugcuccaaauggcugcgcucucuaggggcgcg

SEQ ID NO: 1108 - RNA, 63 nt, Human
ggaggugggaggggagggccacacgaugcguugcugcgccccccgccuuccucucacuccucu

SEQ ID NO: 1109 - RNA, 77 nt, Human
gcccaucacagcagccaggagauguccucugaguaccgggaguaugcagacgaguuuuggcaagugcccuggugggc

SEQ ID NO: 1110 - RNA, 67 nt, Human
gcugucgcgccgcgcugcggggccaugauccggaacgggcgcggggcugcaggcggcgcagagcagc

SEQ ID NO: 1111 - RNA, 75 nt, Human
ucaguuaaaaaagaagaagaagaaauggcaaagagaaaguuuuuucaaauuucuuucuuuuuuaauuuagauuga

SEQ ID NO: 1112 - RNA, 71 nt, Human
ccgggacguggcuggucggccuucauuaacccucgggggguaccggcuggccacuucuuccaagguccugg

SEQ ID NO: 1113 - RNA, 79 nt, Human
uggauucuggauauauuauaaugagugacacuuugacagcggaugucauuggucgaagaguugaaguuaauggagaaca

SEQ ID NO: 1114 - RNA, 61 nt, Human
uuuuggaacagacuuucuuacugcaauuaagaaccgcuauguguuagaagauggaccagag

SEQ ID NO: 1115 - RNA, 100 nt, Human
ugaggcgagagaaucgcuugaacugggaggcagaaguugcagugagccaagaucguaucauugcacuccagccugggccacagagcgagacucugucuca

SEQ ID NO: 1116 - RNA, 72 nt, Human
aguauuugacugcuaaauucuccacauuauguaaccugauuaauuacauuuggguguaaagcaguaaaugcu

SEQ ID NO: 1117 - RNA, 61 nt, Human
ccugggaauuuucaacauggucuaauuauuuacucaaagacauagaugugaaaauuuuagg

SEQ ID NO: 1118 - RNA, 62 nt, Human
uuguauaguaauguuucagaccaucauccagcuuuggcugcugaaaucauacagcugugcaa

SEQ ID NO: 1119 - RNA, 69 nt, Human; identical to SEQ ID NO: 994

SEQ ID NO: 1120 - RNA, 79 nt, Human; identical to SEQ ID NO: 995

SEQ ID NO: 1121 - RNA, 61 nt, Human; identical to SEQ ID NO: 996

SEQ ID NO: 1122 - RNA, 67 nt, Human
gugggcagggguggcagaggacacgagcagccacugcccguacccccucuccucucuguaagcccau

SEQ ID NO: 1123 - RNA, 94 nt, Human
ucccccugcugucugcagccccuccccggggaguuggugcuuucuuuuccuuuuuauuuuuuuccagggggagggaggaaaggaaggaggggga

SEQ ID NO: 1124 - RNA, 71 nt, Human
gcccucguuuauucagcaaauauucauggagcccuuguaccaagcacggugcugagugaugcugugagggu

SEQ ID NO: 1125 - RNA, 87 nt, Human
ucuaccacaccaaugccuucauggucuuacaucuuguccucuuaacccugacuucucuagcccucaugaaugcuuuaguguggcaga

SEQ ID NO: 1126 - RNA, 75 nt, Human; identical to SEQ ID NO: 74

SEQ ID NO: 1127 - RNA, 106 nt, Human
guaacugcaaagaugcuguccgugcgcguugcugcggccgugguccgcgcccuuccucggcgggccggacuggucuccagaaaugcuuggguucaucuuucauugc

SEQ ID NO: 1128 - RNA, 87 nt, Human; identical to SEQ ID NO: 76

SEQ ID NO: 1129 - RNA, 71 nt, Human; identical to SEQ ID NO: 77

SEQ ID NO: 1130 - RNA, 63 nt, Human
agagaugcauggugguauuuaaguaguaugucaucauauuugaaaugccuuugugacauuuuu

SEQ ID NO: 1131 - RNA, 75 nt, Human
ggugagguggguggaucaccugaggucaggaguucaagaccagccuggccaacauggugaaaccccaucucuacu

SEQ ID NO: 1132 - RNA, 79 nt, Human
uuucuaaguuaaaaaagacacaugguccuuuauuuuuaagaaauagaauauguaaaaaguuuucucuuuuaauuugaaa

SEQ ID NO: 1133 - RNA, 79 nt, Human
acauagauggcugguacauugcugugcuggaaucacgccuaucuguauaguaaagaagccaagcccacagagacuaugu

SEQ ID NO: 1134 - RNA, 75 nt, Human
aauuuauguuguuuaguguuauauuccagacgugauaccaaaauuuuguugcaaauauaauggacaauauuuauu

SEQ ID NO: 1135 - RNA, 129 nt, Human
auaaccacaaaugacuuuaaaguucuggaugguaauuacggauuguggaccaguaauaaagggauuauuaaauguuauucgguuaaacagguuaaaguacaguaacaaauugggagucaaacuggggau

SEQ ID NO: 1136 - RNA, 73 nt, Human
ccuuaugugaguaugcaaauauauaaauuugaguaugcuugauuguauauuggaacucaacaugaucauaagg

SEQ ID NO: 1137 - RNA, 79 nt, Human
guacccuuaauugaguuacuacuaugguauuguuaauauuuucuacacuaaauaccauguggugucuuuauagguugac

SEQ ID NO: 1138 - RNA, 70 nt, Human
caugggaaacaaccugaaaaagcaggcaggccucccggucagggagccucugcugugcuggcuucccaug

SEQ ID NO: 1139 - RNA, 84 nt, Human; identical to SEQ ID NO: 286

SEQ ID NO: 1140 - RNA, 64 nt, Human; identical to SEQ ID NO: 287

SEQ ID NO: 1141 - RNA, 89 nt, Human; identical to SEQ ID NO: 288

SEQ ID NO: 1142 - RNA, 81 nt, Human; identical to SEQ ID NO: 201

SEQ ID NO: 1143 - RNA, 69 nt, Human
gccauugaugaccugcccuucaauaauuguuuuguaagaguugaugacccgggagagguugucacuggc

SEQ ID NO: 1144 - RNA, 70 nt, Human
guuaucauuguccucagucucacuggcgaguuuaaauaaaguccgccucuuguucucacacugaucaaac

SEQ ID NO: 1145 - RNA, 71 nt, Human
gggaaacuccgaggacagagggcuaaauccaugaaguuuguggauggccugaugauccacagcggagaccc

SEQ ID NO: 1146 - RNA, 67 nt, Human
guagagcuuuaugcugaaaagguggccacuagaggucugugugccauugcccaggcagagucucugc

SEQ ID NO: 1147 - RNA, 107 nt, Human
gauuccuuuuaauccuauagcuuuguguguuugugugugcauguauguguguuguugugugugugugcacgugcuuuauucacaaauuuauaaggguuucuaggguc

SEQ ID NO: 1148 - RNA, 110 nt, Human
ggcaaguguugucaugguaguacaggaggcaaaaccauuuauauuuugaacacuuacugcacugauaggauguuuugugguugagcugauuuuaguacuguagauagguc

SEQ ID NO: 1149 - RNA, 76 nt, Human
aguggcguucagccaaccgagauugagccauaacaggucugugaugaccuuagauguucggggcugcacgcgcgcu

SEQ ID NO: 1150 - RNA, 66 nt, Human
augacugggucagcgugugccuaaccuacgccggcaggcgcggguaaaccguugaaacccauucgu

SEQ ID NO: 1151 - RNA, 90 nt, Human
aaagaugcuguccgugcgcgugcugcggcgugguccgcgcccuuccucggcgggccggacuggucuccagaaaugcuuggguucaucuuu

SEQ ID NO: 1152 - RNA, 92 nt, Human
cucaaguggcuaaugacacaaucauuacagaaacguucaugauggguccgugcaaagaagaagcuggccugauuaugugguagucgcaagag

SEQ ID NO: 1153 - RNA, 75 nt, Human; identical to SEQ ID NO: 74

SEQ ID NO: 1154 - RNA, 71 nt, Human; identical to SEQ ID NO: 77

SEQ ID NO: 1155 - RNA, 67 nt, Human
accacugaagaaaagacgaaugcaaaggaagaaggagcuuaaugccaggaacagauuuugcaguggu

SEQ ID NO: 1156 - RNA, 77 nt, Human
ggaugauggcccaccgaugggcggguggcaacuucuuggaagcacuuacaccccacccgacguggccauuguaaucc

SEQ ID NO: 1157 - RNA, 72 nt, Human
gaaccaggccccagacaugcugcauagauuuuauggaaagaacucuucuuauguccaugggggauuggauuc

SEQ ID NO: 1158 - RNA, 60 nt, Human
auguuucaacuucuuuaguucaacccugugcuguggacugaucuugugcccaauuaacau

SEQ ID NO: 1159 - RNA, 71 nt, Human
gagagcuucagcuugcauauccuugggcagaaaacccugcuggauuccaguaagcucuuuauugaacucuu

SEQ ID NO: 1160 - RNA, 72 nt, Human
gcagcccugaagaaaucagguaaauuccgcuccagagacggcagagcugguggcgccauucuucagggcagc

SEQ ID NO: 1161 - RNA, 61 nt, Human
ggcgaccaucuuguauucaagugcugacaaccgugaugucauuuacuucagagauuuugcc

SEQ ID NO: 1162 - RNA, 70 nt, Human
gaagcacguggggccagguguccuguccauggcuaaugcugguccuaacaccaacggcucccaguucuuc

SEQ ID NO: 1163 - RNA, 84 nt, Human
ccacucaugaacccucacauccgcgugggccccuccugagcccccuugcuuguggcuaggcagccuaggauguggguucugugg

SEQ ID NO: 1164 - RNA, 70 nt, Human
ggcaggccuggaaguccccgugggucaagcauuugucuugacuugcuuuccucgcgggucuccagccucc

SEQ ID NO: 1165 - RNA, 64 nt, Human
agcagggccucauacuccugggccuggcgcugucccucugcccgggucugugccagcucugacu

SEQ ID NO: 1166 - RNA, 93 nt, Human
gccguggagugggagagcagcgggcagccggagaacaacuacaacaccacgccucccaugcuggacuccgacggcuccuucuuccucuacagc

SEQ ID NO: 1167 - RNA, 75 nt, Human
gucgacccagggaggaagaugaccaagaaccaggucagccugaccugccuggucaaaggcuucuaucccagcgac

SEQ ID NO: 1168 - RNA, 82 nt, Human
ugaaggguuucuaggaagguuuagcagugcuucaauuaucuuagcaucauucucagguucaucuuccuguaaacuacuuuca

SEQ ID NO: 1169 - RNA, 67 nt, Human
ugccaccacagguaccagcacuuaaauuugucagcaggcugaccaaagaguggccugucuguuggca

SEQ ID NO: 1170 - RNA, 101 nt, Human
uguauuauucaacuuuaaucuuuugcgaaauguuguauuuacugcuuaaaaucuagguggguggauauauucauguaugcauauauugauagauuaauaca

SEQ ID NO: 1171 - RNA, 75 nt, Human
ggaagauaacuguucuagauagcucuuuuuuuccaaaauucuugauuaagguuuggggaauuuagaauuaucucc

SEQ ID NO: 1172 - RNA, 107 nt, Human
uuauguuuuguuguuugauuuccuaguucauaacagaagggguuuuguaagcugaccuagcuugacaauccuuuuuggguuuuuugguuucaaacaugaucuuauaa

SEQ ID NO: 1173 - RNA, 100 nt, Human
gaagccgcuagacuuuuuuuccuccccucucaguagcacggaguccgaauuaauuggauuucauucacuggggaggaacaaaaacuaucugggcagcuuc

SEQ ID NO: 1174 - RNA, 69 nt, Human
ggcuuuacuucugucucgucugccccaaccgcuagccucggcuuggguaaggcgaggcggaauuaaacc

SEQ ID NO: 1175 - RNA, 86 nt, Human
aaacuuuuggcauuaaauugcaagaaaaaagaaauacaaauuaucacaauaaauuucagaaucuguuucuuuaguccaaauaguuu

SEQ ID NO: 1176 - RNA, 60 nt, Human
ggaaggcacaucauggcuugguaucuccgugcgagagcagcugcugccugguguacuccc

SEQ ID NO: 1177 - RNA, 80 nt, Human
caaaagguuuauugaaaugcauguagauaaauuaucaucagcauaaaacuguuauggaguuuucaacauggggucuuuug

SEQ ID NO: 1178 - RNA, 68 nt, Human
gaugcuuuugauaagugccaccuugguaauaaacuccauugagauggcccacgugacacuuguucauc

SEQ ID NO: 1179 - RNA, 75 nt, Human; identical to SEQ ID NO: 74

SEQ ID NO: 1180 - RNA, 87 nt, Human; identical to SEQ ID NO: 76

SEQ ID NO: 1181 - RNA, 71 nt, Human; identical to SEQ ID NO: 77

SEQ ID NO: 1182 - RNA, 120 nt, Human
aggugguguucaguugcugcucacaauaguugauaccccaggauuuggagaugcaguggauaauaguaauugcuggcagccuguuaucgacuacauugauaguaaauuugaggacuaccu

SEQ ID NO: 1183 - RNA, 90 nt, Human
ccauuggauauagaguuuaugaagcguuggcaugaaaaagugaaauaucaucccacuuauugccaaagcagacacacucgacaccagagg

SEQ ID NO: 1184 - RNA, 63 nt, Human
gucagaugccugauaacagggugcaguguuguuuauacuucauugcuccuucaggacauggac

SEQ ID NO: 1185 - RNA, 74 nt, Human
ugguagugggugaaucuggauugggaaagucgacauuaaucaacucauuauuccucacagauuuguauucucca

SEQ ID NO: 1186 - RNA, 85 nt, Human
ccagaugaagaagaucuagaacgacuucucuuucuguuccucucaggagaagaugaugaacuugaauaagaucuuuuucgugggg

SEQ ID NO: 1187 - RNA, 64 nt, Human
gcagaugaauauuaacgaaacccaaaccuuucgggugaccgugaucuuguucgucuuuuuuugc

SEQ ID NO: 1188 - RNA, 82 nt, Human
caucuguggauugugaaguuuaucuaguuguuuauaacuuuuuuuagcuaaauagaauggaaaacaucaaagugcauacgug

SEQ ID NO: 1189 - RNA, 120 nt, Human
ccggguucacaccauucuccugccucagccuccggaguagcugggacuacaggcgcccgccaccacgcccggcuauuuuguauuuuuaguagagacagggguuucaccguguuugccagg

SEQ ID NO: 1190 - RNA, 100 nt, Human
auacugaugauuuaaaaacaagcacaacaacguaaagaaucuuccucuauuucaggagaaaugauuuacugugaaguuauccuuuuaacaucuuuggugu

SEQ ID NO: 1191 - RNA, 95 nt, Human
cugggugaaccaggauggucgcuuucugucucguucaaugauccucuugcccugaucuuguucagacggugucucuccuguguacagcaccacag

SEQ ID NO: 1192 - RNA, 62 nt, Human
cagaagcaugcacaaagagauaaugugacagugcuacaauuaggucuuugucagacauucug

SEQ ID NO: 1193 - RNA, 80 nt, Human
guggcaaaaauaauauugugaaguucaauuucaacauguauguauaugaugauuuuuuucucaauuuugaauuaugcuac

SEQ ID NO: 1194 - RNA, 69 nt, Human
aaaggagggagcacgagucauggaggcgggaaguggugcaccugcagacuugcucugcuccaucacuuu

SEQ ID NO: 1195 - RNA, 65 nt, Human
gcagagaagaaagagaaaaguauucugcauaaucaauccugcagacacaauucuguauaaucugu

SEQ ID NO: 1196 - RNA, 69 nt, Human
gcuuuuuaugguuuaaaaucaauugguguauaaauuucaauuaacacccauaaagcuuagccauggggc

SEQ ID NO: 1197 - RNA, 72 nt, Human
cgcgaucagcggacccaucaaggcggaucuugaaagaaacaaggacgcucauacgauguuuccucuauggug

SEQ ID NO: 1198 - RNA, 90 nt, Human
cgcugcgguaggccguuuccgaggcagcaguugcggccgcuuuuagccccugagcggcgaucugcggacugccugcgagucucugcugug

SEQ ID NO: 1199 - RNA, 80 nt, Human
ucuucgcggaccccaacgccaagcagcgagcccugagccgacagccggaugcugccgggcacuuggcgggccucgacgga

SEQ ID NO: 1200 - RNA, 77 nt, Human
ggcagggaagaagauuccggaaugcagacucccugaaaucauguggguuuuuuuguugccgguuuuucccauaagcc

SEQ ID NO: 1201 - RNA, 78 nt, Human
ugaaaucuacauuagcagugcugugcaagauucuuacauaauucaagaccuaaaaccagccugcagugugagguuuca

SEQ ID NO: 1202 - RNA, 61 nt, Human
gcguugcugcggccgugguccgcgcccuuccucggcgggccggacuggucuccagaaaugc

SEQ ID NO: 1203 - RNA, 87 nt, Human; identical to SEQ ID NO: 76

SEQ ID NO: 1204 - RNA, 84 nt, Human
cuccuaccagaaagccauguucauauuucucagcaaugcuggagcagaaaggaucacagauguggcuuuggauuucuggaggag

SEQ ID NO: 1205 - RNA, 78 nt, Human
ggcaacgugagugccugugcgagguccaucuucauauuugaugaaauggauaagaugcaugcaggccucauagaugcc

SEQ ID NO: 1206 - RNA, 85 nt, Human
guucaccucaacuggauucggaaugugcugauuuccauuggacucaaguugaucucacuuauauucugagugccgggaggugaau

SEQ ID NO: 1207 - RNA, 77 nt, Human
ucaaggauagugaugaaggugugagacuuucgacaauaaacuuguuuaaaaguuucuguaccaauaucuuucccuga

SEQ ID NO: 1208 - RNA, 80 nt, Human
gcgggagcugggggugugccuccaggagcugcugauggcugacgggcggcccgggacugguggaucucccggcugaccgu

SEQ ID NO: 1209 - RNA, 60 nt, Human
gggccaaagagcagcaccagaacgcuguggggaagagcagcugggugcucgccagggccc

SEQ ID NO: 1210 - RNA, 68 nt, Human
ucucuggaaagaccagcguggagauugcugcgggacagugaaggacggaagcuggagaaggccagaga

SEQ ID NO: 1211 - RNA, 68 nt, Human
caaugggaagguugaugcucgaagugaccgaacuggggaggucaucuuuaaggacaauuuuucuucug

SEQ ID NO: 1212 - RNA, 98 nt, Human
ccucccagacugagcccccgaccuggcccagccuggcccguccccaauccagugggcuggccaggccaccugcaccagggaggacagcugcuggcagg

SEQ ID NO: 1213 - RNA, 65 nt, Human
uagggccagcuucaugcacuguaccuuguacagucauacaagauuucaugcucagaagugcccug

SEQ ID NO: 1214 - RNA, 68 nt, Human
uuguggacccacagugcuugaaaguucagcaagacucugaguacaagauaagcauuuuaugucuauaa

SEQ ID NO: 1215 - RNA, 95 nt, Human
uuugauuuaacacucucuuauuacugccuuaaauuuuuaaauaauuuuaccucuguguuuuaaaagugcaguaugaugggacacuuguugucaag

SEQ ID NO: 1216 - RNA, 77 nt, Human
cccagaggaugucagucccaaggaccaguagcugccaucaguuuggauucugaaaacuaacuggcaucaacacuggg

SEQ ID NO: 1217 - RNA, 75 nt, Human; identical to SEQ ID NO: 815

SEQ ID NO: 1218 - RNA, 114 nt, Human
ccccuggggaauugagcuugcgccccagguucaggcuugccgagggauaucacugccuuguucaggaagagaguccuuugcaaaaccuggggaauagcccagcuuccaaagggg

SEQ ID NO: 1219 - RNA, 64 nt, Human
gcuaccucugcugccacccucagcugccuuggggagugccucaacuuguuacagcagagugugc

SEQ ID NO: 1220 - RNA, 60 nt, Human
cugcuggcagagaugcauuccagagaugcacuccgcucuggaacucacucucagccacag

SEQ ID NO: 1221 - RNA, 64 nt, Human
ucaacauuuaccagacauccaaugacagccucaggggaaagcacccuugucuggggaguguugg

SEQ ID NO: 1222 - RNA, 74 nt, Human; identical to SEQ ID NO: 365

SEQ ID NO: 1223 - RNA, 63 nt, Human
ggaacuaaaagggauccagcuuugaauucuggugucucucaaaagccugauccugccaaaacc

SEQ ID NO: 1224 - RNA, 91 nt, Human
ugaugacuuccauauggacuuugacucagcuguggcuccucgggcaaaaucuguacggucaaagaaaccuauaaaguaccuggaagaguca

SEQ ID NO: 1225 - RNA, 78 nt, Human; identical to SEQ ID NO: 99

SEQ ID NO: 1226 - RNA, 80 nt, Human; identical to SEQ ID NO: 100

SEQ ID NO: 1227 - RNA, 78 nt, Human; identical to SEQ ID NO: 99

SEQ ID NO: 1228 - RNA, 80 nt, Human; identical to SEQ ID NO: 100

SEQ ID NO: 1229 - RNA, 97 nt, Human
agauaugauuagacuucguuaguaauguucaacuuuucacaaaagauggcugaagugccaucuuaacaaacuuacuggcagauugguuuuuauauuu

SEQ ID NO: 1230 - RNA, 69 nt, Human
auguuccauuuggcucuacacgcacaggugcgcagcacucauacgguggaacggccauauguugggcau

SEQ ID NO: 1231 - RNA, 60 nt, Human
ccacguggugaauuaauucacgguguaaagcaagcuuguaguguaugguguucaccaagg

SEQ ID NO: 1232 - RNA, 72 nt, Human
aggucaggcgugguggcgcacgccuauaaucccagcacuuugggaggcagagacggacguaucgcuugagcu

SEQ ID NO: 1233 - RNA, 68 nt, Human
gggguugagucccaauuuauccaauuaauuuggguuuaguuuugauauggauaagggagaccagcuuc

SEQ ID NO: 1234 - RNA, 78 nt, Human
uaaugcaaaauguggacuaugccagcuaugauugggaaaaauaauuuuucauacagcauuaucuauagauuuguauua

SEQ ID NO: 1235 - RNA, 72 nt, Human
cugggcauggugucuuaugccuguaaucccagcacuuugggaggcugaggcuggaggaucacaugaacccag

SEQ ID NO: 1236 - RNA, 83 nt, Human
gccaagauccauuaauuauuugggguugcaaaauggugguauucucauucugucguuugcuugccuuuauuagcuggaauggu

SEQ ID NO: 1237 - RNA, 89 nt, Human
uuaucugguuacccagugguacaguucauauaggaagggcaggauaaaugcuugauucuuugcucuuguacacuaaguuuuuaagauaa

SEQ ID NO: 1238 - RNA, 61 nt, Human
cuccaaacaagcagaaagggaagagaagcgaguccucggucuggugcugcugcgaggggag

SEQ ID NO: 1239 - RNA, 83 nt, Human
ggcccaggaucggcagggcugcuggcagaggaaucccagcugggguucccaugccaccaggcuccugcaggacuugcugggcc

SEQ ID NO: 1240 - RNA, 63 nt, Human
gguacuguugcagccgcugcagcugcugccacagcaguauugccggggcuccaacccaguacc

SEQ ID NO: 1241 - RNA, 87 nt, Human
gaggccccugggcugguggacguaccuggugggcacccugagccucaggcccugugcccugguggcagcccccagcaccaggaccuc

SEQ ID NO: 1242 - RNA, 72 nt, Human
cacccucaccaagguuaaaugccucccucucgguucauccugagaaagaugaguuaauccuuuuuggaggug

SEQ ID NO: 1243 - RNA, 104 nt, Human
ggccaccaagaccugggaacaagucaaaucaacaggcgguccuucgggucggaguggacaucggaugguggccuggaagagacaauugauccuguuugguggcu

SEQ ID NO: 1244 - RNA, 61 nt, Human
gggucuuuggaggggaguuugccucucccaacggagagcaguucuaccacuacaaggaucu

SEQ ID NO: 1245 - RNA, 65 nt, Human
ccaccaccuggagcccgaggaggugcucaaguacagcgaguucuucacgggcagcaagcuggugg

SEQ ID NO: 1246 - RNA, 84 nt, Human
gaccgaccgcggcugccccaguugaugagcggcguguccccucugcagcgcgcaccccggcggggcuuuggcugugacgcgguc

SEQ ID NO: 1247 - RNA, 77 nt, Human
uguucuuggugagaagggccggcggauucgggaacugacugcuguaguucagaagagguuuggcuuuccagagggca

SEQ ID NO: 1248 - RNA, 97 nt, Human
cuggagagcaugaucaagaagccccgccccacucgggcugaaggcagugauguggccaaugcaguccuggauggagccgacugaucaugcugucugg

SEQ ID NO: 1249 - RNA, 100 nt, Human
uguugauaugguguuugcgucauucauccgcaaggaucugauguccaugaaguuaggaagguccugggagagaagggaaagaacaucaagauuaucagca

SEQ ID NO: 1250 - RNA, 87 nt, Human
aacuuuaucuuucuacaaugaagaguggaauuucuauguuuaaggaauaagaagccacuauaucaaugguggggggguauuuaaguu

SEQ ID NO: 1251 - RNA, 77 nt, Human
gcucagagauguuggggauaaaguauacuggauuaauuuaucugguugaaauuacuauaagacgggggucucugagc

SEQ ID NO: 1252 - RNA, 66 nt, Human
uuaaguagaugggagaauauguuuaaaauauuaggaauccuagaccauauuuucaagucaucuuag

SEQ ID NO: 1253 - RNA, 65 nt, Human
uuguguuuuguuuucuuguuaucacugucacacagcuuauaacauguaugcuuuucagaauacag

SEQ ID NO: 1254 - RNA, 75 nt, Human; identical to SEQ ID NO: 74

SEQ ID NO: 1255 - RNA, 86 nt, Human
guccuugaacuuggaaccugacaauguugguguugucguuuuggaaaugauaaacuaauuaaggaaggagauauagugaagaggac

SEQ ID NO: 1256 - RNA, 71 nt, Human; identical to SEQ ID NO: 77

SEQ ID NO: 1257 - RNA, 70 nt, Human
cagaguccccuuucucagaaguacagcccuuccacagagaaaugccuggcugagauucaggggaucuuug

SEQ ID NO: 1258 - RNA, 76 nt, Human
ccaucuuucacugggaauugcgaaggggauaugccauuaugaaaacaggucccucccucauuccaaggagagaugg

SEQ ID NO: 1259 - RNA, 62 nt, Human
uccauguuccccggcgccacuacuccccuuccuaagggcgcgcuuaccccggggucuaugga

SEQ ID NO: 1260 - RNA, 82 nt, Human
agaaaggaagaggcaggcgccagggggaacccacuucguguuuugugacccucccuuuuaggugaagccccuuuuucuugcu

SEQ ID NO: 1261 - RNA, 67 nt, Human
ccuggcagacaggcgggcaaacagugagcgcccacccagaccggcugcugcgcccccuccugccagg

SEQ ID NO: 1262 - RNA, 78 nt, Human; identical to SEQ ID NO: 99

SEQ ID NO: 1263 - RNA, 65 nt, Human; identical to SEQ ID NO: 247

SEQ ID NO: 1264 - RNA, 80 nt, Human; identical to SEQ ID NO: 100

SEQ ID NO: 1265 - RNA, 86 nt, Human
ccguggcuuauggaguuaaggaaggucacgugagcaaacagaaguguuccuucugcuuuuuaccuucuuucuuucuauagcccugg

SEQ ID NO: 1266 - RNA, 70 nt, Human
ggucuggcaugaauucugccagucugaugauccacccaucauucuucaagaacagaaaacagugcuagcc

SEQ ID NO: 1267 - RNA, 63 nt, Human
ugcuuacuacaguggaugauggaauucaagcaauuguacauuguccugacacuggaaaagaca

SEQ ID NO: 1268 - RNA, 75 nt, Human; identical to SEQ ID NO: 74

SEQ ID NO: 1269 - RNA, 71 nt, Human; identical to SEQ ID NO: 77

SEQ ID NO: 1270 - RNA, 93 nt, Human
cugccacaaaaacagguaauacuuugaaaggagaugucuuggaacauuggaauguucucagauaucugguuguuaugugaucauguguggcag

SEQ ID NO: 1271 - RNA, 92 nt, Human
gacuauccaguugaugggcugccagaucuggggcaugcccaggaccucauggaugggcugccuccaggugacagcaaucagcuggccugguu

SEQ ID NO: 1272 - RNA, 82 nt, Human
cuagaugaguaacaaaaaaaugaaauaaguucuuggaaauuaagccauuuauuuuaauuugcuauuuuuuucaauguucuag

SEQ ID NO: 1273 - RNA, 83 nt, Human
uuggugaacuuuaguggacuucugugagauuguaguuguacuuuguaucucuaaaucuaaagauaguuuuuuaaaacucccaa

SEQ ID NO: 1274 - RNA, 65 nt, Human
gcuaaugucuguaaacccugcugaaucuguaacaaggccugcauugcucuaggguuugacauugc

SEQ ID NO: 1275 - RNA, 111 nt, Human
gcgcgcugcuggcucugugcggggcacuggcugccugcggguggcuccugggcgccgaagcccaggagcccggggcgcccgcggcgggcaugaggcggcgccggcggcugc

SEQ ID NO: 1276 - RNA, 60 nt, Human
ugcaugggaaugaggcuguuggacgagaacugcucauuuucuuggcccaguaccuaugca

SEQ ID NO: 1277 - RNA, 62 nt, Human
caccuuuacggccaaaccguccaccucgaccgauucuguggauauaguuuucccuguuggug

SEQ ID NO: 1278 - RNA, 73 nt, Human
caacuaauguuggaacuaugaaaagcucuucucuacuuuuaacaaagcuuagucacaaacaguuccccaguug

SEQ ID NO: 1279 - RNA, 98 nt, Human
gaaucuggggauugggagcugaugagucuuacucuguugcccaggcugcggugcaauggcgcgaucuuggcucacaguaaccuccaccucccggguuc

SEQ ID NO: 1280 - RNA, 90 nt, Human
ggauaguuugauuguagaaaucacaucccuucagucugccaaugugauaacugcccaagagaaagugaugccuacauucauagauaaucc

SEQ ID NO: 1281 - RNA, 71 nt, Human
gucaacagcagcuggaggaaaauggcaagaacuuggaaucaagauuagguuagaauaacacugcuguagac

SEQ ID NO: 1282 - RNA, 70 nt, Human
uugaaaguccgaaucugcaaguucaucucugagaaccgaauuuuacagccacuccagauuuguacuccaa

SEQ ID NO: 1283 - RNA, 61 nt, Human
cuauuauuauaaugcagauaugucagaucggaauaauuuacauuuacaaauuauaucauag

SEQ ID NO: 1284 - RNA, 91 nt, Human
uuuuuuuuuugaagcuugaaaauuuuauuuaauuguaucuuugauacauugaaagcugaguauuuuuaagacaaagguuucaggaagaaag

SEQ ID NO: 1285 - RNA, 90 nt, Human
acccgucccugauccuggccgcagcacagaugcccgcuuaccaggagcugguggaggaggcgauugccuauggccggaagcugggcgggu

SEQ ID NO: 1286 - RNA, 67 nt, Human
caccgagguccguaucugcccuguggaauucaaccccaacuucguggcgcguaugauaccuaaagug

SEQ ID NO: 1287 - RNA, 62 nt, Human
ccuuuucgggcgggauggugggccgggguccagugcuugccuaaacuccuccgcccugcagg

SEQ ID NO: 1288 - RNA, 85 nt, Human
gggauaugaggagaaugaggaguugcugaggaacaaugcaccaccugcugcuggaggugagaagcggacccaucacuugcuuccc

SEQ ID NO: 1289 - RNA, 92 nt, Human
gucucaaugccgcaggcaacuacuggucacccgggccagcugcagugucuggcugggguuaccguggccuggaguaccugcggcuccgagac

SEQ ID NO: 1290 - RNA, 61 nt, Human
cagagaauguggcuuaggcgccgguuauuauacacugcgauugguagagaccucaucuuug

SEQ ID NO: 1291 - RNA, 65 nt, Human
gaguuuguccaacgguuuucuugcuucgagcucacgaauccugcgggguuaccgcuggguggcuu

SEQ ID NO: 1292 - RNA, 70 nt, Human
agcaggcagaucaucugaggucaggaguucgagaccagccuggccaacauggugaaacccugucuuugcu

SEQ ID NO: 1293 - RNA, 102 nt, Human
ugaggcaggagaaucgcuugaacccaggaggcgaagguugcagugagccgagaucaugccuuugcccuccagccugggcaacgugagugaaacuccaucuca

SEQ ID NO: 1294 - RNA, 119 nt, Human
uuaaucgccuugcagcacaucccccuuucgccagcuggcguaauagcgaagaggccccgaccgaucgcccuucccaacaguugcgcagccugaauggcgaauggaaauguaagcguuaa

SEQ ID NO: 1295 - RNA, 119 nt, Human
ggggaugguuaaaaggggccuuuauuuuaaaauuccccccccuuuuggggaaaaaacaaauccccccggggggggggggggggucuauaaaaaaaaaaggaaauuuuguggugguuuuu

SEQ ID NO: 1296 - RNA, 75 nt, Human; identical to SEQ ID NO: 74

SEQ ID NO: 1297 - RNA, 71 nt, Human; identical to SEQ ID NO: 77

SEQ ID NO: 1298 - RNA, 67 nt, Human
ccugcaacuguacacugccucagccucccgaguagcugggacuacuggcacgugcaccaugcccagg

SEQ ID NO: 1299 - RNA, 74 nt, Human
gggcauuuagugcuauaaauuucccucuaaacacugcuucagcugugucccagagauuuugguacguugugucu

SEQ ID NO: 1300 - RNA, 82 nt, Human
auuuuucuaauauugcucaucuguguuugaaacauauacuucagaaaauguuaaggaaaaaauagaaaaggaaaagaaaaau

SEQ ID NO: 1301 - RNA, 65 nt, Human
cuuacuaaauucuaccgcuaagaagcuaugucaauuuuauacaaacuuuuuaacuaauuuaugag

SEQ ID NO: 1302 - RNA, 120 nt, Human; identical to SEQ ID NO: 1182

SEQ ID NO: 1303 - RNA, 63 nt, Human; identical to SEQ ID NO: 1184

SEQ ID NO: 1304 - RNA, 89 nt, Human
acguagacucggcguggagggugucguggacgccgccugguccgaccgcggccggguggccucagggcuccucauccaggagucugugu

SEQ ID NO: 1305 - RNA, 77 nt, Human
gaggccagagcaggguggacagguguccaggcuggugaugugcuucggaacgccauucuauccccaaacuuggucuc

SEQ ID NO: 1306 - RNA, 74 nt, Human
gccgagggcuggauggggccgugacaugggggcccggggggcugccgcaugugacccugguccagcgcuugugc

SEQ ID NO: 1307 - RNA, 84 nt, Human
caacgaaauaaaauauucucuucuccuaucuucuugacauuuugucacaucacaagaacauaacuaagagaguagcuuucguug

SEQ ID NO: 1308 - RNA, 66 nt, Human
guaguacuguaauggguuuggccaaauaucaucuuugaugaccucuccuaacucaucagcaccugc

SEQ ID NO: 1309 - RNA, 64 nt, Human
cgcuuucaucuuguaaaccugaauucuauuucgaguacuccagguuuauguuuaaaugacagug

SEQ ID NO: 1310 - RNA, 61 nt, Human
cuuuuacuuaauguguauuuugcauugugauauuuaaucaagacauuaacaugaguagaag

SEQ ID NO: 1311 - RNA, 82 nt, Human
guaagauggguaaagcaugccauuucuguuuucuugagauuuuuacuuuuuagaaacacacaugcuuccacugccaucugac

SEQ ID NO: 1312 - RNA, 80 nt, Human
auguggucaguggguugcaucuucggggagcugcugacucagaagccucuguuccccgggaagucagaaaucgaucagau

SEQ ID NO: 1313 - RNA, 75 nt, Human
ccccggucguggugacccugugguaccgcgccccagagcugcugcuuggugccaaggaauacuccacggccgugg

SEQ ID NO: 1314 - RNA, 60 nt, Human
gcugguguguaucggcccagggugacucaagacgucaaccugcugcugagccacgccggc

SEQ ID NO: 1315 - RNA, 64 nt, Human
gcccuuucaccuuauguguuuuucucuguccgaugaggagcaacggcaacaacggcgguagggc

SEQ ID NO: 1316 - RNA, 101 nt, Human
ggcagauaggaaguaugaagagguggcucguaaguuggugaucauugaaggagacuuggaacgcacagaggaacgagcugagcuggcagagucccguugcc

SEQ ID NO: 1317 - RNA, 71 nt, Human
uuaagggaaugugagcacaaugcauaaugucuuuaaaagagcaugucgugacugguacacauuucugguaa

SEQ ID NO: 1318 - RNA, 69 nt, Human
cugugcggcagggccuguuaugugucgugcugcgguucaucauggagaguggggccaaaggcugcgcag

SEQ ID NO: 1319 - RNA, 107 nt, Human
gcaguccccagcauacaggucucuuggcaguguauuccggagucugauguuggcucuaagacuuauaauuuguccaagaaaaaaaaccguuuugggggggaaaaggu

SEQ ID NO: 1320 - RNA, 63 nt, Human
gugaacguuuguggauggccugaugauccacacgcuggacauccuguuaacuacuacguugac

SEQ ID NO: 1321 - RNA, 63 nt, Human
ugcucagacagggugugcugggcaucaaggugaagaucaugcugcccugugacccaacuggua

SEQ ID NO: 1322 - RNA, 84 nt, Human
ugggaaagaaguucgaugaugaaaacuuuauccucaaagcauacggggaccaggucuacuauccaugggcaacuucuuggccca

SEQ ID NO: 1323 - RNA, 100 nt, Human; identical to SEQ ID NO: 1173

SEQ ID NO: 1324 - RNA, 64 nt, Human
uuuacuucugucucgucugccccaaccgcuagccucggcuuggguaaggcgaggcggaauuaaa

SEQ ID NO: 1325 - RNA, 75 nt, Human; identical to SEQ ID NO: 74

SEQ ID NO: 1326 - RNA, 60 nt, Human
gcugcagaaguaccgccugcggaguacugcaaagaugcuguccgugcgcguugcugcggc

SEQ ID NO: 1327 - RNA, 87 nt, Human; identical to SEQ ID NO: 76

SEQ ID NO: 1328 - RNA, 71 nt, Human; identical to SEQ ID NO: 77

SEQ ID NO: 1329 - RNA, 84 nt, Human; identical to SEQ ID NO: 286

SEQ ID NO: 1330 - RNA, 64 nt, Human; identical to SEQ ID NO: 287

SEQ ID NO: 1331 - RNA, 89 nt, Human; identical to SEQ ID NO: 288

SEQ ID NO: 1332 - RNA, 83 nt, Human
gugggagcgccggucucuauauggcggcggcucugucgggccuggcuguccggcucucgcgcucggccgccgcccgcuccuau

SEQ ID NO: 1333 - RNA, 82 nt, Human
gcagacguggauguccagcccuaugcguucacaagcaagucucuguuaguagggcacauggauuauaaguaucuacguuggc

SEQ ID NO: 1334 - RNA, 100 nt, Human; identical to SEQ ID NO: 1173

SEQ ID NO: 1335 - RNA, 70 nt, Human
ggcuuuacuucugucucgucugccccaaccgcuagccucggcuuggguaaggcgaggcggaauuaaaccc

SEQ ID NO: 1336 - RNA, 98 nt, Human
ccguagcagaaaaguauuccaauccucugccauuucuggggauuuaaucuccuugauuuugaagaaguagcccagggucaggaaagcuauggccaugg

SEQ ID NO: 1337 - RNA, 60 nt, Human
ggaguuguggugucguuugugagaugcuugaggguuucauucucugauacacacaagucc

SEQ ID NO: 1338 - RNA, 68 nt, Human
cuuuaaaccagagagugcauguuuuagcaggccacugaauuaaaauuuguggcuccuggauuucaaag

SEQ ID NO: 1339 - RNA, 79 nt, Human
ggcuugcacaggcuccacugccuguguggaguuugcucgugggugacgcugucacaggccgugaggugccuggugagcc

SEQ ID NO: 1340 - RNA, 69 nt, Human
aagguagacaagauagcucccagaaacucauccauuggaauuuucccuaggcacuugauuuugaaccuu

SEQ ID NO: 1341 - RNA, 78 nt, Human
uagccagaggauuggaggagcuuccucacauuaauuugcuguagagaaaagaauuuuuuuuccauuccuuccugguug

SEQ ID NO: 1342 - RNA, 68 nt, Human
gcaugugacugggguucuguuaaaagggcaggcuccucccuccuagcccugaagccccaggaaccugc

SEQ ID NO: 1343 - RNA, 63 nt, Human
uuuuuuuuuuuuuuuuuaaagcaaguaacuuuauuaucauuccuuuaaaaagaaccaaggaaa

SEQ ID NO: 1344 - RNA, 73 nt, Human
acuuauggucaucucucccacugaaaccaaggucuuuucaaauguggcuaaauggggaugaggagacacgggu

SEQ ID NO: 1345 - RNA, 69 nt, Human
gacuuucuuggugugugugcauucuuuaaagagccaaguugcuucggggaaacagccaggaaaaugguc

SEQ ID NO: 1346 - RNA, 64 nt, Human
uugucaaguguuuguuguagcuuaguauccauaagggaaacuuagacuauagacauaacuacaa

SEQ ID NO: 1347 - RNA, 67 nt, Human
agcccucaccgcccccaccuaccccaaccucaauggggaaggaaaggggccugagcugggcagggcu

SEQ ID NO: 1348 - RNA, 69 nt, Human
gucagccaagggaaaugguuggggauuauggcuucagcacucugccggagcacauuccugagcgcugac

SEQ ID NO: 1349 - RNA, 78 nt, Human; identical to SEQ ID NO: 99

SEQ ID NO: 1350 - RNA, 80 nt, Human; identical to SEQ ID NO: 100

SEQ ID NO: 1351 - RNA, 85 nt, Human
aauuuuccuuggacaacaccaaaaacacaguacucaaacggcauguuuuuuuuuuguuuuuuugguuucuuuuugagauggaauu

SEQ ID NO: 1352 - RNA, 73 nt, Human
cucuuguugcccaggcuggagugcaauggugcgaucuuggcucacugcaaccuccgccucccggguucaagag

SEQ ID NO: 1353 - RNA, 76 nt, Human
uuuuuuugagacggugucucacucugucgcccaggcuagagcgcaguggcaagagcgagacuccaucucaaaaaaa

SEQ ID NO: 1354 - RNA, 97 nt, Human
aguggguccuucagagcgugugggggauucucugccggcuugaugggcuagcuccucuaagccggcugcuggagacaucaccggcugagggacuccu

SEQ ID NO: 1355 - RNA, 60 nt, Human
cagcaguuuaaaaauuguccuuuuucuuaaagaggaagaaggcauuuucacacaaggcug

SEQ ID NO: 1356 - RNA, 76 nt, Human
ucagcuucagcuucagcuuggccucauucauuugaaaauaaaauguuuacaugaggccgcgccuguguccagcuga

SEQ ID NO: 1357 - RNA, 82 nt, Human
uuuuuugauauagaugaucuuacuuucuugaaagcuucuucaaaaugcuuaugacuaaccuugaguucaccuuagcaaaaga

SEQ ID NO: 1358 - RNA, 80 nt, Human
gcgccuaccucacagacggccaggagccagggagccccaggaugcuccgacugacaacccugcugcugggaccacggcgc

SEQ ID NO: 1359 - RNA, 84 nt, Human
cucgcccggggguacagucggugaaggaguccguccggggacccccugcgaagcugccucugcccacuggauuccgggucugag

SEQ ID NO: 1360 - RNA, 131 nt, Human
cuggagcgcagccuaggcuggggcugccccugcuggcguccgcgggacccagucuggcuucuguagcggggcagggcgggguccacgcagggcgcagaggcggggacgcggcccgcacggggggugcccag

SEQ ID NO: 1361 - RNA, 131 nt, Human
gcgauguuuccaucucuaaugccacucagcucaggagcaggcuucagacacugccuuuaucuuuacagaaagccaugggaagggaaaugucugagguagagcucagcguugggcaucauauggcuaaucac

SEQ ID NO: 1362 - RNA, 64 nt, Human
caguacuucaaggagaauggcuaugugaccaugucggugggaaaagucuuucacccugguacug

SEQ ID NO: 1363 - RNA, 61 nt, Human
cgcaggccaacucgaccacagaugcucugaacguucuucucaucaucguggaugaccugcg

SEQ ID NO: 1364 - RNA, 63 nt, Human
gggcuguuauggggauaagcuggugagguccccaaauauugaccaacuggcaucccacagccu

SEQ ID NO: 1365 - RNA, 94 nt, Human
ccuggccggccuccggcaguucuucaagcagcugcccagcccgcccuuccugccggccgccgggacagcagacugccgguaacgcgcggccggg

SEQ ID NO: 1366 - RNA, 63 nt, Human
gcaguuucuugggacauaggagcgcaaagaagcuacagccuggacuuaccaccacuaaacugc

SEQ ID NO: 1367 - RNA, 63 nt, Human
uuguuuuauucauaauuugucauguucugggauaccaaaaguaauaauggcugaacuuaacaa

SEQ ID NO: 1368 - RNA, 93 nt, Human
ggacauguagagugcuuuuguagugagcuaaccuugaucucuaaggacuaacuacccagguccaggucuucacuagggguacugacaguguuu

SEQ ID NO: 1369 - RNA, 87 nt, Human
uaguauuuccugaaauaacaaguuuagugcuuuaacuauggcuacaugugcuuaaggaauuugagccacuuauuuuugaagaugcug

SEQ ID NO: 1370 - RNA, 76 nt, Human
gaccuggguucuccccgagcccugaaguggaguaaagauguuuggcccaagaagggcuggggugcaaagccagguc

SEQ ID NO: 1371 - RNA, 74 nt, Human
ugaaguuaaguccguugaacgcgaaaaugacaguugaggcguuguuuucaaacuucgagcggcuuuugaauuca

SEQ ID NO: 1372 - RNA, 104 nt, Human
aguggcucuugaguuccucugcaguuucgacaauuaggauuggugucuuguaacuggacaucuucuagcauguggguuguacagaguauauucuggcugccgcu

SEQ ID NO: 1373 - RNA, 66 nt, Human
ccguacaaacugagauccuugguaccccuaaaaagauugccaauuuucuucaucuuugccauaugg

SEQ ID NO: 1374 - RNA, 63 nt, Human
gccucaaguuauuucaugcgcacagagggaagccaugugggguugcugaagaugccuugaggu

SEQ ID NO: 1375 - RNA, 64 nt, Human
ccacgccuggagcgccuucugcaaggcccuggccuaagacaggcuggcacagccccaggcuugg

SEQ ID NO: 1376 - RNA, 104 nt, Human
agcugucagaguacggcuccugggacgcuuuugcuuauuuuuuguacggcuuuuucgaguuggcuuaggcagaauucuccucugagcgauaaagacgacaugcu

SEQ ID NO: 1377 - RNA, 83 nt, Human
gccggcugccaucuaguuugacgcggauucucuugcccacaauuucgcuugggaagaccaaguccucaaggauggcaucgugc

SEQ ID NO: 1378 - RNA, 73 nt, Human
uucccacugaacuuuuucuccaauucgcguacuagccggacuuggauuuucuggaaagauuucaguugaggaa

SEQ ID NO: 1379 - RNA, 67 nt, Human
ccggcaguucuucaagcagcugcccagcccgcccuuccugccggccgccgggacagcagacugccgg

SEQ ID NO: 1380 - RNA, 63 nt, Human; identical to SEQ ID NO: 1366

SEQ ID NO: 1381 - RNA, 86 nt, Human
gcgcggccggggcgggagagacucagcaacgacccauaccucagacccgacggcccggagcggagcgcgcccugcccuggcgcagc

SEQ ID NO: 1382 - RNA, 61 nt, Human
ugaauucagugauaucccuauacacugccauuuaguggauagguuauuguacuuccauuca

SEQ ID NO: 1383 - RNA, 67 nt, Human
cucuggggacuggaaugcaggcaguggaagccccagauugacuuaaccuguugacagaucuucagag

SEQ ID NO: 1384 - RNA, 68 nt, Human
gugggaguaggggauggggagggcggggggcaggugcccucuccacucaccuucccagaaggccccac

SEQ ID NO: 1385 - RNA, 69 nt, Human
uggggcaacaucuguccuggccucagauugcccaagacaccauuugcucacggaggccaccaugcccca

SEQ ID NO: 1386 - RNA, 70 nt, Human
ccuaagucuauuuagccucacagaugacuuuagaaaucugguauuuucuacaucaggguacauagcgggg

SEQ ID NO: 1387 - RNA, 60 nt, Human
gagaaggccagguuuucuaccuaugggguuuuucuacccuagagaauacuagggcuucuu

SEQ ID NO: 1388 - RNA, 60 nt, Human
uagaauauguuucggugaugauuuggagauaaguacucaaaauuacauaguucauuucua

SEQ ID NO: 1389 - RNA, 62 nt, Human
auggagcaaugccaauaaaauuuuauaaguuaaaaaaguuacuuguuaaaggcagauuucau

SEQ ID NO: 1390 - RNA, 71 nt, Human
cagagcgagucacguacauuuaugaggcaagucagcugaaugcuugaaaucuagaugaauuugaagaucug

SEQ ID NO: 1391 - RNA, 66 nt, Human
guuguguuuacaagcauccauuuaaucaucuccaaaaaaaggauggauuuauuauuugaaacuaac

SEQ ID NO: 1392 - RNA, 76 nt, Human; identical to SEQ ID NO: 923

SEQ ID NO: 1393 - RNA, 73 nt, Human; identical to SEQ ID NO: 924

SEQ ID NO: 1394 - RNA, 88 nt, Human
aggccuucucuuuuucagaaacacgucugacuuuuuaaauucaucaaaagucccucaaagugccagggcuggagaagucccaaggccu

SEQ ID NO: 1395 - RNA, 94 nt, Human
gggucgucgccucguccagucucucuggguggccaugcuugguuuuauguaacucuggccuagggcaucccacugacucuaugaggagugaccc

SEQ ID NO: 1396 - RNA, 119 nt, Human
ucccuuuugugcuuaauuggucuuucgaaauguuuuuauuaaauucagccaguauuuauuuaauaaaugcuggcugaauuuaauaaaaacauuucaaaagaccacuaacacaaugggga

SEQ ID NO: 1397 - RNA, 94 nt, Human
ugguaacuaaguaauaucaggaaagaagaaauaaggaugcaagaugacaaacaaaaucuuuaugaaauacuuuugaucaugaacuuaucugcua

SEQ ID NO: 1398 - RNA, 80 nt, Human; identical to SEQ ID NO: 100

SEQ ID NO: 1399 - RNA, 62 nt, Human
auuugcuagaaucaagaaugauggauccauguucaguuggaguccagcuucguacuacaaau

SEQ ID NO: 1400 - RNA, 60 nt, Human
gguuuuaagacuuugcaagaauugucaucaaaugauaugcuuuuacuucaacuuagaacu

SEQ ID NO: 1401 - RNA, 61 nt, Human
caccaugucagccaggcgaacuccugaccucaggugauccgccugcucggcugccagagug

SEQ ID NO: 1402 - RNA, 102 nt, Human
ggagucucgcucuguugcccaggcuggagugcaauggcgugaucuuggcucacagcaacuuccggcuccuggguuuaagcgauuccccuuaagcgauucucc

SEQ ID NO: 1403 - RNA, 86 nt, Human
guccuugaacuuggaaccugacaauguugguguugucguguuggaaaugauaaacuaauuaaggaaggagauauagugaagaggac

SEQ ID NO: 1404 - RNA, 71 nt, Human; identical to SEQ ID NO: 77

SEQ ID NO: 1405 - RNA, 93 nt, Human
cuauuggccaaaagauccaugugcccaguggggaagagacuacgaugcagugccugaagucaccaugggguugguaggucgaugugccauuag

SEQ ID NO: 1406 - RNA, 86 nt, Human; identical to SEQ ID NO: 1403

SEQ ID NO: 1407 - RNA, 71 nt, Human; identical to SEQ ID NO: 77

SEQ ID NO: 1408 - RNA, 64 nt, Human
aggcuaaagcccggagcaggcucugccacccucuccauggcguaugccggcgcccgcuuugccu

SEQ ID NO: 1409 - RNA, 85 nt, Human
cccccccuuuuugggggaaaaaaagaaccuucccgauggccacccccccaaaacggaaaggcccuccccuucaaaaaaggggggg

SEQ ID NO: 1410 - RNA, 63 nt, Human
ggggugguggaaugguccuuccuuuaagccccggaaaagggauggacccacuuucuccacccc

SEQ ID NO: 1411 - RNA, 73 nt, Human
agccgcgugguucugggggaguuugggguucgcaauguccauacuacugacuuucccgguaacuauuccgguu

SEQ ID NO: 1412 - RNA, 69 nt, Human
guggucgucgugguuuuccuuguaguucguggucugagaccaggccucaaguggaaacggcgucaccau

SEQ ID NO: 1413 - RNA, 81 nt, Human
caccaggagccccuccggguagcuacuacccuggaccccccaauaguggagggcaguaugguagugggcuacccccuggug

SEQ ID NO: 1414 - RNA, 65 nt, Human
ggucagccaccuccaaguuccuacggugcccagcagccugggcuuuauggacaggguggcgcccc

SEQ ID NO: 1415 - RNA, 65 nt, Human
uggggguccugccccuggagggccuuauggaccaccagcugguggagggcccuauggacacccca

SEQ ID NO: 1416 - RNA, 71 nt, Human
augcuagggugagugguaggaaguuuuuucauaggagguguaugagugggucguagcggaaucggggguau

SEQ ID NO: 1417 - RNA, 67 nt, Human
cgccugagacuaguucggaccccccuucggcaaggucagaaggggguccggugggucucggcuagcg

SEQ ID NO: 1418 - RNA, 67 nt, Human
gaauucauaaaaacagggagguuaaaaguagggucugggugacaaaauauuguugguguaagaguuc

SEQ ID NO: 1419 - RNA, 72 nt, Human
ccaaaaauccaucucaucaccuagagagcauguacuggcagaacugucuaaagugacuauuuggaacucugg

SEQ ID NO: 1420 - RNA, 63 nt, Human
gcugccucucugcaaaguugaggcgguggagaacuacugaggacuucugagcagagagguggu

SEQ ID NO: 1421 - RNA, 80 nt, Human
guugacccacaagcucuaaaaaggaaaaggcuaauuuuuuugucacacagccugguucugauauggacuuggggaccagc

SEQ ID NO: 1422 - RNA, 65 nt, Human; identical to SEQ ID NO: 247

SEQ ID NO: 1423 - RNA, 68 nt, Human
ggagccaguuuggauuuuuaaccuccuuccccaccuucagaaaaacacuauucauccacacugguuuc

SEQ ID NO: 1424 - RNA, 80 nt, Human
ucuuguguggagacuucgugguggugcuaagaaaaggaagaagaagucuuacaccacucccaagaagaauaagcacaaga

SEQ ID NO: 1425 - RNA, 131 nt, Human
cgccucuucgugccagcgcuggacaaacccgagacggaccuacucagccaucuggaccggugcguggccuucaucggucaggcccgcgcugagggccgugcgguguuggugcacugucaugcaggagucag

SEQ ID NO: 1426 - RNA, 62 nt, Human
uggauaccucuagugcaauuuauaagcaauaucguuuacaaaagguuacagagaaguaucca

SEQ ID NO: 1427 - RNA, 75 nt, Human
agcuaacauacacauagugaagaaugcuuuccuuuaagacugggagcaaggcauucuuauucaacaauguuagcu

SEQ ID NO: 1428 - RNA, 63 nt, Human
ugaauuuuaucucagaaauuuuuuuacccaaaaggugcagaaaaacauaucugguaaaauuca

SEQ ID NO: 1429 - RNA, 131 nt, Human
acagaguuucaccauguuggccaggcuggucuugaacuccugaccuugugauccacccaccucggcucccagagugcugggauuacaggcaugagccaccacgcuugguaagaacaccuaaauuuuuaugu

SEQ ID NO: 1430 - RNA, 105 nt, Human
guggggacagagucucacuaugucacccaggcuggagugcaauggcaugaucucagcucacugcaaccuucgccuccuggguucaagcgauucuccugccuccgc

SEQ ID NO: 1431 - RNA, 62 nt, Human
ucaaaaucaaaucuauucagguuucuucacuguugagaacaccuaaauguuuuuauuuuuga

SEQ ID NO: 1432 - RNA, 131 nt, Human
uuuuuauguuucuuggcucaaaaaacccaguucauuuucuaauguugguccucacaagacggcuuaaugguggugagacagcacgggagaggaagaacugugguuguacuuggucaacucaggcaaagcga

SEQ ID NO: 1433 - RNA, 83 nt, Human
gagggugacaugccaugccgugccaaccauucguggucacagagucgucuggcaccgagcugaccgggcagggggcgcgccuc

SEQ ID NO: 1434 - RNA, 70 nt, Human
gaugcugcugugaacgauguggagaaaaauggcuucuagcugauaccauuccacguuaucaacaagcauu

SEQ ID NO: 1435 - RNA, 89 nt, Human
cauuaacaaaaacccgugauauugaagaacaagauguucucauauucauuugauuucaucuacuuauuuuuggugucauuuuauugaug

SEQ ID NO: 1436 - RNA, 71 nt, Human
gcccagacuuuccauuucccguaauuauuaggucagaaaaaugaaagcagcgggagggaacgcgguaaggc

SEQ ID NO: 1437 - RNA, 60 nt, Human
gugagacgguggcugccaguguugaguucgagcugacggugugccaagguccuguuuugc

SEQ ID NO: 1438 - RNA, 90 nt, Human
acccccacccuccuuccgauuucucuugaaggacaggccgcucaauuugaaaggcuucuugaaagagaauuucuucuucuucuugggggu

SEQ ID NO: 1439 - RNA, 110 nt, Human
agggccacucuccggccccgagggaguggauggcucuguagccuggggcccugccucuucuucugaggcugcacuagccucugcccccuuggccugggguuccuggcucu

SEQ ID NO: 1440 - RNA, 67 nt, Human
agguccaggcagugaccucacaaggacagcacaguuuuugcagcuuagagaucacccaccugccccu

SEQ ID NO: 1441 - RNA, 67 nt, Human
cgcugcccgcgacuccugagcacacucccauggcggguggcgugcucugggugggugugcggcagug

SEQ ID NO: 1442 - RNA, 61 nt, Human
ccuacuccucugucucaagaggaagcugauaacaaugaagauccuaguauagaggaggagg

SEQ ID NO: 1443 - RNA, 83 nt, Human
ucuucucaugcugaacaguucuccauccacagccaaagacacucuagacaauggcgauuauggagaaccagacuaugacugga

SEQ ID NO: 1444 - RNA, 68 nt, Human
cgucuacaauaaccucaacccccuuaguuacagaaaaacucugcaacaggcaguggaauggagagacg

SEQ ID NO: 1445 - RNA, 78 nt, Human
guacagagaugaggcagaguggagagaaacaacucuggcugagccagagucuccagccacuacuucuuauuccugggc

SEQ ID NO: 1446 - RNA, 68 nt, Human
gaccagacuuuuccagaagugccggacgucgggcggcgucuauaucaccuugaagaaguaugacgguc

SEQ ID NO: 1447 - RNA, 84 nt, Human
ucagcacuguggugagcuccaaggaagugaauaaguuucagauggcuuauucaaaccuccuuagagcuaacauggauggguuga

SEQ ID NO: 1448 - RNA, 66 nt, Human
caggggcgggggugggaaggcuccuuuggccuuggucccaccaaaggcuucaacccacagccccug

SEQ ID NO: 1449 - RNA, 85 nt, Human
ggggccucuauccacgaguucugcaucaaccugcggcagcucuacggggacagccgcaaguuccugcugcuuggucugaggcccu

SEQ ID NO: 1450 - RNA, 66 nt, Human
cuccccccgaggaccccgucggccggcgcauucccccccgcgacccgccgggaugccuugcuggag

SEQ ID NO: 1451 - RNA, 65 nt, Human
gagcuaacagcacgagaagccaguuggggacugcccccuccuggagcagcuccugggcugugcuc

SEQ ID NO: 1452 - RNA, 63 nt, Human
cucgauuugaagacucucccucguauguaaaaugggguaaacugagagauuaucagguccgag

SEQ ID NO: 1453 - RNA, 75 nt, Human
gcccgcagccucgaucgccagcggcgggagcaacagcagcaacaaaggcggccccgaaggcgucgcggcgcaggc

SEQ ID NO: 1454 - RNA, 63 nt, Human
gggggcaccugaaaaccuuauuaaaaaacauuccuguggccuccaaagggguuuugggucccc

SEQ ID NO: 1455 - RNA, 81 nt, Human
ugaagaaaaaaugcaaacugaccgggcaaauagauucgaguauuuauuaaagcagacagaacuuuuugcacauuucauuca

SEQ ID NO: 1456 - RNA, 64 nt, Human
agguggccgugaucgccuccauugugagcugugccaucauccugcucauguccauggccuuccu

SEQ ID NO: 1457 - RNA, 60 nt, Human
gcugaguggucuucaggguccccagugugcaaacuggugccaccacacgagaccuuuggc

SEQ ID NO: 1458 - RNA, 74 nt, Human
ucugaccagcacccacacucaggcucuggccgcaguguccugucauucgagucagguucugggggcugguuuga

SEQ ID NO: 1459 - RNA, 63 nt, Human; identical to SEQ ID NO: 123

SEQ ID NO: 1460 - RNA, 67 nt, Human
gccccuguuggaugcagugucucgggacuucgucaguguccugcacaggcgcaucaagaaggcgggc

SEQ ID NO: 1461 - RNA, 91 nt, Human; identical to SEQ ID NO: 124

SEQ ID NO: 1462 - RNA, 63 nt, Human
gccugcucaacagccucugggagugugaaaucuguucuauacguugaggcuuuauagagacgc

SEQ ID NO: 1463 - RNA, 69 nt, Human
uuggaguucuuucugauuuaugcagcugaaauaauaagagcaauaacauaagcagugagaaugagacaa

SEQ ID NO: 1464 - RNA, 64 nt, Human
ccuuuuuuuuuuaaugcuuaaaggcaauuguauucaguuccuuuccaugcagcacacaauaagg

SEQ ID NO: 1465 - RNA, 69 nt, Human
guaagugucuugcauagggguagagggaccuucuugaugaccuacagacugacuaaguagggggcguac

SEQ ID NO: 1466 - RNA, 64 nt, Human
aauguucuguguacaugucaauguagguuaggccagccaaaagacaaagcaaagcaucaacauu

SEQ ID NO: 1467 - RNA, 64 nt, Human
uuuuuuuuuuuagaagacuuuguuuauuaauaaaguaauucauuaugacuuuugaaaaaaaaag

SEQ ID NO: 1468 - RNA, 66 nt, Human
gcuuggccaaguaugcagacccuguggcugaccuccuagaccgcugggguguguuccgggcccggc

SEQ ID NO: 1469 - RNA, 128 nt, Human
guguggucguugauuuagaugaaacauuggugcacaguucguuuaagccuauuaguaaugcugauuuuauuguuccgguugaaaucgauggaacuguacaucagguguaugugcugaagcggccacau

SEQ ID NO: 1470 - RNA, 75 nt, Human
ugaguugagccuuggccagggguccggugcugucgcgggaaaccuccagccuuguucuucaaaccacucagcuca

SEQ ID NO: 1471 - RNA, 83 nt, Human
uguuuugcacugacuaguacugaauaauacaaccacucuuauuuaauguuaguauuauuuauuugacaacucagugucuaaca

SEQ ID NO: 1472 - RNA, 81 nt, Human
ccuucaaucagcaaaaauuaaaaagaaauccagagcuaucaagccaugaaggaauuuuuuuuuuuuuuuuuuuuuuggggg

SEQ ID NO: 1473 - RNA, 71 nt, Human
ggaaaaauggagaaaucaggagugaggcacuuaaaaaagauggcuaaaauuuucuggacuucaucaaagcc

SEQ ID NO: 1474 - RNA, 70 nt, Human
ucagcgaaugucaauuuauugagcauuacaccugaccaaaugucuuaauucaaccuuuacucaauccuga

SEQ ID NO: 1475 - RNA, 66 nt, Human
ucucccaaaguguugggauuacaggugugaggcacugcaccuggccuaauccacaaacugucuaga

SEQ ID NO: 1476 - RNA, 98 nt, Human
ucugaguguaaaaauaaaucucuuuguggcaugauucuauuacagaucacugguaugccugauuaaaguggacuacaauaaagauuacauacaccaga

SEQ ID NO: 1477 - RNA, 66 nt, Human
uggagacgaguucuuacuauguugcccaggcaagucucaaacuccuggguucaagcgacucuccca

SEQ ID NO: 1478 - RNA, 70 nt, Human
gucgcccaggccggagugcaguggugcgaucucagaucaguguaccauuugccucucgggcucaagcgau

SEQ ID NO: 1479 - RNA, 94 nt, Human
gggaguauaugcuaucaacaugacuugaugauauuaacuuugaccaccuggccaagacaguguuuccagguuucuguacuaugaaguuacucuc

SEQ ID NO: 1480 - RNA, 70 nt, Human
uccucccuuuccauacucuguucuuuggaaguuagucacuaaguccagcccacacucaaggaaggaggga

SEQ ID NO: 1481 - RNA, 74 nt, Human
ugugauuaaauugaggaacuugaguaggaagaauauccuggauuaucucagcaggcccaauauaauuaauuaca

SEQ ID NO: 1482 - RNA, 93 nt, Human
gcgucggggugcuggcagagaccgcggcgagggccggagcaggugcacuggccgcugcacacucgccgcuaggcucccggacaccgcuggcgc

SEQ ID NO: 1483 - RNA, 87 nt, Human
gggacugcagggacugcggcugggacaggcugcugcgccaggcggcccuggaccgccgcuucugccccuaagccgcccucgcagccc

SEQ ID NO: 1484 - RNA, 63 nt, Human
aaggauggggagcaagcuccagcucuguaacacaugguggaacuucuuuuagccccagaccuu

SEQ ID NO: 1485 - RNA, 84 nt, Human
agaaucgcuugaacccaggaggcugagguugcagugagccaagauugugccacuguacuccagcccgggugacagagugagacu

SEQ ID NO: 1486 - RNA, 81 nt, Human
cucuguaaagcgggcugaugacuguaccugccucacagauagcugggauggugcaugucaugugcucagcugggaacagug

SEQ ID NO: 1487 - RNA, 65 nt, Human
agaugggcuggguagagagcaggacuggagcuuccucaccaggguucugccucuggccccgaucu

SEQ ID NO: 1488 - RNA, 69 nt, Human
cuccauuggcucuuggugcccaccagccccuguuagaggaggcccagaggcucaagaggcaccauggag

SEQ ID NO: 1489 - RNA, 65 nt, Human
ugccuggcaccccagucugcacagccccgcacgcccugggggaguguaggauggggguggaggca

SEQ ID NO: 1490 - RNA, 112 nt, Human
ugggcggauggauucuacaagggcaagguggcuauucccaguguggggugguuuuccaacccaaaagcgccccagauguggggaacagcgaucgguggggaggagacggcca

SEQ ID NO: 1491 - RNA, 60 nt, Human
auguuuugaaugcauuacauuaccaaaaaaauuaauauugaaaugcaaaagucaaaauau

SEQ ID NO: 1492 - RNA, 71 nt, Human
cacggccauuugcucuuuuccuagacuagcuauggcugggccuggucaagcuuugggaggcugaggcugug

SEQ ID NO: 1493 - RNA, 80 nt, Human
gguaauuguagacuccaagcucaggauuacuacucccaaguaaugugaaucaagcauucugaguccaugaggucaauucc

SEQ ID NO: 1494 - RNA, 67 nt, Human
uaagaaucugucaugcagaggcuccaggggcaauuugcacuuggaaaaucucgcagacuaguacuua

SEQ ID NO: 1495 - RNA, 80 nt, Human; identical to SEQ ID NO: 1493

SEQ ID NO: 1496 - RNA, 67 nt, Human; identical to SEQ ID NO: 1494

SEQ ID NO: 1497 - RNA, 82 nt, Human
gaauaauuugcaguguuccacaaguccuuccugaucaaaguucuucucaggacaguaaggacaaggaaagguguaacgguuu

SEQ ID NO: 1498 - RNA, 75 nt, Human
guggugcugucugaaguuggcgcugcgguaguuggggucuccccagggcaucgaggcacauaucggacaaaccac

SEQ ID NO: 1499 - RNA, 90 nt, Human
aaauuuuugggggagcgggggaaggaguuaaugaaacuguauugcacaaugcucugaucaauccuucuuuuucucuuuugcccacaauuu

SEQ ID NO: 1500 - RNA, 88 nt, Human
agauuuuucaauuuuuauuuugguuuucuuacaaagguugacauuuuccauaacagguguaagaguguugaaaaaaaaauucaaauuu

SEQ ID NO: 1501 - RNA, 90 nt, Human
ggauucagcuuucaguuaaaaaagaagaagaagaaauggcaaagagaaaguuuuuucaaauuucuuucuuuuuuaauuuagauugaguuc

SEQ ID NO: 1502 - RNA, 61 nt, Human
cugcauagauuuuaaugagagcgucaggcagagcugugcuguugcucuccgggacuugcag

SEQ ID NO: 1503 - RNA, 63 nt, Human
guaggaugagaacauagcacaucgaaacccuaggaggucacugagcuaaugaucuaauccuac

SEQ ID NO: 1504 - RNA, 71 nt, Human
cccgggugcccgagggggcuuuggcccuguuugaauuuuugggaaaaggaaaccccuuuaggggcuccggg

SEQ ID NO: 1505 - RNA, 65 nt, Human
gagaaacagcagcugcgccugaaacucgccacuggccguacuuuuuaucugcaguugugucccuc

SEQ ID NO: 1506 - RNA, 75 nt, Human
gggagaggugauugauguacacaaccguguccgaauggugacagugggcaucgucugcaccagccccauccuccc

SEQ ID NO: 1507 - RNA, 66 nt, Human
guggagcugucuuaaacgaagagaaccaugagcaaugaaucuuguuuaccuuauuacacagcccac

SEQ ID NO: 1508 - RNA, 78 nt, Human
guggcugcagagcuccacagagaaggggaucagagugagacugggcucuacaagccuuugugauguaucugcagccac

SEQ ID NO: 1509 - RNA, 89 nt, Human
gauccucauguucacuacccuucaugcaugaaagacaaagcuacucagacaccuagcuguugggcagaagagggugcagaaaagagguc

SEQ ID NO: 1510 - RNA, 73 nt, Human
gcguucugcgucaugggggagugcugaucaacuaaaagagcagaucgccaaacugaggcagcaacuacaacgc

SEQ ID NO: 1511 - RNA, 82 nt, Human
uggcaaccauauaacaaucagucacacucaggcuacuggaucaaggucaguuccuaugccacugucaaauauaucagugcca

SEQ ID NO: 1512 - RNA, 71 nt, Human
auccuauagauacagcccugguaugaggccuuauaaugccagcuauaugcacaugcccuguauaaugggau

SEQ ID NO: 1513 - RNA, 60 nt, Human
uagcugaguacauguuggaugcugcuaggaauuugcaacccaauuuauauguaguagcug

SEQ ID NO: 1514 - RNA, 82 nt, Human
uugucuucuguagacuagacugggcauuaguuccuuaauaagagaggcaaugagugcaauauaauagucaugaagagggcag

SEQ ID NO: 1515 - RNA, 62 nt, Human; identical to SEQ ID NO: 966

SEQ ID NO: 1516 - RNA, 82 nt, Human; identical to SEQ ID NO: 968

SEQ ID NO: 1517 - RNA, 63 nt, Human; identical to SEQ ID NO: 970

SEQ ID NO: 1518 - RNA, 65 nt, Human
cggcugcagaaguaccgccugcggaguaacugcaaagaugcuguccgugcgcguugcugcggccg

SEQ ID NO: 1519 - RNA, 75 nt, Human; identical to SEQ ID NO: 74

SEQ ID NO: 1520 - RNA, 87 nt, Human; identical to SEQ ID NO: 76

SEQ ID NO: 1521 - RNA, 71 nt, Human; identical to SEQ ID NO: 77

SEQ ID NO: 1522 - RNA, 87 nt, Human
uagcuggcaugggacugguagugcaggcuggcucuuggaaaggaguauguauuccaggcugguuggcugcuguuccacugggagcug

SEQ ID NO: 1523 - RNA, 82 nt, Human
aucuggagaugcaaguuaaccgaaggugcucugccaagccaucagcgugagaaaaaaaaaccaccagaaguugccuccagau

SEQ ID NO: 1524 - RNA, 73 nt, Human
auucuauaaugaagauguuucaugaacuggggcacguauuugucaagaaacuucuuaucuucaugaacugaau

SEQ ID NO: 1525 - RNA, 74 nt, Human
agcagaacugcaacacaauuuaaaugucuguaaauuaggucacaaaagggaugcaaaauguuugcaguuugacu

SEQ ID NO: 1526 - RNA, 66 nt, Human
uaagauuuuagcaauacuuccaauauugauuuccuuaccaaauggaaucuagaagcuaaauuuuua

SEQ ID NO: 1527 - RNA, 64 nt, Human
uuguuaaaggaugacuaaaacucuucaaacccaguagcaggguuuacagaaaauucuagaacaa

SEQ ID NO: 1528 - RNA, 70 nt, Human
cuugaguccagaaaguggcaguugcagugaguggagaucgcgccacugcucuccagccuggguggcagag

SEQ ID NO: 1529 - RNA, 64 nt, Human
ugaucguaucuucaccaccaccgccuucagggaaccauuaauucugaagaugaagaacuagaca

SEQ ID NO: 1530 - RNA, 101 nt, Human
agggguuaaaggaguaaaggggaggaagagaaggauucauuucaugccuaccuguacagagacacuuucuugcuuucuacuuuuuuuuuuuuuuuuuuuuu

SEQ ID NO: 1531 - RNA, 96 nt, Human
guuuauuucuggaauuuucuguuuaauauuuugggaccucaguugaccaugaguaacacaaaccacagaaugcgaaacaguggauaagagagggac

SEQ ID NO: 1532 - RNA, 91 nt, Human
uguacauacuuucgccuaaaacaguucuguauauucuuuuguuaacgggguagcaaaagcauauaaaaagguuuuggggggaugcagugca

SEQ ID NO: 1533 - RNA, 77 nt, Human
gcuaccguguaugaggaacuuugauccuugcgggcaccauuccggaaguagaauuuagaggaagaaaauaccggagu

SEQ ID NO: 1534 - RNA, 90 nt, Human
gagaaggggaaguagaaacagcuggcgcccugccauggccugugaaccacagguggacccgggggccacuggcccauugccccccuccuc

SEQ ID NO: 1535 - RNA, 86 nt, Human
ggauguagucguucaacuaacggugacuuuuacaaaugagacggaaaaucauguaaacuguauccuuuaguuuuaucgcuguaucu

SEQ ID NO: 1536 - RNA, 90 nt, Human
ggcagcuccauccugccccaggcgaggcuacacucccagcgcaccuggaaagcgcuggacagcuucucccuggggcuggccagggcagcc

SEQ ID NO: 1537 - RNA, 120 nt, Human; identical to SEQ ID NO: 1182

SEQ ID NO: 1538 - RNA, 76 nt, Human
ugaggagaggagcgucaacagcagcaccaugguagcuaagaaccuugaaggcuaugugggauuugccaaucuccca

SEQ ID NO: 1539 - RNA, 73 nt, Human
ugguagugggugaaucuggaugggaaagucgacauuaaucaacucauuauuccucacagauuuguauucucca

SEQ ID NO: 1540 - RNA, 61 nt, Human
auagccuccuugggugucauggaucccagaccgauuaucauguaguaccggaggagacuau

SEQ ID NO: 1541 - RNA, 75 nt, Human; identical to SEQ ID NO: 74

SEQ ID NO: 1542 - RNA, 71 nt, Human; identical to SEQ ID NO: 77

SEQ ID NO: 1543 - RNA, 71 nt, Human
cucuacgguucuccaugcccccuccaguuugggggucuaaaccaaacaggagaggugcaggggaccaggag

SEQ ID NO: 1544 - RNA, 60 nt, Human
gggccagagaaagcacaaacauggauccagaaguccaaagaaaugcaguucguugcgccc

SEQ ID NO: 1545 - RNA, 66 nt, Human
cagcacuacagaaaaaauucaaacagguccccgaggcguuuugaaauucaucccaacuguaggcug

SEQ ID NO: 1546 - RNA, 61 nt, Human
ccagggcaggggaguaggggcuuagguguuuuaaaaacaccucuggcuuuucugauguugg

SEQ ID NO: 1547 - RNA, 70 nt, Human
gcauugugaguaaaucagauguugaauucuuuugccaagggaauuauagcugcagguucucucucacugc

SEQ ID NO: 1548 - RNA, 65 nt, Human
cucucaaccuugaaguccccacguaugaguucaccagugacgauauggugauuguugguuaagag

SEQ ID NO: 1549 - RNA, 71 nt, Human
gaauugaugauguauuugcaaacauuaaugugaaauaaauugaauuuaauguugaauacuuucaggcauuc

SEQ ID NO: 1550 - RNA, 73 nt, Human
ucaagucauaggcuucuuucagucuuuaugucaccucaggagacuuauuugagaggaagccuucuguacuuga

SEQ ID NO: 1551 - RNA, 60 nt, Human
ggugacaacaugcuggagccaagugcuaacaugccuugguucaagggauggaaagucacc

SEQ ID NO: 1552 - RNA, 92 nt, Human
auugugggaagauuaucucgauccuauuaugaacaguuuugcagauguuggaaacugaaacuaagagauaucgauugacuuaacccaacaau

SEQ ID NO: 1553 - RNA, 63 nt, Human
cucgucgaucucguucuccaugucuuccgugugcuggauacacuggcagagcucacagaugag

SEQ ID NO: 1554 - RNA, 65 nt, Human
gcugggcucaguagaagcagacggugugcagaaaggugcggccacucuucuccucgaacuccugc

SEQ ID NO: 1555 - RNA, 76 nt, Human
cgucuauaagccguuaccgcagacccgaacuaucacaauccuggguugucgaucugcguggcuggacuuauugaug

SEQ ID NO: 1556 - RNA, 60 nt, Human
uacagacuguaucgacaauaaugguuaugcuugaguaugcaugaucaugugucaucugua

SEQ ID NO: 1557 - RNA, 68 nt, Human
cuggaacagcccauuuuaucuuugaauggucuucugccagcccauuuugaggccagaggugcugucag

SEQ ID NO: 1558 - RNA, 78 nt, Human
gggugcgacugggcgugcucggagcucgcagacgcucggaggcauggcggcugcggagccggcgguccuugcgcuccc

SEQ ID NO: 1559 - RNA, 67 nt, Human; identical to SEQ ID NO: 1379

SEQ ID NO: 1560 - RNA, 61 nt, Human
gcaaguaguuauacucaggaagaacuucgacacuuacggguuucuucuguuugauacuggc

SEQ ID NO: 1561 - RNA, 62 nt, Human; identical to SEQ ID NO: 206

SEQ ID NO: 1562 - RNA, 93 nt, Human; identical to SEQ ID NO: 207

SEQ ID NO: 1563 - RNA, 71 nt, Human
agggccggggccggggacgccagcggcacgcggaagaagaagggcccggggccccuggccacggcguaccu

SEQ ID NO: 1564 - RNA, 79 nt, Human
gccuuauuggaggaauuguuccaucuucuguuguccugacuucuuuccaggugaugucaagaguuuuucuaauaugggc

SEQ ID NO: 1565 - RNA, 89 nt, Human
aaaauguuuuuggcuuugguuuuucuggggacugauaagugcuuuaagcaauguccauaccccgucaagacucccagcuuagucauuuu

SEQ ID NO: 1566 - RNA, 77 nt, Human
gauucucuuuucucuccccacccccugcccuuuguuaccaacaccaguuucccaggggguacaugaguuucugaauu

SEQ ID NO: 1567 - RNA, 83 nt, Human
gggcugcaaagcgagaagagagccgguggaguguacuugucccugacaggcugaccuaccugagucucugagcuuuucagucc

SEQ ID NO: 1568 - RNA, 60 nt, Human
aaugaguuucuuacucgggagcuggcugaagauggcuacucuggaguugaggugcgaguu

SEQ ID NO: 1569 - RNA, 68 nt, Human
cggcggcaagauggcagugcaaauauccaagaagaggaaguuugucgcugauggcaucuucaaagcug

SEQ ID NO: 1570 - RNA, 71 nt, Human; identical to SEQ ID NO: 1145

SEQ ID NO: 1571 - RNA, 67 nt, Human; identical to SEQ ID NO: 1146

SEQ ID NO: 1572 - RNA, 63 nt, Human
cagauuuguaugguuccaaagacacuuuugaugacgauucuuaacaauaacgauacaaauuug

SEQ ID NO: 1573 - RNA, 84 nt, Human
cucuggaguugggcuagaggccagacuucuuuugaaagguaccuccugggcuugaaggucuucuuccuggcucucuuuccugag

SEQ ID NO: 1574 - RNA, 106 nt, Human
gauucaucauuggacccccagaccucucacccaggaccccaagugugcaccuuugaagccauugucuucacuccugacugauagaucggggauccaauggugaguc

SEQ ID NO: 1575 - RNA, 71 nt, Human
ucaaugaucauguguuuuguccuccuaaacaguauaccaaaguuuguuuuuauaguugaggauuguauuga

SEQ ID NO: 1576 - RNA, 94 nt, Human
aaaggagauuaacguuauugauacuuggauaacuggcuaaucauauuaaaggacuaugugguuccagcucaacuuuuaauauauugucuccuuu

SEQ ID NO: 1577 - RNA, 67 nt, Human
gucagguuaauacuaucuuaaacacugagucagaaaaucauuacuguauagaaguugcuuuccugau

SEQ ID NO: 1578 - RNA, 71 nt, Human
ugaaauauauaugaugaaaagaauugagaaguucuaaauuaagacauuucaguuaagcucauaaaauuuca

SEQ ID NO: 1579 - RNA, 105 nt, Human
augguguuuugugacuuagaaguuuuaaguagucguucuuauaucuaagcauuuauuaauuuugguaagaacauuacuauacguuucugaugucacuuuuacugu

SEQ ID NO: 1580 - RNA, 61 nt, Human
gcuuuucaugugcauaaguugacucauuuguuuccuguuagcauuugaaacaccauauagc

SEQ ID NO: 1581 - RNA, 60 nt, Human
guacuuguauuuccugauuaaaacaaaguaacgucuguuuuacuauugaaguaagaguac

SEQ ID NO: 1582 - RNA, 72 nt, Human
uuugugugaaucagaccaucuaaauauaauauaaauuagagacugguacuuguauuuccugauuaaaacaaa

SEQ ID NO: 1583 - RNA, 81 nt, Human
gccaagugagucaaagugaugggccccugggcucauugggauguagacgcucugggaauuaucaccugcucguuccauggc

SEQ ID NO: 1584 - RNA, 77 nt, Human
guauauaggcugagcaagagguggugagguugaucggggguggcuggaucucacuuccucugcuggggccucggugc

SEQ ID NO: 1585 - RNA, 85 nt, Human
acuuguuuauacccucagacuuuuuuaauguuagguauuuguagcauuaggccaacauguauuaagcugagccagaugaauaagu

SEQ ID NO: 1586 - RNA, 68 nt, Human
gagaugaacuauguggucgggggcguggucucccaccgaaauguugucaacguccacaucuucgucuc

SEQ ID NO: 1587 - RNA, 77 nt, Human
guuacauggacggcaugaccgugggugucgugcgccaggugcggccaucgugggcccauuucaugccguccugaagc

SEQ ID NO: 1588 - RNA, 68 nt, Human
cccaauagcaggcgcacagggucucacuuaacauguacucugugccaagcacucugcuauuauauggg

SEQ ID NO: 1589 - RNA, 82 nt, Human
guaaacauuuugauguauacaauauggcuauauuauauuuuguuuuauaaaaucaagucauuguauauauuaugaugcaugc

SEQ ID NO: 1590 - RNA, 67 nt, Human
uccugaucagcuuuuaauaucugucacauaaaaauugaaauugaagaugguauauaagauuucagga

SEQ ID NO: 1591 - RNA, 74 nt, Human
acaggugcuuugacaguuuugaugaaagaugcaauaaaaccaaaccugaugcagacccuggaagggacaccugu

SEQ ID NO: 1592 - RNA, 67 nt, Human
agggccauuaccggcaggcgcaguuugacaucgcaguggccagcgagaucauggcggugcuggcccu

SEQ ID NO: 1593 - RNA, 93 nt, Human
cuuauuuuuucacaagccugguuauuugaggaugugcuuguaacguaugcuuucucuucuauuucucauagccaaugcuuguaccugaauagg

SEQ ID NO: 1594 - RNA, 94 nt, Human
ggaaggauuggagagccacuugaggucauauguuaagguauguaaaacacacuguucugaucacuuacaucuguggcucuccaguuuuccuucu

SEQ ID NO: 1595 - RNA, 64 nt, Human
gugcugauagcaucaucauuguucuacuacugcugugauaauaaugaaauguuuccauuuuuac

SEQ ID NO: 1596 - RNA, 63 nt, Human
aagagaaagcauacguuacaagcacauccucaaauaaccaggcuugugaaaaaauaaguccuu

SEQ ID NO: 1597 - RNA, 122 nt, Human
auagcuagccagaacaacuuaaaauucuucuuuaaacuuccacauugagucauauuauuuggaaaacccauuaaaagaaacauaauugaaggaauggaauuaaguaauuagugaauggcugu

SEQ ID NO: 1598 - RNA, 92 nt, Human
gaaggaaaacuggagagccacagauguaagugaucagaacaguguguuuuacauaccuuaacauaugaccucgaguggcucuccaauccuuc

SEQ ID NO: 1599 - RNA, 72 nt, Human
aggacacccagacugugucuaagggccaauucuuaacuccuaaggcuuguuugcauaacuaauggguguccu

SEQ ID NO: 1600 - RNA, 82 nt, Human
aguuauucauguacauuaugguaauuacacgaaggcuuuuaaaagcuuuaauucuugguaugaguugacaaaaagaauaauu

SEQ ID NO: 1601 - RNA, 65 nt, Human
agagaaaaaguaaccaagaaaauuaaaauauuuccccuugaagguuuuggaguauucuauucucu

SEQ ID NO: 1602 - RNA, 74 nt, Human
uugugacaggauccguuuucccaacucgaucaaaaacaauauugaugguagccaugaaaauuuuccaaacacag

SEQ ID NO: 1603 - RNA, 73 nt, Human
aaugacuaaaaagacuuauguggaaucuauacuugaagguauaaaacaguccaaacaagaaaacuuggacauu

SEQ ID NO: 1604 - RNA, 94 nt, Human; identical to SEQ ID NO: 1594

SEQ ID NO: 1605 - RNA, 70 nt, Human
uacuacugcugugauaauaaugaaauguuuccauuuuuacauauucuuugcuuuauucacuccuguggug

SEQ ID NO: 1606 - RNA, 70 nt, Human; identical to SEQ ID NO: 1605

SEQ ID NO: 1607 - RNA, 80 nt, Human
cuaguuuuauuaacuagacuuauaagaaggucuucguauacuaagcguaaccuuuuaucacacucacauaauaaaacuag

SEQ ID NO: 1608 - RNA, 67 nt, Human
guccaagcaacugggcugagguaaauggaccgguucuggguuccugacuucaguauaguaugugggc

SEQ ID NO: 1609 - RNA, 67 nt, Human
guugaaaaguacacaaacaagguauacaugguuaaauauuacacaaaaguaucccuuuacuuuucac

SEQ ID NO: 1610 - RNA, 71 nt, Human
uuacacauaaagaaaugacaaccucuggggcuugaaaaagccuccagacaaaguuaacuccuauguuguag

SEQ ID NO: 1611 - RNA, 63 nt, Human; identical to SEQ ID NO: 1596

SEQ ID NO: 1612 - RNA, 94 nt, Human; identical to SEQ ID NO: 1594

SEQ ID NO: 1613 - RNA, 64 nt, Human; identical to SEQ ID NO: 1595

SEQ ID NO: 1614 - RNA, 75 nt, Human
acuccugccucugggaucucuccagauauggucgcugcucaauggagagcuaccgggagaaccuggagcgggugu

SEQ ID NO: 1615 - RNA, 85 nt, Human
ugguggcugggggccagcugggcgagcugcacaacgggacacaguaucgugagguccgccaguucugcucgggcucuggccacca

SEQ ID NO: 1616 - RNA, 67 nt, Human
ugugcgcuucuacuuccucacucguguuuacuccgaguaccuugaggauguucuggaagagcugaca

SEQ ID NO: 1617 - RNA, 75 nt, Human; identical to SEQ ID NO: 74

SEQ ID NO: 1618 - RNA, 87 nt, Human; identical to SEQ ID NO: 76

SEQ ID NO: 1619 - RNA, 71 nt, Human; identical to SEQ ID NO: 77

SEQ ID NO: 1620 - RNA, 68 nt, Human
gcgcuggccgccgccgccuccuccaaagggggccggguccuggaggugggcuuuggcauggccaucgc

SEQ ID NO: 1621 - RNA, 85 nt, Human
aggugaaaucaaaauaaucuauacuaucuagaagacuuucuugaugcgcaguccagagaugucaugguguagaacuugaacaccu

SEQ ID NO: 1622 - RNA, 62 nt, Human
ucacucuugugcaggcgauguuucaauguuucauggggcaagaguuuaucucuggagaguga

SEQ ID NO: 1623 - RNA, 66 nt, Human
ucagagacugugugcuaaauauuaggcuacugugaucuuaggccaccugaggcacauacuaucuga

SEQ ID NO: 1624 - RNA, 89 nt, Human
ugagcucucauuuuuucaccuugacuggccaucuaacuuaaacaauuaauaaguguaauuuccaagcaggccuggaagacugggguuua

SEQ ID NO: 1625 - RNA, 63 nt, Human
uggacacauacuaaagcgccaaaagaccuuuaacauuuucugagagccaccgaguauuugcca

SEQ ID NO: 1626 - RNA, 92 nt, Human
gaugcuuuggaagacucauuauucagagcugcagcuggacugccuuagacaucugcauuucucuaucucugaaauaagggacuccgagcauc

SEQ ID NO: 1627 - RNA, 82 nt, Human
cacuuuucuggcagugaggaaaauauggaaaggaagugggaagaaguaaaugcugguggcugugacacucuccagggaagug

SEQ ID NO: 1628 - RNA, 124 nt, Human
guggagguggugauaugggauaggagguuucucauauacucuggagaagagaggcuaugugaaggcugggcucuggacuucagaggcggugauagaacacccagacgcaggucggcaacucuac

SEQ ID NO: 1629 - RNA, 66 nt, Human
guggcugugaaagaggaugcuuugguagcaagggggaucugucagacauuaauauucacauaccac

SEQ ID NO: 1630 - RNA, 75 nt, Human; identical to SEQ ID NO: 74

SEQ ID NO: 1631 - RNA, 60 nt, Human
acccagaccugucgcugagccucucuaccccaggucagacggacaggacagaucacaggu

SEQ ID NO: 1632 - RNA, 61 nt, Human
cuggaagauucaggagccugggcgggcuucgcuuacucucaccugcuucugaguugcccag

SEQ ID NO: 1633 - RNA, 64 nt, Human
gucccggcgaagagaagagacacauuguuggaaggcagcccaugacagcuucccuuccugggac

SEQ ID NO: 1634 - RNA, 66 nt, Human
gaucauacaauucagaacuuuaucuaaagacuguucucacaaauuaagauauucuaaaguaugauu

SEQ ID NO: 1635 - RNA, 70 nt, Human
ugggaugcuccauuugugaaauacuaugauuaaacauuuccaaguaauuuugcaaaaaaaaaagcaccca

SEQ ID NO: 1636 - RNA, 78 nt, Human
uucagcacauucuugugggcuucaaguugcaaguuuguuaauaauaauagcuauuccuuaaaaguuucaagagcugaa

SEQ ID NO: 1637 - RNA, 109 nt, Human; identical to SEQ ID NO: 831

SEQ ID NO: 1638 - RNA, 87 nt, Human; identical to SEQ ID NO: 76

SEQ ID NO: 1639 - RNA, 71 nt, Human; identical to SEQ ID NO: 77

SEQ ID NO: 1640 - RNA, 62 nt, Human
gaagggcucaauaaaguuuguguuuugccaaaaaaaaaaauacaaaaaaacccgggccuuuu

SEQ ID NO: 1641 - RNA, 74 nt, Human
cuucuccucagcuggagcagcagcaguggagggggcaggaccuccugcuggugcagcaccagcugcuggagcag

SEQ ID NO: 1642 - RNA, 64 nt, Human
gcauugaucuuauccuccgugacugucaccucaucgucgugcagaaugagggccgaguagaugc

SEQ ID NO: 1643 - RNA, 82 nt, Human
ggcuagguacgacgcuggguguggaaucggccgaggggaggucguuggagucacuuccgcgucaccagcuccugugccugcc

SEQ ID NO: 1644 - RNA, 70 nt, Human
uucugugguuaaaaauuugauugugcuuauuaaaaauggucaucuauguuuugcacuucagcuacgugaa

SEQ ID NO: 1645 - RNA, 70 nt, Human
uuuauuugaguucaaauauuuuugaaauauaaaaauugguuguauuuuuuaaagcuauaauucuuguaga

SEQ ID NO: 1646 - RNA, 85 nt, Human
ggaagagggugagcaugauugccuccugccuuggcuaacugugcccugcaugaauuggcuccugauuuucuugcccuccaguucc

SEQ ID NO: 1647 - RNA, 97 nt, Human
ggcucuuggcucugcucucuccucccucucaucuucugcccuccccucugcuauguggggaacaugaagaugaagggccuccugagugaguccggcu

SEQ ID NO: 1648 - RNA, 85 nt, Human
cugucagagaaaucugaguggaugacaaaaccugcaaucacgcacuuuaugcuauugugauguuuuuaaccagauuuuaugacag

SEQ ID NO: 1649 - RNA, 61 nt, Human
gaucaugaagagcuauggccacaccuuugaaaagcacugguggcaggaccuguucagaauc

SEQ ID NO: 1650 - RNA, 64 nt, Human
aacaaucaguuauaauguucuuuuuaagguuacuauaccuuuauuucaaauuauauuacauguu

SEQ ID NO: 1651 - RNA, 62 nt, Human
gucuucccauaaaaaauguggcuacauuuuccccccaaugacuacauacauagauggguagc

SEQ ID NO: 1652 - RNA, 116 nt, Human
ugaacuuuuaaaugacaaacuuuuggcucauaagaauggcaccuucaaaaggggcgauuuccacucagucucugguggcauuauuccaggcuaguuucaccaguuaaaaaccuuca

SEQ ID NO: 1653 - RNA, 75 nt, Human; identical to SEQ ID NO: 74

SEQ ID NO: 1654 - RNA, 61 nt, Human; identical to SEQ ID NO: 1202

SEQ ID NO: 1655 - RNA, 130 nt, Human
ucugaaagcccccgguaucauuccucgaauuucagugcgggaaccaaugcagacuggcauuaaggcuguggauagcuuggugccaaucggucguggucagcgugaaacugauuauggguggaccgacaga

SEQ ID NO: 1656 - RNA, 71 nt, Human; identical to SEQ ID NO: 77

SEQ ID NO: 1657 - RNA, 63 nt, Human
uaggagugucggguguuaaaaaacuagagcuuauuccuauuccaaaucuaucuugcgcuccug

SEQ ID NO: 1658 - RNA, 75 nt, Human
uuuuuuuuuuugaguuuuuccaaagauuuauugaagcaaaaccaaguugguuggauacuugcuggaaaaaaaaaa

SEQ ID NO: 1659 - RNA, 75 nt, Human; identical to SEQ ID NO: 74

SEQ ID NO: 1660 - RNA, 67 nt, Human
gcgucgcgguuuuguuggcuugggcaacagggaucccuggggcacuggggaaaaacuaaauggaugc

SEQ ID NO: 1661 - RNA, 60 nt, Human
agaaagaagaaggugguucauagaacagccacagccagaugaccacaaaacuucaguucu

SEQ ID NO: 1662 - RNA, 75 nt, Human
caggccaugcugagacaaagcagcugacagaaaugcuacccagcaucuuaaaccagcuuggugcggcauagucug

SEQ ID NO: 1663 - RNA, 87 nt, Human
gaugcuguccgugcgcguugcugcggccgugguccgcgcccuuccucggcgggccggacuggucuccagaaaugcuuuggguucauc

SEQ ID NO: 1664 - RNA, 88 nt, Human
ugggacugcugagauguccucuauucuugaagagcguauucuuggagcugauaccucuguugaucuugaagaaacugggcgugucuua

SEQ ID NO: 1665 - RNA, 81 nt, Human
acgagugugugugugcagauggggcuggauuugucugugugugaccuugagucuacgucuugugugugugaccaggcgcgu

SEQ ID NO: 1666 - RNA, 106 nt, Human
ggggcaggcaugacagucucacuguugcuacuuuuccucucagggcagccuauuacauuccccccaaaggccccugugguuaaccguggggcugucugucugucuc

SEQ ID NO: 1667 - RNA, 130 nt, Human
acauagagcuuaaauaauaucaaaaugcaaauauagauugggugcacuguuaagcugaauugcaaauuauggcaacacacacuggacugggguauacguugcuuugauaucaccauuuguuuguuuaugu

SEQ ID NO: 1668 - RNA, 73 nt, Human
uuuuguuuuucuuuuuuguacaaaaauaccagugcuuguuauacuaguuacuaaaagaagaagaaacucaaaa

SEQ ID NO: 1669 - RNA, 61 nt, Human
gaccuuaugugguucauuccuucaaucauuucaaacauugaaaguagggccuacauggguc

SEQ ID NO: 1670 - RNA, 80 nt, Human
ggugccaaaaguacccagcacaauacuuguauaauuuuuaguaccauacagaaguaaagucccaggaacuaugaagcacu

SEQ ID NO: 1671 - RNA, 78 nt, Human
uuuuuuuuuuuuuaaccaagucuuacagggauuauuuaacguguucccauguaucucacuuggggcuguauaaaaaaa

SEQ ID NO: 1672 - RNA, 72 nt, Human
uguuuccauuuuuacauauucuuugcuuuauucacuccugugguguguagggucauuauucaugugguugca

SEQ ID NO: 1673 - RNA, 72 nt, Human; identical to SEQ ID NO: 1599

SEQ ID NO: 1674 - RNA, 82 nt, Human; identical to SEQ ID NO: 1600

SEQ ID NO: 1675 - RNA, 86 nt, Human
ccccaagucagcccuccaucuguuuuccugauuuccuucaccuguaagauagagacaucacuacagaggucauuggguuguugggg

SEQ ID NO: 1676 - RNA, 80 nt, Human
uaguagcacagugcugacgacucagguggcuuugcugagugaguaccugccaccugcacacaguaagccuguguuaucua

SEQ ID NO: 1677 - RNA, 93 nt, Human; identical to SEQ ID NO: 1593

SEQ ID NO: 1678 - RNA, 62 nt, Human
cuucaauuauguuucuuuuaauggguuuccaaauaauaugacucauguggaaguuuaagaag

SEQ ID NO: 1679 - RNA, 94 nt, Human
ggaaggauuggagagccacuugaggucauguguuaagguauguaaaacacacuguucugaucacuuacaucuguggcucuccaguuuuccuucu

SEQ ID NO: 1680 - RNA, 70 nt, Human; identical to SEQ ID NO: 1605

SEQ ID NO: 1681 - RNA, 90 nt, Human
gaguuuaacuguguaauuuuuggccuaaauagcccugugaaguagauauuauuccaacuuuacagguuagggcaauuuggacuuggauuc

SEQ ID NO: 1682 - RNA, 80 nt, Human
gugguaaauauaaaugaguuucauuuuaaguaaacucauuuugugggauuugagauuuaaaaaugaaauuaauuuugcac

SEQ ID NO: 1683 - RNA, 85 nt, Human
ccgggcgagcugcugcugcgucugcugcggaugaucaucuugccgcugguggugugcagcuugaucggcggcgccgccagccugg

SEQ ID NO: 1684 - RNA, 90 nt, Human
cugagcuggauggaaagacagcaaagauguacagggguggcuuuggacuagcucaucucauggcucuggggcuggguccauggcuggcag

SEQ ID NO: 1685 - RNA, 82 nt, Human
gacugaaggaggaauaucagucccuuauccgguauguggagaacaacaagaaugcugacaacgauugguuccgacuggaguc

SEQ ID NO: 1686 - RNA, 86 nt, Human
cuugagagaagaaaaauuucagauuaauugccucaauuugacuagaauaucaaugaaccaggaaaacugaagcaccuucccuaaag

SEQ ID NO: 1687 - RNA, 94 nt, Human
gcuuuauuauggcugcuguuguccaacagaacgaccuaguauuugaauuugcuaguaacgucauggaggaugaacgacagcuuggugauccagc

SEQ ID NO: 1688 - RNA, 74 nt, Human
uuggguauacaauuacuccacagacagagcugaggguuuuuuacccaaaucagucacuggauuuugcugccuga

SEQ ID NO: 1689 - RNA, 123 nt, Human
agagguuuuaaaugauaccugggguuucuucccuucguggucuggagacucuaccuuuugugaguucccagaaagacucaauaugaagaaaccuauuuaucguugugaaagaugaacgccuuu

SEQ ID NO: 1690 - RNA, 74 nt, Human
gacccagaaugagcguuauaaggcugccaugcggagggcauuccacauccgguugauagcucggcgccuggguu

SEQ ID NO: 1691 - RNA, 78 nt, Human
guggaacggcucaccaacauccuugauggaggugcccagaacacugcacuccgcaggaaaguugagagcaucauccac

SEQ ID NO: 1692 - RNA, 107 nt, Human
uuacucugaauuagaaacauguuuaugauaauccuauuagaaaauuugauugauugauuaaagugucuuuuugggucgacaucccuagcguuucugauccugaguaa

SEQ ID NO: 1693 - RNA, 74 nt, Human
gguagagacgggguuucaccauguuggucaggauagucucaaucucuugaccuugugauccaccugccucagcc

SEQ ID NO: 1694 - RNA, 82 nt, Human
uuguaaacacguugagauuaaagaagguuuuaccagaucaaugggaaaauguucauuuaauaaacuuucuaacuguauacag

SEQ ID NO: 1695 - RNA, 67 nt, Human
agguggagggggcccacauuuuccuguagaaucuuugcauugaggugguuccggccaguuuccauuu

SEQ ID NO: 1696 - RNA, 72 nt, Human
ccaccuuaaugcuauguuauaauuuuccauaauuucucgggauauuacacacggauguaagcauuuuggugg

SEQ ID NO: 1697 - RNA, 75 nt, Human; identical to SEQ ID NO: 74

SEQ ID NO: 1698 - RNA, 87 nt, Human; identical to SEQ ID NO: 76

SEQ ID NO: 1699 - RNA, 99 nt, Human
ccuuuguuauaauugauaggauacaucuuggacauggaauuguuaagccaccucugagcaguguaugucaggacuuguucauuagguuggcagcagagg

SEQ ID NO: 1700 - RNA, 96 nt, Human
uauagcuuugggauuuugaauugguaaauauucaugaugugugaaaaaucaugauacauacuguacagucucagucccauaaaauuggauguugug

SEQ ID NO: 1701 - RNA, 60 nt, Human
uuacgaauggggugacaacuuaugauaaaaacuagagcuagugaauuagccuauuuguaa

SEQ ID NO: 1702 - RNA, 125 nt, Human
cagcuagucaccagaguugccauuuggggauuauauuuauuaacaauauuucauuaagugaucuuucacaguuagaguuaaggaaaucuugagugaaaauccuuaucccuuugguggaccuguug

SEQ ID NO: 1703 - RNA, 63 nt, Human
ccgagaagugcucccuuaggcacgcuugcuuagccccauuuccugagggagugaagucucugg

SEQ ID NO: 1704 - RNA, 101 nt, Human
gaaccgaugcacuggcaccuagacauguacaacaggaaccguguggauacaucccccacaccuguuucuuggcaugucauguguaugcagcucuucgguuu

SEQ ID NO: 1705 - RNA, 83 nt, Human
guaggaauccagucaauaccaagcuuggcuuccuggagucuuaggagauaggaagauaggagggccuugacccauuggccugc

SEQ ID NO: 1706 - RNA, 62 nt, Human
gcggcucccgcgcgcgcgcuccguggccgucgccgaggcgcgggggugggcgcggaagucgc

SEQ ID NO: 1707 - RNA, 91 nt, Human
gguuuaaugccuaguuaugcaacuugagugcuuuuuuauuuggcgaggaauaauucaggguguauauuuuuaaugccggguacuugaaacu

SEQ ID NO: 1708 - RNA, 72 nt, Human
guucuuuuauucauuuuuuauuugugacuguagugauaacuuuacagauggagaaagagugaauggaugaau

SEQ ID NO: 1709 - RNA, 76 nt, Human
cugggcccggaggucaccacgcaguacggcggccaauaccggacggugcacacugaguggacccagagggaccugg

SEQ ID NO: 1710 - RNA, 95 nt, Human
caaauguaaccauguuuucauaggauuuguggauucuguaaaagcaguucugcucaggauaaaugcaaguuuucaguguuuacgugguuuuuuug

SEQ ID NO: 1711 - RNA, 63 nt, Human
gaaacaauacuauucaucauuuccucaagagaaacaauuucucuggugcuaagguaggguuuu

SEQ ID NO: 1712 - RNA, 81 nt, Human
guuaaaaugucuauugggguccuuauuuaacucucaaaaggguuuuagaaguaaauagcagauucaacuauccauugaagc

SEQ ID NO: 1713 - RNA, 70 nt, Human
aauagaaacaauacuauucaucauuuccucaagagaaacaauuucucuggugcuaagguagguuuuuauu

SEQ ID NO: 1714 - RNA, 95 nt, Human; identical to SEQ ID NO: 1710

SEQ ID NO: 1715 - RNA, 81 nt, Human; identical to SEQ ID NO: 1712

SEQ ID NO: 1716 - RNA, 64 nt, Human
aagauguagcggguuuucuggugguggauccgaagaugggccacagagauuccacuuuccucuu

SEQ ID NO: 1717 - RNA, 61 nt, Human
augcagcacaaguucucauauccuugcuuuuuccauuuugcaaucagguuuuugucugcau

SEQ ID NO: 1718 - RNA, 93 nt, Human
gugcacucgaugaugcggcccacuuccagcuugcuuuugggcacgcggcagaugcaguucgucccgaaguuggugucccgugucugaaugcac

SEQ ID NO: 1719 - RNA, 79 nt, Human
ccggaaccugcucaucuggaucaagaagaauuugcuaaaagagcggccagaguuguucauccaggaagacagcgugcgg

SEQ ID NO: 1720 - RNA, 60 nt, Human
gaugccgacugggagcuacugggugagcuggacuaccagcuucaggaccaggacagcguc

SEQ ID NO: 1721 - RNA, 63 nt, Human
cggucgagcgcaguuaccgcgcggggcucugcuccaaagccgcgcuguuccugcugcuggccg

SEQ ID NO: 1722 - RNA, 63 nt, Human
gagcagcuacgaggagcagccgaccgugcgcuuccaacaccaggugcugcucguggccugcuc

SEQ ID NO: 1723 - RNA, 66 nt, Human
guacuccgagugcagcucauccugacuucuccuaucgaacaaccaggauggcgacccucgcgaugc

SEQ ID NO: 1724 - RNA, 69 nt, Human
cccaagcugggcccgcgacucgaaggugacugggauggugaucucguuggacugcguggcuagcuuggg

SEQ ID NO: 1725 - RNA, 87 nt, Human
uuuuuuuuuuuuuuuuuuuuuuuuuuuuuucaggugguugcuuugaacuuuauuugagaaaaacagaagauaaauguaucaaaagaa

SEQ ID NO: 1726 - RNA, 65 nt, Human
gauaaggaccuguuuggggcagcagggagcaaaaucuccuuuaacaaccaagcaguuccucauuc

SEQ ID NO: 1727 - RNA, 65 nt, Human
aauccuucuuuuucucuuuugcccacaauuuaagcaaguagaugugcagaagaaauggaaggauu

SEQ ID NO: 1728 - RNA, 70 nt, Human
ggaagggcaggcgugaugggcuuauuuguuuggaauucaaugauugucuuuccccaucauuuguccuuuu

SEQ ID NO: 1729 - RNA, 80 nt, Human; identical to SEQ ID NO: 367

SEQ ID NO: 1730 - RNA, 61 nt, Human
agccauccagcgucgcuguaaguuccucugucucagggcugaaguaccagcugagguggcu

SEQ ID NO: 1731 - RNA, 70 nt, Human
gggaaggggcuagagcccacaaucagacaugggcaacuagaguguggggugggggcucccaguuuguccc

SEQ ID NO: 1732 - RNA, 87 nt, Human
ugucucgggucuggggggauucgggggguucagcaguggcuccuaaagcagccaccggugccuccuccaucucccuguccucagaca

SEQ ID NO: 1733 - RNA, 67 nt, Human
aagaagcucaaacuccccaaaugcagcucccacuaucagugcuugauggauaaauguuuggcuucuu

SEQ ID NO: 1734 - RNA, 63 nt, Human
ugagucagggaaaucuuaaaaggauuauuaaucacaauacuauccauuuaaauuaacugauca

SEQ ID NO: 1735 - RNA, 71 nt, Human
gacccaucuguggugauguuccugacagcucacaaugcguguggcgugucugaggugcacgaagauggcuc

SEQ ID NO: 1736 - RNA, 67 nt, Human
acauuucugaaaugaccaaaguacacaaauggagaacagaugagugguugucagggguuagagaugu

SEQ ID NO: 1737 - RNA, 92 nt, Human
auguguggcucaggccgggcaugguggcucacgccuguaauccuagcacuuugggaccacgggcaugagccaccaugccuggccccauuuau

SEQ ID NO: 1738 - RNA, 77 nt, Human
guacagagaaaacugggaaaguuugaagaagauugauggauuguaucaaugucaauauccuaguuuugguauuguac

SEQ ID NO: 1739 - RNA, 81 nt, Human
gugauggaacugcucuguaucuugacuaugauggucgauacaugaacccacacucaggauacaauuggauagaacuaacac

SEQ ID NO: 1740 - RNA, 60 nt, Human
ccguuccaguucgagaucaccuucgagugcaucgaggaccugucugaagacuuggaaugg

SEQ ID NO: 1741 - RNA, 65 nt, Human
gcguaacuguugugcuaauuacugguaccuaucgaggacaagaauuauuagaguggcuauuaugu

SEQ ID NO: 1742 - RNA, 81 nt, Human
ggccagaauugcucaguugcauuugauccaggacuauagauuggaaaugggucaucauuguuuucuguugugauuauagcc

SEQ ID NO: 1743 - RNA, 63 nt, Human
ucacacucagaguggggcaauuccagcauuuauccuggcugcguuucauugcauugucuguga

SEQ ID NO: 1744 - RNA, 62 nt, Human
ccaugucaucagcguggacccuucagaccagaagaagacggcgugcuaugacauugacgugg

SEQ ID NO: 1745 - RNA, 64 nt, Human
ggaauacaucaauggggacaaguauuuccagcagauuuuugauuguccccggcugaaguuuucu

SEQ ID NO: 1746 - RNA, 78 nt, Human
ggacggcuuccaggugaaacggccuggggaccugagugugcgcugcacgcugcuccucaugcuggacuaccagccucc

SEQ ID NO: 1747 - RNA, 107 nt, Human
gacuacggcggccucguggucuucugcaucuucuuuggcaucuccuacggcauggugggggcccugcaguucgaggugcucauggccaucgugggcacccacaaguu

SEQ ID NO: 1748 - RNA, 88 nt, Human
gggugcacugugcuggaccaacccugauucugcuggggcuagcgggucuccauuaggaguggggugcuccguccggcacagugugucc

SEQ ID NO: 1749 - RNA, 105 nt, Human
gugcucgucgggcccccuucgggaggugagcgcugcgcccccaggcaguuccccacaccugcccuucccgucagacgcccgcuuugcgaggggggggacgcgcac

SEQ ID NO: 1750 - RNA, 113 nt, Human
ccgcuuugauuggcuccgaauccucuuggguccacauacggccaucacuccugccuggagcgaaugcgauuccaaugagaucuauacugucggacacacgcuuucaaagacgg

SEQ ID NO: 1751 - RNA, 60 nt, Human
gggggucguccuuggcacgcgcuggggagugcuaguccugaggcgagccgguagaucucc

SEQ ID NO: 1752 - RNA, 73 nt, Human
gguggcgucugccuucucauauggauuuguccguggguccgcggcuucguucuuaaggcaugauggcgccgcc

SEQ ID NO: 1753 - RNA, 84 nt, Human
ggggucuaugguggucgccaagucuuggugccggugccaggggaacugcuucuuggaaacaccuuugguggacaccguugcccu

SEQ ID NO: 1754 - RNA, 88 nt, Human
cccuaacauugaguuucaugugacuaugacauauucuacaaauuguuacaauaugaauaugguauggacaaauuauuuaaaguugggg

SEQ ID NO: 1755 - RNA, 63 nt, Human
acgauauuaggagagaaagaccccgagaguauugguuugggaauuucuuuuguacaagauugu

SEQ ID NO: 1756 - RNA, 70 nt, Human
uaauuuuaugugggauucugagguaucgagugaauugagguuuuaucuauagaaacaccuuugggaguua

SEQ ID NO: 1757 - RNA, 129 nt, Human
uguuuucguuauuauugacacacaaauuuauuuuuuaauuuuccaugagucuauguucaaaauuauuuguuuguuggacgcggauuucaagaaaaauagaagaagucuguggugcauaaagacgacaca

SEQ ID NO: 1758 - RNA, 77 nt, Human
gaguggcgacgacgguggagugguauaaugugggcgcggaaaguauagauugcggggugcuauucagguggucacuc

SEQ ID NO: 1759 - RNA, 64 nt, Human
ggagggaggguuucuggugacuacccgagaagaggggggggggcggcggagagugcuugcaucu

SEQ ID NO: 1760 - RNA, 95 nt, Human
ucucgaaggggggcgacaccagaacgacgguuuauggggggaguuucgaacccgugugagaaacccguuaugcauaggguguuuuauccccgaga

SEQ ID NO: 1761 - RNA, 61 nt, Human
ggugucaccacguuggccugaagacggcuuucaucaaaagcggcaccuacagggggacacc

SEQ ID NO: 1762 - RNA, 76 nt, Human; identical to SEQ ID NO: 758

SEQ ID NO: 1763 - RNA, 70 nt, Human
uccuugccaguuucucccagcaggacccucuucuuguuuugaaagauggucggcugcuuuuugguaggga

SEQ ID NO: 1764 - RNA, 71 nt, Human
ugcaucuucaucuuggucaccacgccagagaggauccgcccucgaauggacacauuaccagugaaggggca

SEQ ID NO: 1765 - RNA, 100 nt, Human
cuccuggaaguucgugcucggguucuugcugcacagcaugaagccgaucuggccgcugggguagguggugauggugcaguaggcauaggccaccacgggg

SEQ ID NO: 1766 - RNA, 82 nt, Human
gggcuggaggggccgaggcaccccgcaggcuccaagguccgagguccuggguggcaucagugguggcgccugggcucagcuc

SEQ ID NO: 1767 - RNA, 99 nt, Human
aagacuguacugcagaugcucagaaaguuaaaucucgcucucauauguaugcagguaugucuugagugucaggauuucuggguagcugcggcuggucuu

SEQ ID NO: 1768 - RNA, 129 nt, Human
uagccaacaaacccaagauacagugcagaucaccuuuccauuucuaaacaguguguagagagcauaguauugucugcaagagaugucagaauugggaggaguccguagcgcugguggagauguugguua

SEQ ID NO: 1769 - RNA, 61 nt, Human
cuuguggagacgggauggggaaaaauacugauucugugaaaauacccccuuucuccauuag

SEQ ID NO: 1770 - RNA, 82 nt, Human
gcagcuccaguaucccaaacuuucuaguccugcugauccucccagcaacgggguggaaacuggagggcagugucuggucugu

SEQ ID NO: 1771 - RNA, 63 nt, Human
ggagucuuuagauuuuuacaaauauaugaucauaucauuugcgaacaagaauauuuugacucu

SEQ ID NO: 1772 - RNA, 75 nt, Human
ggugaggcuaggaccuggcccagggcaacugucuccucaacagcauuugcgccuccauuccauuuaguuuccacc

SEQ ID NO: 1773 - RNA, 71 nt, Human
gucagaggaaaaggcacuuugaaccuccuguaacgaugcugagguuuggacauucugacccagccccugac

SEQ ID NO: 1774 - RNA, 131 nt, Human
gucauccauuuauuuauuaagaauuuacuaggcacuguauuaaacauuuuacauacuuaauuucauuuaauccuuaucaaagcugucauuauggggcacugucauucuguucacuuuauagaugagggugc

SEQ ID NO: 1775 - RNA, 77 nt, Human
uuguuugggucugaauuuuguuuuuaaaacuaagcuaaguuuaauguuuuuuaaaaugcuguuuggaauaugaauag

SEQ ID NO: 1776 - RNA, 74 nt, Human
ggaucucaaaagaugaagacuuuuguaaacgguguauucuuuggguacugugggauaaaagcagguugaaaucc

SEQ ID NO: 1777 - RNA, 64 nt, Human
ggggcuugcccuggcucucugucuccucccaucgggaggaacagagagccaggaccaaagcucc

SEQ ID NO: 1778 - RNA, 64 nt, Human
uucuuauauuguguguuaaucaucaaggaaucucuucucgauuaaaauacacacaucuuaagaa

SEQ ID NO: 1779 - RNA, 79 nt, Human
cucuucagccaggcaggcaggcaggcaggcauccucacugagugccucccaggugccaggucuguauugggcugaggag

SEQ ID NO: 1780 - RNA, 88 nt, Human
uggcaaguuacaccuaaccccuggcuccauggagguuacagugcacacagcaacuaccuccuaguggggguuuaguacauauuuguua

SEQ ID NO: 1781 - RNA, 76 nt, Human
gcucuagcucuuuuccugugguauuguaaugauugguuuauguuuaccuuccuuacuagacugugagcucaagagc

SEQ ID NO: 1782 - RNA, 77 nt, Human
ugucucacuaggguccccuccccaaggcucagcucuaagaccugcaccugcuucucuuggccccugcgugacagaca

SEQ ID NO: 1783 - RNA, 85 nt, Human
ccgcaaagugggucucauugcugccggcggaccuggaccgucuccgggcaccaagacugugccggacacagagacuagugugagg

SEQ ID NO: 1784 - RNA, 74 nt, Human
ccucuuccgugaggcgcgcugagacccggaccggcccuccugagaggaugccggugcgggcgcccgcggagagg

SEQ ID NO: 1785 - RNA, 89 nt, Human
gaaggguuuacgaugcauuguuaucauuaaccagucuuuuacuacuaaacuuaaauggccaauugaaacaaacaguucugaaaccguuc

SEQ ID NO: 1786 - RNA, 63 nt, Human
uccaugcaaugugagccguguggcaauccaauacagggccauacccgcgcuuauuuggcugga

SEQ ID NO: 1787 - RNA, 61 nt, Human; identical to SEQ ID NO: 776

SEQ ID NO: 1788 - RNA, 131 nt, Human
agauucgggcaaguccaccacuacuggccaucugaucuauaaaugcgguggcaucgacaaaagaaccauugaaaaauuugagaaggaggcugcugagaugggaaagggcuccuucaaguaugccugggucu

SEQ ID NO: 1789 - RNA, 62 nt, Human
gagcggucggugacagccucaagggcuucagcaccgcgcccauggcagagccagaccgacuc

SEQ ID NO: 1790 - RNA, 75 nt, Human
gcuggacgagcugaccuuggaagggguggcccgguacaugcagagcgaacgcugucgcagagucaucuguuuggu

SEQ ID NO: 1791 - RNA, 76 nt, Human
uagccgggcuggaacaggaggacuugguggaggcgcacggcaccuucuacacaucacacugcgucagcgcccgcug

SEQ ID NO: 1792 - RNA, 61 nt, Human
cgcaccccugaauuucuccgcaaauuuccugccggcaaggucccagcauuugagggugaug

SEQ ID NO: 1793 - RNA, 65 nt, Human
agcagccgagcggccauggagcugugcgggcuggggcugccccggccgcccaugcugcuggcgcu

SEQ ID NO: 1794 - RNA, 60 nt, Human
ucuaagagugaaguaggugugacuugaacuagauugcaugcuuccuccuuugcucuuggg

SEQ ID NO: 1795 - RNA, 100 nt, Human
cuggagggccugaauuucaaccucacggagauuccggaggcucagauccaugaaggcuccaggaacuccuccguaccucaacagcagacagccaguccag

SEQ ID NO: 1796 - RNA, 84 nt, Human
ggaggagggggucgggccuccgaggaaggccuagccgcugcugcugccaggaauuccagguuggaggggcggcaaccuccugcc

SEQ ID NO: 1797 - RNA, 76 nt, Human
uggccgggaggcugggcugggggagguaucucuucgaaggguccauccucaagccacgauaagagcuucugagcca

SEQ ID NO: 1798 - RNA, 77 nt, Human
gaggcagcccuggccaccuucggaacuuucccgucgaccaggccccccgggacucccagggcuccagggcccuccuc

SEQ ID NO: 1799 - RNA, 63 nt, Human
ucugugcacuugauaauaacccugcaggcguucugcgugaaccaggcuguuaagugcaccaga

SEQ ID NO: 1800 - RNA, 64 nt, Human
ugaguaugggguuccucugcagacuucagauucguuucugagauuuccuucgucccugacauca

SEQ ID NO: 1801 - RNA, 66 nt, Human
ugccaugcugugggcaccuucugcaggaccagccagguaggucaucuuggacggugccagcaggca

SEQ ID NO: 1802 - RNA, 67 nt, Human
ccaagcugggcccugagaucgagcgggcugaguguacaauccgcaugaaugaugcacccagcacugg

SEQ ID NO: 1803 - RNA, 86 nt, Human
gccccagggcagccucgugcgugugauccagcgagcgggccugguguuccccaacauggaagcauaugccggucucucccuggcgc

SEQ ID NO: 1804 - RNA, 81 nt, Human
gcgggcaaccuggccuccggcggugcggccggcgcgaccucccucugcuucguguacccgcuggauuucgccagaacccgc

SEQ ID NO: 1805 - RNA, 61 nt, Human
aggagaagcugugcuccgucgccuggaacuucgagcaggagauggcaaccgcgauccuccu

SEQ ID NO: 1806 - RNA, 67 nt, Human
cugguuugcuggggacgacgcuccccgagccguguuuccuuccaucgucgggcgccccagacaccag

SEQ ID NO: 1807 - RNA, 66 nt, Human
cguuucuaguaagaacuuggcaucaagucuaagaagaagggcuuuaccaaguacugcgcagaaaug

SEQ ID NO: 1808 - RNA, 96 nt, Human
ggaggugguggaggcugugaccauuguagagacaacaaccauggugguagugggcauugugggcuacguggaaacccucgaggccuccggaccuuc

SEQ ID NO: 1809 - RNA, 60 nt, Human; identical to SEQ ID NO: 1551

SEQ ID NO: 1810 - RNA, 79 nt, Human
uugucgucauuggacacguagauucgggcaaguccaccacuacuggccaucugaucuauaaaugcgguggcaucgacaa

SEQ ID NO: 1811 - RNA, 61 nt, Human
gcaucuaaugugauaaggcugcacguuuuauaucgauggucauucuuuauuguauuggugc

SEQ ID NO: 1812 - RNA, 74 nt, Human
gugaugagcacgacgggacgggcagauccauucaugcaaccgguaugagaucuccuuacccucuguugcaucau

SEQ ID NO: 1813 - RNA, 81 nt, Human
ggauggaguggcagcugaaggugcaggaacuggaccccgccgggcacaagucccugugcgugaacgaggugcccuccuucu

SEQ ID NO: 1814 - RNA, 66 nt, Human
uuucaggaguuggagaacggaguacauuuuuaaaauuuuuuguuccauucugaucaacuaaagaaa

SEQ ID NO: 1815 - RNA, 61 nt, Human
acccuuccuuggcaccauucuucuacacuuaaggauggaguuugggaccacauugaagggu

SEQ ID NO: 1816 - RNA, 63 nt, Human
cggcugcgaaguaccgccugcggaguacugcaaagaugcuguccgugcgcguugcugcggccg

SEQ ID NO: 1817 - RNA, 73 nt, Human
uuggugcauguaauaauguugaguggcagucaaaagucaugauuuuuaucuuaguucuucauuacugcauuga

SEQ ID NO: 1818 - RNA, 62 nt, Human
ggacccgacaaccauccugggagaauaucccauuagcaaucucaggagagcaagacccgucc

SEQ ID NO: 1819 - RNA, 81 nt, Human
cugaagguucagcauaguagcuacagacagagggcccggcuguugaaggaccagcucucccugggaaaugcugcacuucag

SEQ ID NO: 1820 - RNA, 131 nt, Human; identical to SEQ ID NO: 1788

SEQ ID NO: 1821 - RNA, 64 nt, Human
uuccauaauccuccucaucacugguaccuaugugggaccccuggugguggaggucauccaggaa

SEQ ID NO: 1822 - RNA, 93 nt, Human
gcauacucgcugcccgccggcucccucccccgcgucccugcgaccgccgcggcgaagauggccucaggagugcaaguagcugaugaaguaugu

SEQ ID NO: 1823 - RNA, 61 nt, Human
ggugacaacaugcuggagccaagugcuaacaugccuugguucaaagggauggaaagucacc

SEQ ID NO: 1824 - RNA, 79 nt, Human
gcugcccugucuugcguuccaguguuccagcuucugcgagaugacccucaaggcgagcgagggcgagagugggggcagc

SEQ ID NO: 1825 - RNA, 73 nt, Human
acuauugccagacccacuaccagugcuuguggucgugcugguaguugcagaacucuggguagcuggcgguggu

SEQ ID NO: 1826 - RNA, 105 nt, Human
gcugauagugugucuggauucugcaucugcugcaggaaggcugggagcuguggccgcaucugcuccugcagcugaggauuugcaguaaacagcgggcuauucagc

SEQ ID NO: 1827 - RNA, 60 nt, Human
ugggagaguauuuuagagacaauggcaaacaugcuuugaucaucuaugacgacuuaucca

SEQ ID NO: 1828 - RNA, 60 nt, Human
ugccuacaaugccuuucagauccgugcuggaaacucgcagggggacuuuuacauuaggca

SEQ ID NO: 1829 - RNA, 76 nt, Human
uggcuucuccugcagugauauugaugaguguagcuacuccagcuaccucugucaguaccgcugcgucaacgagcca

SEQ ID NO: 1830 - RNA, 81 nt, Human
ggagcggcggcgcccgcagcaaucacagcagugccgacgucguggguguuuggugugaggcugcgagccgccgcgaguucu

SEQ ID NO: 1831 - RNA, 65 nt, Human
gagcuaauacaugccgacgggcgcugacccccuucgcggagggggaugcgugcauuuaucagauc

SEQ ID NO: 1832 - RNA, 66 nt, Human
gauuaagccaugcaugucuaaguacgcacggccgguacagugaaacugcgaauggcucauuaaauc

SEQ ID NO: 1833 - RNA, 68 nt, Human
cucuggucuagauuuucauauaauguauuaaagacaaaguagugaacaucaaugaacaucugauagag

SEQ ID NO: 1834 - RNA, 63 nt, Human
agaugacguuuaugaucguaugcugcuagacuacuucuuuucuuaucaucaguucauccaucu

SEQ ID NO: 1835 - RNA, 60 nt, Human
gaacuuuuuuaaacaacaacauugucuacacguucaugacacauuuccuucuaaagguuc

SEQ ID NO: 1836 - RNA, 63 nt, Human
aggacuagccaggaccggagcgcucgucacuccaauugggugcuccugggucccacugguucu

SEQ ID NO: 1837 - RNA, 88 nt, Human
cacggugcugucgggcggcaccaccauguauccgggcauugccgacaggaugcagaaggagaucaccgcccuggcgcccagcaccaug

SEQ ID NO: 1838 - RNA, 72 nt, Human
cuuuugaauaaaagaucauucaacuaaaaauauuaaaauuuauuucacuggaugguaauguaaccuuaaaag

SEQ ID NO: 1839 - RNA, 91 nt, Human
cugcacuuauaguuuuaaaauaucguacacauaacauuaugauuucaguucuaaauguaaaccaugauuucuuuuuaaagacguauggcag

SEQ ID NO: 1840 - RNA, 66 nt, Human
gucuccgggguagcaggggcugcucugugcugggcugggccaguagggggcgcccucccugggagc

SEQ ID NO: 1841 - RNA, 80 nt, Human
guggcuguugaggggcgucuuccaaucucgcacagcugcguuggcuguagaagagaacggacggcgauggcgacggucgc

SEQ ID NO: 1842 - RNA, 95 nt, Human
gccaacaaaaaagacuuggaggaggcagaggggagacuugcagcuccucugcugaaacguuuaagccucuccacauccaaauugaacagccuggc

SEQ ID NO: 1843 - RNA, 131 nt, Human; identical to SEQ ID NO: 1788

SEQ ID NO: 1844 - RNA, 71 nt, Human
agggagagguggaggcccugcuggaucgauacuucgaggcugauccuccagggcagguggcugccuccccu

SEQ ID NO: 1845 - RNA, 63 nt, Human
cccggugcuggaaaggcgcccagggcccaagcgggaccugagccacgcgucgggcacaacggg

SEQ ID NO: 1846 - RNA, 76 nt, Human
gcggaucgugucucggcugcggcgauucgggacagugcucaccgagcacguggcggccgccgagcugggcgcgcgc

SEQ ID NO: 1847 - RNA, 72 nt, Human
ccaauaacucuauccucgggcggucgacauuuauucaacaagaaaaaaaccuuucgugguaccgacuauugg

SEQ ID NO: 1848 - RNA, 62 nt, Human
gagaauguauguaaaaguucugugacaguacagaaggaaaacaacuuuuuauguauagcuuc

SEQ ID NO: 1849 - RNA, 79 nt, Human; identical to SEQ ID NO: 1810

SEQ ID NO: 1850 - RNA, 67 nt, Human
cgugaagaaggcggcccgggucaucauagaaaaguacuacacgcgccugggcaacgacuuccacacg

SEQ ID NO: 1851 - RNA, 79 nt, Human; identical to SEQ ID NO: 1810

SEQ ID NO: 1852 - RNA, 63 nt, Human
ggugacaacaugcugggagccaagugcuaacaugccuuggguucaagggaugggaaagucacc

SEQ ID NO: 1853 - RNA, 79 nt, Human; identical to SEQ ID NO: 1810

SEQ ID NO: 1854 - RNA, 77 nt, Human
caaugucgauucuggacaucauuuuuuccaaaagucuuggaaaugacaggaaauauugaugaagcagaaugggagug

SEQ ID NO: 1855 - RNA, 89 nt, Human
gcaggucccgcuggugcuguggucgagugaccgggacuugugggcuccugcggccgacacucaugaaggccacaucaccagcgacuugc

SEQ ID NO: 1856 - RNA, 71 nt, Human
gcucuggcgcaugccguggcugccgguguuuuugucguuggcggcggcggcggcggcggcagcggcggagc

SEQ ID NO: 1857 - RNA, 80 nt, Human; identical to SEQ ID NO: 367

SEQ ID NO: 1858 - RNA, 67 nt, Human
ggcagacugccugcuggugccagaaugaugccaaagacauagaaaagucccagcaggagguugagcu

SEQ ID NO: 1859 - RNA, 68 nt, Human
uggcaguccucuggggcaguuuguugaaggccugggcuucgaaacugucucucaaggggagaaggcca

SEQ ID NO: 1860 - RNA, 75 nt, Human
gagugugguaguggauuagugaaagucuccucaggaaaucugaagucuguauauugauugagacuaucuaaacuc

SEQ ID NO: 1861 - RNA, 77 nt, Human
uguaugaauuaagcuguaaggccuguagcucugguuguauacuuuugcuuuucaaauuauaguuuaucuucuguaua

SEQ ID NO: 1862 - RNA, 67 nt, Human
ccaagcugggcccgcgacucgaaggugacugggauggugaucucguuggacugcguggcuagcuugg

SEQ ID NO: 1863 - RNA, 73 nt, Human
ggcagcaggggugggcauccgggcuaaggcuuuacuuggcggcagucucaucggauuuugcagcuucugggcc

SEQ ID NO: 1864 - RNA, 70 nt, Human
aaaugguugaauggguaacaugcauugaucaauacaacaaccaauaauauuuacugaauucaaacuauuu

SEQ ID NO: 1865 - RNA, 68 nt, Human
ugguuuuauuuuaacuuaaccuuugugaauacuucacaaaaauacacauacagaaguaaauaaaacua

SEQ ID NO: 1866 - RNA, 75 nt, Human
cugacugcccgcccuuggcuccaucugcagaugucuucagagacgagauguacuuggaccagaaggagcagucgg

SEQ ID NO: 1867 - RNA, 97 nt, Human
caggugaaaauggcagguuuuuguuuggaagguggggggagaugccacaaggugacuccccaccucccuugccucacagauuggccuguuuucccug

SEQ ID NO: 1868 - RNA, 72 nt, Human
gcaguugucaaauaccaggagggcaucagccgcaaacuccucugagcugguguaccuggacagggcaggggc

SEQ ID NO: 1869 - RNA, 71 nt, Human
uccagaaggaccucaucucugcaccucuuacuugaggagcaagaggagggaagggagaaagggauguagga

SEQ ID NO: 1870 - RNA, 72 nt, Human
gcauuaaaggauaauuuucucugugaauaagagcaaaauggucuucagagaaacagacuguucauuugaagc

SEQ ID NO: 1871 - RNA, 92 nt, Human
acuuggagaguuuggcccaggaguuccugaaccauauuuguuacuugugcucacucagguugaguucuguggccaguuuguauucucaaagu

SEQ ID NO: 1872 - RNA, 63 nt, Human
cuugggacucccuguagcagugccuggaaaaugguauguuuugcugcugcaggaauucucaag

SEQ ID NO: 1873 - RNA, 66 nt, Human
gggcagagggcaugugaaguaaccuaggaccugcuggucacccugggugaugugcugcccucguuc

SEQ ID NO: 1874 - RNA, 77 nt, Human; identical to SEQ ID NO: 1066

SEQ ID NO: 1875 - RNA, 69 nt, Human
acacgcacauucacaguaguucccagggcagcagaaaguacugaaaucccaccuuaugugaugaagugu

SEQ ID NO: 1876 - RNA, 96 nt, Human
cugugcagugaaaccaucuguuaccuguguugaucaagacuucaaaucccaaaagaacuuucaucauuaacaugacuugcagauuuugcugggcag

SEQ ID NO: 1877 - RNA, 71 nt, Human
gcgccuugugucgcgugcugcucuuccuuucgcaguucugcauucugucgggcggugagaaucgcaggcgc

SEQ ID NO: 1878 - RNA, 72 nt, Human
guguagcaggcuuccugcagacuguauagacugcacaacaaauuucuccuguaccuaugggaagccugucac

SEQ ID NO: 1879 - RNA, 79 nt, Human
cuggugcucccgaccccugguaggcccauccuccccgugcagacaggggagcaggcgccagcuaagaggagcaguccag

SEQ ID NO: 1880 - RNA, 115 nt, Human
gaugaagggagagagaggaggagagaggcaaguguuccaggcuagagaaauagagaccacgacccugaacuggagcauugacuuccuuucucucccuuucuccuuccuucccguc

SEQ ID NO: 1881 - RNA, 79 nt, Human
guuguuucuuuagcucuccuccaagacacuauggccaacugaagcccaaagccagcugagaggggagucugggaacugc

SEQ ID NO: 1882 - RNA, 66 nt, Human
aaggaacaugaagauuauuguggugcccggacggaacuauguggcaacuguggucgcaauguccuu

SEQ ID NO: 1883 - RNA, 84 nt, Human
ggauggcugaauuucuagaugaccaggaaacucgacugugugacaacugcaaaaaagaaauuccuguguuuaacuuuaccaucc

SEQ ID NO: 1884 - RNA, 69 nt, Human
cuggaaucacgauagaugaagauacaauagugucaucuacaggugcuuuaucuuuaaaaaaaguuccag

SEQ ID NO: 1885 - RNA, 67 nt, Human
cuggugcuaccaagaagucagauggaaacaauugauguuucuauugaagcugcuucuggugguaaag

SEQ ID NO: 1886 - RNA, 74 nt, Human
guuguuauuggugcaggaguaauagguguagaauuggguucaguuuggcaaagacuuggugcagaugugacagc

SEQ ID NO: 1887 - RNA, 65 nt, Human
agcgugucuggaaacgcaaacuaucauuaauuucauacuaguuguaccguaucuguaggcauccu

SEQ ID NO: 1888 - RNA, 66 nt, Human
ucuucgggaaaggugguggcggggcguccacuagguuuccuguccccugcugcuccuuccguaaga

SEQ ID NO: 1889 - RNA, 78 nt, Human; identical to SEQ ID NO: 99

SEQ ID NO: 1890 - RNA, 80 nt, Human
ucuuguguugagacuucgugguggugcuaagaaaaggaagaagaauucuuacaccacucccaagaagaauaagcacaaga

SEQ ID NO: 1891 - RNA, 81 nt, Human
gcugagugagccuccgccauccagcaugacaaacuguggccgaccgcagcugugccguggcacgauggcgaggaagccagc

SEQ ID NO: 1892 - RNA, 130 nt, Human
uugguuuuuuggcgauuucauuccauucuugaccaaagcuucucuuuaaguaguuuauuauggaaaauugucacacuaacuuaaaagacagggugagggagauauguaaauuguccacuagaaaauuaaa

SEQ ID NO: 1893 - RNA, 74 nt, Human
aauagaguaaaaaaaaaaaaguaggacacacauugcauauauagucagucuuauuugggcagaaggaaucuauu

SEQ ID NO: 1894 - RNA, 70 nt, Human
cagcaccauaacacuagacccagccuaacuguccugcaacaggggauggguaaaagggaugauggcgcug

SEQ ID NO: 1895 - RNA, 67 nt, Human
cuuagggaggaaggacuaggagggaaaacugggaaaacguacggugggcucugucuugcgucuugag

SEQ ID NO: 1896 - RNA, 72 nt, Human
aggaaucuaguggccaagaguuguaguuuagaaacaacccaucugaauacugcuuuuaccacuuugauaccu

SEQ ID NO: 1897 - RNA, 130 nt, Human
gaaaacaacauauagagaaauacuguagaaaccauugcuagugucuuaacuaggaaaagcaaguagacucaucaacaauccuuucaaaacaagaccuagagauaaacaguuuuuuccagugucaauuuuc

SEQ ID NO: 1898 - RNA, 63 nt, Human
accagaaaucuucaugcaaugaaaaauacuuuaauucaugaagcuuacuuuuuuuuuuuuggu

SEQ ID NO: 1899 - RNA, 87 nt, Human
gagucucgcucuugucacccaggcuggaaugcaguggcgccaucucagcucacugcaaccuccaucucccagguucaagcgauucuc

SEQ ID NO: 1900 - RNA, 62 nt, Human
gggugaaacaugaacauuugaggcugauucccuguggaaaaaucauucaaaucuauucacuc

SEQ ID NO: 1901 - RNA, 81 nt, Human
ucugauggcuguugcuuguuuuauuuuuuguccaagagaggugguguuggaccgagguagagaagacagugguacaccaga

SEQ ID NO: 1902 - RNA, 83 nt, Human
gugcuuauaaagugaaggggucauacaguugggccuucauuauuuugcugaauuaugugaugauucuuuugcuuucuacccac

SEQ ID NO: 1903 - RNA, 102 nt, Human
guuucagacaucaaggaguaucacugugcuuuccuccucuuuauaacugugcaggugggugugcagagaaauagcagagugaugguucgaugauacugaagc

SEQ ID NO: 1904 - RNA, 63 nt, Human
ggcucccggaucaaaggcugguggguguuccaucacuacguguccaccuuccugucgggaguc

SEQ ID NO: 1905 - RNA, 76 nt, Human
ggugacagaugcugccuucaacuuccugcuggucugguacuacugcacccugaccauccgggagagcauccucauc

SEQ ID NO: 1906 - RNA, 75 nt, Human; identical to SEQ ID NO: 1860

SEQ ID NO: 1907 - RNA, 77 nt, Human; identical to SEQ ID NO: 1861

SEQ ID NO: 1908 - RNA, 76 nt, Human
agauguagcuuuuguaauacuauuuugaccucuucugcucucauuugguuaauauuugcaugcaaugucuaaaucu

SEQ ID NO: 1909 - RNA, 92 nt, Human
aguuaauaaaucuauuauuguuuaaugucuuucuuugucucuuugcaguuuugacuuaaaguacuuuauguaagauaugacaguuuuugacu

SEQ ID NO: 1910 - RNA, 62 nt, Human
uuaaucauuaggaugucagcugacccuuguagaaagggcaaauugggaucuuggguuuuuaa

SEQ ID NO: 1911 - RNA, 69 nt, Human
gcauuuauaauuaucucauuuguuaaggcugagaagguuguuuuuauaauagguaauuauauugaaugc

SEQ ID NO: 1912 - RNA, 95 nt, Human
uauaugaaccuuuccccaagaagggcccuaggaaauugaugugggcuuuccucuuaaauauuaauuauuaguccugaaaggaaagguaacauaug

SEQ ID NO: 1913 - RNA, 73 nt, Human
cuucuaaaagacuuucuucgaaaccucaaagaaccucuucugaccuuucgccuuaacagagccuuuauggaag

SEQ ID NO: 1914 - RNA, 76 nt, Human
gacuguagacacaaacuguguaacuuccaugagccauuuccuuccugugcacauguauguguguuauuuuucaguc

SEQ ID NO: 1915 - RNA, 119 nt, Human
ggccuugugcagucagcuuaugcucagcccauugauuccaccacaucccugaucgaggggacguuaauuaccugucuuugugaauuaagcaguuuaugagcagcaaguuacugaggacc

SEQ ID NO: 1916 - RNA, 76 nt, Human
ccccuuccaggaagggccugguguugcagcugauccagucuuaccagcggaugccaggcaaugccauggugagggg

SEQ ID NO: 1917 - RNA, 69 nt, Human
augcuugagaaaugcccuuuuccugcuggcucagauuuagcccaaaaauggcauuugauuaaacagcau

SEQ ID NO: 1918 - RNA, 88 nt, Human
cuccugugagcccacauucaacauuuuuugauacauuugauccaucuuugguuucuacagaagaugaagaagauaggcuuagagagag

SEQ ID NO: 1919 - RNA, 68 nt, Human
ggcauugaagauccauaacuaucuucugaauuaucacagaaagaagaaaguuagaagaguuuaauguu

SEQ ID NO: 1920 - RNA, 72 nt, Human
guuugcaaacuaauucaaccauuuuacacagcauuaauuuuuuuuuuaacuggguugacauugggcugaaac

SEQ ID NO: 1921 - RNA, 61 nt, Human
ccagugaaguagugaaugcacggagagcuucuauucugcggcaggacagacacuccacugg

SEQ ID NO: 1922 - RNA, 64 nt, Human
uuaguuagcaugcugucggguauucguauuuuaaaguaauauuuuaaugggagcagcugauuga

SEQ ID NO: 1923 - RNA, 78 nt, Human
gagguccaguuucauucuucugcauguggguuagccaauuuuccuaacaccauuuauugauuaggguguccuuuccuc

SEQ ID NO: 1924 - RNA, 68 nt, Human
guaccaguaccaggcuauuuugguuacuauagcuuuguaguauaauuugaguuuggguaauaugguau

SEQ ID NO: 1925 - RNA, 60 nt, Human
guugccuuuuucagaaaucaguuaguuguaaauguguggcauuauuucuggauucucaau

SEQ ID NO: 1926 - RNA, 76 nt, Human
uccccacagccgccccacagccagucccggggcagguccuugggccgcgccgaccggcugcagccgcauguggaga

SEQ ID NO: 1927 - RNA, 64 nt, Human
ucgcccucgcggcaggcccggcugauggcguugaccacgcccgcggcgcucaccgcguggguga

SEQ ID NO: 1928 - RNA, 73 nt, Human
uggugcagcagaccuguaaaugucuucaaauucauuauuccucagaucgucaaguacaguccugauugcauca

SEQ ID NO: 1929 - RNA, 66 nt, Human
uugugguauccaacccaguugaccauucuuacaguauguaaccuggcaacuaaguggauuacccaa

SEQ ID NO: 1930 - RNA, 70 nt, Human
agaacuggaugggaauuuccacucuucacccucuaccuaggugacuuugagcaaguuauuuauccuuucu

SEQ ID NO: 1931 - RNA, 79 nt, Human
cucuuuuguauccuuauccguauaaugaggauaauaauauugucugugugauuggguuguugugaggauuaaaugagag

SEQ ID NO: 1932 - RNA, 115 nt, Human
ucaccaccuugguuuuguuuuauuuugcuucuuggucaagaaaggaggggagaacccagcgcaccccuccccccuuuuuuuaaacgcgugaugaagacagaaggcuccgggguga

SEQ ID NO: 1933 - RNA, 114 nt, Human
gugcucuucaugcaagguugcaaaccuaccaagaaugcauaauagucucacuuuuccccaauaaagagaugcgugugacuaguuuuggacuuuuaaccuuaauggggguugcau

SEQ ID NO: 1934 - RNA, 85 nt, Human
gaagaguuaaaaauaguacagaaaugugaaguuugguaucucuaaauguguuguacuugacuuucuuuuuuauuuuguuuuuuuu

SEQ ID NO: 1935 - RNA, 69 nt, Human
gugucugacaaaaauguaaacuguauaaacugaggaaccucagcuaaucaguauuacuuuguagaucac

SEQ ID NO: 1936 - RNA, 66 nt, Human
cucacaauuuuucuuuaaguuugaaacuauuucaaaaugaaguuauauaacuacaugaauugugag

SEQ ID NO: 1937 - RNA, 88 nt, Human
guggcccaugacaaucuuuuuccaauguggccuggggaagccaaaagauuggacaccccugguuacaggaagaaguuccuugugcuau

SEQ ID NO: 1938 - RNA, 82 nt, Human
acugacaguacccgacuguuuauuggaucuauugauuugaaaagaauuuguuaggauagaucuuaagcaguaaucugucagu

SEQ ID NO: 1939 - RNA, 64 nt, Human
cacaaaaugggacugcugaagaguggacaguuggaccuuacuuuggugaccccauacguuugug

SEQ ID NO: 1940 - RNA, 61 nt, Human
uagccauacacaugguaacauugacuauggagucuugugaaaguguaaugugcgauggcua

SEQ ID NO: 1941 - RNA, 75 nt, Human
augaagacgaguaugaaguaaauuugaaagacuuugagccacagcccgguaauaugucucauccucggccuuggu

SEQ ID NO: 1942 - RNA, 67 nt, Human
ggccauuaaaauccauaacugauuuccaagcugguguguucaaggcgaggacgguguguggguggcc

SEQ ID NO: 1943 - RNA, 77 nt, Human
uuaacagccuagaacuuuggugcacgugcccucuagccgaagucuucagcaagagggauucgcuggcuggguguuaa

SEQ ID NO: 1944 - RNA, 79 nt, Human
acuuccauguucugggugauggaaacugccaaaccuccugucagugaggacucuuuccgacugcccagaaagugggggu

SEQ ID NO: 1945 - RNA, 61 nt, Human
aaagaauaguuugguucuucaaaucuuaagagaauccacauaaaagaagaaacuauuuuuu

SEQ ID NO: 1946 - RNA, 64 nt, Human
ugugcaauggaauauaaauaucacaaaguuguuuaacuagacugcguguuguuuuucccguaua

SEQ ID NO: 1947 - RNA, 84 nt, Human
uuauguuuuaauauccuaggcaucugcuguaauaauauuuuagaaaauguuauuacagcagaugccuaggauauuaaaacauaa

SEQ ID NO: 1948 - RNA, 74 nt, Human
gcugcacuggugcaugaaggugaaguaaggaggcagcuacucccuccacaaauaagaauucgugcagcagcagu

SEQ ID NO: 1949 - RNA, 78 nt, Human
gagaguugcuugagcccaggaggcggagguuguagucagccagccacuguacucuagccugggcaacagagcucucuc

SEQ ID NO: 1950 - RNA, 66 nt, Human
aaagugagauuugucgcguuuuuuuaauauuuaguuuauauuaauaguuagacuuuaucucauuuu

SEQ ID NO: 1951 - RNA, 76 nt, Human
cuaguguauuuacuauuaugcgauugaauugcaguauuuaggauaguuacucauucguuucuuaguguaugacuag

SEQ ID NO: 1952 - RNA, 90 nt, Human
ucggauauauaucaauucuacagaguuuagauuauauauagguauuacaggugauaugauaugauagauuuuuguauugauguauuacga

SEQ ID NO: 1953 - RNA, 86 nt, Human
uuuuagaaaagaauaugacauuuuauuuucacuuauggacauacaguacaugaauuuagaaauaaaaucgucgcaggauucugaaa

SEQ ID NO: 1954 - RNA, 82 nt, Human
gcaugcgauuuguuaaucaugauggagucucagagcuuuugaagagcugaaccgauaugagaaagucuuaaccaguuguugc

SEQ ID NO: 1955 - RNA, 79 nt, Human
uuguaagauacuaaauuuaugcuguuuuaaaccauuauguucaugauaauuuguuacaguagccauagaaaucuaauaa

SEQ ID NO: 1956 - RNA, 89 nt, Human
cucggccuccccuucagcagcuuugaccacucuaaagcccacuacuaucgcuaugaugagcaguugaaccugugccuggagcggcugag

SEQ ID NO: 1957 - RNA, 77 nt, Human
ucacaugacaaugaagcagauauggcucucccgcugguucggcaagccauccccuuugcuuuuacaauacaguguga

SEQ ID NO: 1958 - RNA, 60 nt, Human
cgguugccauggaccagcagcaccuccuugauccgguccugcuggaagcccaugucacug

SEQ ID NO: 1959 - RNA, 67 nt, Human
ggugcugggggcucugcugggccuggccucaaccauggggagccccagcuccagugccuacugcacc

SEQ ID NO: 1960 - RNA, 70 nt, Human
gauaugcagcaaguuuaauaccugaagguuaacauaaaugacaacaggacacagaugcaaugcuacaguc

SEQ ID NO: 1961 - RNA, 70 nt, Human
gcauugcugaggaugagacucaaggcaggggucugcagcucugucacagaguguuaaugcucaacgaugc

SEQ ID NO: 1962 - RNA, 63 nt, Human
gccacuugacucgugucacaaagaauggaguaaacuaacaacucugaaagacaagaggguggc

SEQ ID NO: 1963 - RNA, 64 nt, Human
gcccagugcgggcgcagcggccccggcccuggaagcgccccggcggagcuggcccgcggugggc

SEQ ID NO: 1964 - RNA, 70 nt, Human
gccccgccucguggugccggcugguucuucgcgcucgcccgacuucccagcggccccgugcggcccgggc

SEQ ID NO: 1965 - RNA, 61 nt, Human
gcccugucgauuggggagcagcucacugaacuccuuguaguucucuccaccagcacggggu

SEQ ID NO: 1966 - RNA, 77 nt, Human; identical to SEQ ID NO: 1066

SEQ ID NO: 1967 - RNA, 122 nt, Human; identical to SEQ ID NO: 1067

SEQ ID NO: 1968 - RNA, 76 nt, Human
gucaggccaggggguugcaaauguggguacuuuccgugagaacucauaaggguaguuggggauuuccugaucugau

SEQ ID NO: 1969 - RNA, 94 nt, Human; identical to SEQ ID NO: 807

SEQ ID NO: 1970 - RNA, 76 nt, Human
guggaagaucuuagaauugccugccucauuugcugggaaaaaucagauaggaaguggccuuuaggggaucuuuuac

SEQ ID NO: 1971 - RNA, 77 nt, Human; identical to SEQ ID NO: 796

SEQ ID NO: 1972 - RNA, 91 nt, Human
gaugguuuuagaugauaaccacaggucuacaagagcguuuuuaguaaagugccuguguucauuguggacaaaguuauuauuuugcaacauc

SEQ ID NO: 1973 - RNA, 77 nt, Human; identical to SEQ ID NO: 1066

SEQ ID NO: 1974 - RNA, 70 nt, Human
ugcagggucugagaacaucagagugaaaaacauaauuuugucaaauaaacaugauguugucaagccugca

SEQ ID NO: 1975 - RNA, 61 nt, Human
uuacuaacguuaacaaaauuucuaauauauuugaagauguagaguuuuguguuaugagugg

SEQ ID NO: 1976 - RNA, 61 nt, Human; identical to SEQ ID NO: 1965

SEQ ID NO: 1977 - RNA, 77 nt, Human; identical to SEQ ID NO: 1066

SEQ ID NO: 1978 - RNA, 86 nt, Human
gcugccccauggcuaagcuuuauggguguuaauugaaauuuauacaccaauugauuuuaaaccauaaaaagcugaccacaggcagu

SEQ ID NO: 1979 - RNA, 74 nt, Human
uucuuuuuaaaaaaaccaauuuaaaaauaaaggcaaauaaccuaauuuuuauauaacucaaaguuuuuaaagaa

SEQ ID NO: 1980 - RNA, 77 nt, Human
agccaccuccgccaccccugccccgccgacccagcacaccuaggcagggccuguggggagugggcgccgggagugcu

SEQ ID NO: 1981 - RNA, 99 nt, Human
cugcaggucgacucggccgaguauggcugccucaaggcaucgcgcucuucacgcccgacgccuguggcucucagacccggccacguugagagccugcag

SEQ ID NO: 1982 - RNA, 112 nt, Human
gcagccccccgggcucggcgcuggcggcaguggcgagcggcggagaccucuucccggggcagccgguguccgaacugaucgcgcagcugcugcgcgcugagcccuacccugc

SEQ ID NO: 1983 - RNA, 66 nt, Human
gguggcgcugcugcgccugagcuggagcgagcucuucgugcugaacgcggcgcaggcggcgcugcc

SEQ ID NO: 1984 - RNA, 69 nt, Human
aucacagcugugccaguaauaaggaugcuaacaauuaauuuuaucaaaccuaacugugacagcugugau

SEQ ID NO: 1985 - RNA, 62 nt, Human
ucuucaaaaacaaauugcacugauaaaacaaaaacaaaaguauguuuuaaaugcuuugaagg

SEQ ID NO: 1986 - RNA, 68 nt, Human
ccaggcugcgggccaaccagagcugggaagauucgaacaccgaccucgucccggccccugcaguccgg

SEQ ID NO: 1987 - RNA, 67 nt, Human
cugguaaacaugaacuggacauuuguaagaauauauuucaauauauguacacccauuauguuuucag

SEQ ID NO: 1988 - RNA, 61 nt, Human
gcuacucagcugcuuaagcuggcccacaaguacagaccagagacaaagcaagagaagaagc

SEQ ID NO: 1989 - RNA, 72 nt, Human
ucacccgcuuugugaaauggccccgcuauaucagguugcagcggcagagagccauccucuauaagcggcuga

SEQ ID NO: 1990 - RNA, 68 nt, Human
cucacugcccuggagaaagagaggaaugacaccaccugucccguugcugacucuaaggcuuuuaugag

SEQ ID NO: 1991 - RNA, 131 nt, Human
gagaauacacaaaagagaauagauacuugaaaccacuggaaugacaguuuaucuggugauuuucuuauaaaguucuauuguuacuaguuuccuccucuaucuguacuguugcuucucuuugauuuugucuc

SEQ ID NO: 1992 - RNA, 62 nt, Human
gcugccagcccaacugcuccagugauaguuuuccaccacuucaccgagagccugggcucagc

SEQ ID NO: 1993 - RNA, 82 nt, Human
cuuuggaaaaacaguuagucuggagccuguggcccaggcccuucuguccccaggcaucaucccaacagcucauuuucccuag

SEQ ID NO: 1994 - RNA, 67 nt, Human
gccuguguccacagugcugugaucccgagggaaguccuccagucuaagucacagugcccugacaggu

SEQ ID NO: 1995 - RNA, 65 nt, Human
gccuucguucaagggucaggaauggaccagaacagauggguucuggaggccccugaacagagggc

SEQ ID NO: 1996 - RNA, 78 nt, Human
gguagugcagcuguggguggaggcuggggugucugcacgaagucaggccagcguccuccuccacagccugucacugcc

SEQ ID NO: 1997 - RNA, 82 nt, Human
cuuucugcauuuaauagguuagaauguaaauuaaaguguagcaauagcaacaaaauauuuauucuacuguaaaugacaaaag

SEQ ID NO: 1998 - RNA, 71 nt, Human
gccuugggacgugcccauuuuuacuguaaauuaugauuccguaacugacuuguaguaagcagguuucuggc

SEQ ID NO: 1999 - RNA, 83 nt, Human
ggcaugaguguuggaugccagcgaucagguaagggacaaauuuguggauugacccuuuguccugcacagcaccagacacuccc

SEQ ID NO: 2000 - RNA, 69 nt, Human
guucuggcugcugaggugcuuguccauggcaucgagagacccauaccgcgauauuucuuuagccggauc

SEQ ID NO: 2001 - RNA, 73 nt, Human
gucucugcaagcucuugagucccgccaagaugauauuuuaaaacgucuguaugaguugaaagcugcaguugau

SEQ ID NO: 2002 - RNA, 60 nt, Human
cacgaggccgacgccccaggcgugauccccgggauugugggggcugucguggucgccgug

SEQ ID NO: 2003 - RNA, 80 nt, Human
ugccaacgcagagccagcuguucagcguacucuuuuagagaaauagaagauugucggcagaaacagcccaggcguuggca

SEQ ID NO: 2004 - RNA, 62 nt, Human
auggugacaacaugcuggagccaagugcuaacaugccugguucagggauggacagucaccgu

SEQ ID NO: 2005 - RNA, 90 nt, Human
gcagaaaucuggauggccugaguuugaugacuccggggcaugggcccccauguucgagucccuccgcucuuggcaaaccgguucuucugu

SEQ ID NO: 2006 - RNA, 65 nt, Human
guggaccaggcuguugaagucuggaugcuucuacaaccacucuuccgaugaaaagccugggcugc

SEQ ID NO: 2007 - RNA, 86 nt, Human
aagguguccaggccacagucucaagggcuuucuagcagcuuggggcuccugaaagucuggcugacucugcuucucucggacaccuu

SEQ ID NO: 2008 - RNA, 76 nt, Human
ccugcucugggacagauuccgaagugggagugucauagaucaaucccguguccugaacuugggucccaucacacgg

SEQ ID NO: 2009 - RNA, 79 nt, Human
gugauguccggagauucggagcggcgauaucuggaucuaagucuccgcuccgaugugaagucuaucucugugacaccau

SEQ ID NO: 2010 - RNA, 105 nt, Human
aaugggcaacgugagguggagggaggcgggagaugaaauucuugguugaaacaauagucagaagaaaauaaucuucucauuuuuccucacuuuaguugauucauu

SEQ ID NO: 2011 - RNA, 73 nt, Human
gggacaagggagauggagguaagacagaugaacacaacacagucuuugcugaaggaggucaucccuuguaccc

SEQ ID NO: 2012 - RNA, 69 nt, Human
uacaguaaauauucauugcuguccuacuucaagccagucucaagggauauagaauugaaucagacugua

SEQ ID NO: 2013 - RNA, 82 nt, Human
aagagguggggagggauuacuuugaggcuugggaguuugagacuacucuggggcaaccauagccaagacccucccauuucuu

SEQ ID NO: 2014 - RNA, 76 nt, Human
ucauaucagugaauauuugcuaagaacaggaaagagaagucuuccuuucaaauagcuuauuguucauugggaauga

SEQ ID NO: 2015 - RNA, 64 nt, Human
ugguaggaaagcugcuuggaaauucauaaaggacgaacugggaagaauuuuauaagcgauacca

SEQ ID NO: 2016 - RNA, 69 nt, Human
acaaaaagauguaaauugugacaccaaacacauauguuauuggggguggacuaugugcagacuuuuugu

SEQ ID NO: 2017 - RNA, 95 nt, Human
gacugaguuuugcccuguugccuaggcuggagugcaauggcaugaucucggcucacugcaaccucugccuccuggguucaagugauucuccuguc

SEQ ID NO: 2018 - RNA, 65 nt, Human
agccaguggaucuuagcuugcugggcccuguggggaugggaucugcugagcuagaccacuuggcu

SEQ ID NO: 2019 - RNA, 61 nt, Human
ggcauucccggagacacugagcugugaaaaaaaaacugcugcagcuaacuuggggucugcc

SEQ ID NO: 2020 - RNA, 62 nt, Human
agcauuacauauuguagauuagcauuacagcauuaugcaauuucacacaauucauguuagcu

SEQ ID NO: 2021 - RNA, 68 nt, Human
guuuucuuuuuuuuucaaaauuugacacauuuauuuuauuuuugaguuucauuuuuacaagagaagac

SEQ ID NO: 2022 - RNA, 91 nt, Human; identical to SEQ ID NO: 124

SEQ ID NO: 2023 - RNA, 73 nt, Human
cuggugcaccuuaaggagcugaagccugugccauagccaaagcugguagccaggccauagcugaggucacgag

SEQ ID NO: 2024 - RNA, 82 nt, Human
uaggcgagcucagaucacaucauaccgcugggggucuucguaugauaucauguucugcaucccaaaucaaguggcucuccua

SEQ ID NO: 2025 - RNA, 85 nt, Human
uucacuugggcaggaagucagaggacucagacaccagcuucccaucgcgggucucgaucuucuucacaaccacggcccuggugga

SEQ ID NO: 2026 - RNA, 72 nt, Human; identical to SEQ ID NO: 225

SEQ ID NO: 2027 - RNA, 62 nt, Human
gagaacaggugaaucaguugaauuuguguguaaacggggauaucgucuuucaucacguucuc

SEQ ID NO: 2028 - RNA, 60 nt, Human
cauuggcgugauaauggauuuugcaucaaauaauuguaagggguuauccgagagccagug

SEQ ID NO: 2029 - RNA, 66 nt, Human
guacuacagauuuugccaguaagggggauuuuagacacccguaagugggcuaucaaauguuaguau

SEQ ID NO: 2030 - RNA, 62 nt, Human
caccacugggugcccgcuggcuacgcuugcaugggcgccaucuuugcuggcaccuuguggug

SEQ ID NO: 2031 - RNA, 65 nt, Human
ccgcccagucccggggaccgucccuaccgcgagggucugaggcgcggcugccccggggagggugg

SEQ ID NO: 2032 - RNA, 68 nt, Human
cagcugccuuaagccucugggcauugacguugauaucgauguggagcacggagggaaagaagccgcug

SEQ ID NO: 2033 - RNA, 81 nt, Human
gccaaaaugggaaaggaaaagacucauaucaacauugucgucauuggacacguagauucgggcaaguccaccacuacuggc

SEQ ID NO: 2034 - RNA, 60 nt, Human; identical to SEQ ID NO: 1551

SEQ ID NO: 2035 - RNA, 68 nt, Human
cguccaaaacucauccucuuccccaaggaagcccucgggccccaaagaaggggagacaguucugcuug

SEQ ID NO: 2036 - RNA, 60 nt, Human; identical to SEQ ID NO: 1551

SEQ ID NO: 2037 - RNA, 75 nt, Human; identical to SEQ ID NO: 74

SEQ ID NO: 2038 - RNA, 130 nt, Human
uacacuaaaagugguauauauauauauauauauacacuaaaagugguauauauauauacacuaaaagugguauauguauauauauacacuaaaagugguauauguauauauauacacuaaaagugguaua

SEQ ID NO: 2039 - RNA, 83 nt, Human
cggaggcugcggcugcagaaguaccgccugcggaguaacugcaaagaugcuguccgugcgcguugcugcggccgugguccgcg

SEQ ID NO: 2040 - RNA, 75 nt, Human
gagauguccucuauucuugaagagcguauucucggagcugauaccucuguugaucuugaagaaacugggcguguc

SEQ ID NO: 2041 - RNA, 87 nt, Human; identical to SEQ ID NO: 76

SEQ ID NO: 2042 - RNA, 71 nt, Human; identical to SEQ ID NO: 77

SEQ ID NO: 2043 - RNA, 75 nt, Human; identical to SEQ ID NO: 74

SEQ ID NO: 2044 - RNA, 87 nt, Human; identical to SEQ ID NO: 76

SEQ ID NO: 2045 - RNA, 71 nt, Human; identical to SEQ ID NO: 77

SEQ ID NO: 2046 - RNA, 87 nt, Human; identical to SEQ ID NO: 76

SEQ ID NO: 2047 - RNA, 75 nt, Human; identical to SEQ ID NO: 74

SEQ ID NO: 2048 - RNA, 87 nt, Human; identical to SEQ ID NO: 76

SEQ ID NO: 2049 - RNA, 71 nt, Human; identical to SEQ ID NO: 77

SEQ ID NO: 2050 - RNA, 68 nt, Human
ggagugcaaguagcugaugaaguaugucgcauuuuuuaugacaugaaaguucguaaaugcuccacacc

SEQ ID NO: 2051 - RNA, 60 nt, Human; identical to SEQ ID NO: 1551

SEQ ID NO: 2052 - RNA, 63 nt, Human
uguucuuuauuguccuaaaauugcauaguacuuuugauugugcacgcuuuuaaauagagagca

SEQ ID NO: 2053 - RNA, 64 nt, Human
gcgcucacuugucuucaggaagcucggagccuuugguggagccggggagaggaagggugggugc

SEQ ID NO: 2054 - RNA, 94 nt, Human; identical to SEQ ID NO: 807

SEQ ID NO: 2055 - RNA, 77 nt, Human; identical to SEQ ID NO: 796

SEQ ID NO: 2056 - RNA, 102 nt, Human
agcuggccuucaaccuggacuacuacacagagguucuaggaccucuccuaccugcuugaccaccuggauuucugacccuuucuuccgacacuaacgccagcu

SEQ ID NO: 2057 - RNA, 79 nt, Human
cggcgcggcuaccugccccguuuucccugugaguugaccugcuccgggccgcgggccgccaauggcaggggccgcuccg

SEQ ID NO: 2058 - RNA, 74 nt, Human
gcgugccaagcucgacccccuccgcggccacuacuuccucuucgacugcccaggccagguggagcucugcacgc

SEQ ID NO: 2059 - RNA, 71 nt, Human
gugcccuaaggccccuaacucuugcuggcuguuucuugaccccaagccaggguugggaguccucugggcau

SEQ ID NO: 2060 - RNA, 73 nt, Human
cuuuccuuuguccuggagccucagcagccauaaauuugaaucugcugucuuauuguuccaggacuucagaaag

SEQ ID NO: 2061 - RNA, 62 nt, Human
guggaagcuuguuuaauaucgcucuaccaucauccugaaaggcauaauaauuugaguuacac

SEQ ID NO: 2062 - RNA, 70 nt, Human
uucaagguaguauuaaguguccauauuucucaagccacauucaaggaaaucaugucuuaacuauuuugga

SEQ ID NO: 2063 - RNA, 60 nt, Human
uugcaugcaaguugcugagcugaagggaaagaugauccgcguacugguaaaaagcugcaa

SEQ ID NO: 2064 - RNA, 77 nt, Human
cuccuugcccaaauuugcccccugugugcuacaugaucggaugacucauaacucuaagggccugguuaagcaagcgg

SEQ ID NO: 2065 - RNA, 60 nt, Human
gggauaguuuuggcucccuuggaggcuauguaggcuugucccgggaaagagaacuguccu

SEQ ID NO: 2066 - RNA, 60 nt, Human; identical to SEQ ID NO: 1551

SEQ ID NO: 2067 - RNA, 61 nt, Human
uugucgucauuggacacguagauucgggcaaguccaccacuacuggccaucugaucuauaa

SEQ ID NO: 2068 - RNA, 61 nt, Human
ggugacaacaugcuggagccaagugcuaacaugccuugguucaagggauggcaaagucacc

SEQ ID NO: 2069 - RNA, 79 nt, Human; identical to SEQ ID NO: 1810

SEQ ID NO: 2070 - RNA, 79 nt, Human; identical to SEQ ID NO: 1810

SEQ ID NO: 2071 - RNA, 79 nt, Human; identical to SEQ ID NO: 1810

SEQ ID NO: 2072 - RNA, 70 nt, Human
cggagugucgguggugaugggcaucccgagcgugcggcgcgaggugcacucguaccugacugacacucug

SEQ ID NO: 2073 - RNA, 67 nt, Human
cuucuacccugacuucucccgccuccgagaguccuuuggggaccccaaggagagagucagguggagg

SEQ ID NO: 2074 - RNA, 68 nt, Human
gagaaggaugcgaagcacugugaccggcagaaagccaaccugcggauccgcuucaaaccgucccucuu

SEQ ID NO: 2075 - RNA, 61 nt, Human
guuaugucugggcuguagcuguggucacgugaagaugacagacgaugagcuuguguauaac

SEQ ID NO: 2076 - RNA, 60 nt, Human
ggugacaacaugcuggaaccaagugcuaacaugccuugguucaagggauggaaagucacc

SEQ ID NO: 2077 - RNA, 61 nt, Human; identical to SEQ ID NO: 2067

SEQ ID NO: 2078 - RNA, 65 nt, Human
ccgcagcgaaugaaggcgaacaacgcgagaaccccugaagccuggucccuucauccucgcugugg

SEQ ID NO: 2079 - RNA, 129 nt, Human
uuggacucagaggccggggcucugcgugguuugcuugggagguggagcugcagcgucagagcgccugugacugcguuccaugcggccuauguucacuacugcaguaaucucugggcgccuggguaccag

SEQ ID NO: 2080 - RNA, 61 nt, Human
ccaagggaucugcccaccauuccgggggucaccagcccuuccagugaugagccccccaugg

SEQ ID NO: 2081 - RNA, 73 nt, Human
cuuaggugaugugcuugggaaagucccucccccucuucccaagagacggacauacaagccacgucggccuagg

SEQ ID NO: 2082 - RNA, 81 nt, Human
ggguggugcucggcgacggcgugcagcucccgcccggggacuacagcacgacccccggcggcacgcucuucagcaccaccc

SEQ ID NO: 2083 - RNA, 79 nt, Human; identical to SEQ ID NO: 1810

SEQ ID NO: 2084 - RNA, 75 nt, Human
ucuuuuuuaaaugaauuaaauauugaaacacugugcaccauaguuuacaauauuauguuuccuauuaaaauaaga

SEQ ID NO: 2085 - RNA, 115 nt, Human
cugggucuugcugugcccucccaggcuuaguguucccucccucaaagacugacagccaucguucugcacggggcuuucugcauguaacgccagcuaagcauaguaagaaguccag

SEQ ID NO: 2086 - RNA, 65 nt, Human
gcugcugcgguugccauugcuucuugccuguucuggcaucaggcaccuggauugaguugcacagc

SEQ ID NO: 2087 - RNA, 77 nt, Human
aguugcugcagagggagaaggacaggcagugucguggccuggagcucauugccucagagaacuucugcagccgagcu

SEQ ID NO: 2088 - RNA, 64 nt, Human
cgguuuagcuguggugggucuuguccagccaagacuggcucauuugacuacgacagguggacug

SEQ ID NO: 2089 - RNA, 61 nt, Human
guggagugcaccugggguugggggcacugugcccccagcccccugcuccuuuggacucuac

SEQ ID NO: 2090 - RNA, 80 nt, Human
gcugggaccugcugagacucccccuggagcgggagcagaauggagacagccaccauucaggggacuggcgggggcccagc

SEQ ID NO: 2091 - RNA, 81 nt, Human
gguaggcgguggcuggcgguccgcccgagcccagcgcagugccagcuggugcgagcuuagggccuguugccaccgcaggcc

SEQ ID NO: 2092 - RNA, 65 nt, Human
gucuugcuaggccaggucuuccaggugguuaccggggucacauggauuucugggcggagcgagau

SEQ ID NO: 2093 - RNA, 84 nt, Human
aggaguaguauuugucaucaauccuguacauguagugauacaucgggacugcggguuauaagagagauggacggagacauuccu

SEQ ID NO: 2094 - RNA, 92 nt, Human
cuguggcggggugccuugcccuugugggaccgcccucuuuucggcacgaggucggguuaggguccugggacaagugcggcacgaggcggcgg

SEQ ID NO: 2095 - RNA, 93 nt, Human
ugauguguccuuugcuuuuggugcaguuauguugcuuacuaugcacuauacaauagacuacucauaacaacacauauauaaaaagacacacca

SEQ ID NO: 2096 - RNA, 83 nt, Human
ggagcuggaguucaggaggagucagaagaggcuuucagccuggucggggcugggccucaaggcuaaaguuuuacuuaggcucc

SEQ ID NO: 2097 - RNA, 71 nt, Human
ugucaggcucgggcucuggggccuacaaggagccagccauccucguggggccugagaaccucacccugaca

SEQ ID NO: 2098 - RNA, 71 nt, Human
uuuuauuuuuuuuuggcccccuuggaguuuuggguuucaaauuggggaaaaaguggguuauacggauagga

SEQ ID NO: 2099 - RNA, 71 nt, Human
cccggccuccacaggugccaaaacuaaucgggcagacccuaaaaagucugccagucgcccugggagucggg

SEQ ID NO: 2100 - RNA, 72 nt, Human
cccuuuguagaaucggcacccaauacgcgacgugggcgagcugccaugucacgucgggacucggacaaaggg

SEQ ID NO: 2101 - RNA, 73 nt, Human
cccacucuugaagaagaaggcggcuccuccgggguccaaggugguuggccgcgucuucucccucggaagcggg

SEQ ID NO: 2102 - RNA, 85 nt, Human
aagaggagauaccguagucuagaugucuugagguagaauauaugauggaccacauaguuuaagauuacaagguacuuucccucuu

SEQ ID NO: 2103 - RNA, 80 nt, Human
cucuuguacuugguugcaaacucagaucucuagucuagucuagucuagucuagucuagucaugugugacuguguacugag

SEQ ID NO: 2104 - RNA, 91 nt, Human
uauuuaaugucuuuuuaggaucauaaacauaaauaggucugugauauucaggccuucagaauuuaaggguuuuaaauauagcauucagaug

SEQ ID NO: 2105 - RNA, 62 nt, Human
uccaaugacucuuucuuuaacuuuuuugccccuccugaaguuccugagaguggagaucugga

SEQ ID NO: 2106 - RNA, 67 nt, Human
ucugagagaggcaggcucgcugcagaugggaacagggcuccucucacaguaugccugggcucuugga

SEQ ID NO: 2107 - RNA, 95 nt, Human
gcaguucuugugcuaugggugggagucuucuuccucaaguuucggcagcugugcugcugcuggaugggcugcuccucccagggcucaagggcugu

SEQ ID NO: 2108 - RNA, 62 nt, Human
ugcugcuucuaacagauggccaggaggugacaccgauuucagccauuugccaagguuuagca

SEQ ID NO: 2109 - RNA, 88 nt, Human; identical to SEQ ID NO: 1837

SEQ ID NO: 2110 - RNA, 62 nt, Human
gaagcaguuuuaagauucuugaaggcaaaauuugaaaaacagugaauacuucuaauuguuuc

SEQ ID NO: 2111 - RNA, 74 nt, Human
caguuaagcuuucaugguauguaauuuuccagccuuuugagaaaacaagcauacuauaagugagagcuguuuug

SEQ ID NO: 2112 - RNA, 78 nt, Human
gggugacaugugaucguuuaaauggcauuaagugaauaaagcacacaaacagugcuacucuugaacacuauuuuaccc

SEQ ID NO: 2113 - RNA, 66 nt, Human
uguuuucaccccaacuaucuggugcuauugaaugacuaauucagucccuaaaguucugugaaaaca

SEQ ID NO: 2114 - RNA, 64 nt, Human
ugcaagagaauauuggcaauggagacuucucuguguacagugccagcacccacaaguucuugua

SEQ ID NO: 2115 - RNA, 74 nt, Human
ccggguuggccugaaccugcuuuaugcucagacgguaucagauauugagcguggguggaucuuggucaccaagg

SEQ ID NO: 2116 - RNA, 67 nt, Human
aagauuaccuaggaacaguacgauuugggguuaucacaaauaaacaucuugcgaaacugguauccuu

SEQ ID NO: 2117 - RNA, 66 nt, Human
ggcgaaccugaaaaguuaggucaggcguugacugaagucuaugccaaggccaauagcuucaccguc

SEQ ID NO: 2118 - RNA, 72 nt, Human
gugcaagcccuguugugcuuguauauaauacauguacucucacagaccccaaaacagcugcuuuaaauguac

SEQ ID NO: 2119 - RNA, 64 nt, Human
uacucccuuaauagcuuuaaagacaugcucgccugagaguuaauuuuuggggaaaaagcaagua

SEQ ID NO: 2120 - RNA, 63 nt, Human
agcuaaugagaccaucuuuugcgagcuggggaaccccuucaaacggaaccagaggauggagcu

SEQ ID NO: 2121 - RNA, 100 nt, Human
gccacaccacuacggugaccaucguggaccagaugacacuugggcugcgcuagcuggaggacacauuuggcaaugaugggcagaacccguguggccuggc

SEQ ID NO: 2122 - RNA, 79 nt, Human
gcuguggcaggcgccagcaccagaccugaagcaccccgaacagcaggaccucuucaacuggugcugguacccccacagc

SEQ ID NO: 2123 - RNA, 64 nt, Human
ucucggagagcaggacaucgaauguaaagcgcagaugggacuucgacaggcuucuucucuggga

SEQ ID NO: 2124 - RNA, 89 nt, Human
ggcgcagcuggccugagcugggcgagagguggcagagggcagucauggccucugcugcccaauagccuuccuucuccaccagcggcgcc

SEQ ID NO: 2125 - RNA, 69 nt, Human
gucuugaacccaucuuucuauggcaugccugggcacacccacaccaugauccaugagauuggucacagc

SEQ ID NO: 2126 - RNA, 86 nt, Human
gagcaagauuuuugucucaaaaaaagaaaaaaaaaaaaaaaagaggacuuccuguacuuuaaguugauuuugauaauuauuugcuc

SEQ ID NO: 2127 - RNA, 62 nt, Human
ggcuuccuguauguggcugggcuugguggcucacaccuguaaucccagcacuuugggaggcc

SEQ ID NO: 2128 - RNA, 68 nt, Human
gugucacacuaaaggauucggauguagcuuugcccauuauugagaauuauaaggaucgguuguggcac

SEQ ID NO: 2129 - RNA, 70 nt, Human
gagacuacgggagggacagacacuucgggacucaaugcuuaaguauccagauagucaccagcccaggauc

SEQ ID NO: 2130 - RNA, 70 nt, Human
gacagaauuguacccuguaaccauaaauauguagaauuucuaccauaucaauaagguauaaguuucuguu

SEQ ID NO: 2131 - RNA, 63 nt, Human
uuugggccgcccucggcccccagaaaaguuuuucaaaaccucuuuugggcgccgggccccaga

SEQ ID NO: 2132 - RNA, 67 nt, Human; identical to SEQ ID NO: 1347

SEQ ID NO: 2133 - RNA, 69 nt, Human; identical to SEQ ID NO: 1348

SEQ ID NO: 2134 - RNA, 76 nt, Human
gaagcugaagaagccgcccugguugcacaugccgucggccaugacuguguaugcucuggugguggugucuuacuuc

SEQ ID NO: 2135 - RNA, 87 nt, Human
gaaggaaauaugaaaauuaggauuucagauguuugaacauaaaagauaauuuuaaacauugucaguaaucuauuucuuuuuuuuuuc

SEQ ID NO: 2136 - RNA, 83 nt, Human
caccuguaggaggccagguacaaguucgugcaaagugagaaagaucuuugugggcacgauaaugguaacucccucaucuggug

SEQ ID NO: 2137 - RNA, 66 nt, Human
gagaggcacccuggaucuuuugacgugguucacgugaaagaugccaauggacacaguuugcgacuc

SEQ ID NO: 2138 - RNA, 69 nt, Human
gcaugccauggcucgugguacccaaugaagcaucugaagcgguguggucagcuccaaagcuauggaugc

SEQ ID NO: 2139 - RNA, 60 nt, Human; identical to SEQ ID NO: 1551

SEQ ID NO: 2140 - RNA, 67 nt, Human
ucucaaucauugcuuugugcacgcggaucagguucgccuggacaugcgucauugcuauucauccaga

SEQ ID NO: 2141 - RNA, 75 nt, Human; identical to SEQ ID NO: 74

SEQ ID NO: 2142 - RNA, 87 nt, Human; identical to SEQ ID NO: 76

SEQ ID NO: 2143 - RNA, 72 nt, Human
augccaccaaggcccgggcccaugggcuggagguggagcccucagcccuggaacaaggcuucaggcaggcau

SEQ ID NO: 2144 - RNA, 83 nt, Human
cacaggauguucccuuuguuggcaaaaacauggacggaacuucugaaacaugugagagaaaccauaaagaggaauacuaugug

SEQ ID NO: 2145 - RNA, 84 nt, Human
uuuguuugugacuaugaaggguguggcaaggccuucaucagggacuaccaucugagccgccacauucugacucacacaggagaa

SEQ ID NO: 2146 - RNA, 62 nt, Human
acucguccaacugacaagcccuugcgcccugccucuccaggaugucuacaaaauuggugggu

SEQ ID NO: 2147 - RNA, 74 nt, Human
cuuccuuuuuccagaauuugaaauuguaauagaaacagaagaugagauuaugccugagguuguggaaaaggaag

SEQ ID NO: 2148 - RNA, 67 nt, Human
gauacacaauuuugucaguuuacuuacagugcauacucuuggguaguacuugugcugaccaaguauc

SEQ ID NO: 2149 - RNA, 63 nt, Human
uugagguucuggguauaacuuucuuugguccccuaauauuaaauuuuaccauuugagccuuga

SEQ ID NO: 2150 - RNA, 76 nt, Human
cuuaaacuuccuccaacuuucuucugcuacaagaauagaccagauuauguuagugaagaagaggaggaugaugaag

SEQ ID NO: 2151 - RNA, 72 nt, Human
agccucuucccgguuccauuucccaccucuggacacccauucuccaaccaaugaugugcagccgggacgguu

SEQ ID NO: 2152 - RNA, 65 nt, Human
caagcuggugaugcccaacuacccauucaucaacauucggucaaguggugugguuccucagagug

SEQ ID NO: 2153 - RNA, 61 nt, Human
uaguucaguucuuucaaggguuggaaaucgugccaaaugggauaacauugacgauggacua

SEQ ID NO: 2154 - RNA, 75 nt, Human
ggcugcggcugcagaaguaccgccugcggaguaacugcaaagaugcuguccgugcgcguugcugcggccgugguc

SEQ ID NO: 2155 - RNA, 87 nt, Human; identical to SEQ ID NO: 76

SEQ ID NO: 2156 - RNA, 71 nt, Human; identical to SEQ ID NO: 77

SEQ ID NO: 2157 - RNA, 76 nt, Human
gugcugaccccaggaggggaggggccggccaccaucaagacguuccggacgccggagcucccacccucuucagcac

SEQ ID NO: 2158 - RNA, 106 nt, Human
ggcgagugccucaauggaagcgguacuuucuggcuggcuugagguugauguauguggccuucaucuccucggccucaggguuccgcacaucuuugaaucgcucccc

SEQ ID NO: 2159 - RNA, 60 nt, Human
cuuuucaaggauaggcuuuauucugcaagcaaucaaauaauaaaucuauucugcuaagag

SEQ ID NO: 2160 - RNA, 97 nt, Human
gcugagugaacugcacugugacaagcugcauguggauccugagaacuucaagcuccugggaaaugugcuggugaccguuuuggcaauccauuucggc

SEQ ID NO: 2161 - RNA, 66 nt, Human; identical to SEQ ID NO: 12

SEQ ID NO: 2162 - RNA, 70 nt, Human
cugugucaggaaagucgcucagaugggaagccguguccggcuuuuaagaucgugauucuggaugaagcag

SEQ ID NO: 2163 - RNA, 75 nt, Human
uuuuuuuuugccauuugcuauguuuuauuuugcuaguagcuuauuaaacauaacaugcaaauaaucaaagagaaa

SEQ ID NO: 2164 - RNA, 99 nt, Human
cuaggcugucuuuggcgaggagggccccugcggaaucguggucuauauccccgauacauauucugccucacuggucuaccuuguucuacugcacccugg

SEQ ID NO: 2165 - RNA, 121 nt, Human
ggucuaccuuguucuacugcacccugguugucagcacccuccaucacuucucccugcacaggaggguuggaauacuguggucgacgcccauagggucuccgcauguaguaaggugggaacc

SEQ ID NO: 2166 - RNA, 61 nt, Human
gccauguacguugcuauccaggcugugcuaucccuguacggcucuggccguaccacuuggc

SEQ ID NO: 2167 - RNA, 86 nt, Human
uaaagaaaauguaauucgagcugguuagcuuaauuuugugccauucuuuaacauaagaguaagcucuauuaugaaauacaacuuua

SEQ ID NO: 2168 - RNA, 69 nt, Human
gaaaucacuuaaacuagcaauugcccuuauaaaguggaugauacacugggcuuuugcuuuugugcuuuu

SEQ ID NO: 2169 - RNA, 86 nt, Human
gaccaacaagaugauuuuagcguggacuaggacacuuaaccuaagaagaguuucacuuaaucauucaaaucacuaucugaaggguc

SEQ ID NO: 2170 - RNA, 64 nt, Human
uccugcagacggugagcagugagaagguccgcuccacuaaucucaacugcucagugauugcgga

SEQ ID NO: 2171 - RNA, 74 nt, Human; identical to SEQ ID NO: 365

SEQ ID NO: 2172 - RNA, 102 nt, Human
gaaacagacugggccaauguccacaaagaauuccuggucagcaccaccgauguccaaaggugcaauaucaaggaagggcaggcgugauggcuuauuuguuuu

SEQ ID NO: 2173 - RNA, 86 nt, Human
gauugugugcccccccgaggccgugccggcugccagcaggcccuucgucgcucgucagcgggccguuuccuccaaggcacgucguc

SEQ ID NO: 2174 - RNA, 75 nt, Human; identical to SEQ ID NO: 74

SEQ ID NO: 2175 - RNA, 84 nt, Human
gcguccggcugcggcugcagaaguaccgccugcggaguaacugcaaagaugcuguccgugcgcguugcugcggccgugguccgc

SEQ ID NO: 2176 - RNA, 87 nt, Human; identical to SEQ ID NO: 76

SEQ ID NO: 2177 - RNA, 71 nt, Human; identical to SEQ ID NO: 77

SEQ ID NO: 2178 - RNA, 60 nt, Human
acuagcaacucugugacuacauuuauuuuuauuuuuuuuagagacaggaucuugcuaugu

SEQ ID NO: 2179 - RNA, 99 nt, Human
gagacaggaucuugcuauguugcccaggcuagagagcaguggcuuuucacagacaaagucauaaugcccugcagucuugggcucaagcgauucucucuu

SEQ ID NO: 2180 - RNA, 67 nt, Human
auuauuaaauauauaagcagcuuccuaucuuuuaaauagauauuuaaaugacuuuauauaaaauaau

SEQ ID NO: 2181 - RNA, 99 nt, Human
ugaccuuuaaaauauuauauguuuaagguagggggggaugaaggggggaaugcccuuuuuauuuuucuucccauuuuaaaaauauguguuuucuaggca

SEQ ID NO: 2182 - RNA, 61 nt, Human
uguccucucuugacuucucagagaacagaagggguuccugagcagguagccuggggggaca

SEQ ID NO: 2183 - RNA, 76 nt, Human
cuggccaggcgguggguucucucuagcuuuaguucuacugcaacguucagagcaggcccauagucuuacaggccag

SEQ ID NO: 2184 - RNA, 78 nt, Human
uggaugaguacgaccccgaggacacguggcaggaugaagaguacuucggcagcuauggaacucugguauugcuuucua

SEQ ID NO: 2185 - RNA, 91 nt, Human
auuauuucuguguauauauguuccaaagaaaugcggcuuguauauucaugcuuuucaacuuuuugugauagacaguugauacacaaguagu

SEQ ID NO: 2186 - RNA, 80 nt, Human
cuguccgguugaaacacaacgcgaggaucgggcgugguggcucacgccuguaaucccagcacuuugggaggccgaggcag

SEQ ID NO: 2187 - RNA, 67 nt, Human
cuguuugguagaugcauguuuuuuguuacuuguaauguacaguauucaguucauuuucuuuuugcag

SEQ ID NO: 2188 - RNA, 62 nt, Human
gcugccgcguggcggacacgccagaaggaggaggccuggggcauggccgcguguguggcagc

SEQ ID NO: 2189 - RNA, 66 nt, Human
uaaggcagugaaauucacaaucugcaguuaaaauauaaaagcagcaauucuauguucauagucuug

SEQ ID NO: 2190 - RNA, 74 nt, Human
uaauugcaauggaguugacguuuucccuccuuuuugguuuuaggaggggaauuauuugaaucgugguguaauug

SEQ ID NO: 2191 - RNA, 65 nt, Human
cugccaucauggagcaccugcgggaauuccuguuaacaggccgugaggaccuucagccugugcag

SEQ ID NO: 2192 - RNA, 70 nt, Human
cucugccaauccugccaugcagcuugaccgcuucauccaggugugcacccagcugcaggugcugacagag

SEQ ID NO: 2193 - RNA, 76 nt, Human
gccuuccuccagcagcagggaggggaggacuggcugucucagaaucuuuuaaaagcccugcugucugaggaccugc

SEQ ID NO: 2194 - RNA, 78 nt, Human
ggacuuuuauuuccaccuguugacaggacagcaggaggacugccugcccuuccuggucugacgguugcuguguuguuc

SEQ ID NO: 2195 - RNA, 73 nt, Human
gaugucagaguuuauuuauuaccucuguuguucacaggaagaaacuagggguaucuuaaaaucuucugacauc

SEQ ID NO: 2196 - RNA, 98 nt, Human
auuuauuuuuuguuaucaaagagaauguccagaaacauugaguacuaaagaauuuguucauggcauuguuuuacaaaauuuucuaauggagagugaau

SEQ ID NO: 2197 - RNA, 85 nt, Human
agaugccaggcauguaugcaacagagaaaauccagcugcacagaaacccuguggaggagcagcucaguccagcgugaaggcgucu

SEQ ID NO: 2198 - RNA, 65 nt, Human
auauuuuucuagaaagaacauauuuggcauuuuaaaauaauguuaaaaacagcuuucucaaaugu

SEQ ID NO: 2199 - RNA, 100 nt, Human
ugcugcucuuugucagaauaugucagaaaacaaaacaaaaaaaguuuuaaaugcuaaagauuuuaaaaauuaguucucugaaauuucuguaaagccagua

SEQ ID NO: 2200 - RNA, 67 nt, Human
ugaacucucagucacguggaagccacgggacugcuccgaagccgccauaauaaaaucugauuguuca

SEQ ID NO: 2201 - RNA, 84 nt, Human
gucuucaaaaugggguuuauaguaucaagugaggcuguuugguucuucugaaaacacacucauuuucugacacaugggcuagac

SEQ ID NO: 2202 - RNA, 90 nt, Human
uaggcaccuauuaaaacaucacagaacagguuauauugugguuugaagaacuggauauuccccaauguuuuaacugaguuuaugugccua

SEQ ID NO: 2203 - RNA, 64 nt, Human; identical to SEQ ID NO: 1375

SEQ ID NO: 2204 - RNA, 61 nt, Human
cccaguagccucaagcagcaccaauggggaugacccugacaggugcccucaggggucuggg

SEQ ID NO: 2205 - RNA, 66 nt, Human
caagagaggaagagauggcagcuuuuuaagugaaauuuuaaucuuaucuaucuuuuguucauuuug

SEQ ID NO: 2206 - RNA, 83 nt, Human
caggggggugcgagcugguauggaugcccuccugggguuccugggggcucugcacauccagacuccaguuuguccacccccug

SEQ ID NO: 2207 - RNA, 76 nt, Human
gacuggugaggugggacccagcccaggccucgcuggcaccuccagcugccugccuauggucccacuggcauugcuc

SEQ ID NO: 2208 - RNA, 83 nt, Human
gagccggccagcccugacaguccaaaggguuccucgggagacagagaccgagccuccuguggcccuggccccugguccagcuc

SEQ ID NO: 2209 - RNA, 97 nt, Human
guaucauuucugauauaaaguuacuuaaaaaaauccagggucuuggggaauucacaaaucauaacuaggaagguaacuuuuauuaauuuaaugguac

SEQ ID NO: 2210 - RNA, 74 nt, Human
gaagguauuuguuuuucggucuuugaggaagaaccacaccguuuuccacaacgguugaacuaauuuccacuuuc

SEQ ID NO: 2211 - RNA, 108 nt, Human
uguguaagcauuccuuuuucucugcaaccucgccagcaucuguuuuuuguuuguuuuuugagacggaguuuugcuuuuguugccuggggcugggagugcaauggcacg

SEQ ID NO: 2212 - RNA, 67 nt, Human
aaguccuuuuagguggcccuuccaguugaggcaucuccuuagauuuaggccuuccucuuuugggcuu

SEQ ID NO: 2213 - RNA, 99 nt, Human
augguugucacuuucagauucuagcuugcuuggacuuucaguggcaacaaauggagccacugacaguacagguggcuucaucuugacuggugaccucau

SEQ ID NO: 2214 - RNA, 67 nt, Human
ggucacucauacuacagacacuuggccuaugacugucaucuaggucaucuggauccugaaguugauc

SEQ ID NO: 2215 - RNA, 62 nt, Human
guuugaaggaagggauuucaauuucuggcuguaaaauuggggguucuuguucuuccuuagac

SEQ ID NO: 2216 - RNA, 71 nt, Human
caaggagagagcugggcuuuccaaguuaccugaccuuaaagaugcugaagcuguucagaaguucuuccuug

SEQ ID NO: 2217 - RNA, 77 nt, Human
gacucugaggccuggagugugcucaccucucuaauccggaagaugggaagagcauuaaugcuggaggccacaagguu

SEQ ID NO: 2218 - RNA, 69 nt, Human
gaagcuaagcaacugcaucaucagccacauucaaucgaauuaauacuguuguccccaguccguaguuuu

SEQ ID NO: 2219 - RNA, 109 nt, Human
uugagacagacagggucuugcucuguugcccaggcugggaaugcaguggcgccaucuuggcucacugcaaccucugccucccggguucaaggcaagucuugcgucucag

SEQ ID NO: 2220 - RNA, 98 nt, Human
gauucuacauuauggugaguuguagaauuauuuaauuauauauuacaaaguaaugauaguagaaauaaaguacacaauaaauguaaugugcuagaauc

SEQ ID NO: 2221 - RNA, 102 nt, Human
aguaggcauacaauaaccuaaagaucucauagaaguauacugagagucuaaaauacauucuaguagugcaugucuuggugugcuuuuguuuguuugcuuucu

SEQ ID NO: 2222 - RNA, 76 nt, Human
cuugaaugauaagcuugccuugcucuuuggaaaaugaugauuguuauuacagaagugaaacaaacuucuauucagg

SEQ ID NO: 2223 - RNA, 70 nt, Human
gguggacagaaagaguuuguaugccgcaagacaauauuuuguucaguggugugcagacagaaauuucacc

SEQ ID NO: 2224 - RNA, 67 nt, Human
aggaagaaggauuacuaaauuagaucagauuuugcuaaauggaaauaauauaacaaugcugguuccu

SEQ ID NO: 2225 - RNA, 83 nt, Human
cuggguaauggugggucuuaauggaggcuggguggaccacugcccguccacucuucaacaggaggaacagcaugccaccacag

SEQ ID NO: 2226 - RNA, 78 nt, Human
gcucagccuuuuccccacucuuaaauacuguacuacuucacuguaagaacgaaagaauaguuaggauaccaauugagu

SEQ ID NO: 2227 - RNA, 77 nt, Human
ggguuccuguucacucuugacucuguggcaaauuguauuuacaguagaccgcugacguuucccaaguggacagaucc

SEQ ID NO: 2228 - RNA, 64 nt, Human
aaaauuauuacuguaagaaauaguuuuauaaacaaauuauauuuuuauucaguaauuuaauuuu

SEQ ID NO: 2229 - RNA, 66 nt, Human
aguauuucacuuuucucgaucacuaaacauaugcauauauuuuuaaaaaucaguaaaagcauuacu

SEQ ID NO: 2230 - RNA, 118 nt, Human
guaucagaggggccaguagagcuugggacagaacgacacagaaacuuggguguuaggguaacuugacuuauugcaccuaguauuuccagacuuucccacuucuuauacucuucuuuac

SEQ ID NO: 2231 - RNA, 82 nt, Human
uaaguguagacuuaauaccaugugacauuuaauccagauuguaaaugcucauuuaugguuaaugacauugaagguacauuua

SEQ ID NO: 2232 - RNA, 63 nt, Human
ucuguauuuuaaaggauccaacagaucaguauuuuuuccugugauggguuuuuugaaauuuga

SEQ ID NO: 2233 - RNA, 78 nt, Human
aaacauguucaccuaaaugcacuugauggguguugaaauguccacccuuucuuuaaauuuuuaagaugaaauuaguuu

SEQ ID NO: 2234 - RNA, 79 nt, Human
agaugucuuauuauuaaaguuaccuauuauuguuggaaauaaacuaauuuguauggguuuagaugguaacauggcauuu

SEQ ID NO: 2235 - RNA, 73 nt, Human
ggcuugauuugcuuggugaccgaauuacuaggugacuaguuuacuaacuaggucauucaaggaacgucaaguu

SEQ ID NO: 2236 - RNA, 68 nt, Human
agucuauuccagguagacaggccugcaggggguccaaccccuacaggccccucugucuggaauagacu

SEQ ID NO: 2237 - RNA, 62 nt, Human
uagaaagcagaccuguuucaggguucggggaagguuguucgauaugaacuggguccucucua

SEQ ID NO: 2238 - RNA, 63 nt, Human
ugacuucuuccuagaaagaauggaagaauguuuauguuagaacauuuuaucuauucuuuguca

SEQ ID NO: 2239 - RNA, 89 nt, Human
gcuggugggggauaaucugcagucuuacuuuuaaguuagaaacaccaauaaauuuaguauacagacgacagugaacuuucacuuacagc

SEQ ID NO: 2240 - RNA, 80 nt, Human
ggggaacacaggagcguaccacuacacuugggcugauuuuuuguaaauuuuguaggagacagggucucccuguguugccc

SEQ ID NO: 2241 - RNA, 63 nt, Human
cggcgcguggggcucgcgcggcccagucaugcucacgcccccccucgcgcgccucacgccccg

SEQ ID NO: 2242 - RNA, 63 nt, Human
gaaacguggaacgggauacaccaaagugguugaucaccaccaugccccagcccccgcguccuc

SEQ ID NO: 2243 - RNA, 67 nt, Human
gggcaccgcgagagcguacuuacaucggggucccgacaggugucccucccggcgccucguguugccc

SEQ ID NO: 2244 - RNA, 81 nt, Human
guuuuauaauuccuuaaaacagcugaaaauugggacaacauacuuuacgcaaugaacaguaguuaaauagggaaauaaaac

SEQ ID NO: 2245 - RNA, 60 nt, Human
cuguaguucuaaguauuaguaaauauuaaugguuaauuaguauuaaagauuaggcuauag

SEQ ID NO: 2246 - RNA, 74 nt, Human
gcagguucuggagaacacuucagugccagcauuaaccgauuagcugcugggcuguggggaguuuccagagaggc

SEQ ID NO: 2247 - RNA, 120 nt, Human
gagcaaagguuuuuaguaauugaauuucucugcaguaguccuucaagcacuugaauguaaaccuuuagcauuuauucguuuaaugacuacugauacgaaucucaagcagauuucuugcuc

SEQ ID NO: 2248 - RNA, 71 nt, Human
uuauguuucacugaguucugguuuguguagcuauauuuuauauagcuagauauuccucacagugaacauga

SEQ ID NO: 2249 - RNA, 90 nt, Human
uuggccccgcccgagaagagaagggcuuuuucagaaccgcucuuguugcuuuccaaaaagccggccgucuacaaacacggggggggccaa

SEQ ID NO: 2250 - RNA, 68 nt, Human
uuuuuugaaagccacuauuuuaugaaccaaguagaacaagauauuugaaauggaaacuauucaaaaaa

SEQ ID NO: 2251 - RNA, 85 nt, Human; identical to SEQ ID NO: 866

SEQ ID NO: 2252 - RNA, 71 nt, Human
uuguuaaccuuguaagauggauaauguguauaagaauguaggccuuaacuauuucacaugagucaaaacaa

SEQ ID NO: 2253 - RNA, 64 nt, Human
uauguugguuuagagaaagaaauuggauguaauuuuaugcaauuuacuuuuaaagacaaacaua

SEQ ID NO: 2254 - RNA, 71 nt, Human
ucacaaauggcagaacaguauguaaagcugguaacaccucgguuucagugcaccauguguuugcuuuguga

SEQ ID NO: 2255 - RNA, 64 nt, Human
ccagguucugaaaagaucaggagacuaguugaagucuugagaacugauguaauucguggccugg

SEQ ID NO: 2256 - RNA, 81 nt, Human
cuguuuuauaucucuuuuuuauaucucuuuggcguuucccuacagaaaagaaauuggacagaacagaauaauaugaagcag

SEQ ID NO: 2257 - RNA, 70 nt, Human
gcuuuuagagcagguguaugaucuuuggaggaggaggaugaauuugauagagagguacguuugcgggagc

SEQ ID NO: 2258 - RNA, 69 nt, Human
uuuguccuaaucugcugccagaauuaaagaccuauuuuuagaggauuuggcuuaaaaagcaagggcaaa

SEQ ID NO: 2259 - RNA, 81 nt, Human
ggucucuucagagcugcugugcccaguggugcuucaacugguaucuaugaggcccuagagcuccgggacaaugauaagacu

SEQ ID NO: 2260 - RNA, 72 nt, Human
ggguggcagcaccaggggacacaccugccaaacccaccagauggaggggcccucccuggucucuggccaccc

SEQ ID NO: 2261 - RNA, 70 nt, Human
agggagaagcuggugcuaccgucgccccugggacuucgaggcaggagaugggccaccgcccggcaucccu

SEQ ID NO: 2262 - RNA, 93 nt, Human
ccuuuccuuuucuggggggaaagggaaaauuuuugggggggauuuccccgagaaaaccccccuuuucaacuuuccuaccauaaaaaggggggg

SEQ ID NO: 2263 - RNA, 63 nt, Human
caguacagcuucuggcucuaugagcucugugaugucuacuuggagugccugaaaccuguacug

SEQ ID NO: 2264 - RNA, 61 nt, Human
gccucuggguuacccccuacccgggagcccuucgaaugcuuccuggaaggacccccgaggc

SEQ ID NO: 2265 - RNA, 86 nt, Human
ccugccaggugaaaggaaauauugcacuuucuguucucaugacuaaggggacaggaguuccagaagaaccuuucaagaugaucagg

SEQ ID NO: 2266 - RNA, 66 nt, Human
ggaaaguguauuuaacagaagauuaaaaauauaaauguagaagaucuguuuguuuauauauuuuuc

SEQ ID NO: 2267 - RNA, 77 nt, Human
gcacucuccgagucgcugaagccgcugcugucgcugacacugggcgcugcugcggccuuucaugcgcuccagggugc

SEQ ID NO: 2268 - RNA, 66 nt, Human
ucuagcucuuuugugucuccuaauuuagcuuucugaggagugacaguggcagagagaagagcuggg

SEQ ID NO: 2269 - RNA, 102 nt, Human
acucacaaagauauucucacuuagucaacuccugucaaaaugaaggugaacuggcauggcccgaucacuguccauaagggagaaaguggcucauuccugggu

SEQ ID NO: 2270 - RNA, 67 nt, Human
cuggguagaaguaugggugguuaucauuucaaaauuauugugauucucaccucccuccccaccucag

SEQ ID NO: 2271 - RNA, 73 nt, Human
gcaagguuaaaguggguaaucauaagcuccuuuuuaucaaugaaguuugaaguuuuucuauuuuucacuuugc

SEQ ID NO: 2272 - RNA, 91 nt, Human
agccuguccaucaugguguuaaccagcuaaaguuugcucgaagccuucaguccguugcagaggagcgagcugggacgccacugugggggcu

SEQ ID NO: 2273 - RNA, 115 nt, Human
gccugauaaagcgcgccuacugggcuacaaggccaagcaagguuacguuauauauaggauucguguucgccgugguggccgaaaacgcccaguuccuaagggugcaacuuacggc

SEQ ID NO: 2274 - RNA, 82 nt, Human
ggaaugaccugucacuauaauauacuguauguuuacauuuuauuuaaauuuaaucucuuauguauaggggugauaaccuucc

SEQ ID NO: 2275 - RNA, 75 nt, Human
uuuuagugauuauuaagcacuucugucagucuuugaaaaaagaacguauuuuuugugcuuugaagaucucugaag

SEQ ID NO: 2276 - RNA, 79 nt, Human
ccccugggaagaggccccgccuggagcacuaggcccccacccugcugcugccuuccagugcugucauuuucuucagggg

SEQ ID NO: 2277 - RNA, 89 nt, Human
cugugcucacucugguuuucugcucagggucugaagcagcugcugucucccuccucugcccccauccccuggcucuccccugggcacag

SEQ ID NO: 2278 - RNA, 78 nt, Human
gggagcaggcagccacacacgggccuugcaaccuugucagagaaaaggcgaacagggcccucacccugccugucuccc

SEQ ID NO: 2279 - RNA, 61 nt, Human; identical to SEQ ID NO: 1965

SEQ ID NO: 2280 - RNA, 77 nt, Human; identical to SEQ ID NO: 1066

SEQ ID NO: 2281 - RNA, 68 nt, Human
ggugagauguagcaguaaucagcucccagcgacguguguagcuggggcugccgcucgcaauauucacu

SEQ ID NO: 2282 - RNA, 65 nt, Human
gaggcugguggucuugagcuuuuggccuggaauuccagucugaauuuucaaauauucccugccuc

SEQ ID NO: 2283 - RNA, 67 nt, Human
gaguguccguugaaagcaauaaggaauuccagaacagaacugcacuucuugucccucucucacacuu

SEQ ID NO: 2284 - RNA, 61 nt, Human; identical to SEQ ID NO: 1965

SEQ ID NO: 2285 - RNA, 77 nt, Human; identical to SEQ ID NO: 1066

SEQ ID NO: 2286 - RNA, 122 nt, Human; identical to SEQ ID NO: 1067

SEQ ID NO: 2287 - RNA, 60 nt, Human
cacuggcugacucucccauaucugcaagagauucugcaggaacugggugugcacacggug

SEQ ID NO: 2288 - RNA, 67 nt, Human
gauuuggguuuuguugggguuuuuguuacuguuuuaaauuacaguaggcuucuauauauccuggauu

SEQ ID NO: 2289 - RNA, 75 nt, Human
aacagugaaaaauuaguuugguuagaagaaccaucuggaaacacaccagcuucugcuaccuucaugcucauuguu

SEQ ID NO: 2290 - RNA, 61 nt, Human; identical to SEQ ID NO: 1965

SEQ ID NO: 2291 - RNA, 77 nt, Human; identical to SEQ ID NO: 1066

SEQ ID NO: 2292 - RNA, 65 nt, Human
ggccugggagggcaugggucaagggcguccgggaagcuggagcucuuccugcugaccuuccggcc

SEQ ID NO: 2293 - RNA, 78 nt, Human
guugcccgagccguugccgucguaacuaggcguccuggaaguccacgucguuuaccguuuguaaggcgcuugcgcagc

SEQ ID NO: 2294 - RNA, 70 nt, Human
cacacaaugaaugaucaccugcaugucggcagccacgcucacggacagauccagguucaacaguuguuug

SEQ ID NO: 2295 - RNA, 77 nt, Human
ggcucggugcaggggccacccggagcggaguggggacuggcccgcccucccccaucgcccugccgccucuccgggcc

SEQ ID NO: 2296 - RNA, 61 nt, Human
gugcucacgacacaaccaaaugggcuuacaacagugggcaaaacgggcuugccaguggugc

SEQ ID NO: 2297 - RNA, 61 nt, Human; identical to SEQ ID NO: 1965

SEQ ID NO: 2298 - RNA, 77 nt, Human; identical to SEQ ID NO: 1066

SEQ ID NO: 2299 - RNA, 122 nt, Human; identical to SEQ ID NO: 1067

SEQ ID NO: 2300 - RNA, 90 nt, Human
agauggugguaacaguuggacacuauuucuuggcaaaaccguggaaaaacacguucuacaccagcagguggcaaauuguggccgccaucu

SEQ ID NO: 2301 - RNA, 71 nt, Human
gcucacaaucgagcacacgcgugugcacacacaugugcacagaucagugucagaagcaucgaccugcgagc

SEQ ID NO: 2302 - RNA, 61 nt, Human; identical to SEQ ID NO: 1965

SEQ ID NO: 2303 - RNA, 77 nt, Human; identical to SEQ ID NO: 1066

SEQ ID NO: 2304 - RNA, 87 nt, Human
agagucccacuuuguugcccaggcuggagugcaguaggcaugaucuuggcucacugcaaccuccaccuccuggguucaagcgauucu

SEQ ID NO: 2305 - RNA, 68 nt, Human
gagaugggguuucaccauguuggccaggcuggucuugaacuccugaccucaggugauccacccaccuc

SEQ ID NO: 2306 - RNA, 98 nt, Human
guucaggaaaaacuaaguucccauuacuuccagauuauuuuaaaauaaaaaaucaugaugacuugugaggaaaaggaagaacaugucagauccugagc

SEQ ID NO: 2307 - RNA, 77 nt, Human
ccaaagucuggggguuagaaagaaggaagcuugacccaaacaaaguuucauuuacaguauauacagucaggccuugg

SEQ ID NO: 2308 - RNA, 78 nt, Human
gggcgugagcugcaggaagcacauuuggcuuggcaggagcugucaggaaggggaagcggguuuccugcgauucugccu

SEQ ID NO: 2309 - RNA, 61 nt, Human; identical to SEQ ID NO: 1965

SEQ ID NO: 2310 - RNA, 77 nt, Human; identical to SEQ ID NO: 1066

SEQ ID NO: 2311 - RNA, 77 nt, Human; identical to SEQ ID NO: 1066

SEQ ID NO: 2312 - RNA, 122 nt, Human; identical to SEQ ID NO: 1067

SEQ ID NO: 2313 - RNA, 61 nt, Human; identical to SEQ ID NO: 1068

SEQ ID NO: 2314 - RNA, 61 nt, Human; identical to SEQ ID NO: 1965

SEQ ID NO: 2315 - RNA, 77 nt, Human
gcugacugcccgccccuggcuccaucugcagaugucuucagagacgagauguacuuggaccagaaggagcagucggc

SEQ ID NO: 2316 - RNA, 61 nt, Human
ccaacccaugaugggcaggagggcuaaucuugaggggccuuugugucaccaugggcuaugg

SEQ ID NO: 2317 - RNA, 67 nt, Human
cuguagagacagggagacagggcuuggggacguuccccucagcuugcugucaaguuaccuucugcag

SEQ ID NO: 2318 - RNA, 80 nt, Human
uaugauuuccacugugcccagccucagggcaucagcuucuucuggagcgcugugaaggcugggccacgcagaggagcaug

SEQ ID NO: 2319 - RNA, 62 nt, Human
cuaagauaguucagauugaucuuaggucaaugguaagaccuauguaguucaugaagucuugg

SEQ ID NO: 2320 - RNA, 69 nt, Human; identical to SEQ ID NO: 994

SEQ ID NO: 2321 - RNA, 79 nt, Human; identical to SEQ ID NO: 995

SEQ ID NO: 2322 - RNA, 85 nt, Human
gcacagggaaaucucaguuccucaaauaugcagcaaagauuacaccaagaucugugcugaccacaggaauuggaucuacuagugc

SEQ ID NO: 2323 - RNA, 75 nt, Human
uauuggcuagcuugugcccucaaguguuuggaauguaucuaguaaagcuugcuguggccauggugcuggcuggug

SEQ ID NO: 2324 - RNA, 74 nt, Human
gacugcgggacggacgguggacgcugggacgcguuuguagcuccggccccgccguuccgacccccgccgccguc

SEQ ID NO: 2325 - RNA, 113 nt, Human
gggagucugcuacaccauuuuugauuugggcuuccgcuuugauguggcaugguuccugacggagacuucgcccuucaugugguccaaccugggcauuggccuagcuaucuccc

SEQ ID NO: 2326 - RNA, 89 nt, Human
ggacccuuguggcuccacuuguccucaccagucgggacuucagcugaaccucugagugccaaggacaccacuggaacucacaaaggucu

SEQ ID NO: 2327 - RNA, 64 nt, Human
uauaucagaaggugagauugaauaaugcuugaugcagaaucgaaacuucucauuuaucuguaua

SEQ ID NO: 2328 - RNA, 63 nt, Human; identical to SEQ ID NO: 527

SEQ ID NO: 2329 - RNA, 69 nt, Human; identical to SEQ ID NO: 528

SEQ ID NO: 2330 - RNA, 68 nt, Human
cggcccaggguucacgcgggccggguagaggcucgagccgggacccccgagcgugaaccccggagccg

SEQ ID NO: 2331 - RNA, 70 nt, Human
agagcuuccucaucagguuacccagaagugggucccauccaccauccaggugugcuuggauguuaguucu

SEQ ID NO: 2332 - RNA, 77 nt, Human
ugggggagcgggggaaggaguuaaugaaacuguauugcacaaugcucugaucaauccuucuuuuucucuuuugccca

SEQ ID NO: 2333 - RNA, 80 nt, Human; identical to SEQ ID NO: 367

SEQ ID NO: 2334 - RNA, 65 nt, Human
caccaaauggcucccuuugcccaagugaaagccgaaaggucagcggcuggcuggggaggcaggug

SEQ ID NO: 2335 - RNA, 72 nt, Human
ccagaguucuuagagcuugugucuaaaggguaauuccccaacccuuccuuaugagcauuuuuagaacauugg

SEQ ID NO: 2336 - RNA, 85 nt, Human
guuccagguuuauuuaauuccaaaggugagaguuggagugagaugucuuccauaucuauaccuuugugcacaguugaaugggaac

SEQ ID NO: 2337 - RNA, 85 nt, Human
cagcucuccggucaucuuugcagguggucaggccuauaccauucaaggacaguaugccauuccacagccagauuugaccaagcug

SEQ ID NO: 2338 - RNA, 89 nt, Human
gaugucuggggcgcagaucaaaauugcgaacccaguggaaggaucuacugauaggcagguuaccaucacuggaucugcugcccagcauu

SEQ ID NO: 2339 - RNA, 110 nt, Human
cucucaccugaauuuugugguagaaagucuguauuuguuguugugagcguguuaaauugauaacaaaccaaacuacuugauagcuaaagcagauuguuucggguggggag

SEQ ID NO: 2340 - RNA, 69 nt, Human
ugugugugugaagucuuaaauguuuuauuagucuacagcuaaucaguuuauuguaauauuguauguaca

SEQ ID NO: 2341 - RNA, 68 nt, Human
gccacuuuccagcuccacuucaaauuccuuaaaauauaacugaaauugcuguggggaggggggagggc

SEQ ID NO: 2342 - RNA, 85 nt, Human
ggaaaauuaaacuuuaauuuauugacauugacauagcucuguguaaauagaauugcaacugucagguuuuguguucuuguuuucc

SEQ ID NO: 2343 - RNA, 68 nt, Human
uuucuuuuuuaauguccaaaagugggggaaagugcuauuuccuauuuucaccaaaauuggggaaggag

SEQ ID NO: 2344 - RNA, 86 nt, Human
gcccucgcccggccugucagcgcugcucuccgccgcagcuucagcaccucggcccagaacaaugcuaaaguagcugugcuaggggc

SEQ ID NO: 2345 - RNA, 63 nt, Human
aggagaagcugugcuacgucgcccuggacuuucgagcaggagauggcaccgccggauucuccu

SEQ ID NO: 2346 - RNA, 71 nt, Human
ggucccggugucccggaggcgcuguuccaggcuuccuuccuggguauggaaucuugcggguucccgagacc

SEQ ID NO: 2347 - RNA, 93 nt, Human
cauugcugucagggguguuggcuacuccgccagcuguugaaaaaaggagaaagaaagagagcaaacugagauccacacaccccacacaguaug

SEQ ID NO: 2348 - RNA, 65 nt, Human
gcuauuaggaugcaggccuugccagaacuaccacuggcaauacagguuuuggugcccugacaggc

SEQ ID NO: 2349 - RNA, 64 nt, Human
gguuggccugacaaauuaugcugcagcauaugguacuggccugcugcuggcccgcaggcuucuc

SEQ ID NO: 2350 - RNA, 62 nt, Human
guggaggugacuggugaugaauacaauguggaaagcauugauggucagccaggugccuucac

SEQ ID NO: 2351 - RNA, 89 nt, Human
aggguuuuaaacacuaaucacaaacuggaaugacuugacuucaaaaggcaacaaccuuaaagggccgucauuuccauuagguauucccu

SEQ ID NO: 2352 - RNA, 61 nt, Human
gguuuuuaaagacuaggauauugaaugugaaacauccguuuucauuguucacuucuaaacc

SEQ ID NO: 2353 - RNA, 69 nt, Human
uagugaaacauguacuuugagcuuauuguuuuuauucuguauuaaauauuuucaggguuuuaaacacua

SEQ ID NO: 2354 - RNA, 89 nt, Human
gaguuagaguugagcuccccuguagcccaggacuaugcuguagauaucaguaugauccugggguguggcaaaaacaauuuucuuuauuc

SEQ ID NO: 2355 - RNA, 79 nt, Human
ccugccccaucccuuccccagugcacucugaccuagcuagugccuggugcccagugaccugggggagccuggcugcagg

SEQ ID NO: 2356 - RNA, 122 nt, Human
cacuuacaaagucauuguuugaacuuggcucuuguuuaaccucuguaaaccucaguuuucuuguuuauucaguggggcuaauacuugaguuacuguaaacauuaaaugggaugauguaugug

SEQ ID NO: 2357 - RNA, 78 nt, Human
cuguaggaauugugugcauuccauucacacaguauuucuuuagggaugcugugaugauuugaauuacaaauccuacag

SEQ ID NO: 2358 - RNA, 92 nt, Human
ugugcaaggugaggacaggccccgaaugcuuaugaugcuuucacagaaugugucauaccgugccucgggguugaccacauagugcuugcaca

SEQ ID NO: 2359 - RNA, 73 nt, Human
caugauccaugucuucacugcuacagucuggcucaaaauaaaugccuucuuuauagaacaggaaggacucaug

SEQ ID NO: 2360 - RNA, 73 nt, Human
gcaucaauagcaacagaaaugggccccacaguugcaacugccuucaucagggccuucuccugcuuagggaugu

SEQ ID NO: 2361 - RNA, 61 nt, Human
auuucacugagauccagaaaguagcaauauaggacuuuuagggguauguauuaguguaaau

SEQ ID NO: 2362 - RNA, 75 nt, Human
uuuuuacugacaacuaauaaacacuguauguguacauauucauauacacuguggacuggagaaagucaguaugga

SEQ ID NO: 2363 - RNA, 93 nt, Human
uucugaagaauuaacccuuggucgcaauuacuugaaacuggacacgagacaagagccaagaacaaaauugcacaaggaaaccaacaauaagaa

SEQ ID NO: 2364 - RNA, 80 nt, Human
gcugucugguguugcauuagugaagauacucccuacaacuacauggguaccccagagacuaugacgaaucacuuuacagc

SEQ ID NO: 2365 - RNA, 64 nt, Human
uaugaauaaaugaacauuugcaauuuuaaaaucccaauucacuugccaauguugcaaauucaua

SEQ ID NO: 2366 - RNA, 77 nt, Human
ucaccuguaaaccugagucguacagaaagcugccugguauauccaaaagcuuuuuauuccuccugcucauauuguga

SEQ ID NO: 2367 - RNA, 74 nt, Human
gugaguccauggcuaaaucaaagcugccccugagaagagacuuaauccaagccugauuguacuaguggcaucac

SEQ ID NO: 2368 - RNA, 80 nt, Human
cacgguauuguacacggucaucuguugaaacagauuucuuuuuuaacagaucuuaguuuaaaaaagucuuagguacugug

SEQ ID NO: 2369 - RNA, 79 nt, Human
gcauaaucggucacucguauagaacaguauuguuucuauaauuugaagcuuucugaauggacggguucaggccugaugc

SEQ ID NO: 2370 - RNA, 73 nt, Human
guucuguauaaacugguggacaguaaguuaguuccuuuguuuuaacuuauaagccucaacuucaccgcagaau

SEQ ID NO: 2371 - RNA, 84 nt, Human; identical to SEQ ID NO: 286

SEQ ID NO: 2372 - RNA, 64 nt, Human; identical to SEQ ID NO: 287

SEQ ID NO: 2373 - RNA, 103 nt, Human; identical to SEQ ID NO: 294

SEQ ID NO: 2374 - RNA, 117 nt, Human
cuaauuuuugaggugcugauuuagaggcaaaauugcagaauaacaaagaaaugguauuucaaguuuuuuuuuuauaagcaauguaauuaugcuauucacaggggccucaagaauugg

SEQ ID NO: 2375 - RNA, 76 nt, Human
gagacucuaugucugcccguccaucagugaacucauuaaaacuugugcaguguugcuggagcuggccuggugucuc

SEQ ID NO: 2376 - RNA, 124 nt, Human
guucauuaauuuucagcuucgaagguggagggaacauucugcuuuucaggcaccagcugugaagaagaaaccaacaguaacuaaaggcagaucuucuaaaaaaggaacagaaaauggugugaau

SEQ ID NO: 2377 - RNA, 69 nt, Human; identical to SEQ ID NO: 1010

SEQ ID NO: 2378 - RNA, 67 nt, Human
acuuuuccuuuguuuuuuaacuacacacagauuucuaccucugggcucuuuaaaaaucaaagguagu

SEQ ID NO: 2379 - RNA, 68 nt, Human
gccuguccuuaccuccgccugcgagagccacagcaaggagcucagccagccgugguggggugcagagu

SEQ ID NO: 2380 - RNA, 67 nt, Human
ggucguguuuuccuccuggggccaaucacagaggcaauagugggaguccugggggaggggcauggcu

SEQ ID NO: 2381 - RNA, 95 nt, Human
uuuuagagagucaaaauggaaauaacacauuguccacauagcuacugugaaagcuguaauacagaguuauccuuuauuuugacacauuuuuaaaa

SEQ ID NO: 2382 - RNA, 64 nt, Human
ugguaacuacacuuuaugguauaggguucugacuaaccuuuauuaccccauaaguuuguuucca

SEQ ID NO: 2383 - RNA, 93 nt, Human
caugaguucauuacaauagugcugauaaaugccuugaccauauaauagcaaacaagggcaaaacauuuagugcacaauauuuuaauacacgug

SEQ ID NO: 2384 - RNA, 60 nt, Human
gguacagauuauuuuaaauaaaaacuacaauauuuuuagcaacaaaauaauaggaaugcc

SEQ ID NO: 2385 - RNA, 130 nt, Human
ggcaccgugacugugaucagcccccuggagcuuaugcggacaaagcugcaggcucagcaugugucguaccgggagcugggugccuguguucgaacugcaguggcucaggguggcuggcgcucacuguggc

SEQ ID NO: 2386 - RNA, 65 nt, Human
gguguccuggagccucuguaccugugcccaaauggugcccgcugugccaccugguuucaagaccc

SEQ ID NO: 2387 - RNA, 93 nt, Human
auggugcuaaggaaauuugcuaugcucuucgagcugaggguuauugggcugacuuuauugacccaucaucugguuuggcauuuuuuggaccau

SEQ ID NO: 2388 - RNA, 76 nt, Human
auucucuguugaugaccuuggaugcuguaaagugauucgucauagucucugggguacccauguaguuguagggagu

SEQ ID NO: 2389 - RNA, 62 nt, Human
uuagcagaaauauccauucauuugcuguacuauuuguauguaauauuuggguugaucuauaa

SEQ ID NO: 2390 - RNA, 75 nt, Human
guggagggaacauucugcuuuucaggcaccagcugugaagaagaaaccaacaguaacuaaaggcagaucuucuau

SEQ ID NO: 2391 - RNA, 67 nt, Human
aguuuaauuaggucccaguugucaauuuuuuuuguugcauuugcuuuugagggcuuagucauaaauu

SEQ ID NO: 2392 - RNA, 66 nt, Human
agucaguuacguugcuuccaaauaggugcugcuguugacguaauaucuuguggacgcaagcuuccu

SEQ ID NO: 2393 - RNA, 88 nt, Human
guucccaucuucaccuugguggcagcccuaccucugagauuuuaaggucuacggaaagugcaggcuuccaggagugaugagguggagc

SEQ ID NO: 2394 - RNA, 87 nt, Human
uuuuuuuuuuuuuuuugagauggggucucacucugucacccaggcuggaguacagagugagacuccgucucaaaaaaaaaaaaaaga

SEQ ID NO: 2395 - RNA, 131 nt, Human; identical to SEQ ID NO: 1788

SEQ ID NO: 2396 - RNA, 62 nt, Human
auggugacaacaugcuggagccaaguguaacauggcuuggucaagggauuggaagucaccgu

SEQ ID NO: 2397 - RNA, 61 nt, Human
aggucauugcucccuggaggaugccugaauucuacagacgguucaagggccgcaaugaccu

SEQ ID NO: 2398 - RNA, 71 nt, Human
gccugccaccgcugcccgagcccgacgcuauguccagcaaaggcuccgugguucuggccuacaguggcggc

SEQ ID NO: 2399 - RNA, 85 nt, Human
gcuacgaggcugggaauccuggagaacccccaagaaccaagcgccuccagggucucuacacgaaagaccaggacccagcaaaagc

SEQ ID NO: 2400 - RNA, 126 nt, Human
uccagcgcacuguaugaggaccgcuaccuccugggcaccucucuugccaggcccugcaucgcccgcaaacaaguggaaaucgcccagcgggagggggccaaguaugugucccacggcgccacagga

SEQ ID NO: 2401 - RNA, 85 nt, Human
ccugauguuaaugguagauuugagcguaugaauuuuuaaugcuggauauuuugaauuuugcgcauaauaggccuugacuuguagg

SEQ ID NO: 2402 - RNA, 68 nt, Human
auggacaaauacacagaggucucaagaccacggacuccuggucugagccauaaagacuguaacuccgu

SEQ ID NO: 2403 - RNA, 95 nt, Human
ggugguuccugcugcccucaaggucgugcgucugaagccuacaagaaaguuugccuaucuggggcgccuggcucacgagguuggcuggaaguacc

SEQ ID NO: 2404 - RNA, 83 nt, Human
ccggacucuccgucaugggcgugugcuugugauuccaggacuggcuacugcguacauccacagguucacuaacgggggcaagg

SEQ ID NO: 2405 - RNA, 107 nt, Human
ccauggccgcguauuucgccguaugggccucggucccgagucccgcauccaucugugcggaacuugcucacagggcuggugcggacgaacgcaucgaggcaccaugg

SEQ ID NO: 2406 - RNA, 60 nt, Human
ccucuuugacaauaggauaaaguuuuuuugaaaaaaaaaaaaaaaaaaauuggggggggg

SEQ ID NO: 2407 - RNA, 65 nt, Human
cugccaggcagcagcgaggauggugaccgagaagguggggaccacguccugguggcuguuggcag

SEQ ID NO: 2408 - RNA, 64 nt, Human
ggcugaagugcaguggugcaaacauggcacacugcagccuugccgugcacggcugcaaguagcu

SEQ ID NO: 2409 - RNA, 71 nt, Human
agucaguccugcugugggaagcccacacaucaguguguuggagcaaaguucacgaaggccaugggcugacu

SEQ ID NO: 2410 - RNA, 61 nt, Human
cuggacucgguucaccuuugacaccuggagagguggggaagccaggggguggggaguccag

SEQ ID NO: 2411 - RNA, 64 nt, Human
ccugcuuuauugcucagacggucucacgauauugaagcgugggguuggaucugggucaccaagg

SEQ ID NO: 2412 - RNA, 129 nt, Human
gcugcggggacucgcugagcagcggaaggggagcgugcagagccgcugcggcccucacaguccggagcccggccgugccgugccguagggaacaugcacuuuuccauucccgaaaccgagucccgcagc

SEQ ID NO: 2413 - RNA, 74 nt, Human
uauguuuucaggguaacaggaggaaaaaugcagcacaauuuuuuucucuugaaaggcacugucauuuaaacaua

SEQ ID NO: 2414 - RNA, 84 nt, Human
ucuuuuagguuuuucauaaaauauauucauuucucaauuuauaucaaauaagugauuauuuuacagcucuuaaaauuuggagga

SEQ ID NO: 2415 - RNA, 64 nt, Human
cuuuguaagaugcaaagagguuggaucaaguuuaaaugacugugcugccccuuucacaucaaag

SEQ ID NO: 2416 - RNA, 85 nt, Human
cgccaauguguucgccaccgggugggagaacguccguuugucccgggagauucugcuccggauguucgacgcccagggguuggcg

SEQ ID NO: 2417 - RNA, 99 nt, Human
gacacggggacauacaacgcaggcagcuucggacagguguggucuggagacauucacaucacgucgcggcgcugacggaguauacagaagccccguguc

SEQ ID NO: 2418 - RNA, 62 nt, Human
cuaaaagccaaacaugcgacaggaaaagacucauaucaacauugucgucauuggacacguag

SEQ ID NO: 2419 - RNA, 73 nt, Human
uaaggaagucagcacuuacauuacgaaaauuggguacaaccccgacaaaguagcauuuugugccauuuucuug

SEQ ID NO: 2420 - RNA, 81 nt, Human
cagcucugucucgaucugcuccucgaggucucgaaccucccgcaugauggugccuguguccucgauggucuggaugagcug

SEQ ID NO: 2421 - RNA, 98 nt, Human
ggaauauaaagaucuuguuucuucauauuucaaacaccaaauaguauuagucuacuacuaauaguguuagaacaccagauacaaagcuaaaauauucc

SEQ ID NO: 2422 - RNA, 70 nt, Human
guuuuccuuucuaacccacagcuuguuacaauaccagaaauauuaaaaaaccuuguguagauaggagaac

SEQ ID NO: 2423 - RNA, 62 nt, Human
agucucauguggcugcugcaccuccagauauaugcucucgaacaguguggccugaugaaacu

SEQ ID NO: 2424 - RNA, 128 nt, Human
gacaugaguuugugauggcacaauaugugaaugaauuucaggguaaugaugcaccuguugaacaagaaauuaacagugcagaaacuuacuuuugaaagugccagaguagagugugauacaaacauguc

SEQ ID NO: 2425 - RNA, 62 nt, Human
auuggauucauuuuaaaacuuaaguucuuucaagcuaacaaguuuaacugguuuguuccaau

SEQ ID NO: 2426 - RNA, 66 nt, Human
acagauuugaaggaaaaaauuuugauguaacaauuuuuuaaauaaaauuuuguuuuucuguaaugu

SEQ ID NO: 2427 - RNA, 69 nt, Human
gaaugaguaagaccuaguauugauaguacaacagugggacuauagucaguaauaauucauuauucguuu

SEQ ID NO: 2428 - RNA, 79 nt, Human
ccaugccguuaguaacgaggaacaucgagccaaggcaccugugccagucagacguugccuagcguuagaagcgagcugg

SEQ ID NO: 2429 - RNA, 62 nt, Human
gaagaagugucacuggaaggaaaucaagcagccgaaaagccuuucaggaaguuccaccauuc

SEQ ID NO: 2430 - RNA, 64 nt, Human
ugcgugaccaagaucagccuggcaaaugucauccgacagcugggccagacugaguacauaugca

SEQ ID NO: 2431 - RNA, 86 nt, Human
gggagggcgcgccggagggauauacccgggggcacagauuuccagagagcacauuuuuuuguucccggggcccggggcggucaacc

SEQ ID NO: 2432 - RNA, 68 nt, Human
gagaagaggagauggcgugauaccaacgagucaacaaacacucggguccuauacuucagccucuuuuc

SEQ ID NO: 2433 - RNA, 78 nt, Human
gggaaauuugccuuuaccacugaagauuaugacauguuugaaguguguuuugagagcaagggaacagggcggauaccu

SEQ ID NO: 2434 - RNA, 70 nt, Human
ggcccugguacagcggcugcccgaagcaaucucuauuugggacacauugacgucagguguaccaggugcc

SEQ ID NO: 2435 - RNA, 70 nt, Human
uccggugugcgcaguugccaggaucccuaucaugaacuugcgaugcaacaauucacccgugcaugccgga

SEQ ID NO: 2436 - RNA, 73 nt, Human
auuucuaaauuagagagguuaacaagacagaugauuacuaugccucaugugcugugugcucuuugaaaggaau

SEQ ID NO: 2437 - RNA, 70 nt, Human
ugcuuuguaacagacuugcgguuaauuaugcaaaugauaguuugugauaauugguccaguuuuacgaaca

SEQ ID NO: 2438 - RNA, 74 nt, Human
ccgccgugacguucggggugguuucaugagugugcgcguggggugagugcucgccgccgugacguucggggugg

SEQ ID NO: 2439 - RNA, 78 nt, Human
ggggcagucaguaggaacuguaacuaugucucugaugcaccacguguuuagacacagcacaguccuuuuuucuguucc

SEQ ID NO: 2440 - RNA, 85 nt, Human
uucugggggacuauguggacaggggcaagcaguccuuggagaccaucugccugcugcuggccuauaagaucaaguaccccgagaa

SEQ ID NO: 2441 - RNA, 90 nt, Human
cccccggaccccccccgggggacaaaagaggcgggcccuuuuuuuggccgggggggggggccuuuuuuaacccugggggggguuuugggg

SEQ ID NO: 2442 - RNA, 83 nt, Human
uggacgggggggcuacccuggcuucccugcugaaggagggcacccccugaguagggguccaaaccauaggccuccaaguuccg

SEQ ID NO: 2443 - RNA, 60 nt, Human
guguauauauuuacggggucuaugagauguuuugauagacaugcaacgugaaauaagcac

SEQ ID NO: 2444 - RNA, 131 nt, Human
caaugggugcucuucaugcaagguugcaaaccuaccaagaaugcauaauagucucacuuuuccccaauaaagagaugcgugugacuaguuuuggacuuuuaaccuuaauggggguugcaugucuccuauug

SEQ ID NO: 2445 - RNA, 75 nt, Human
gauccacaguccugcauuuacugccuuucacuuaaugauuuuggacagguuuuagagagccagggauguuggguc

SEQ ID NO: 2446 - RNA, 79 nt, Human
ggggccuuuauuugguuuugggcuuuagcuggauaauguuuuagugaugucagcuagugcaguucucaaaugggcugcc

SEQ ID NO: 2447 - RNA, 81 nt, Human
gauauguugaaggguauuuguuaauuuuacuuuucaaagauacuuuaaaacaguagagcuagcaaugacaccuugcauuuc

SEQ ID NO: 2448 - RNA, 84 nt, Human
ccaccaccaucaaggucaucauugucaucuaccuguccguggugggugcccuguugcucuacauggccuuccugaugcuggugg

SEQ ID NO: 2449 - RNA, 90 nt, Human
ggcuuugcuggcccagcaagccugauaagcaugaagcucuuaucuuugguggcuguggucggguguuugcuggugcccccagcugaagcc

SEQ ID NO: 2450 - RNA, 62 nt, Human
cuuguucuucucuuauaaaugacuuuugcacaacagaagcuuuuuauuuugaugaagucaag

SEQ ID NO: 2451 - RNA, 78 nt, Human
ggauuuugagaguuguuuauuuaucuggauacaaguucuguguuggacaggugauuugcaaguauuuucacccagucu

SEQ ID NO: 2452 - RNA, 81 nt, Human
uggcugacggucgcagcaaauccagcugcugcugcggcggcuguggcggcggcagcggcggugacugaggauagagagcca

SEQ ID NO: 2453 - RNA, 61 nt, Human
ggugacaacaugcuggagccaagugcuaacaugccuugguuucaagggauggaaagucacc

SEQ ID NO: 2454 - RNA, 79 nt, Human; identical to SEQ ID NO: 1810

SEQ ID NO: 2455 - RNA, 61 nt, Human
uaauauauuuaauagagagacgccagcaugaguggguggaccguauauauaaguacuauua

SEQ ID NO: 2456 - RNA, 63 nt, Human
uguuaacugaauaccacucuguaauugcaaaaaaaaaaaaaaguugcagcuguuugguugaca

SEQ ID NO: 2457 - RNA, 72 nt, Human
cggagugucgguggugauggugcaucccgagcgugcgugcgcgaggugcacucguaccugacugacacucug

SEQ ID NO: 2458 - RNA, 67 nt, Human; identical to SEQ ID NO: 2073

SEQ ID NO: 2459 - RNA, 68 nt, Human
gagaaggaugcgaaaaaacugugaccggaaaaaagcacacugcgacuccgauacaaccguaccuacuc

SEQ ID NO: 2460 - RNA, 79 nt, Human; identical to SEQ ID NO: 1810

SEQ ID NO: 2461 - RNA, 61 nt, Human
aggucauugcucccuggaggaugccugaauucuacaaccgguucaagggccgcaaugaccu

SEQ ID NO: 2462 - RNA, 78 nt, Human
auuagcaauagagcaauugaaauguuaggaggugaacuuggcagcaagauaccugugcaucccaacgaucauguuaau

SEQ ID NO: 2463 - RNA, 69 nt, Human
cagagcucaaaugauacuuuucccacagcaaugcacauugcugcugcaauagaaguucaugaaguacug

SEQ ID NO: 2464 - RNA, 71 nt, Human
cgcgcucgcgucccucgugcgggcuccagccgcagccuuagcuucggcucccggcuuggguggcgcggccg

SEQ ID NO: 2465 - RNA, 79 nt, Human; identical to SEQ ID NO: 1810

SEQ ID NO: 2466 - RNA, 62 nt, Human
aguccaacgucucugaugcgguggcucagagcacccguaucauuuauggaggcucugugacu

SEQ ID NO: 2467 - RNA, 75 nt, Human
guuuauaucuucacccuguaaugguugggaccaggccaaucccuucuccacuuacuauaaugguuggaacuaaac

SEQ ID NO: 2468 - RNA, 69 nt, Human
uucuggcauuuagaauuuuguuccauucauuugauuuguucaucugagaauuuuuuuuuuuugccugaa

SEQ ID NO: 2469 - RNA, 61 nt, Human; identical to SEQ ID NO: 2067

SEQ ID NO: 2470 - RNA, 70 nt, Human
cacagcuguuaugccagauggucaguuuaaagauaucagccugucugacuacaaaggaaaauauguugug

SEQ ID NO: 2471 - RNA, 66 nt, Human
aauuccaaaguauauucucuuuuauugggaacacauucaauuaauuaacauauuauuccuggaauu

SEQ ID NO: 2472 - RNA, 81 nt, Human
aguagccauggcggccaugaguuguugcggcggguuucgguuacugcgguggcagcucugucuggccggccccuuggcacu

SEQ ID NO: 2473 - RNA, 78 nt, Human
gcguuuuuugaaguuauugagauucuacauugcauugacugggauuccaguagcaauuuucauaacucuggugaaugu

SEQ ID NO: 2474 - RNA, 70 nt, Human
ggggccucccuccagcgcucuggggagccaggcuuugcuuggcuuccucagggccuggggaucuggcccu

SEQ ID NO: 2475 - RNA, 85 nt, Human
uccgaaagaagcuggugaucguuggggauggugccugugggaagaccugccuccucaucgucuucagcaaggaucaguuuccgga

SEQ ID NO: 2476 - RNA, 90 nt, Human
ggcaguucggcggucccgcgggucugucucuugcuucaacaguguuaggacggaacagauccggggacucucuuccagccuccgaccgcc

SEQ ID NO: 2477 - RNA, 68 nt, Human
caccucuuauagagguugauaggacugcuuggguccuccacuguccucugucaaucuaguuagacgug

SEQ ID NO: 2478 - RNA, 68 nt, Human
uguaggcuuuaagaauuuuauccuaauggccuuuauaggaccaaugcugauuuuuuuuuuaaagggca

SEQ ID NO: 2479 - RNA, 80 nt, Human
ccuuggaaauuccgccgcaauaagguuaccuucgaagcuaacaaaggagugaaucgaaugcgugggggaaauugccaagg

SEQ ID NO: 2480 - RNA, 75 nt, Human
ugagcgagggggucacgaacugguuccgugucaguccaguggaaggauacucauagacugugaaugauaaguuca

SEQ ID NO: 2481 - RNA, 68 nt, Human
gcacagcaggccuagguccucccacaccugcccccuaauaaagugggcgcgagaggaggcugcugugu

SEQ ID NO: 2482 - RNA, 88 nt, Human
ucgcugucgugacuacacagaguuacugggcacaaguuuaucuucuuccagauauccuuuucagaacacucaaagguucgacuaguga

SEQ ID NO: 2483 - RNA, 109 nt, Human
ggaagcacauacucagaccuguuuuguuaacuagaauucuuuaaaagcugaugccaaacaucuuuacagaggaacuguaguucacauccaccugucugacauugucccc

SEQ ID NO: 2484 - RNA, 63 nt, Human
uuucuguuauaaaaagaagugugaucuguuuuuuuagugauuuccuuuguuugggaauagaga

SEQ ID NO: 2485 - RNA, 63 nt, Human
gauuggcugcguuguuguaggccaacaugaugguggcaucuggcaaucaacuuaguagaaguc

SEQ ID NO: 2486 - RNA, 89 nt, Human
cccuuccccgggccacgguggccuugggucccugcccucccacccagguuugguuccucccggggcccccacuguggagauaagaaggg

SEQ ID NO: 2487 - RNA, 64 nt, Human
gcccugggguuggcggccucacccccucuggagggccggaggcaggagguggaaaccccagggc

SEQ ID NO: 2488 - RNA, 67 nt, Human
acccugucucccauucugagaaucuggguuagaacugcaacauacaaauuucuuuugggggaugggu

SEQ ID NO: 2489 - RNA, 60 nt, Human
uuuuaaguaccaaugauacuuaaaauuuccagaauggucuggggugucauuggcuugaaa

SEQ ID NO: 2490 - RNA, 83 nt, Human
cuuuuauuugaaggcagaaaacacccuauuuggggguucacucauaaucugcaacaguuuguuuguuuguuuuuaaaaaagag

SEQ ID NO: 2491 - RNA, 83 nt, Human
ggccgaguuguuugggggcgcugugcccacggggcccgggggcuccgccccggguuucaauggcguugccccucuacuuugcu

SEQ ID NO: 2492 - RNA, 66 nt, Human
ugcucgccguccccgccaugcugucucuagacuuuuggacgaugugcggcggaugaacaagcggca

SEQ ID NO: 2493 - RNA, 77 nt, Human
ccuaggauacugaugguugugaagacuguuucaaaugauuggaucuuugaaagcuucagcgugccuuaguuucuagg

SEQ ID NO: 2494 - RNA, 61 nt, Human
gacaauggacuuuuaaaacgugccacaauaagggguguauaacagguuccauuuuaauguc

SEQ ID NO: 2495 - RNA, 81 nt, Human
uugguccugguaugguccugggaaauuaaaccugauuggaggaacaaucaucauaacuuuacgggggacaauugggacgga

SEQ ID NO: 2496 - RNA, 88 nt, Human
uuuggaucuaucacugucaucauaaacugguucugcuugucauccacacaacacaggacuuaagacaaugggacugaugucaucugag

SEQ ID NO: 2497 - RNA, 79 nt, Human
cacgccauuccuucucucucugcagcaaggcaaauuucuaccucuagagacucugccauugucaggaaaggauuuagug

SEQ ID NO: 2498 - RNA, 83 nt, Human
accucaguuuccugaauagcuaggaccacaggcaugcaccaucaugccuggcuaauuuuuaaauauuuuguaggaaacugggu

SEQ ID NO: 2499 - RNA, 81 nt, Human
uugggggggggcauuaauuccuuauuuaaggauguuacugaguuggaauuaaaaggccccuccaaccauucaaccccccaa

SEQ ID NO: 2500 - RNA, 60 nt, Human
gauaccaagguaauuucugggcagguuuaaaaccuuuaaaaguugauagaauaacuguuc

SEQ ID NO: 2501 - RNA, 63 nt, Human
gugucuagauuugaaacuuuuuaauuaaggaugucuuaauuuuugacuuuuaaaaaugguuau

SEQ ID NO: 2502 - RNA, 131 nt, Human
gucacccaggcuagagugcaguggugugaucuuggcucacugcaaccucugccuccugggcccaagagauucuugggaggcggagguuggcagugagccgagaucagcccacuggacuccagccugaguac

SEQ ID NO: 2503 - RNA, 68 nt, Human
uaggacaggcucugggggggacagggcaccagguuggccgcuggcuuuuccucaggccucaggaccua

SEQ ID NO: 2504 - RNA, 70 nt, Human
ggagcacaugugccgccuggacauugauucaccacccaucacagcccggaacacuggcaucaucuguacc

SEQ ID NO: 2505 - RNA, 70 nt, Human
uguggcucgucugaacuucucucauggaacucaugaguaccaugcggagaccaucaagaaugugcgcaca

SEQ ID NO: 2506 - RNA, 94 nt, Human
aacaucuaccuacucaugacauggcaaauagucauuuuacaauaacaauacaguacaauaugaucgugcuacuuucauggcuaggaaugaaguu

SEQ ID NO: 2507 - RNA, 65 nt, Human
guuggguuucucuuucagagcuaccccuaaaggcauucacuuuauauucucugaagagaaccagc

SEQ ID NO: 2508 - RNA, 70 nt, Human
uuugaauucaaacucuuuggaaaacaugcauaauaaucuuaaugaucccauugacuaguuuaaauucaaa

SEQ ID NO: 2509 - RNA, 85 nt, Human
cauuuuaucuggaacaguuccucagccuuucugucucuugaccuuaauauuuuugaaagguacaggcaaguuauuuuguagaaug

SEQ ID NO: 2510 - RNA, 77 nt, Human
cuaguccagguucgaacccaggaucacagauugcauuuaguuguuaugucucuuuagucucauuuuaucuggaacag

SEQ ID NO: 2511 - RNA, 62 nt, Human
gaauuggacacuuuguccuucuuagguauaucacaucaagagggcauauggauguuggauuc

SEQ ID NO: 2512 - RNA, 65 nt, Human
ucccucaacauggauuuguuugauguuuccuccuaaggauucaaguuauaaauuuuucacaggga

SEQ ID NO: 2513 - RNA, 90 nt, Human
ggguguugagaacuuguaccauggacuucagaccgccuugcagccguaugcugcacaagcguguacacccccugggcagccucaaaaccc

SEQ ID NO: 2514 - RNA, 61 nt, Human
ucugcuccauagguuucuguuuuuaauuucaauguuaaauacaacuacaauaugagcgaga

SEQ ID NO: 2515 - RNA, 61 nt, Human
gcuggugggcgcguaccccaacuacaacgaggaggaggaggagcgccgcuacuaccgccgc

SEQ ID NO: 2516 - RNA, 75 nt, Human
acuugugcugagaauagugucugauuauacgacuuuuaagcaaaguggguguaauuaggugaaacacagccaggu

SEQ ID NO: 2517 - RNA, 73 nt, Human
ccagcaaguuucaccuggguuguauuuuaaauguuuuacaagaauguccaugugcuucccuaggcugagcugg

SEQ ID NO: 2518 - RNA, 85 nt, Human
gagggauguaacuauugaaucggauacaaggaucagaauggaaagaaacucacgaugaaauugaaccugguuuuguauauuuauc

SEQ ID NO: 2519 - RNA, 64 nt, Human
auaucagauuugaauuacagcugaguuacccacuugggagucaguuuuagauuggagcugguau

SEQ ID NO: 2520 - RNA, 101 nt, Human
cuuccuauaaaaguuuagcucucucuuuuugaaggaaauuucugggcaaacaacauuuugagaaagaaauucagauaugggaaaguaaagaucauggggag

SEQ ID NO: 2521 - RNA, 67 nt, Human
ggcuuuaagaaaccuggcuugugcaugugguuuacacauguugaaaaguaugaagauuaaugaagcc

SEQ ID NO: 2522 - RNA, 64 nt, Human; identical to SEQ ID NO: 2519

SEQ ID NO: 2523 - RNA, 100 nt, Human
cuuccuauaaaaguuugcucucucuuuuugaaggaaauuucugggcaaacaacauuuugagaaagaaauucagauaugggaaaguaaagaucauggggag

SEQ ID NO: 2524 - RNA, 67 nt, Human; identical to SEQ ID NO: 2521

SEQ ID NO: 2525 - RNA, 100 nt, Human; identical to SEQ ID NO: 2523

SEQ ID NO: 2526 - RNA, 67 nt, Human; identical to SEQ ID NO: 2521

SEQ ID NO: 2527 - RNA, 83 nt, Human
aggaggcggcagucugaagaggaugaguucagagucaagcaacuugaagauaacauucagaggucuaagucuuggccguuccu

SEQ ID NO: 2528 - RNA, 63 nt, Human
cccacucuuacagccucugucucuuuauuuucaaggaagaaagaggcagacugaaauagaagg

SEQ ID NO: 2529 - RNA, 79 nt, Human
ggugucucuggaagugucuauacagaugugugcugcugcugcugcugcuuucugccuuaaaauuucuggagccaacacc

SEQ ID NO: 2530 - RNA, 101 nt, Human
cuucccauaaaaguuugcucucucuuuuugaaggaaauuucugggcaaacaacauuucugagaaagaaauucagauaugggaaaguaaagaucauggggag

SEQ ID NO: 2531 - RNA, 67 nt, Human; identical to SEQ ID NO: 2521

SEQ ID NO: 2532 - RNA, 70 nt, Human
cacagccgggaccccgccagaagugcccggugcauuggcagugcccguccacgcaggucccguggccgug

SEQ ID NO: 2533 - RNA, 62 nt, Human
ggggacacucuucacugcaguuggacccgguccauccggcaucacagcggcagccggucucc

SEQ ID NO: 2534 - RNA, 62 nt, Human
ccaaacuguaaauacagaacuaggcacaucucaauguucugucucuguguuuacauuacugg

SEQ ID NO: 2535 - RNA, 62 nt, Human
gaaaauuaagcauucuucaacuuuucuaugggucuuaaaauucauggaauaugugcauuuuc

SEQ ID NO: 2536 - RNA, 62 nt, Human
uaugaaauguuaucaaggcagaaaacuacauuaauuucgacuuuaauaagauguaacucaua

SEQ ID NO: 2537 - RNA, 63 nt, Human
gucugcugccuuuuguuuagcuaagcccugcccacagagguugagucuauagaggcaguaggc

SEQ ID NO: 2538 - RNA, 71 nt, Human
ugcugagcuggggugggcuccacucaguucaagcuuaccagcugcuuuguuuaccuacucaagccucagca

SEQ ID NO: 2539 - RNA, 97 nt, Human
gguauaaucuagcagucuguggauuugauccuuccaccucauaaaaaaggcauaggugggcaguauaauugauuugcagggauaugcuagaauuacu

SEQ ID NO: 2540 - RNA, 78 nt, Human
uguccaguucccauuuugguccucauaaucaaaacagcuuaacaugacagucaucaccaguaauaguggcauuggaua

SEQ ID NO: 2541 - RNA, 80 nt, Human
guguaaugugguucuagugucgcugcguguucauccucucgagcuugucugucacguaggucacacuagacucugggcac

SEQ ID NO: 2542 - RNA, 102 nt, Human
uugucgagcucaucaggugguggaagauggauaugaauuuuuugcuaaacgacaguugguaaccuuauuuucagccccaaauuacuguggcgaguuugauaa

SEQ ID NO: 2543 - RNA, 60 nt, Human
gaggacaaaugaacaagacagaugagggagacauccucucugauauaagauacaguccuc

SEQ ID NO: 2544 - RNA, 98 nt, Human
aaauggcuuuaaagcuugguguuacuuuucuuaaguuguuuaauuauaguuaaggcaauuucaaaaaugcuccaaagaaauguggaaagggaccuuuu

SEQ ID NO: 2545 - RNA, 61 nt, Human
ucugacagggcccaugucccacaaggcugcuuggccucagugggugcuuggcugugcugga

SEQ ID NO: 2546 - RNA, 60 nt, Human
uugguguuacuuuucuuaaguuguuuaauuauaguuaaggcaauuucaaaaaugcuccaa

SEQ ID NO: 2547 - RNA, 62 nt, Human
auauucuucuacugauucagucagacacgaaauccaacugaauuacccgguagacugaauau

SEQ ID NO: 2548 - RNA, 64 nt, Human
gaaagcaagcuuuugccaaugaucuuuaauggaguuaaaauguuuaugguaauuguaaccuuuc

SEQ ID NO: 2549 - RNA, 69 nt, Human
cuccauaaucacaugagccaauuccuuauaagaaaucucuuuguguguauugguucuguuucucuggag

SEQ ID NO: 2550 - RNA, 77 nt, Human
ggauuuauacauacagagauuguaguauuuaguauaugaaauauuuugaauacacaucucugucagugugaaaauuc

SEQ ID NO: 2551 - RNA, 68 nt, Human
gugguuuuuagugcacuuaauauuagcuugcuuaaggcauacuuuuaaucaaguagaacaaaaacuau

SEQ ID NO: 2552 - RNA, 71 nt, Human
guuaugugaauuugaguuugcuguuuuaaauugcauuucuaugccauuuuuaguuuaaaaucuugcauggc

SEQ ID NO: 2553 - RNA, 65 nt, Human
cccaucuccagcccgggcuucaaacugcugcugagggggggcugggagccaggaauggggcuggg

SEQ ID NO: 2554 - RNA, 120 nt, Human
gggagcgggaucuaaggacuuacaugaaccucgaguucugacuuugguaaagucugacccuagucugcugcugaagucugaacuugggccucugaccuggggccuuugacuuccccuucc

SEQ ID NO: 2555 - RNA, 78 nt, Human
ggggugagggccgugccaaucccauccccacuguccucaagagggaccaggaaggacuaggcuacagaucagcacccc

SEQ ID NO: 2556 - RNA, 100 nt, Human; identical to SEQ ID NO: 1173

SEQ ID NO: 2557 - RNA, 70 nt, Human; identical to SEQ ID NO: 1335

SEQ ID NO: 2558 - RNA, 76 nt, Human
uccaagagauagcaaaucgagucuuaaauaauccggggagaaagacgcccggguagauuuguggugcagccuugga

SEQ ID NO: 2559 - RNA, 73 nt, Human; identical to SEQ ID NO: 721

SEQ ID NO: 2560 - RNA, 82 nt, Human; identical to SEQ ID NO: 119

SEQ ID NO: 2561 - RNA, 63 nt, Human; identical to SEQ ID NO: 722

SEQ ID NO: 2562 - RNA, 60 nt, Human; identical to SEQ ID NO: 723

SEQ ID NO: 2563 - RNA, 69 nt, Human
caauuuuaagcauuaucuugcaaaguagacauaggugguguuugauuugccauaauuaacuugaauuug

SEQ ID NO: 2564 - RNA, 75 nt, Human
cucgucaaaaaauauucacaguucauaaacuuuccuauuuauguauggagcagcaagacugaaacuguugaggag

SEQ ID NO: 2565 - RNA, 83 nt, Human
guagaagaagaugaauacaaagcuuucuacaaaucauuuucaaaggaaagugaugaccccauggcuuauauucacuuuacugc

SEQ ID NO: 2566 - RNA, 69 nt, Human
gggccggagccggcggcagugguggcagcgguaucgccgcccuagcucaccgcgccccuuuuccagccc

SEQ ID NO: 2567 - RNA, 79 nt, Human
ggccacuccugcaucuuuaccgucucagggacuuccaguugcugccccuucccagaggccguggcaugcggggauggcc

SEQ ID NO: 2568 - RNA, 71 nt, Human
gguugcugcugcccaaggaccgcggagucggacgcaggcagaccauguggacccuggugagcuggguggcc

SEQ ID NO: 2569 - RNA, 63 nt, Human; identical to SEQ ID NO: 527

SEQ ID NO: 2570 - RNA, 75 nt, Human; identical to SEQ ID NO: 74

SEQ ID NO: 2571 - RNA, 87 nt, Human; identical to SEQ ID NO: 76

SEQ ID NO: 2572 - RNA, 71 nt, Human; identical to SEQ ID NO: 77

SEQ ID NO: 2573 - RNA, 81 nt, Human
aggcuugagagugggaaggucugaguguagucaguguagcucagcugacuuacguaagucuugaggaccuugcuugagccu

SEQ ID NO: 2574 - RNA, 68 nt, Human
uugcuugaaccugggaggcggagguugcagugaaccgagacugcaccacuguacuacagcuugggcaa

SEQ ID NO: 2575 - RNA, 60 nt, Human
uuucuucauugaggaaaacugggauaaugacccauuuucacaggguuuuucuugaggaaa

SEQ ID NO: 2576 - RNA, 65 nt, Human; identical to SEQ ID NO: 1518

SEQ ID NO: 2577 - RNA, 75 nt, Human; identical to SEQ ID NO: 74

SEQ ID NO: 2578 - RNA, 87 nt, Human; identical to SEQ ID NO: 76

SEQ ID NO: 2579 - RNA, 71 nt, Human; identical to SEQ ID NO: 77

SEQ ID NO: 2580 - RNA, 78 nt, Human
accagaggaggacaucagauccugcauuauguacacugaucguuucugcagcugcagauucugcuguucgacucuggu

SEQ ID NO: 2581 - RNA, 81 nt, Human
cauauuugcucaacaaaaugaucaguuucagaaagugcuuucucucuguggacaugaggauuggauuagaggaguggaaug

SEQ ID NO: 2582 - RNA, 65 nt, Human
ucugcuuaucuuuuuugccaaauacugauguaccaauauuagcauguggcaaugaugauugcaga

SEQ ID NO: 2583 - RNA, 70 nt, Human
gccugggacuuggagaaaugggauuugaaauuccuccuggagaaagcucagaaucuguuuuuucccaagc

SEQ ID NO: 2584 - RNA, 69 nt, Human
uggaguaccuucuacugccucagugggcaaauccaaaaccccauuaguggcaaggaagaaaguguuccg

SEQ ID NO: 2585 - RNA, 79 nt, Human
ccaagaucacucaauuuaucaguaauggagcuuacuucaucagcuuccuugccugcuuuuauaaauuagguucuauugg

SEQ ID NO: 2586 - RNA, 60 nt, Human
uguagccagccccgucucaauccccugggcuaacaaaagaaucagaagaggcuggccaca

SEQ ID NO: 2587 - RNA, 78 nt, Human
ugcagaccaagguguccaaaugaggugacccagacuugagaggucguuugggcuuuaggaguggagcacguuucugcg

SEQ ID NO: 2588 - RNA, 78 nt, Human; identical to SEQ ID NO: 99

SEQ ID NO: 2589 - RNA, 65 nt, Human; identical to SEQ ID NO: 247

SEQ ID NO: 2590 - RNA, 80 nt, Human; identical to SEQ ID NO: 100

SEQ ID NO: 2591 - RNA, 73 nt, Human
gccauggcagugacagcgacggcucccagaguccccgcucucugccccccuccagcccugucaggcccauggc

SEQ ID NO: 2592 - RNA, 131 nt, Human; identical to SEQ ID NO: 1788

SEQ ID NO: 2593 - RNA, 75 nt, Human; identical to SEQ ID NO: 74

SEQ ID NO: 2594 - RNA, 96 nt, Human
ggagccauuguggacguuccaguuggugaggagcuguugggucguguaguugaugcccuugguaaugcuauugauggaaaggguccaauugguucc

SEQ ID NO: 2595 - RNA, 87 nt, Human; identical to SEQ ID NO: 76

SEQ ID NO: 2596 - RNA, 71 nt, Human; identical to SEQ ID NO: 77

SEQ ID NO: 2597 - RNA, 87 nt, Human; identical to SEQ ID NO: 76

SEQ ID NO: 2598 - RNA, 65 nt, Human; identical to SEQ ID NO: 1518

SEQ ID NO: 2599 - RNA, 71 nt, Human; identical to SEQ ID NO: 77

SEQ ID NO: 2600 - RNA, 65 nt, Human; identical to SEQ ID NO: 1518

SEQ ID NO: 2601 - RNA, 87 nt, Human; identical to SEQ ID NO: 76

SEQ ID NO: 2602 - RNA, 67 nt, Human
uuucuuuuauaauagaaugggcauguauuguaacaguuuuaugucaaaugaucugugcuguaggaaa

SEQ ID NO: 2603 - RNA, 75 nt, Human; identical to SEQ ID NO: 2275

SEQ ID NO: 2604 - RNA, 65 nt, Human; identical to SEQ ID NO: 1518

SEQ ID NO: 2605 - RNA, 75 nt, Human; identical to SEQ ID NO: 74

SEQ ID NO: 2606 - RNA, 87 nt, Human; identical to SEQ ID NO: 76

SEQ ID NO: 2607 - RNA, 87 nt, Human; identical to SEQ ID NO: 76

SEQ ID NO: 2608 - RNA, 75 nt, Human; identical to SEQ ID NO: 74

SEQ ID NO: 2609 - RNA, 71 nt, Human
ugcccgcguacaugggcugaggaauguucaagcagaagaagugguagaguuuucuucaggcuuaaagggua

SEQ ID NO: 2610 - RNA, 87 nt, Human; identical to SEQ ID NO: 76

SEQ ID NO: 2611 - RNA, 71 nt, Human; identical to SEQ ID NO: 77

SEQ ID NO: 2612 - RNA, 87 nt, Human; identical to SEQ ID NO: 76

SEQ ID NO: 2613 - RNA, 65 nt, Human; identical to SEQ ID NO: 1518

SEQ ID NO: 2614 - RNA, 75 nt, Human; identical to SEQ ID NO: 74

SEQ ID NO: 2615 - RNA, 87 nt, Human; identical to SEQ ID NO: 76

SEQ ID NO: 2616 - RNA, 71 nt, Human; identical to SEQ ID NO: 77

SEQ ID NO: 2617 - RNA, 65 nt, Human; identical to SEQ ID NO: 1518

SEQ ID NO: 2618 - RNA, 75 nt, Human; identical to SEQ ID NO: 74

SEQ ID NO: 2619 - RNA, 71 nt, Human; identical to SEQ ID NO: 77

SEQ ID NO: 2620 - RNA, 71 nt, Human; identical to SEQ ID NO: 77

SEQ ID NO: 2621 - RNA, 65 nt, Human; identical to SEQ ID NO: 1518

SEQ ID NO: 2622 - RNA, 75 nt, Human; identical to SEQ ID NO: 74

SEQ ID NO: 2623 - RNA, 87 nt, Human; identical to SEQ ID NO: 76

SEQ ID NO: 2624 - RNA, 65 nt, Human; identical to SEQ ID NO: 1518

SEQ ID NO: 2625 - RNA, 75 nt, Human; identical to SEQ ID NO: 74

SEQ ID NO: 2626 - RNA, 87 nt, Human; identical to SEQ ID NO: 76

SEQ ID NO: 2627 - RNA, 71 nt, Human; identical to SEQ ID NO: 77

SEQ ID NO: 2628 - RNA, 75 nt, Human; identical to SEQ ID NO: 74

SEQ ID NO: 2629 - RNA, 87 nt, Human; identical to SEQ ID NO: 76

SEQ ID NO: 2630 - RNA, 71 nt, Human; identical to SEQ ID NO: 77

SEQ ID NO: 2631 - RNA, 75 nt, Human; identical to SEQ ID NO: 74

SEQ ID NO: 2632 - RNA, 87 nt, Human; identical to SEQ ID NO: 76

SEQ ID NO: 2633 - RNA, 71 nt, Human; identical to SEQ ID NO: 77

SEQ ID NO: 2634 - RNA, 65 nt, Human; identical to SEQ ID NO: 1518

SEQ ID NO: 2635 - RNA, 75 nt, Human; identical to SEQ ID NO: 74

SEQ ID NO: 2636 - RNA, 87 nt, Human; identical to SEQ ID NO: 76

SEQ ID NO: 2637 - RNA, 71 nt, Human
ugcccgcguacaugggcugaggaaugcucaagcagaagaaaugguagaguuuucuucaggcuuaaagggua

SEQ ID NO: 2638 - RNA, 65 nt, Human; identical to SEQ ID NO: 1518

SEQ ID NO: 2639 - RNA, 75 nt, Human; identical to SEQ ID NO: 74

SEQ ID NO: 2640 - RNA, 96 nt, Human; identical to SEQ ID NO: 2594

SEQ ID NO: 2641 - RNA, 87 nt, Human; identical to SEQ ID NO: 76

SEQ ID NO: 2642 - RNA, 77 nt, Human
cugcugucuggugcccugugagcugugauugauugccuuuggucaguaaugcguucaggaguccacaccaggcacag

SEQ ID NO: 2643 - RNA, 85 nt, Human
aggcgcugguccccuucaaaagggcagggggaccgcaugggggcgucuuuuucuuaaccuuauugcaagggaauaccgugugccu

SEQ ID NO: 2644 - RNA, 67 nt, Human
gagcaauaggcguggucaugacaccgcuacaaaugugcuggcggcuuuauaccaucgcacguugguc

SEQ ID NO: 2645 - RNA, 65 nt, Human
ugaucaagauccuuacguuacucugaaagauacagaacaauaugaacgugaagauuucuugauua

SEQ ID NO: 2646 - RNA, 87 nt, Human; identical to SEQ ID NO: 76

SEQ ID NO: 2647 - RNA, 84 nt, Human
ucuucaaaagacugggacugcugagauguccucuauucuugaagagcguauucuuggagcugauaccucuguugaucuugaaga

SEQ ID NO: 2648 - RNA, 82 nt, Human
auuaucugccaguuaagauuauucuuaaaacucuggaugccauggcuuuuaauaaguuuaauguucuucacuggcacauagu

SEQ ID NO: 2649 - RNA, 70 nt, Human
guccguauggugauugaauaugccagauuacgaggaauucgaguccugccagaauuugauaccccugggc

SEQ ID NO: 2650 - RNA, 87 nt, Human; identical to SEQ ID NO: 76

SEQ ID NO: 2651 - RNA, 71 nt, Human; identical to SEQ ID NO: 77

SEQ ID NO: 2652 - RNA, 75 nt, Human; identical to SEQ ID NO: 74

SEQ ID NO: 2653 - RNA, 87 nt, Human; identical to SEQ ID NO: 76

SEQ ID NO: 2654 - RNA, 65 nt, Human; identical to SEQ ID NO: 1518

SEQ ID NO: 2655 - RNA, 75 nt, Human; identical to SEQ ID NO: 74

SEQ ID NO: 2656 - RNA, 87 nt, Human; identical to SEQ ID NO: 76

SEQ ID NO: 2657 - RNA, 71 nt, Human; identical to SEQ ID NO: 77

SEQ ID NO: 2658 - RNA, 90 nt, Human
cugguucucgccgccucacgcgaacucuacaaaugcaucaagaaagcggugaagcagaagcagauucggcgcggggugaaagagguucag

SEQ ID NO: 2659 - RNA, 73 nt, Human
gugugaggaccgaaauuugcccuaugucuauaucccucuaagacggaccugggugcagccgcaguccaagcgc

SEQ ID NO: 2660 - RNA, 87 nt, Human; identical to SEQ ID NO: 76

SEQ ID NO: 2661 - RNA, 85 nt, Human
cugggaccagggcuggugguagaacucagcccggcgcuccucuucaggguugccggcuacaucugucaucaccuugaggucccgg

SEQ ID NO: 2662 - RNA, 87 nt, Human
uagcaugaagucccucuggaucuugagcugguuuauggacucaaucgucucauggaucuuacuguccagagcacugaucuccugcug

SEQ ID NO: 2663 - RNA, 62 nt, Human
ccucuauucuugaagagcguauucuuggagcugauaccucuguugaucuugaagaaacuggg

SEQ ID NO: 2664 - RNA, 65 nt, Human; identical to SEQ ID NO: 1518

SEQ ID NO: 2665 - RNA, 87 nt, Human; identical to SEQ ID NO: 76

SEQ ID NO: 2666 - RNA, 71 nt, Human; identical to SEQ ID NO: 77

SEQ ID NO: 2667 - RNA, 77 nt, Human
ggcgucugcuggaguggcccaaugcuauaugucaguugagguucuaagacuuggaagccacagaaaugcagaaugcc

SEQ ID NO: 2668 - RNA, 85 nt, Human
uguuuuucuccucauccuguaccucuuuuuucauuaagaauccugccuggaaguuuaggucaaagaggcugcuuggagcaaaaua

SEQ ID NO: 2669 - RNA, 63 nt, Human
guccgcuucucgcccaacaggagcaacccuaucaucgucuccugugggugggacaagcugggc

SEQ ID NO: 2670 - RNA, 76 nt, Human
uguggguaucuccucagaugggcaguuugcccucucaggcuccugggauggaacccugcgccucugggaucucaca

SEQ ID NO: 2671 - RNA, 120 nt, Human
agcgagcgggcgccgggaagcgaggagacgcccgcgggaggcccagcugcucggagcaacuggcauggcccgagccauggccgccgcguggccgcugcugcugguggcgcuacuggugcu

SEQ ID NO: 2672 - RNA, 65 nt, Human
gucacuugucuggagcuugaagaaguggguauuccccuucccaccccaggcacuggaggagcggc

SEQ ID NO: 2673 - RNA, 99 nt, Human
ggauuuaacaaugggucacuaauugaaaauaaaaagacaaaaggaaaacaggaaauagggacuuuugucucuagaagguuaggggcauuuguugagucu

SEQ ID NO: 2674 - RNA, 68 nt, Human
ucuacuauauuuuacaaaaaaacaacugaacauuuuacacauguacaguauuuuucaguaaaagugga

SEQ ID NO: 2675 - RNA, 97 nt, Human
gcacuuugugccgcaccagcuccagccgguccuuguccucagccgccgccagguaugcgcuggacgcccgcuucuccugcugggcggccuccagugc

SEQ ID NO: 2676 - RNA, 73 nt, Human
gcuccuucugagacuuuaacuccuuggugagcaucagaaccuguugcuccaaggcugccacuuucuccugggc

SEQ ID NO: 2677 - RNA, 131 nt, Human
gggaggugggcccucgauguggccuuuuuguggaaggcgguguugacccuggggcuggugcuucucuacuacugcuucuccaucggcaucaccuucuacaacaaguggcugacaaagagcuuccauuuccc

SEQ ID NO: 2678 - RNA, 68 nt, Human
ggugaggacucugccuggggcucugcugaugguuccgaaucauggagcugcagagagcuccuccagcc

SEQ ID NO: 2679 - RNA, 72 nt, Human
aaaaugagacugucaaacuuuacaguauaaucaaaucaaauuacaaaguuagaugaccaguauucucauuuu

SEQ ID NO: 2680 - RNA, 71 nt, Human
ggccaagugcagcggcucaugccuauaaucccagcauuuugggaggccaaagcaggaggaucacuugagcc

SEQ ID NO: 2681 - RNA, 63 nt, Human
guauuuauaaucauuuacuuguagcgaacuguuuaaaguuaacacuuguuuaaauuuuuuuac

SEQ ID NO: 2682 - RNA, 63 nt, Human
uggucagcuggucccugcggguccuaccagccagcuucucuguagggcucucggccgcgucca

SEQ ID NO: 2683 - RNA, 129 nt, Human
acauacgaaguuaccaccucaagggaauaacagaagaacguugcacaauguaucuacgggguacgcgaguucaaacaaugugggcacagcaacuucacucuacacacucugaccaucgcuucaguaugu

SEQ ID NO: 2684 - RNA, 66 nt, Human
ccacgcucagcuccgacugggacggcgagcgcaccgcgccgcagugucuacuccggaucaagcggg

SEQ ID NO: 2685 - RNA, 64 nt, Human
guucguuguaccugauacuguugacaugacuaagauucaugcauugaucacaggcccauuugac

SEQ ID NO: 2686 - RNA, 112 nt, Human
ucuucugaauuaucacagaaagaagaaaguuagaagaguuuaauguuaaguguauuaaaaaucauauucuaauucuuuuaauuugguuaucugaguaugauaauauaggaga

SEQ ID NO: 2687 - RNA, 71 nt, Human
cagcccaagccugacuauggagcugcuguggcuuucuuugaggagacagcccgccagcugggccugggcug

SEQ ID NO: 2688 - RNA, 79 nt, Human
aagagaaaaugguacagcaguuacaagaggauguggacauggaagaugcuccuuaaaaaucucuguaaccauuucuuuu

SEQ ID NO: 2689 - RNA, 71 nt, Human
cauuugaaaaugcccuuguggauacuuggaacuguaaauuauuuuauuuuuuacauaaggucacuuaaaug

SEQ ID NO: 2690 - RNA, 70 nt, Human
ugcaucuacauaauaucagauauuacggauguuagauugcaucucaguguaaaucuuuaugauagaugua

SEQ ID NO: 2691 - RNA, 78 nt, Human; identical to SEQ ID NO: 1996

SEQ ID NO: 2692 - RNA, 70 nt, Human
uggaguauuucacacugaggacuaaucugcuaucuucauuccagucccuaccccucagugccugcucuca

SEQ ID NO: 2693 - RNA, 70 nt, Human
gugaguguauauaauguggauuguggcccuguguauuaugauauuugguaguuuguguuauauuauuuac

SEQ ID NO: 2694 - RNA, 68 nt, Human
ugguuguuguguuuccauuuuaguggauaaaauugguauuuugaacuaugaauggagacuaacgccca

SEQ ID NO: 2695 - RNA, 82 nt, Human
auguuuucauacuggguacuacugaaauuuugcagaugugugcaucuguuccauuuaaggugcccuuaaauguguugaaugu

SEQ ID NO: 2696 - RNA, 62 nt, Human
uguguugaauguuuauguguaauggcuaaaguaucuauauguaugugcauaaaacugucaca

SEQ ID NO: 2697 - RNA, 69 nt, Human
aguaaggauaggccccaaauguggacagauccucuuagucacaugagccucuuggggucuauuuucucu

SEQ ID NO: 2698 - RNA, 86 nt, Human
uuuuauuuuuuuuuugagacggaguuucgcucuucucacccaggcuggagugcaaagcgagacucugucucaaaaacaaaacaaaa

SEQ ID NO: 2699 - RNA, 77 nt, Human
cugggacccuguacacguauccugaaaacuggagggccuucaaggcucucaucgcugcucaguacagcggggcucag

SEQ ID NO: 2700 - RNA, 72 nt, Human
gccaugcagaccuggcacggcgguuccuggggggccuacgaguccagggaccccguggcgcaucuggacagc

SEQ ID NO: 2701 - RNA, 102 nt, Human
cacuacguugaccugaaggaccguccauucuuugccggccuggugaaauacaugcacucagggccgguaguugccauggucugggaggggcugaauguggug

SEQ ID NO: 2702 - RNA, 90 nt, Human
cuugugggagagauuaucaagcguuuugagcagaaaggauuccgccuuguuggucugaaauucaugcaagcuuccgaagaucuucucaag

SEQ ID NO: 2703 - RNA, 98 nt, Human
accuugguggagaacaagaaagcucagcugguggugauugcacaaccgacguggauucccaucgaggcugguuggucuucuuggccugccccuggggu

SEQ ID NO: 2704 - RNA, 101 nt, Human
ggcccuggacccgccaaacagcuacucagcugcuuaagcuggcccacaaguacagaccagagacaaagcaagagaagaagcagagacuguuggcccgggcc

SEQ ID NO: 2705 - RNA, 60 nt, Human
ggugaauccccuguuugagaaaaggccuaagaauuuuggcauuggacaggacauccagcc

SEQ ID NO: 2706 - RNA, 63 nt, Human
ggcagcacacuggagcaaaagaagaaaaaccagcacaauucaucuuauuaccacuuagcagcc

SEQ ID NO: 2707 - RNA, 78 nt, Human
gggugcuccuuggggcacgcagacgguugugaaccuccggggcuggggggaauggccugcggugucgacagggcaucc

SEQ ID NO: 2708 - RNA, 66 nt, Human
gcaggggcuggcacugaugggcgaggggaggaagugccucccuuagaaacuugggccaaacccugu

SEQ ID NO: 2709 - RNA, 64 nt, Human
gggugggggcuggggguugggaaaagccauuuccugagaaguguccggcuccugggucucacuc

SEQ ID NO: 2710 - RNA, 60 nt, Human
uaaguguauauaacaguauaguaaguuuuagaaauuuaagguauuacuaugguauucuug

SEQ ID NO: 2711 - RNA, 66 nt, Human
cccaucucugugacuuccuuggagacucacuuccuaaugaggagugagcuucaucgagaagauggg

SEQ ID NO: 2712 - RNA, 78 nt, Human
cuggccgaggagaagcgcgagggcuacgagcgucuccugaagaugcaaaaccagcguggcggccgcgcucucuuccag

SEQ ID NO: 2713 - RNA, 98 nt, Human
gugggguaaaagcccagacgccaugaaagcugccuuggcccugggagaacaagcugaaccaggccuuuugcaucuucaugcccuggguucugccccgc

SEQ ID NO: 2714 - RNA, 130 nt, Human
cggcuauuuuuuuuuucuauuuuaguagagaugggguuucaccauguuagucuugaggucaggaauuugagaccaggcugggcagcauuggugaaaccccgucucuacaaaaaaauacaaaaauuagccg

SEQ ID NO: 2715 - RNA, 86 nt, Human
uuuguuuuuguuuuuuuaauggucagauggauagaacaacacagguuuuguuuguuuguuuuaacuuuuaaaaaaauuauaauaga

SEQ ID NO: 2716 - RNA, 61 nt, Human
cuacacauuuaaaggaacuguuaaacugaaaaagacuugacaauuuuugguaaauccguag

SEQ ID NO: 2717 - RNA, 74 nt, Human
gcuggugacggcggcgggcacugcugagucacgugaaacacagguucccccacguuccccccacccccgccggc

SEQ ID NO: 2718 - RNA, 70 nt, Human
gccagccccugggguuuccaccuccugccuccggcccuccagaggggugaggccccaaccccagggcagc

SEQ ID NO: 2719 - RNA, 82 nt, Human
gccaugccaucgucagugaccccgaggcagguaacgcuguugacgugccaucgaggacugcugcacggucgcccuucauggc

SEQ ID NO: 2720 - RNA, 70 nt, Human
ccauccugucuuccucccagggucugguuggcggcuuuuuacucucaauaaaggauggauggauggaugg

SEQ ID NO: 2721 - RNA, 81 nt, Human
cggauggagcuugagcaacgccccgcccuuuguugagauuccccaacccugcuagccuuguaaacuccugagccuucaccg

SEQ ID NO: 2722 - RNA, 74 nt, Human
cgggauaauggggucucaaaagguuuuggaaguaguagauaccucuaaaagccaaggagcagcccuaguucucg

SEQ ID NO: 2723 - RNA, 64 nt, Human
gaguuguguacuuauaagaggaagcagaacuugcauggaggaguuugggaugggugcacaacuc

SEQ ID NO: 2724 - RNA, 66 nt, Human
uccugugggugguauucugauugggaagggauuuuuuucaauuguuuacauucuaccugagcaggg

SEQ ID NO: 2725 - RNA, 78 nt, Human; identical to SEQ ID NO: 99

SEQ ID NO: 2726 - RNA, 65 nt, Human; identical to SEQ ID NO: 247

SEQ ID NO: 2727 - RNA, 80 nt, Human; identical to SEQ ID NO: 100

SEQ ID NO: 2728 - RNA, 72 nt, Human
ccgcuucacuggcaccauggaugccuucgugaagaucgugaggcacgagggcaccaggacccucuggagcgg

SEQ ID NO: 2729 - RNA, 83 nt, Human
ccuucgagaugugcccuucucagcccuguacugguucaacuaugagcuggugaagagcuggcucaaugggcucaggccgaagg

SEQ ID NO: 2730 - RNA, 130 nt, Human; identical to SEQ ID NO: 2385

SEQ ID NO: 2731 - RNA, 65 nt, Human; identical to SEQ ID NO: 2386

SEQ ID NO: 2732 - RNA, 63 nt, Human
acuuuauuuuucuuacacuuuuaagguugaugaaaaaccuucauuucaauugaaaaguauggu

SEQ ID NO: 2733 - RNA, 88 nt, Human
gucaucaucaucaucaucgucaucaucaucaucuucacguuuucuuuucaaugcauuugaugauucauuggcaguauuuugugaugac

SEQ ID NO: 2734 - RNA, 68 nt, Human
uuagugguaauaagaauguuuuuggacccgauuaaugauggauuaaucagaacauucugaacugcuga

SEQ ID NO: 2735 - RNA, 74 nt, Human; identical to SEQ ID NO: 424

SEQ ID NO: 2736 - RNA, 86 nt, Human
gucgguagggggcagucuugcuuuauucauccuccaucucaaaaugaacuuggaauuaaauauuguaagauauguauaaugcuggc

SEQ ID NO: 2737 - RNA, 99 nt, Human; identical to SEQ ID NO: 425

SEQ ID NO: 2738 - RNA, 78 nt, Human; identical to SEQ ID NO: 99

SEQ ID NO: 2739 - RNA, 65 nt, Human
gcgacaugggccucuauaaaagguucuuaaaaccaucuugggggccggggggcccugaugguugc

SEQ ID NO: 2740 - RNA, 80 nt, Human; identical to SEQ ID NO: 100

SEQ ID NO: 2741 - RNA, 81 nt, Human
ggaggggcugggcucuaccccuuucuucuuuccauccagucuauugccagauccagagaaagcgcggaagcccagcucucc

SEQ ID NO: 2742 - RNA, 84 nt, Human
aaauccuguuuuacuaucucaacugugcuuaggcagcauuuuaacguuuaagucacagcugaaaauaaaaagaaaacaagauuu

SEQ ID NO: 2743 - RNA, 63 nt, Human
ugguggcaugugccuguagucccagcuacucaggaggcugaggcaggagaauugcuugaacca

SEQ ID NO: 2744 - RNA, 70 nt, Human
cucgaggaaaaaggcucgaaucuuauaaugagauacccuuugaacagaucucgauucgaaccggcccggg

SEQ ID NO: 2745 - RNA, 70 nt, Human
gcaugagaucuuugcgcguucgagguguuaccauaugcccguaagauuuuagaccgugcaauuauuaagc

SEQ ID NO: 2746 - RNA, 67 nt, Human
gaugaccuuucagaugcuuucucuggaacugaaccagagguucacaaaacaaguguaguagguuguu

SEQ ID NO: 2747 - RNA, 65 nt, Human
gcacagaaaucaaaaguguagcuaaugcuugauauguucaacugggagacacuauuuaucugugc

SEQ ID NO: 2748 - RNA, 65 nt, Human
caccuucaaugucacugucaccaagacugacaagacgcuagucuugcugaugggcaaagaaggug

SEQ ID NO: 2749 - RNA, 66 nt, Human
gggacucacugcugcaggauggggaauuuagcauggaucuucguaccaagagcaccgguggggccc

SEQ ID NO: 2750 - RNA, 90 nt, Human
uggcggacgggaccugucaggacgcggccaucgugggcuacaaggacucgcccuccgucugggccgccguccccgggaaaacguucguca

SEQ ID NO: 2751 - RNA, 101 nt, Human
gagagcaggcgcugggcaguguggaggucguuggagucacuuccgcgucaccagcuccugugccugccagucggugccccucccgcuccagccaugcucuc

SEQ ID NO: 2752 - RNA, 74 nt, Human
gucccugucauugguggccaugcugggaagaccaucaucccccugaucucucagcgcacccccaaggugggaac

SEQ ID NO: 2753 - RNA, 69 nt, Human
uggaggcaucgggcagccacuuucacuucuccugaagaacagccccuuggugagccgccugacccucua

SEQ ID NO: 2754 - RNA, 73 nt, Human
gcugggagccuugagagccaugugcaagaggacagauccuguuccugucaccauugcucucgauucacucagc

SEQ ID NO: 2755 - RNA, 83 nt, Human
ccaccaucaucugauuuucuagcugauguuguugggcuacaaacugaacaaagagcuggagaucugcccaagacaauggaagg

SEQ ID NO: 2756 - RNA, 67 nt, Human; identical to SEQ ID NO: 681

SEQ ID NO: 2757 - RNA, 71 nt, Human
agagggauguagccagauucuguggaccgccgucuuuuucacccuuaagaauccgucgcuaugauuucucu

SEQ ID NO: 2758 - RNA, 60 nt, Human
auuugcaauaaaugauucacuccuuagcuccaaaagcaaguccuuuaucaaaaugcaaau

SEQ ID NO: 2759 - RNA, 74 nt, Human
gagcaugaaagcagcaaggggguaaggaugcacacggagaucugacguucgcagggacuuccaugcucauguuc

SEQ ID NO: 2760 - RNA, 66 nt, Human
ccuuucuccguccuucauggaagcccugggagauaaccuggcuuccuggaguugauggaauaaagg

SEQ ID NO: 2761 - RNA, 76 nt, Human
auguaaacucgcguccgugcugcgugcccagaguaguggccgaauaccuuaacggggcugugcgcgaggagagcau

SEQ ID NO: 2762 - RNA, 78 nt, Human
ugcgcauucccaagucacgaugucacuguacauccgaucggagaugaggauacaugugugaugccacuggaugaugca

SEQ ID NO: 2763 - RNA, 72 nt, Human
gggcagcugagcgaugccaggaacaaagagaaccugcaaccgcagagcucugguguccaaggucaggugccc

SEQ ID NO: 2764 - RNA, 60 nt, Human
ggcggaucaccugaggucaggaguuugagaccagccugaccaauguggugaaaccccguc

SEQ ID NO: 2765 - RNA, 71 nt, Human
gggaguaaggcagggcagugugccacccccugcaagauggacccaggcagagugcccugaucuucccuccu

SEQ ID NO: 2766 - RNA, 63 nt, Human
ggaguggagggggcugcccacccucgcuguacacagcugggcccagauggccccuucugaucc

SEQ ID NO: 2767 - RNA, 68 nt, Human
uugcaaucugaacucgggccguuaaauauaccgcgggaacgguuggcaaauggcgaguuuuuuugcaa

SEQ ID NO: 2768 - RNA, 81 nt, Human
agaguggcuuugagaauuuuguaaggaacaaacauguuuuugguucuggaauauaggaggugcucaauaaaaguugacucu

SEQ ID NO: 2769 - RNA, 76 nt, Human
gauuuuaagaaaacuguaaaagccaagauuuuguaguaaugacacaaauguaacaaauagauguuuucuuaaaauu

SEQ ID NO: 2770 - RNA, 60 nt, Human
caggccugagaagcugcccuccuagggcccucccaguggccugucucucccagcggccug

SEQ ID NO: 2771 - RNA, 82 nt, Human
gccugucaccuaaaucuuaugcaacuuaucaaagaaaugcuucuacauucuuacaaagaccacuaggaagagguggcaaggu

SEQ ID NO: 2772 - RNA, 106 nt, Human
accauccaccaccgucuucuuuagaacacuguuuucugggaucugauguuaaccagccgucauugucucugucauacgugcugaagaacaugccguugugaauggu

SEQ ID NO: 2773 - RNA, 69 nt, Human
ggggacuauugcugugggaagaagggccugaucuucauacucaucuuccucauugaguaccaugacccc

SEQ ID NO: 2774 - RNA, 102 nt, Human
ggugacgcugcggggcgggcggacagacugcgggacggacgguggacgcugggacgcguuuguagcuccggccccgccguuccgacccccgccgccgucgcc

SEQ ID NO: 2775 - RNA, 69 nt, Human
ugugguccaaccugggcauuggccuagcuaucucccugucugugguuggggcagccuggggcaucuaua

SEQ ID NO: 2776 - RNA, 74 nt, Human
guugccaaggaaggcuuuuucugauuuuuugacaaaugaauuuuugcacacuuucauuggugucuuucggcaac

SEQ ID NO: 2777 - RNA, 64 nt, Human
aggcgggcggaucacgaggucaggagaucgaaaccauccuggcuaacacggugaaaccccgucu

SEQ ID NO: 2778 - RNA, 61 nt, Human
uguguccuugacuaaaaccauacguggcuauggaaaccauguuuguaguucugaauacaca

SEQ ID NO: 2779 - RNA, 60 nt, Human; identical to SEQ ID NO: 1551

SEQ ID NO: 2780 - RNA, 65 nt, Human
ugccccccgggccgucuuccccuccaucguggggcgccccaggcaccagggcgugauggggggca

SEQ ID NO: 2781 - RNA, 65 nt, Human
ccaggagcccgugagugugccccagacacugacuagcacgcuggagcacauugugggccagcugg

SEQ ID NO: 2782 - RNA, 93 nt, Human
gugaauugcuauauuguucaccagaaagacagaaguuaauccccagaugggaaauuucagauuuuucuuuugguuugcuuuuugguuuuucau

SEQ ID NO: 2783 - RNA, 62 nt, Human
ugggggguguugcuauguugcccggguugggucuugaacuccugacuucaagcaauccccca

SEQ ID NO: 2784 - RNA, 67 nt, Human
uuuuugcuuuggcaauuacauuuauguucuugggagcccagacacugauauaaauuuccagcaaaaa

SEQ ID NO: 2785 - RNA, 67 nt, Human
gcugugcggcucaaggagaagaagcuggugaaggaggucaucgccgucagcugugggccugcacagu

SEQ ID NO: 2786 - RNA, 72 nt, Human; identical to SEQ ID NO: 2728

SEQ ID NO: 2787 - RNA, 65 nt, Human; identical to SEQ ID NO: 2386

SEQ ID NO: 2788 - RNA, 86 nt, Human
aaggaucuaaacauugagauuuuuaaaucaagguuuugaguuggcacaauguuccuacuaagucaaguuucaauuagcacaucuuu

SEQ ID NO: 2789 - RNA, 61 nt, Human
augccaggaaaaggucucagguguagagggucuacauuucaggauaaauggucucuggcau

SEQ ID NO: 2790 - RNA, 68 nt, Human
cuaaagcuguauauuuaugaagaaaaggugauugucccuuuuuaugcauguguaggaucuuguuuuag

SEQ ID NO: 2791 - RNA, 61 nt, Human
gugguguuguuuuugguccugauaagaagcugaagcugucuauccucuacccagcuaccac

SEQ ID NO: 2792 - RNA, 85 nt, Human
ggaaauugacaucuaugcuaaccugucugaugaaaaggcuuucguguuuucagucgccuuggcagaaauaaauagaaaaauuauc

SEQ ID NO: 2793 - RNA, 105 nt, Human
uccuuguuuaccaaggaguauugucaguguuuaguguugggauauaaguaaguguauuugccaacaacaaaaaaaaacaaaaaaaugcuggauggauguuaagga

SEQ ID NO: 2794 - RNA, 60 nt, Human
auagagaaaacacugauugauaauaggcauuuuaguggucuuuuuaauguuuucugcugu

SEQ ID NO: 2795 - RNA, 79 nt, Human
aauguggucgaagauucaaaagcauguuaccuucaaccaagugaaaggcauuuucggcuucacugacagcgacugcauu

SEQ ID NO: 2796 - RNA, 62 nt, Human
gcauguaggucaccucauuccauuuauuuucacaaaguggcuccaggauguauuuaacgugc

SEQ ID NO: 2797 - RNA, 68 nt, Human
gcccugcagggagccagaccaaaaugagugcaacgaaccaaaucaucaucuuuccucaccgacagggc

SEQ ID NO: 2798 - RNA, 62 nt, Human
ucugauguggaccggucuuaauguacugacuucuuccucaggagagacagucgacaaucaga

SEQ ID NO: 2799 - RNA, 62 nt, Human
uggcaucaugcccggacagaccugaagaagaaucgggacuacccauagcuccaaagaugcca

SEQ ID NO: 2800 - RNA, 94 nt, Human
ucuuccgccguaucaggacgcugaaagggaaacuggccaggcagcacccagaggccuucagccauaucccagaggcauccuuccuggaggaaga

SEQ ID NO: 2801 - RNA, 64 nt, Human
caccgcgccgacguccccucggccugcgcucuccucccgcuuguccccuguguucgugcuggug

SEQ ID NO: 2802 - RNA, 66 nt, Human
gcacucuguucuuccgccgcuccgccgucgcguuucucugccggucgcaauggaagaagagaucgc

SEQ ID NO: 2803 - RNA, 86 nt, Human
gcccuccgcgcgccuacauuucucggugcuacugaugcccgcccacuucucauuugucgcaccgccguguucgcgccccgcgccgc

SEQ ID NO: 2804 - RNA, 89 nt, Human
uucguuuugaccacauauauaccaagccccuuagucuuagagauacccucugagacagagagccaagcuaaugugguagugaaaacgag

SEQ ID NO: 2805 - RNA, 86 nt, Human
cgauuuucuucuacauucauugaugccccuuguaauguuugcauacacuagaaaaugccuucaauuuguguuuuaccagaauuuug

SEQ ID NO: 2806 - RNA, 61 nt, Human
uaucuuucaucauuaaacauccuucuuuuucuauuguuuggguguaauuuuuguaaagaua

SEQ ID NO: 2807 - RNA, 60 nt, Human
cccugcuagccuuuaaguggaugguuucucuuagccaguucuuaauuuuuguuagggggg

SEQ ID NO: 2808 - RNA, 67 nt, Human
ggcgggguggggaauaaauauauuaagugccucuuggcauuugggguguuuaaacaauaacccggcc

SEQ ID NO: 2809 - RNA, 74 nt, Human
uaaaggugaccguaaggagucccuuggggaggauuugaaaauuuguccuucccaaaaguugcccggaaccuuug

SEQ ID NO: 2810 - RNA, 101 nt, Human
gaggccgucaaagugcacagcuuccccacacucaaguucuuuccugccagugccgacaggacggucauugauuacaacggggaacgcacgcugaugguuuu

SEQ ID NO: 2811 - RNA, 68 nt, Human
aucccuugugcugacgcgacgggaugccagcaagagcugguauaauuaucgucgcgcugaagagggau

SEQ ID NO: 2812 - RNA, 104 nt, Human
cgggcuuuucaaaaaggagggacacaaauuaaacccuuuccccuuuguuggacgcccccuuucaacauagggaggggauuugcuccuccacaagagaagcagcg

SEQ ID NO: 2813 - RNA, 96 nt, Human
cuacaugaagaagagagaagaggagaugcgugauaccaagagucaaaaaacucggguccuauacuucagcaucuuuucaaguucugucucaugugg

SEQ ID NO: 2814 - RNA, 70 nt, Human
ggauccuaccaacaggcccuccaggccgugggguuuugccaaaagaacccuuuggggggggccugggucc

SEQ ID NO: 2815 - RNA, 71 nt, Human
gguccuugccaucuccuuccaucugcccauuaacucucgcaagugccuccgugaggagauucacaaggacc

SEQ ID NO: 2816 - RNA, 72 nt, Human
aggaggagcagugagggauuuauuaaauggaguaaagccucaggauauagauuugccaccacugcuaccccu

SEQ ID NO: 2817 - RNA, 85 nt, Human
gaugcugaggugccuguaucauuggcacaggccagugcugaaccguagguggaguaggcugugccuucugaagcaguaucuauuc

SEQ ID NO: 2818 - RNA, 66 nt, Human
uugagauuacuacacuacggauugaugucaccacugauggaagacaugcugagguagaauuuacaa

SEQ ID NO: 2819 - RNA, 60 nt, Human
cauaggcuuugauucugugagcccaaauucacauauugaagaagaucaaagcaaacugug

SEQ ID NO: 2820 - RNA, 72 nt, Human
gcucacuagucacaggucuuuuagguccuucuggaugucccacaggguaucugcacuuuucuugagcugagc

SEQ ID NO: 2821 - RNA, 64 nt, Human
uuggguaauccacuuaguuuccagguaacauacguaagaauguccacuggguuggaaaccccaa

SEQ ID NO: 2822 - RNA, 61 nt, Human
gccaguuuaacugucuagcaaaaugcauuucauuuuaaaauuggauauugggagacuuggc

SEQ ID NO: 2823 - RNA, 64 nt, Human
guccauauuacccuucagcaccugagucccaagcugaggucucaacaugggugaugugaaggac

SEQ ID NO: 2824 - RNA, 66 nt, Human
gucacuuuaaacugaggaaacggcaaaugguguuuuaaagcucuuuguauuucuccaguuucugac

SEQ ID NO: 2825 - RNA, 60 nt, Human
cccugggguuggggccucaccccucuggagggccggaggcaggagguggaaaccccaggg

SEQ ID NO: 2826 - RNA, 66 nt, Human
uggcuuuuuuaaaacugguuuuauuuuaauuuuuauuauauuuucaguuuuuccauaaaggagcca

SEQ ID NO: 2827 - RNA, 68 nt, Human
cccugagcgcaagagccaagccgccagcgcugcgaugugggccacgcugccgcugcucugcgccgggg

SEQ ID NO: 2828 - RNA, 65 nt, Human
ccugcggucugguuccuccaucagggcgcuguggguauggcccugaggugaggggcaggccuggg

SEQ ID NO: 2829 - RNA, 60 nt, Human
gaggacauucaaaacccuccagccacagauggccagaaacuuugguuuguguuuguuuuc

SEQ ID NO: 2830 - RNA, 73 nt, Human
cuacuaggggggccgaugucgcguaucccuccugucaccuggaccaacgcguaaacgcggcccacuuuaguag

SEQ ID NO: 2831 - RNA, 64 nt, Human
guguguuuagggggggcguggcuagcgcccuuucccuuacgucacccccccucuuggucaccac

SEQ ID NO: 2832 - RNA, 67 nt, Human
gagcaagcggggcccgcgcagcuucaggguccgcaagggccggggcgccaagggcaucggcuuccuc

SEQ ID NO: 2833 - RNA, 73 nt, Human
gggcuggagguucgugcagaucaaggagauggucccggaguucgucgucccggaucugaccggcuucaagcuc

SEQ ID NO: 2834 - RNA, 80 nt, Human
gcgucguagcagccaugcccuagaccgucauacacuaaucuacuccuaaugaccaagaucuauugcacgauacaugacgc

SEQ ID NO: 2835 - RNA, 63 nt, Human
auuuggcucucuuauaucccaugcauauccaccaccaugauauguucccaccaguacccgaau

SEQ ID NO: 2836 - RNA, 72 nt, Human
ggaucgugccgcccgccuuucuugaccgucaucguuuggcucuccacauuuugcuuaccgugcucgcugucc

SEQ ID NO: 2837 - RNA, 84 nt, Human
uuuuuuuuuuuuugauuguuuugacaaguuuuuauugcgcaucaaauugcgucauuguuuuguuuagcauugaaaggaguuaaa

SEQ ID NO: 2838 - RNA, 78 nt, Human
cugggguguuuauggcaagucacuuugacagacauuauuguggcaaaugucgucugacuuacuguuucaacaaaccag

SEQ ID NO: 2839 - RNA, 72 nt, Human
guaccagcacuuaaauuugucagcaggcugaccaaagaguggccugucuguuggcauucaucggacaugggc

SEQ ID NO: 2840 - RNA, 84 nt, Human
ucccuucagcucuccagugaguuucaaguucagagcacuuucaguccuugucuuguuuaucuauuacugaaggguuucuaggga

SEQ ID NO: 2841 - RNA, 104 nt, Human
caauaaauaaauguggauuugugcucuuguauuuuuaaguggauuaaaaaacuuacuaccucaaaaaaaaaacaaacacaguaaacaaaacacacauuuuguug

SEQ ID NO: 2842 - RNA, 66 nt, Human
gccaucuuggcuccuguggaggccugcugggaacgggacuucuaaaaggaacuaugucuggaaggc

SEQ ID NO: 2843 - RNA, 73 nt, Human
ccucugccuugcccccagacccaccagccaggagccagaggagggaggcugaggggcggggacgaggaagagg

SEQ ID NO: 2844 - RNA, 78 nt, Human
cuuccagguccucaguacagaaccaccacgagggaaacccagaccuagguuuccggcgccgacucugaggcccgggag

SEQ ID NO: 2845 - RNA, 70 nt, Human
gucuuucacgccugucucacuccacacggugccccgaccccagggucccgaaagucccaggcuguuggac

SEQ ID NO: 2846 - RNA, 69 nt, Human
ccccagcuaccccuucuuugcagggcuaaggcccccaaacauagccccugccccggaggaagcuugggg

SEQ ID NO: 2847 - RNA, 75 nt, Human
cccguccguggcucgcucccggggcgggucuccgggugacuucgggggcucucgcucgggggucccgcgugccgg

SEQ ID NO: 2848 - RNA, 62 nt, Human; identical to SEQ ID NO: 1789

SEQ ID NO: 2849 - RNA, 75 nt, Human; identical to SEQ ID NO: 1790

SEQ ID NO: 2850 - RNA, 61 nt, Human
cccucauaccaacuguggacuuggaauaucagcagaguaguaggcacaguuguaaaaaggg

SEQ ID NO: 2851 - RNA, 68 nt, Human
gauuucgguaggcacagguguaggugagaagaugagaaagaaaugaugcugagggaccuagugaaauc

SEQ ID NO: 2852 - RNA, 94 nt, Human
guuauauucccagaggaugucagucccaaggaccaguagcugccaucaguuuggauucugaaaacuaacuggcaucaacacuggguguagaaac

SEQ ID NO: 2853 - RNA, 68 nt, Human
uugcccaggcuggagugugguggcacaaucacagcucauugcauccucaaucacccaggccuaagcaa

SEQ ID NO: 2854 - RNA, 89 nt, Human
cgcugguuccugcggcuucugcucagacaccaacgccagacggcgaugccucucggguggugacuccagcgcaggaacuugaagaagcg

SEQ ID NO: 2855 - RNA, 77 nt, Human
uccgauuggugaggcuguccuugggaaaugggugaaauugaaaaccaucaaaacaauuggacuucuuaaaaauugga

SEQ ID NO: 2856 - RNA, 131 nt, Human
ugagugaaagguguuuaugagaagucgaugacuccggaucuuaucauccaagaggacagcacagaauaguuaauuuugucccuggagggacuaggaugcuggacgucuuuuucugauacccgaucauuacg

SEQ ID NO: 2857 - RNA, 68 nt, Human
uggaaucucggagggccacuaaccgggguccuuucucaaggggguuccccagaggaacuccgauuuca

SEQ ID NO: 2858 - RNA, 60 nt, Human
gcacuauacaccaaagucaaucauuauaaagauucacgauggaaguugguucaauugugc

SEQ ID NO: 2859 - RNA, 84 nt, Human
gcuagcuaucugaugagucgcugugccauagcuugaucuauguuucuaucaaauaugguaaguauaaacuucauucauacuggc

SEQ ID NO: 2860 - RNA, 60 nt, Human
gcgccaugcucguccucagaagcgcccugacucgggcgcuggccucacggacgcuggcgc

SEQ ID NO: 2861 - RNA, 87 nt, Human
ggagucuaugaacuggccacuuuucagaugaaaccuggugggccagcucuguggggugaugcauuuaaaagggcaguucaaugcuuc

SEQ ID NO: 2862 - RNA, 87 nt, Human
uggguauggaaucuugcggcauccacgagaccaccuucaacuccaucaugaagugugacguggacauccgcaaagaccuguacgcca

SEQ ID NO: 2863 - RNA, 81 nt, Human
uauucuuggccucaauaucuaccaccuauuuuuuaaccagacaaauuugaauguaucaagauaauuuggggcaagagagua

SEQ ID NO: 2864 - RNA, 74 nt, Human
ggccacgugcugccccuccuggacaauaauuuagcaauaaauacugcgcagggcagggguagggcaccaaggcc

SEQ ID NO: 2865 - RNA, 68 nt, Human
ugccugcaagaggucaggccccugccgcccuacacgaaguugagcgcucgggccucaccccgcaucca

SEQ ID NO: 2866 - RNA, 62 nt, Human
ccauaugcacuuuugagcauuucuacagcaugcgauucuaagaguaaacccacccaauaugg

SEQ ID NO: 2867 - RNA, 63 nt, Human
acccgauuuuuuucaaccguggguauaaaagcugucaaugguaaaaaaaaaaaaaaauugggu

SEQ ID NO: 2868 - RNA, 131 nt, Human
cuaugaaaaagcaaagcacuaucacaaggaauauaggcagauguacagaacugaaauucgaauggcgaggauggcaagaaaagcuggcaacuucuauguaccugcagaacccaaauuggcguugucaucag

SEQ ID NO: 2869 - RNA, 70 nt, Human
uucuugccuggugucggugguuaguuucugcgacugugugggacugcugauaggaagaugucuucaggaa

SEQ ID NO: 2870 - RNA, 76 nt, Human
uauucauucugaugauggauguuugaguuguuuccaguaugggacaauuacaaaucgcucccuaucaggauuuaua

SEQ ID NO: 2871 - RNA, 65 nt, Human
uguggcguguaacaguaguuugcucauuuucauuguuuuauaaacuguuguauaaauaugcccca

SEQ ID NO: 2872 - RNA, 82 nt, Human
aacagaaagauauggggagcuugugagugauuauacuauguucauagaacagauuaauauagagauugacguauuauauguu

SEQ ID NO: 2873 - RNA, 76 nt, Human
cagguuccugcugcucaacagaugcuaagauuuuuccugagaaaaacaaggaaaaagcaguugauugcagaacuug

SEQ ID NO: 2874 - RNA, 81 nt, Human
ucuccguuacugacauuuacuccaagaaaaccauuagcaagaguaaggugcuagugguggaagagaauggcuggacggggg

SEQ ID NO: 2875 - RNA, 72 nt, Human
cuuauuguaacugacaacuguuuucaacuccaagagcuaaacuauuggcaguucauguuaaguuacagugag

SEQ ID NO: 2876 - RNA, 64 nt, Human
ugucagugaguggcucuugugccugcuguaaacauuacgccugcacuagggccaugugcuguca

SEQ ID NO: 2877 - RNA, 72 nt, Human
gagucugaaguuguuaccauggugaaauacugugcaaaaaguguuucucagaaugaugaugguuccagauuc

SEQ ID NO: 2878 - RNA, 89 nt, Human
gaggggaaaggagccccaaagagaagggacgcagggcaaaaaucaugcagccccagcaccccaccucugcgggcuggccaccuccccuc

SEQ ID NO: 2879 - RNA, 85 nt, Human
uauucaucacguuggguugaaaaguuggaagauuuugcaucuuauugaaaagaauuuuucaaaaauguuucuguacaaaugaaug

SEQ ID NO: 2880 - RNA, 62 nt, Human
caccugggcuauauuuuuuuuuaauuuuuaguagaauaaaagaauaauuuuauccucaggug

SEQ ID NO: 2881 - RNA, 63 nt, Human
uaagauuacaggcaugagccaccacaccugggcgcaaugugguccauuccuuuaauguccuua

SEQ ID NO: 2882 - RNA, 87 nt, Human
agcaacuggguucccauggcaugugguggccuuagaggagguguucagccugccaccgucggugcuuuggugcucugcccaggagcu

SEQ ID NO: 2883 - RNA, 64 nt, Human
agggucuuuccaacuguucuggucagugaggacccugacugcaaggaggaguucuggagacccu

SEQ ID NO: 2884 - RNA, 74 nt, Human
ggggggggacgcauauaggcgaaacccggcuggauaauaccccaaguugccuuaagugugggaaaaaccccccc

SEQ ID NO: 2885 - RNA, 69 nt, Human
uuauguuuauacacuguggugcuuuuacuuuuuauuuaaacuaaggcaaaaaaaugguguugaacguaa

SEQ ID NO: 2886 - RNA, 69 nt, Human
aaaagaauuauuuaugcauuccccuuaauugugugccuaacacguuuaacugccuuauuuuauuuuuuu

SEQ ID NO: 2887 - RNA, 63 nt, Human
uuugauucuucagcacuuaauagucugccuggcacuaagugcucaauaaauucugaacucaaa

SEQ ID NO: 2888 - RNA, 69 nt, Human
cagaaaugcuuccuggaauauuacgucagcuuggugcugacaguuuaacaagccuuaggaaguuagcug

SEQ ID NO: 2889 - RNA, 76 nt, Human
gaugucuuauuauuaaaguuaccuauuauuguuggaaauaaacuaauuguauggguuuagaugguaacauggcauu

SEQ ID NO: 2890 - RNA, 62 nt, Human
gcucuccgccgcagcuucagcaccucggcccagaacaaugcuaaaguagcugugcuaggggc

SEQ ID NO: 2891 - RNA, 70 nt, Human
cagcgcaaacuccucaacaacacucucggcaccacaagcguaggagagauggguuggcuuguuugcccug

SEQ ID NO: 2892 - RNA, 77 nt, Human
gauuaaagggagacaauggugucuuggaggcaaacuacaguuugcuguaagauaacuuuccgugcaucuuuuaaauc

SEQ ID NO: 2893 - RNA, 98 nt, Human
gguaccccaggaggaugccuuguaacugcucuuuggucaugauagugguaaugaauccauucauguaaaaugcaauaugucuguuaguuuggggcacc

SEQ ID NO: 2894 - RNA, 67 nt, Human
ccgaggaagcuaaggcugcguuggggugaggcccucacuucauccggcgacuagcuaccgcgcucgg

SEQ ID NO: 2895 - RNA, 69 nt, Human
gggcauuugaagucauggucaucaaaaagaaaugauuguuuuuugaaaagcuaaaugcuuaaaaugcuu

SEQ ID NO: 2896 - RNA, 67 nt, Human
gguuguugaguuuguuuuuaaacauuuuuauaaguucaugagaaaaaauauauaaauucuaagaacc

SEQ ID NO: 2897 - RNA, 63 nt, Human
uggacucuggggggacaccaaagaugcccugugaccacuuuugguguugcccgaguuagucca

SEQ ID NO: 2898 - RNA, 60 nt, Human; identical to SEQ ID NO: 1551

SEQ ID NO: 2899 - RNA, 69 nt, Human
cggggccaaaaaaggggggggguuuaaaccccccggagggggggcccccuuuuuuuuuugccgaccccg

SEQ ID NO: 2900 - RNA, 63 nt, Human
ggucaccccgccggccccgacgggcgcccuggcgcccggggguacccagaggcgggaaagacc

SEQ ID NO: 2901 - RNA, 73 nt, Human
uuuuuuuuuuuuuuuuuuucccgggcccacuuuuuuaauuuuuuuuggguugguuuaaaaaaaaaaaaaaaaa

SEQ ID NO: 2902 - RNA, 61 nt, Human
acggaucccaggagcccacacaugacauccugcagaugcucagugaccuccaggagucugu

SEQ ID NO: 2903 - RNA, 76 nt, Human
caugucuuaucccgcugaugauuaugagucugaggcggcuuaugaccccuacgcuuaucccagcgacuaugauaug

SEQ ID NO: 2904 - RNA, 62 nt, Human
uggcaaugaugcugucuuccugauuuuauacaaagaauuauacuacaggcacauauaugcca

SEQ ID NO: 2905 - RNA, 60 nt, Human
uccggauuuucggauucgucgacccacgcguccggucggcagcugugaggggguuccggg

SEQ ID NO: 2906 - RNA, 74 nt, Human
uccugcuuauuguaacugacaacuguuuucaacuccaagagcuaaacuauugggcaguucauguuaaguuagga

SEQ ID NO: 2907 - RNA, 65 nt, Human
gagaaaacugguuuuucuguuucuagcaaagauaguaaaggcuuagaaauaaaaucuguuuucuu

SEQ ID NO: 2908 - RNA, 75 nt, Human; identical to SEQ ID NO: 74

SEQ ID NO: 2909 - RNA, 87 nt, Human; identical to SEQ ID NO: 76

SEQ ID NO: 2910 - RNA, 88 nt, Human
uccaguggcgggacccaaugcagacuggcauuuaaggcugggggauagcuuuggugcccauuggcccgucggcccgccgugaacugga

SEQ ID NO: 2911 - RNA, 71 nt, Human; identical to SEQ ID NO: 77

SEQ ID NO: 2912 - RNA, 81 nt, Human
gagguuaucuugugguuuauuuuauauucuacuuaacuuuaacauuucugcagguagaauaaauauccuauuuaaagcuuu

SEQ ID NO: 2913 - RNA, 83 nt, Human; identical to SEQ ID NO: 1471

SEQ ID NO: 2914 - RNA, 75 nt, Human
cgaccucaacgucacccgccugucccacuuugaguacgucaagaaugaggaccuggagaagaucggcaugggucg

SEQ ID NO: 2915 - RNA, 80 nt, Human
gcagaggcugggaggcggcagaaugcagccagaggagggcacaggcuggcugcuggagcugcuguccgaggugcagcugc

SEQ ID NO: 2916 - RNA, 85 nt, Human
ucucucccugaccgcagccgcugggauuuggggcuccaugggggagagaucugcuuaccagcgccuggcugggggcgaggaggga

SEQ ID NO: 2917 - RNA, 61 nt, Human
ccauuuaaaaaugcuuggaacuauaugugaauaauuauacaaaguuccagaugcaacaugg

SEQ ID NO: 2918 - RNA, 63 nt, Human
caaggggaggaucaagugggggggugcaucucggucacccaucaacaugguuuuucacucuug

SEQ ID NO: 2919 - RNA, 73 nt, Human
ucuuuguuugaaaaucuauauaaaguacaacuugcuuuuagcaugauuauuuuccuaaauaaaaagacaaaga

SEQ ID NO: 2920 - RNA, 66 nt, Human
cuccucaccgccuggcuaccugaccuugguguugagcuucagguaugccacauagugugucaggag

SEQ ID NO: 2921 - RNA, 104 nt, Human
ggcagccacagguuucaacucccauuugugaauaaauuaaaugacucuuuacaaaaccaucagcagucuugguguaucacauuugguauuuagaaacuuuuguc

SEQ ID NO: 2922 - RNA, 91 nt, Human
augcaaaugucuucagguuagaaagccuuuauuuacuuuggaaaugaacaagaaaugccucugucuuagaaaccuggagauuauuugacgu

SEQ ID NO: 2923 - RNA, 69 nt, Human
ucaacuaaugcgacuuaugguagccaaggaagcccgcaauguuaccauggaaacugagugaaugguuga

SEQ ID NO: 2924 - RNA, 60 nt, Human
gcuaccuguacagaauggauuacauaugcaaaaauaaaaaucucaagaccacaggacagc

SEQ ID NO: 2925 - RNA, 61 nt, Human
ggggggagugaugcauggaaggaaaagccaccggccauggaaauuaguacagaaccccccc

SEQ ID NO: 2926 - RNA, 63 nt, Human
aguucuuggauugauagcaacaaaggcucaugcucccccuucccucccuaucuuugaagaacu

SEQ ID NO: 2927 - RNA, 86 nt, Human
uuggugaaguauuuuguuaccucagucuuguauucaaguugcuguauuuuuucagcuuguuacauugauaauaauuauuucaccaa

SEQ ID NO: 2928 - RNA, 67 nt, Human
caguuccuauuauguggugaaauuuuguaaauaaaugauuauacaaaacagucaccaccuagaacug

SEQ ID NO: 2929 - RNA, 68 nt, Human
gcuucaauuuucucauuuguaauuuaggggacuuacccauuuuuauaggauuuacuaggaaauuaagu

SEQ ID NO: 2930 - RNA, 61 nt, Human
cuggguguuagaauggugaccaagaguuaaccgagcuguguggugccuaucuccuguccag

SEQ ID NO: 2931 - RNA, 62 nt, Human
gucuggggaccacgcuuggggggcaacgccguuccgcaaguggacaguuaaaggccaaggac

SEQ ID NO: 2932 - RNA, 85 nt, Human
uggaaggcuucuuuuacccagcuggaagggacggauuccuggacuucuaugugacuuccagaaauggggaaguaggagcucucca

SEQ ID NO: 2933 - RNA, 71 nt, Human
cuuucuauuucacuggcccaggugggggggcggagaguaacuuugagucugugggccagugaaauauaaag

SEQ ID NO: 2934 - RNA, 65 nt, Human
gcugagcaggacgugcccuccacccugggacccaucucccagggucaccagcaugaaugcucggc

SEQ ID NO: 2935 - RNA, 96 nt, Human
aagaaggcaaagacuggggcagcagggaaguuuaaaaggggaaaauaaauguguuuccccauuauaccuccuucaccccagaauauuugccgucuu

SEQ ID NO: 2936 - RNA, 76 nt, Human
guggagcgagccaaaugaagaagagcugaucaaguucauguguggugaaaagcaguucucugaggagcgaauccgc

SEQ ID NO: 2937 - RNA, 71 nt, Human
uuggcuccacaaggaggcucaccagcucuucuuggaaccugaggugcuggacccagagucuguggagcuga

SEQ ID NO: 2938 - RNA, 64 nt, Human
aacaacuauggccggaaccuccucagcucucccucugcagaguucccuacccuaagagaauguu

SEQ ID NO: 2939 - RNA, 73 nt, Human
cagcuuguauaauguaaccguuugggguccgcuuuuaacuuggacuaguguaacuccuucaugcaauaaacug

SEQ ID NO: 2940 - RNA, 61 nt, Human
gccaugcugucuagucuugaagucccucauuuaaacagaggucaagcaauaggcgccuggc

SEQ ID NO: 2941 - RNA, 66 nt, Human
aagaccagucagugguugcuccuacccauucaguggccugagcagugggagcugcagaccagucuu

SEQ ID NO: 2942 - RNA, 72 nt, Human
gccagcaggggcuggcacugaugggcaaggggaggaagggccucccuuaaaaacuugggccaaacccugggc

SEQ ID NO: 2943 - RNA, 77 nt, Human
ggaaaaaccaccgggggggggcuggggguugggaaaagccauuuccugaaaaggguccggcuccggggucuaacucc

SEQ ID NO: 2944 - RNA, 61 nt, Human
ggcuugccuaaggccccgcaaaagucccugaaaaggcaggccugcggggcagggggcuguc

SEQ ID NO: 2945 - RNA, 82 nt, Human
agaacuggguuucuggggauaaggggaaaggccagcuugagucuuaccggaauugggcguggccccgucuucagagaguacu

SEQ ID NO: 2946 - RNA, 84 nt, Human
uuaccucacaggagcuuuggcaucccagcuugcuaggcucugaauuggcucaagcauugggugucacggcauccuuugagauaa

SEQ ID NO: 2947 - RNA, 64 nt, Human
ccccagccccugcgcccggcccgaacgagagguuccggagccccggcgcgggcggguucugggg

SEQ ID NO: 2948 - RNA, 85 nt, Human
guagacgcugcuggccagcccuccccagccgagguucucggcaccgccuugagagcuucagcugccccagggugugcagguuugc

SEQ ID NO: 2949 - RNA, 65 nt, Human
cggaggauuagagcaggcggugcgcugggggcgggagcagcgcggagcccggcucggccacaccg

SEQ ID NO: 2950 - RNA, 75 nt, Human
ggggccggcugggggccugagcgggaggccaucaucaaccuggccacccagcccaagaggcccauguccaucccc

SEQ ID NO: 2951 - RNA, 61 nt, Human
ggaaggcuggcaggggucuuuuuuucuauugcguaacuggaggaggccaccucggucuucc

SEQ ID NO: 2952 - RNA, 85 nt, Human
uacacauugaagagaacaaacagugggaguguuuauuccuuaagagagaauaaacugcagagauuaaaaguuuccuucgagugua

SEQ ID NO: 2953 - RNA, 67 nt, Human
agcacuguggcuuuugucagauggagugccggucugcagaggacugcucuuucgaauccacaguguu

SEQ ID NO: 2954 - RNA, 68 nt, Human
ugucauccaucuucccuggaagucucccaccggggagugaggugcuugucaggguucacuggguaaca

SEQ ID NO: 2955 - RNA, 71 nt, Human
cuccagggggcagcacucaagcgcaucuuaggaaugacagaguugcgucccucucgguugccaggcuggag

SEQ ID NO: 2956 - RNA, 62 nt, Human
guuuccacccuggagguugcugacacccugugcccucggugacuuccagccgguggacagac

SEQ ID NO: 2957 - RNA, 86 nt, Human
ucuccugcuucugggaccugccagcaccguguuuugugguuagcuccguucuugccaaccaagcaugagcucccagauucgucaga

SEQ ID NO: 2958 - RNA, 79 nt, Human
agucggcuucgguaaaggccaagaaaaagcggcguacaaaaaaauuccuccgcccaccggcaaaguaccgacaucgacu

SEQ ID NO: 2959 - RNA, 61 nt, Human
caccuuucaucucucugcucaggucuggccugcaggagcccgcagcaaggaguguguggug

SEQ ID NO: 2960 - RNA, 70 nt, Human
cagcgccagucugcugggccucccuuucuagcuacugcacaggccccagggaaggcuugcagacccgcug

SEQ ID NO: 2961 - RNA, 91 nt, Human
gcuagccaagggagcagcguugcgucucagaggguucuguugggcgcacaacacuucuguccuccgagggcugcagcuuccauaggcuagc

SEQ ID NO: 2962 - RNA, 78 nt, Human; identical to SEQ ID NO: 99

SEQ ID NO: 2963 - RNA, 65 nt, Human; identical to SEQ ID NO: 247

SEQ ID NO: 2964 - RNA, 80 nt, Human; identical to SEQ ID NO: 100

SEQ ID NO: 2965 - RNA, 76 nt, Human
cacggaccaccgcgggguccccggcaagccuggaagaguugugacucuuguugaagauccugcgguaugggaugug

SEQ ID NO: 2966 - RNA, 77 nt, Human
gggucccugaucuggaagguggauuuccccuaucaggacaagcuggucggauacaucaccaacuacagcaggcgcuu

SEQ ID NO: 2967 - RNA, 69 nt, Human
gggcauggggugcagcuagaacaguguagguucccucaauaaccccuuucugcuguucucccaugaucc

SEQ ID NO: 2968 - RNA, 66 nt, Human
agcaauuauauacaccuaauggcuuauucccuacaaaaugaacuauuaugggugucagaaaaggcu

SEQ ID NO: 2969 - RNA, 66 nt, Human
aaugagauucaggaaacauccugucagccuccugggaaagcauccuugucuccuuaguauuucauu

SEQ ID NO: 2970 - RNA, 62 nt, Human
uggauaauugggugccauuaacacaaacaggucacaauccugcuguuuucuagcccugucca

SEQ ID NO: 2971 - RNA, 63 nt, Human
ccauuuaaaaaugcuuggaacuauauguugaauaauuauacaaaguuccagauugcaacaugg

SEQ ID NO: 2972 - RNA, 61 nt, Human; identical to SEQ ID NO: 1092

SEQ ID NO: 2973 - RNA, 96 nt, Human
uuaugauugggaaagaaugccaagaugguauuuucuuuuggcaagaugcuugguugugcagucauugaagauaacuuggcacuauuuucugcauag

SEQ ID NO: 2974 - RNA, 83 nt, Human
gagcugugaucacugccacugcacuccagcccgggugacagagugagacccugucuggagugcaguggcagugaucacagcuc

SEQ ID NO: 2975 - RNA, 67 nt, Human
uguagucucagcuacucuagaaggcuaaggcaggaggauugcuugagcccaggagguggaggcugca

SEQ ID NO: 2976 - RNA, 84 nt, Human; identical to SEQ ID NO: 286

SEQ ID NO: 2977 - RNA, 64 nt, Human; identical to SEQ ID NO: 287

SEQ ID NO: 2978 - RNA, 103 nt, Human; identical to SEQ ID NO: 294

SEQ ID NO: 2979 - RNA, 127 nt, Human
uccagcagccuucuuguccacugcuuugaugacacccaccgcaacugucugucucauaucacgaacagcaaagcgacccaaagguggauagucugagaagcucucaacacacaugggcuugccagga

SEQ ID NO: 2980 - RNA, 68 nt, Human
acauuugcuaagacagcuggccuggaugcuucaaaaaguaucaugggaaaauaugucgggguuguugu

SEQ ID NO: 2981 - RNA, 61 nt, Human
gaaagugacuagaguugaaaccaaaagaauguaugaaccuugaugggaccugguuguuguc

SEQ ID NO: 2982 - RNA, 70 nt, Human
cuugugaagcacuuacugagugggaauaucugccaccuguuggaccccgcccacccaaaggauucguggg

SEQ ID NO: 2983 - RNA, 80 nt, Human
uggcacuccuaggcucuaucagacugaccccucgggcacauaccaugccuggaaggccaaugccauaggccggggugcca

SEQ ID NO: 2984 - RNA, 61 nt, Human
agcugcagacaucaggccaaggaccaagaggagcugugguuuuugugugaugaaaugugcu

SEQ ID NO: 2985 - RNA, 66 nt, Human
gcucugagcacaaccugcuaguuuggaaaccugaagccaggauuuucagaacgcuggcucuuaagc

SEQ ID NO: 2986 - RNA, 63 nt, Human
aaucuuugucagaugcaucguuugugaauauuuucucccacucugauugucuguuugcugauu

SEQ ID NO: 2987 - RNA, 70 nt, Human
ccacuucauaacugugaggacucugggauaaaucacuuaaguuuccugagugucauuuucuucucugugg

SEQ ID NO: 2988 - RNA, 107 nt, Human
uauguauggcuuacaaaacauguguuucuaaauuuaugaaauuauauguauguuuauacauucauucgugcuuucauuuagccaacauuuauuaaguuuuuuacaua

SEQ ID NO: 2989 - RNA, 66 nt, Human
aacaucaucaaaguucacuuguauuguacccuguaaaacuguguguggugugcuuucaaagauguu

SEQ ID NO: 2990 - RNA, 88 nt, Human
gccaguuugcuuuuauuuuugauuaaguaaauuccauguuguaauguuacagagagugugauuugguugugauauauauauauugugc

SEQ ID NO: 2991 - RNA, 64 nt, Human
uuacgcaagauaauuauuuagagacugauuacagucuuucucagauuuuuaguaaaugcaguaa

SEQ ID NO: 2992 - RNA, 88 nt, Human
ccacaaaaacagguauauacuuugaaaggagaugucuuggaacauuggaauguucucagauuucuugguuguaugugaucaugugugg

SEQ ID NO: 2993 - RNA, 111 nt, Human
ugucagcacugcacacccuccaggggacuuggaauacaauccuuuuuacuuuuuuuuuuuuuuuuuuuaagaaacggggucucucugucccccaggcuggagugcguggca

SEQ ID NO: 2994 - RNA, 70 nt, Human; identical to SEQ ID NO: 2504

SEQ ID NO: 2995 - RNA, 70 nt, Human; identical to SEQ ID NO: 2505

SEQ ID NO: 2996 - RNA, 62 nt, Human
gcggugcgcucggccuauuccugccccgaggggcgucugguaggcaccccgcccucucccgc

SEQ ID NO: 2997 - RNA, 76 nt, Human
cucucccuugacccaagccacgaacgagcuggagggaaucugcgguacuuugagcaguuauuggaggaagagagag

SEQ ID NO: 2998 - RNA, 105 nt, Human
gguggcugcuaugacaucgucaucuuaaaggaagcgguaucuagacacugcaaacaaacgcaaauucugguuuaauguuucagaagacauuuuaaaguagccacu

SEQ ID NO: 2999 - RNA, 74 nt, Human
uaccuguucuggaugagauuccccucuuuuuuuauugugaaguugaagauaagaguccguuuucggggugggua

SEQ ID NO: 3000 - RNA, 91 nt, Human
gaagaaaaaaauaauaguuuuaaggaaaucuacagaagggaaucugaacuucauuucccacuuuauuuuugcgagucuguuguguaucuuc

SEQ ID NO: 3001 - RNA, 70 nt, Human
gguuuaaugcagucaaugaaacaagaugccacacaaagagggaaccaaugucagcugcuauauuacuacc

SEQ ID NO: 3002 - RNA, 79 nt, Human
aguaggauuauuguccaaaggcuuuuauuuaggggaaacgggguaauuaaaacagcagcuuuagggauagcuucuuacu

SEQ ID NO: 3003 - RNA, 79 nt, Human
aagacuagggauuaucuacaccuucacuuugggcaauagcuauuuccuaaaggaauggaaaaaggugauuuugcuacuu

SEQ ID NO: 3004 - RNA, 130 nt, Human
uauaaaauuaaauccaaauuuuauuaaggauuucagguuacauacuucaaauuucuagaauggaauggaaucauuuuggaacuggaaaaauggcauaaacacugacgucccuuaaaacuucaauuuuaua

SEQ ID NO: 3005 - RNA, 76 nt, Human
agacaacagaauagauuuuucacaaguaacggcaccaaagucacaugcuggaauuuguaaggaaacgagguuguuu

SEQ ID NO: 3006 - RNA, 64 nt, Human
uuaugaacugucccaucacaagacauacaguuggcuuucuugugagucagauauuuuuacguaa

SEQ ID NO: 3007 - RNA, 67 nt, Human
uuggggaagguauuaaacaaaaagaccaauaaguaucuccucucgccuuucccccuacccuccccaa

SEQ ID NO: 3008 - RNA, 98 nt, Human
ucccccgccccccgggagggggaaugggauauugauuuucaacccgaaaggagaaguugucccuucuuccucccccgcucagagggaaggugggaggg

SEQ ID NO: 3009 - RNA, 79 nt, Human
aaaugggaugguugcgccuuugcuggaacauguacaaacuuuuuuuugucauuaaacaauauagguauaacaacuauuu

SEQ ID NO: 3010 - RNA, 87 nt, Human
agauuaaaaucauaaugcaugacuaaaaacuccuuggauuuauuucccauuuuaaaauuuuuagcgguaaguucagauuuauaaucu

SEQ ID NO: 3011 - RNA, 118 nt, Human
ccgcuggaucaacgauguggaagacagcuacgggcagcaguggaccuaugagcagaggaaaaucguggaguucaccugccacacagccuucuucgucaguaucgugguggugcagugg

SEQ ID NO: 3012 - RNA, 66 nt, Human
ucaugaagagacagcccagaaaucccaaaacagacaaacuugugaaugagcggcugaucagcaugg

SEQ ID NO: 3013 - RNA, 80 nt, Human
ugucaccauccucugcauugacuugggcacugacaugguuccugccaucucccuggcuuaugagcaggcugagagugaca

SEQ ID NO: 3014 - RNA, 62 nt, Human
cccuuuaauggcauugccacagcgggucccauugucugcaaguuugucgugaugcugaaggg

SEQ ID NO: 3015 - RNA, 65 nt, Human
cugugcgucuguggcaaacguggucuggugacagcaaccaaugaucccaccauuuggacacgcag

SEQ ID NO: 3016 - RNA, 81 nt, Human
cgacgguuacucugguuacugggcccgcgccgcgcuggcgagagccgccgcccgcgagggaugcuggugaggaagccgucg

SEQ ID NO: 3017 - RNA, 62 nt, Human
ggccucuaaaucuuuagguuggggcugcauugcccuggagccgcacucuugaguccgaggcc

SEQ ID NO: 3018 - RNA, 76 nt, Human; identical to SEQ ID NO: 758

SEQ ID NO: 3019 - RNA, 71 nt, Human; identical to SEQ ID NO: 1764

SEQ ID NO: 3020 - RNA, 71 nt, Human; identical to SEQ ID NO: 1145

SEQ ID NO: 3021 - RNA, 67 nt, Human; identical to SEQ ID NO: 1146

SEQ ID NO: 3022 - RNA, 70 nt, Human
agauguguuaggaaugucaacagagcaaggagaaaaaaggcaguccuggaaucacauucuuagcacaccu

SEQ ID NO: 3023 - RNA, 63 nt, Human
gugauuccuuuccuaaaaguguaagaaagcauagagauuuguucguauuuagaaugggaucac

SEQ ID NO: 3024 - RNA, 75 nt, Human
cccgcguauagcuucuggccugagcuuggccuggauuguuggacgaguucuuuaugcuuauggcuauuacacggg

SEQ ID NO: 3025 - RNA, 66 nt, Human
gagcccaccagaacacguuggaaguguauccucccuucuuauuuuuucuagcuguuggagguguuu

SEQ ID NO: 3026 - RNA, 84 nt, Human
uuugugcuucuaacuggugcugccagcuuuauaaugguggcccaccuagccaucaauguuuccaaggcccgcaagaaguacaaa

SEQ ID NO: 3027 - RNA, 62 nt, Human
agcgggauggcugcagccaaggagcugggggagggccgggcucagggcuagcccuuuccgcu

SEQ ID NO: 3028 - RNA, 100 nt, Human
cuuggcccacauccaggcuacccccagcccgcuucuccccugcuuagcccagggaggagacaguagaggugaugggggcagccgggagggaggggccaag

SEQ ID NO: 3029 - RNA, 65 nt, Human
ugaggcugggggcacagggaggagcugcccaggugcaguuaccauugcucagugacagagccuca

SEQ ID NO: 3030 - RNA, 61 nt, Human
ccagaggcuugguuuuauugugcaguuuucuuuguccucaaugagaugccauaagcugugg

SEQ ID NO: 3031 - RNA, 66 nt, Human; identical to SEQ ID NO: 2708

SEQ ID NO: 3032 - RNA, 64 nt, Human; identical to SEQ ID NO: 2709

SEQ ID NO: 3033 - RNA, 90 nt, Human
gccuuggcggauaugcucggggcccucggcgcagaggaacuuagccucgauucucuuccugaggggcuucuuaacuuuuccaagccaggc

SEQ ID NO: 3034 - RNA, 82 nt, Human
gcguggugggaggcuggggcuggugccugcggacagcuccagauggaaucccaggccacggugcuucuaguguccccccagc

SEQ ID NO: 3035 - RNA, 65 nt, Human
gcacccggguugucagcacccuccaucauuucucccugcacaggaggguuggaauacuggggugu

SEQ ID NO: 3036 - RNA, 74 nt, Human
gggcaaggagggccccuggggaaucguggucuauauccccgauaaauauucugccucacgggucuaccuuguuc

SEQ ID NO: 3037 - RNA, 63 nt, Human
aggccugggccgcuuccugcaagaaaacaagcagcuucugcacgacgcacuggcccaggaccu

SEQ ID NO: 3038 - RNA, 64 nt, Human
cuggaugaaggacgagcgugugcccaagaaccuggccacgcagcuggacuccgccuucauccgg

SEQ ID NO: 3039 - RNA, 63 nt, Human
ucggaggugucugagguugccaucagccagggcgaggucacccuggcccucaggaaccuccgg

SEQ ID NO: 3040 - RNA, 75 nt, Human
aguggaaauuagcagaaauauccauucauuugcuguacuauuuguauguaauauauggguugaucuauaaacacu

SEQ ID NO: 3041 - RNA, 93 nt, Human; identical to SEQ ID NO: 2387

SEQ ID NO: 3042 - RNA, 76 nt, Human; identical to SEQ ID NO: 2388

SEQ ID NO: 3043 - RNA, 66 nt, Human
acguucauggucggugugaugagagacugagaugugaauugcucaguagagaguuggcgguggcgu

SEQ ID NO: 3044 - RNA, 60 nt, Human
ucccagaguguacuuagaaacaugaaaacuucuuugaaagggagcugaucacuuuuggga

SEQ ID NO: 3045 - RNA, 99 nt, Human
ugaaccuuaccuaaauaaugaaagccagccagauucauuuuccacggcacaugguuuccuguggguaagauguguuuauuugguuuugguacaaguuca

SEQ ID NO: 3046 - RNA, 63 nt, Human
cugggcaucguggcugaggugcuggugcuggucaccaucaucuucaucuacgagaagcgccgg

SEQ ID NO: 3047 - RNA, 79 nt, Human
gcccgaggacguccuggaugaugacgacgccggcucugaacccugaagagcagcgggcagcaccagaaugaccaagggc

SEQ ID NO: 3048 - RNA, 70 nt, Human
gauuauauaucguccauauguaauuauaucugugguaaaauauaaagauaugcauuuuggggacauaguc

SEQ ID NO: 3049 - RNA, 76 nt, Human
guuuuuuaagguuuuggaaguaacaaagggauacauacagcaagauccacuuacauaguuuuaaaacaugcaaaac

SEQ ID NO: 3050 - RNA, 71 nt, Human
ucaaggaaaggcaggaggaagagugcucuggguggggggagguucacagggugcuuggacuguaccuauga

SEQ ID NO: 3051 - RNA, 71 nt, Human
gucaucuuucuccuccucuugguugguuuacaagaguagugaauacuucaguuauggacagaaagaaagac

SEQ ID NO: 3052 - RNA, 66 nt, Human
gaagguuaagcuggcucguccugaaauauuauaagguggaugagaauggcaaaauuagucgccuuc

SEQ ID NO: 3053 - RNA, 80 nt, Human; identical to SEQ ID NO: 100

SEQ ID NO: 3054 - RNA, 74 nt, Human
cccgagccuggcgaccaugcaggagucgcugcgggugaagcagcuggccgaagagcagaagcgucgggagaggg

SEQ ID NO: 3055 - RNA, 84 nt, Human
cucucuuuuuuuguaauuagaauacuguuuggacuugcucaacaagaccuuaucuuaacaaaaaguaacuuauagaaaagggag

SEQ ID NO: 3056 - RNA, 66 nt, Human
cugaggcuagauaagauaaccaguuaguggguccacugaccuuuaggacaguagucuauccguaag

SEQ ID NO: 3057 - RNA, 61 nt, Human
gaauagcuccaaacccuaaguguaaauauuuuuguccacacaaauaggcacacauauauuc

SEQ ID NO: 3058 - RNA, 64 nt, Human
ugcugcaggcugucaugcucaacaaaacgcucccaccugguuuggguaugcaaggcacugcgca

SEQ ID NO: 3059 - RNA, 127 nt, Human
gauaucguagggggcggcgcggcggguggggugcgcguugggcauuauugggggugcgcagaacgagcgcgcuccgcaggucgagcgucgcguaugcguaucuugcucgcugucguccucuacuguc

SEQ ID NO: 3060 - RNA, 70 nt, Human
ugucguggaauuugaguauaugugcgaauaucaaauuaauguuagauguuugucacuucaauccacuaca

SEQ ID NO: 3061 - RNA, 99 nt, Human; identical to SEQ ID NO: 1699

SEQ ID NO: 3062 - RNA, 62 nt, Human
uuuacgaauggggugacaacuuaugauaaaaacuagagcuagugaauuagccuauuuguaaa

SEQ ID NO: 3063 - RNA, 64 nt, Human
aucuugucccuccuuuccugauugcucuuggcugaguaucuauggugguaggagaguacaggau

SEQ ID NO: 3064 - RNA, 60 nt, Human
gccaucagcuccuugggacugaugaacagagucagaagcccaaaggaauugcacuguggc

SEQ ID NO: 3065 - RNA, 87 nt, Human
gcuggagcccagcaugcuggggagugcggucagcuccacacaguaguccccacguggcccacucccggcccaggcugcuuuccgugu

SEQ ID NO: 3066 - RNA, 62 nt, Human
ugucauuuuaaacauugguaggccuugguacaugaugcuggauuaccucucuuaaaaugaca

SEQ ID NO: 3067 - RNA, 71 nt, Human
auuggcauauuucaggaccauaguuucuuguuaacauauggauaacuauuucuaauaugaaauaugcuuau

SEQ ID NO: 3068 - RNA, 69 nt, Human; identical to SEQ ID NO: 1724

SEQ ID NO: 3069 - RNA, 71 nt, Human
uuacaggugguugcuuugaacuuuauuugagaaaaacagaagauaaauguaucaaaagaacacacaggugg

SEQ ID NO: 3070 - RNA, 100 nt, Human
accuuuguaaggagaugguggauggauuaagaauaaccuuugauuacacucucccguugguuuuacucuaucccuaugaacaagcucaguauaaaaaggu

SEQ ID NO: 3071 - RNA, 61 nt, Human
agaacaguaacucuagaaaucccugaaguucugaagaggcagcuggaggaugauuguuacu

SEQ ID NO: 3072 - RNA, 82 nt, Human
cuuuucagccaaugagaggccucgucaccaucacgcuaugccacaugccagcaugaacgugccuuauaucccagcagaaaag

SEQ ID NO: 3073 - RNA, 99 nt, Human
cuagguacccauaagaaaaaagauucauucucugugaaaacuguaggaaucuguuguuguuuucauuugaauaugcucuacuucugcucuaguauuugg

SEQ ID NO: 3074 - RNA, 64 nt, Human; identical to SEQ ID NO: 175

SEQ ID NO: 3075 - RNA, 80 nt, Human; identical to SEQ ID NO: 100

SEQ ID NO: 3076 - RNA, 77 nt, Human
gcuuggccuaugacaggucaccguguguaaaucuuucccaauaaaguguugcacaaaggcauccuguccgugcaggu

SEQ ID NO: 3077 - RNA, 76 nt, Human
ggggaaacugaggugcgggugcgcgggccuggggacggccgucccauggcuuccaucugagccaccucgggacccc

SEQ ID NO: 3078 - RNA, 61 nt, Human
gauuuuaguauucuuuaaaauagucucacuuaucuuaauuguucauuaaagaucuauaauc

SEQ ID NO: 3079 - RNA, 66 nt, Human
gucaaaugcuucuuguggggguguguguguguguguguguguguguguacaugccggggcauuugc

SEQ ID NO: 3080 - RNA, 74 nt, Human; identical to SEQ ID NO: 365

SEQ ID NO: 3081 - RNA, 102 nt, Human; identical to SEQ ID NO: 2172

SEQ ID NO: 3082 - RNA, 77 nt, Human
uucaguuaaaaaagaagaagaagaaauggcaaagagaaaguuuuuucaaauuucuuucuuuuuuaauuuagauugag

SEQ ID NO: 3083 - RNA, 80 nt, Human; identical to SEQ ID NO: 367

SEQ ID NO: 3084 - RNA, 86 nt, Human
agagaaaacagcugggccccggggacaccuaccaucaagacgcggagacugguagcggccccgaacggcuaggcucuuugauaucu

SEQ ID NO: 3085 - RNA, 69 nt, Human
uuucagguaggugaagcagagaaagaaggcagcauacgucagcauuuucuucucugcacuuauaaggaa

SEQ ID NO: 3086 - RNA, 68 nt, Human; identical to SEQ ID NO: 813

SEQ ID NO: 3087 - RNA, 75 nt, Human; identical to SEQ ID NO: 815

SEQ ID NO: 3088 - RNA, 103 nt, Human
ccccuucuccuccuccucuuccucuucagucuccaacgacucugcccccgaugguccucguggguuggguuguuuuggggggguugugcugggggggaggggg

SEQ ID NO: 3089 - RNA, 86 nt, Human
gccguggcucuuccaggcguccgugugaggguucgugaccaggagacaaugcaggucucgggccucgguggugccugggucucggc

SEQ ID NO: 3090 - RNA, 73 nt, Human
gaagaaaaacucagauuggauaugggauuggucaagucggccggaaaauauuccccccaaggaguuccucuuu

SEQ ID NO: 3091 - RNA, 104 nt, Human
ucauuugcuggccaucggauuggggaucuauauuggaaggcgucugacaaccucuaccagcaccuuuugaugaagaacuggagucugacuugguucguuagugg

SEQ ID NO: 3092 - RNA, 61 nt, Human
cacuuauugugcauucuccuuguggauuuuuggucaccuaaggaaaugcauuugaugagug

SEQ ID NO: 3093 - RNA, 67 nt, Human
uucucuguguaauuggcaaggcuguaccaauguugugcugaugcaagccuuuuucaguucaagagaa

SEQ ID NO: 3094 - RNA, 61 nt, Human
cuccucuccccucacccuccugccccuggccacugcaggaucaggaggggagaagaaggag

SEQ ID NO: 3095 - RNA, 68 nt, Human
cuuggcucuggggugugcugggagggucaccaggucccuuuuccuuccugugcccucugaaagcuaag

SEQ ID NO: 3096 - RNA, 79 nt, Human
ggcaccagcucuuugggccuaggauacugccgggccccccaaggggguccccagcaaccaggccuggccuccugguguc

SEQ ID NO: 3097 - RNA, 105 nt, Human
ucugcugccucccaggcugcugggacugggcugguuuuguccuugaaguggucaggauacaggacaagggcagccccaccccauccagccugggcuccccgcaga

SEQ ID NO: 3098 - RNA, 62 nt, Human
ugguccaccuuucuuaaaauuuuucucaggaauggacuuaaguucuuaagaaaggauaacca

SEQ ID NO: 3099 - RNA, 74 nt, Human
uucaagcgaaggucaagcuguaaacuuuaagacauguucacccuuaaaagugccacuuugaaugguuguuugaa

SEQ ID NO: 3100 - RNA, 91 nt, Human
cucuugauaaucugauuuaacacaaauuuccucauugaguuucuccucaugaagaaacggccucagugagguaaaucggaaugcacaggag

SEQ ID NO: 3101 - RNA, 71 nt, Human
uagaacuauugaaugguacaguuugagaucuucgaaaccaucaggacugaucauuuucuggcuacuuucua

SEQ ID NO: 3102 - RNA, 63 nt, Human; identical to SEQ ID NO: 123

SEQ ID NO: 3103 - RNA, 91 nt, Human; identical to SEQ ID NO: 124

SEQ ID NO: 3104 - RNA, 60 nt, Human
gcacugcaugguaucugcacucagcaguuuacaccugcuaggguguucaaaggucagugc

SEQ ID NO: 3105 - RNA, 74 nt, Human
gucuucaucaguauuauccauauuuaaaacgaggugacagaaagccaaaguuaauuauggggcuggacagggac

SEQ ID NO: 3106 - RNA, 89 nt, Human
cgaaguuccaugucaugucuucaguuguagaaguuuuuccucuuuaagguaaagcgaccaacuugaacuuucucuggcaacacgauucg

SEQ ID NO: 3107 - RNA, 130 nt, Human
uuccccaguguuacggaggguccuugaggcaggagugaaaauugggucuggggguuaguccugggguggaggucugggcacgccgggucggacccccuccaucuucgguuuugcacaccccgcuuuccag

SEQ ID NO: 3108 - RNA, 126 nt, Human
uuuccgggucuguuccuccuugagccguuucaaaacagcuuugugcucacucuuugggguagucuccagcaggugauuucuuaaugcuuuguacugucugguuuggauuuugcagguauccugaaa

SEQ ID NO: 3109 - RNA, 81 nt, Human
uuuuuuucccaagcuucggagagcuaucauuuccaacuaguacuuuaauugcugugauuucguucaggugggggaagaaaa

SEQ ID NO: 3110 - RNA, 75 nt, Human
gaucaguuugucucggugaaaaguaaacuuugaaagcuuuccagaguguugaaucuuccaccagaaaacuugauc

SEQ ID NO: 3111 - RNA, 74 nt, Human
gcacuuccguagagguggacauggcgugcggcuuucgccgcgcuauugcuugccagguauggaucccggagugc

SEQ ID NO: 3112 - RNA, 61 nt, Human
aacugugcauguccuucaugguaggugagcaccagucuccaugaucaaaaaugccccaguu

SEQ ID NO: 3113 - RNA, 79 nt, Human
caccuuccaugauugcuuuugagggaaaagcuacaguggccacauuucagauguucacuuuugcaauuuguggagggug

SEQ ID NO: 3114 - RNA, 83 nt, Human
gcugguaagcucauccauuagcugcguccuucagcuauuccuuuagauuggaggaaguggauaugaagauggauugauucagc

SEQ ID NO: 3115 - RNA, 60 nt, Human
acgacggcaguuagagacgaggcguuucaggugaacuguauguaguguuacuccggacgu

SEQ ID NO: 3116 - RNA, 62 nt, Human; identical to SEQ ID NO: 2890

SEQ ID NO: 3117 - RNA, 80 nt, Human
agaacaaguuguuaaaacauuuaauauuauauaggauauugcuaauuguguauauguugguuuaauuaauaauauguacu

SEQ ID NO: 3118 - RNA, 101 nt, Human
cugugguaguuggaaacaaaucauaauguauuauuuaaauguuuaacaucauugcauaacagcguuuauuauacaguggcagauuucuuuagcugccacag

SEQ ID NO: 3119 - RNA, 88 nt, Human
ugauaaauguaccccucucagucugcaguauugaguugucuaaaguauaugugcagucuugcuuacaaggagggguuaccauguauca

SEQ ID NO: 3120 - RNA, 64 nt, Human; identical to SEQ ID NO: 175

SEQ ID NO: 3121 - RNA, 67 nt, Human
uuucggcgcugggucgccaaagcagaauggagacggauagagugggugggcucccagaaucccgaag

SEQ ID NO: 3122 - RNA, 77 nt, Human
ggagguuguauuccuuuuauauugcugagaaaacuaguuaaaugaucagauucuuggcuguuaaggaaacaauuuuc

SEQ ID NO: 3123 - RNA, 91 nt, Human
ucaugaauccuucugucugacuaacucaauaacuuucuauaaaagccaauggaauucaaauaggagcuaggagacaacaaguuauauauga

SEQ ID NO: 3124 - RNA, 64 nt, Human
ucuaauucauagcaaccauaucugcuuuauccuaggugaggguagcaguccacaauggaauaga

SEQ ID NO: 3125 - RNA, 65 nt, Human
acaggaccagguggagcaguuccuggcccggcacaaggggccaggccugcagcacguggggcugu

SEQ ID NO: 3126 - RNA, 77 nt, Human
cccgagcugggccucgaaaugacagcaggguuugggcuugggggacugaggcuuacagcccugcaggcccagccggg

SEQ ID NO: 3127 - RNA, 66 nt, Human
guggaggccacugaggggguggcaacugcuggaggccaguuccuggcucccccuggggcauacuac

SEQ ID NO: 3128 - RNA, 78 nt, Human
gacucauguuuauuagggagugagggagcacaaagggaggucuccuugcccuuguucuccuuaacacagcucagaguc

SEQ ID NO: 3129 - RNA, 77 nt, Human
ccagaacaaccugcagcagacuccacuccacuuggcugugaucaccaaccagccagaaauugcugaggcacuucugg

SEQ ID NO: 3130 - RNA, 85 nt, Human
cuccauccauccugaagguaccaauacaauggcacacgugucuacacuuaggcucuuauuccuggcuaccuggggauucgugggg

SEQ ID NO: 3131 - RNA, 99 nt, Human
gaggacggggacucguuccugcacuuggccaucauccaugaagaaaaggcacugaccauggaagugauccgccaggugaagggagaccuggccuuccuc

SEQ ID NO: 3132 - RNA, 68 nt, Human
agacaagcuuguagugaaguauaguagcaauaauuucuguaccugaucaaguuuauugcagccuuucu

SEQ ID NO: 3133 - RNA, 68 nt, Human
ccguuauugaauaucuauuaguguuuaauauagaagagcuuaauaaaccgcuaauccgaaaauaaugg

SEQ ID NO: 3134 - RNA, 76 nt, Human
ugauccuguucucuuccacucugccagcaguuccuuuuguacugcuucugguaguucauagaaaacuugaggauca

SEQ ID NO: 3135 - RNA, 69 nt, Human
ggguggggggcauccauauagucacuccagguuuauggaggguucuucuacuauuaggacuuuucgcuu

SEQ ID NO: 3136 - RNA, 92 nt, Human
guaacgucggggcauucaggauagucagagaaaguguuguuggaaguacguuagauuuacgcugaugaauaugauagugcaguggauguugc

SEQ ID NO: 3137 - RNA, 61 nt, Human
agaaccuuccccuugcuuagccaacucuauuuccccuccuugaggaagacgggaggauucu

SEQ ID NO: 3138 - RNA, 64 nt, Human
ugcagcugaggcaauacuccaacagggugaaagcacucaaucugguucccauguuucuccugca

SEQ ID NO: 3139 - RNA, 61 nt, Human
gccccagcuguguggccucaagccagccuuccgcuccuugaagcuggucuccacacagugc

SEQ ID NO: 3140 - RNA, 84 nt, Human
gucagggaaaucaugcagccaucaggacacaggcuccgggacgucgagcaucauccucuccuggcugaaaaugacaacuaugac

SEQ ID NO: 3141 - RNA, 69 nt, Human
guccugcauuguggcuguuuucugcuuucauccgugucagugcagcagcagcuucauccagugcacaac

SEQ ID NO: 3142 - RNA, 65 nt, Human
uguucauuuacacuucugccuucaucuagcaauuuacgaacagcauuaacauccccaucugaaca

SEQ ID NO: 3143 - RNA, 60 nt, Human
cuuuuaauaaaugaauuuuaauuguuaacaaaccuaauaaguggaagaauuuguuaagag

SEQ ID NO: 3144 - RNA, 101 nt, Human
gagaucggagucucacucuguugccuaggcucggagugcaguggcgcgaucuuggcucacugcaaccuccgccuucuggguucaagcgauucuccugccuc

SEQ ID NO: 3145 - RNA, 75 nt, Human
gucucacacaugacaugugaaaaucugacucaaaguucuuuaucuugaagcuguguuuauauguuccgugugcac

SEQ ID NO: 3146 - RNA, 78 nt, Human
auuugcauuugucuauaucuaauaaauguuuauuuuugcuugacacuuuauacuaguuacuuaggugagugcuuaaau

SEQ ID NO: 3147 - RNA, 69 nt, Human
ucuacaaauuguucacuggcauguauuaacgagaugauaauaaggccccugauauucauauuuguauga

SEQ ID NO: 3148 - RNA, 74 nt, Human
aggcuggagcaguggugcgcucucggcacugcaaccucugucugccaguuucaaguaguucuccugcccagccu

SEQ ID NO: 3149 - RNA, 60 nt, Human
ggccaauacuuuauaagcaaaguuuaaacaacuaauuuaauauuugauaagguuuugguu

SEQ ID NO: 3150 - RNA, 71 nt, Human
aguucuuguguguucguaucuuuauuuauucccuaguuugcagaacugucugaauaaaggauacaaggauu

SEQ ID NO: 3151 - RNA, 77 nt, Human
ucccacguuuguuccagaggaauuuaacuuucuguauuuuuccaacauuaaaauccacaucaauagcacacguguga

SEQ ID NO: 3152 - RNA, 81 nt, Human
ugcaucugguuugagggauccuuugaaaaucucauauuguuucgaguuuucauuacuuccauacaaagcaauccugaugua

SEQ ID NO: 3153 - RNA, 64 nt, Human
uuuccccuuaaauuggucagcauagugccccauuuuggggcauccuucaucuggacaagggaaa

SEQ ID NO: 3154 - RNA, 62 nt, Human
uguccagcaacuucaucacuggggcacaaugagcuguucuucacauuugaguguccuggaca

SEQ ID NO: 3155 - RNA, 70 nt, Human
gguuuguauguguguguauauauguaaauauguauguauguguguacguauguauauacacauacacucu

SEQ ID NO: 3156 - RNA, 73 nt, Human
uauacaaauucucauucaauauuaugucaacuaucagguauaguaugaaucuaccauuauguauauuuguaug

SEQ ID NO: 3157 - RNA, 102 nt, Human
ccgaggcgcgcguggggccacugccguggcggcggcugcccuccucacacucggcuccgcgccgccuccggccaccgugcgcucccgcguggggcgccucgg

SEQ ID NO: 3158 - RNA, 74 nt, Human
ggacaugguaaccugguccacggagggcggccgccacccucgcguagcuuuccugugguuuuccaggacugucc

SEQ ID NO: 3159 - RNA, 80 nt, Human
gggagggcugggggcucuucccuggaggaagcggcuccgcuucgcuggcgccgcuuuuuagcuuggacuucaguccuccc

SEQ ID NO: 3160 - RNA, 95 nt, Human
uccggaguaacggucuucauuagcuuggaguggcgcagguccgugacagcaccgcgagaccugugcgacagugggcugaugcucguuucucuggg

SEQ ID NO: 3161 - RNA, 88 nt, Human
ccucucaagucgagagagcaagauccaguauuuuuuuuuagaaagauccaaauuuuuuaagugccuuuguucacuuggcauuuagagg

SEQ ID NO: 3162 - RNA, 70 nt, Human
cuauacaguuuuuuuauccuuuuagauuuauuuuuuaaaaaaacauuuuauacaaggagaaacugaauag

SEQ ID NO: 3163 - RNA, 76 nt, Human; identical to SEQ ID NO: 1089

SEQ ID NO: 3164 - RNA, 114 nt, Human
agacgaggaggugauugagcuguauggggguacccagcacaucccacuauaccagaugaguggcuucuauggcaagggucccuccauuaagcaguucauggacaucuucucgcu

SEQ ID NO: 3165 - RNA, 90 nt, Human
gcccaugggaaacagcuguuccucaucaccaacaguccuuucagcuucguagacaaggggaugcggcacauggugggucccgauuggcgc

SEQ ID NO: 3166 - RNA, 80 nt, Human
cauuauuuuguacauuuuguauauacugggacagcgugaaacacuggaauccuucauggacgagggcauauacaaugaug

SEQ ID NO: 3167 - RNA, 66 nt, Human
gcucccagggguaccugguggugaggcucuccaugaugauccacccagccgccuucacucuggagc

SEQ ID NO: 3168 - RNA, 73 nt, Human
guuccaggcccugaaaagacccgacgacacagcuuuccaaauaguggaacuucggauuuuuucuaacuggggc

SEQ ID NO: 3169 - RNA, 80 nt, Human; identical to SEQ ID NO: 100

SEQ ID NO: 3170 - RNA, 62 nt, Human
uuagguaucuagcuucaucaggcauauuuuagaaauggacugccuaauaucuauuuaccuaa

SEQ ID NO: 3171 - RNA, 70 nt, Human; identical to SEQ ID NO: 1335

SEQ ID NO: 3172 - RNA, 62 nt, Human
ugcuguggcucuagacacuaaaggaccugagauccgaacugggcucaucaagggcagcggca

SEQ ID NO: 3173 - RNA, 78 nt, Human; identical to SEQ ID NO: 2712

SEQ ID NO: 3174 - RNA, 64 nt, Human
gagugucacaccuuugcuuauggccugcaaugccuacgagcuaagugucaagaugaagacccuc

SEQ ID NO: 3175 - RNA, 70 nt, Human
ucucucugccggaagucuuuggcccuuuugggacagacauuuuccuuggccucuucuuuccggcaggaga

SEQ ID NO: 3176 - RNA, 82 nt, Human
ccuuuggcccacauaugguucugucccggugagcucuguugucagaggcucacgggacagaaccacaugcuagggucuaggg

SEQ ID NO: 3177 - RNA, 65 nt, Human
gagggagagugcguggggagccaugcucaccguggcaaacacaggaaccccaugacucgccccuc

SEQ ID NO: 3178 - RNA, 73 nt, Human
cucuuguugaccaggcuggagugcaauggcgcgaucucggcucacuguaaccucugccucccggguucaagag

SEQ ID NO: 3179 - RNA, 62 nt, Human
gaaggaauuuuaagaguaguuaucuuuauacagugaagcuaaauauaauuuucaguuucuuc

SEQ ID NO: 3180 - RNA, 64 nt, Human
caguauuaaauaauccuggcauuauagggaaaaaaccuccuagaaguuagauuauuugcuacug

SEQ ID NO: 3181 - RNA, 61 nt, Human
auagaaguauacugagagucuaaaauacauucuaguagugcaugucuuggugugcuuuugu

SEQ ID NO: 3182 - RNA, 88 nt, Human
guuugcuuucuaaaagaacuaaugaaucuguauauuguaaacuguggguguuuuacaugucaauucauuuuuuuaauggaaagaaaau

SEQ ID NO: 3183 - RNA, 61 nt, Human
cgguuucugcgggccaagcacggugcgcaaagagcgcguggugcggcccgacucggagcug

SEQ ID NO: 3184 - RNA, 65 nt, Human
gagcuuccaguacagaccacgaggccuuccugggcaaggaggacuccaagaacuucgacgagcuc

SEQ ID NO: 3185 - RNA, 99 nt, Human; identical to SEQ ID NO: 1699

SEQ ID NO: 3186 - RNA, 60 nt, Human; identical to SEQ ID NO: 1701

SEQ ID NO: 3187 - RNA, 92 nt, Human
agcagaauuccagacaagaacuacaggucagaaauggaagggaugucggaaaucuaaucuaaaccucugacuuucuagacuaggaagcugcu

SEQ ID NO: 3188 - RNA, 60 nt, Human
auaaaauaaugauccuauauacuuuuaauacaaaaucacauauguagggcaucacuuuau

SEQ ID NO: 3189 - RNA, 60 nt, Human
cgguggcgcccgcgggccccgggcgacuccgccucggccgcccuggacgagcugucacug

SEQ ID NO: 3190 - RNA, 70 nt, Human
ggcucccaauguugacguuggccagggcguuugcaaacaagccaggccaaaaaggcucaacauuuacacc

SEQ ID NO: 3191 - RNA, 72 nt, Human; identical to SEQ ID NO: 2728

SEQ ID NO: 3192 - RNA, 130 nt, Human; identical to SEQ ID NO: 2385

SEQ ID NO: 3193 - RNA, 65 nt, Human; identical to SEQ ID NO: 2386

SEQ ID NO: 3194 - RNA, 127 nt, Human
acauauaucuaacucaugauuacaaaacuuuuagagacaacuagguuaaauauuucauguuuugggcuaagggaaaaggaauucaugaucucguuaaaggaaguucaaagucaacacuggauauugu

SEQ ID NO: 3195 - RNA, 87 nt, Human
uuuuuuuccugcauuucucauuuuuauuugacagaaaaaguugcucuugcuguacagauuuuaaaaaaccaaaaugccuuuaagaaa

SEQ ID NO: 3196 - RNA, 61 nt, Human; identical to SEQ ID NO: 587

SEQ ID NO: 3197 - RNA, 87 nt, Human; identical to SEQ ID NO: 631

SEQ ID NO: 3198 - RNA, 65 nt, Human
cagccacuucaucauccgucagaagccagaccuuuuccuggauuugacauccagugggguuccug

SEQ ID NO: 3199 - RNA, 68 nt, Human
gcaucgauuaaauccacagucagccauaauaacuccucagacauguuaugcuggggccgugucgaugu

SEQ ID NO: 3200 - RNA, 62 nt, Human
gagcaucccugagagcaccagcacuucugaccuagcgggugagcccagugcugaaggggcuu

SEQ ID NO: 3201 - RNA, 75 nt, Human
guuggugaccucagauacacuguucagaaguacucaaaguauuccuuuuuucucacauuugagagucacucuagc

SEQ ID NO: 3202 - RNA, 65 nt, Human
aagauauuaaugaaaacuaauugaaaguacgcacacuucucauguaggaacaaaauuaaaauuuu

SEQ ID NO: 3203 - RNA, 77 nt, Human
aggaagaaaggaauaaggaacuuuuuacugggaacuauuuuccaucucuaggaaaaagugcuucuuccccucccccu

SEQ ID NO: 3204 - RNA, 93 nt, Human
caucaagaggucaugauugcagaagaggugacuggaauugaaugacaugauccaggggaggccggccacaaaugcaguaacaugaccaggaug

SEQ ID NO: 3205 - RNA, 61 nt, Human
ggugugacaaggucagcccgcugcaaggagaaggucacgaacaggggguaagcccaacgcc

SEQ ID NO: 3206 - RNA, 75 nt, Human
aggaaaaaauagaagucuacugaauuaauuuuuuaaaagaaaagagaucagauuaaauauuucuuuguuuuuccu

SEQ ID NO: 3207 - RNA, 75 nt, Human
ccuggcuauggaaaagugauguggguagccaauuuuauaaaauguuggcuuucuggauuuuuauccggagugagg

SEQ ID NO: 3208 - RNA, 95 nt, Human
gcagauuuuaaaauauaguaacauccauuuuuuucccuugaaagugauucucuuauaaaaaaugaaaguggaguuuaagguauaucaaaucgugu

SEQ ID NO: 3209 - RNA, 72 nt, Human
ggcugaggucucuugaaauugcuaaagggaaauuuuucuaugguaaugcucuuacggauauaaaccucaguu

SEQ ID NO: 3210 - RNA, 62 nt, Human
uaugcagagaugaguuaguguuucuggacguggagaccuuuuaaauggcucaucugugugua

SEQ ID NO: 3211 - RNA, 73 nt, Human
cugucccccuaccccaagucccccagucccucaaaggagggcagggaguggggacuugcaggaagcaggacag

SEQ ID NO: 3212 - RNA, 67 nt, Human
uagugauuguuucucuucacccccaacauuuccguuuaccaaggucgaguuggagagaaauucauug

SEQ ID NO: 3213 - RNA, 66 nt, Human
guauuucuaguucuagaucccugaggaaucaccacacugacuuccacaaugguugaacuaguuuac

SEQ ID NO: 3214 - RNA, 61 nt, Human
agaggagauccaggcuaaauuuucuggcccuucaggaaggcuggcaccucuggcucucccu

SEQ ID NO: 3215 - RNA, 69 nt, Human
aaucauuuauuauggucagcuuguuuuacauguccccuaucaugagaaaugcuaucaacaucugugauu

SEQ ID NO: 3216 - RNA, 81 nt, Human; identical to SEQ ID NO: 949

SEQ ID NO: 3217 - RNA, 61 nt, Human; identical to SEQ ID NO: 950

SEQ ID NO: 3218 - RNA, 64 nt, Human
ugaccaaaacugugccuuguggaaaugaacuucacaaguuccucaucugggacacugcugguca

SEQ ID NO: 3219 - RNA, 64 nt, Human
gcuggagcgagggugcaccauaacguuccaagugggacagauacuggcgauccuuaacgauagc

SEQ ID NO: 3220 - RNA, 60 nt, Human
ucucuguccucugcaucuggaugagugcacuuuuccuuggugugggagugagggcagagg

SEQ ID NO: 3221 - RNA, 64 nt, Human
ggagagcccgucgcgggagugcaaggagcuggacggccucuggagcuuccgcgccgacuucucu

SEQ ID NO: 3222 - RNA, 64 nt, Human
ggagcagugguaccggcggccgcugugggagucaggccccaccguggacaugccaguucccucc

SEQ ID NO: 3223 - RNA, 69 nt, Human
aaugcaaauuuucugguagguaucucuuuuuuugcuaugaugauuccaacuuaucagagaccucccauu

SEQ ID NO: 3224 - RNA, 88 nt, Human
aguacuuguuuuucucugauaagacucaggaauucugaaaugugaaauugucucaauucuuucucuuguagcaugaaucaaauguauu

SEQ ID NO: 3225 - RNA, 76 nt, Human
uuaugacuauagaauauaauuuggcauaugauucauauuacauauguauucauuuuauuuuuaaaauaguuuauaa

SEQ ID NO: 3226 - RNA, 81 nt, Human
agaaggauuucagcaaauuuggagcagggcuguuugcucuuuuguggauauugugccugucaggauucuugaaguuuuuuu

SEQ ID NO: 3227 - RNA, 64 nt, Human
cuuuucuggggauucaucaucuaugacacacacucacugaugcauaaacuggucaccugaagag

SEQ ID NO: 3228 - RNA, 78 nt, Human
ccugcgcacgcgucgcagccaucuccgcgcacagugguggccaccgcgacuggugcugaagugucggcgugugccggg

SEQ ID NO: 3229 - RNA, 67 nt, Human
gggcccugagauggggucugaccucaguuccugcggggaacuucaccagugaccccagucagugccc

SEQ ID NO: 3230 - RNA, 64 nt, Human
ucuuuaacacagugucccauugaaauuuuaauuuuuagagaauuuaugaaucacuguuucaaga

SEQ ID NO: 3231 - RNA, 84 nt, Human
gaugucaauguaaauuuugaaaaauccaaacuuacauucaguugucucggaggaagugauaauuuuaagcauuuaaaugacauc

SEQ ID NO: 3232 - RNA, 61 nt, Human
gucccccugccccguucacaaugcagccugcuucugcaaaaggugguacgaucgaagggac

SEQ ID NO: 3233 - RNA, 69 nt, Human
cgggccaggggcugucucgcacaucggaguacuaaaggcauuagaggaggcggggguccccuggaccug

SEQ ID NO: 3234 - RNA, 115 nt, Human
agacacuaacggccagugaguuggagucucagggcaggguggcaguuucccuugagcaaagcagccagacguugaacuguguuuccuuucccugggcgcagggugcagggugucu

SEQ ID NO: 3235 - RNA, 83 nt, Human
ucuccuccaugugucuuggcaggcacucauuucuguggcugucggcagagggaauguucuggagcugccaaggagggaggaga

SEQ ID NO: 3236 - RNA, 65 nt, Human
gggcaggaaggcgggcucgacuuucucuuuuugccagcgggagcugaagcccguccuuagcgccc

SEQ ID NO: 3237 - RNA, 62 nt, Human
aguaggucuuaagugucaucuggcaucuucuuucuguagccagguaacucuuaaaucuuauu

SEQ ID NO: 3238 - RNA, 90 nt, Human
ucagccugcugaacaguuccuuuuucagagacauagauaccauccaaaaauuuccugauauccuuguuuuuaacuguuguggcuggcuga

SEQ ID NO: 3239 - RNA, 80 nt, Human
guaagaagcauccucaagcucccaguuaaguaacuugacuacuuuuauuugggaauuucagacuauagaagcucucuuau

SEQ ID NO: 3240 - RNA, 81 nt, Human
uauguccagauucugugaccacuaguuacuguaucagaacucaucagguacccacuuauaaauagcacugaucuggcugua

SEQ ID NO: 3241 - RNA, 72 nt, Human
agugucgacagggggaaaugauuguuuuuugagccccagaaucauaugaucaaaccuauagucugucgugcu

SEQ ID NO: 3242 - RNA, 82 nt, Human
cuucggggaagagaggaaauaggauugagauagaauacaaaagggauuucagcuaugucugauuuuuuuucuuauaaagaag

SEQ ID NO: 3243 - RNA, 84 nt, Human; identical to SEQ ID NO: 286

SEQ ID NO: 3244 - RNA, 61 nt, Human; identical to SEQ ID NO: 776

SEQ ID NO: 3245 - RNA, 76 nt, Human; identical to SEQ ID NO: 758

SEQ ID NO: 3246 - RNA, 71 nt, Human; identical to SEQ ID NO: 1764

SEQ ID NO: 3247 - RNA, 101 nt, Human
cccucuucuuguuuugaaagauggucggcugcuuuugguaggcacgcucagucugaauguccgccaucuucccggccgccugaaaaaaagcgggggggggg

SEQ ID NO: 3248 - RNA, 76 nt, Human; identical to SEQ ID NO: 758

SEQ ID NO: 3249 - RNA, 76 nt, Human
ggcccucagaggcuccucccuaucuccuggcuaguuaccacuaggcuaccaggucucuaggggccugagagaggcc

SEQ ID NO: 3250 - RNA, 65 nt, Human
cagggagcucccaguccugggagaggcugaaggcaaagcagcagaggacucggagcucacacuug

SEQ ID NO: 3251 - RNA, 64 nt, Human
gacuuguguuugaaucccaguuccaucacuuccugcugugagaucuugggcaaaucacuuaguc

SEQ ID NO: 3252 - RNA, 75 nt, Human
ggcgagagaagaaggaauggguugagaaacugacugaaguguucuaucagcgucugaugccuucuucccuuugcc

SEQ ID NO: 3253 - RNA, 63 nt, Human
guagacagagcguaaaaggagaugguguggcguacauugcggcaucccuccggauucugcugc

SEQ ID NO: 3254 - RNA, 71 nt, Human; identical to SEQ ID NO: 1145

SEQ ID NO: 3255 - RNA, 67 nt, Human; identical to SEQ ID NO: 1146

SEQ ID NO: 3256 - RNA, 68 nt, Human
ccccaucuugaagcugggggcuccacagccugggcugccuuuacaggaugcccucucaggaucagggg

SEQ ID NO: 3257 - RNA, 116 nt, Human
gugaggaacauaaccucuuacaauugaaauauuuagaaauauaauccugauuuucacucugccuaaggauuuccacgaauugaaaauuuuuacugaugggaagguuuguuuuuuac

SEQ ID NO: 3258 - RNA, 85 nt, Human
uucugacccaugagaaagggaaaauuuacggagugauaauuuucacauaggugugaauuuauccauuauauaggcauggucagga

SEQ ID NO: 3259 - RNA, 78 nt, Human; identical to SEQ ID NO: 99

SEQ ID NO: 3260 - RNA, 80 nt, Human; identical to SEQ ID NO: 100

SEQ ID NO: 3261 - RNA, 61 nt, Human
cccugggguuggggccucaccccucuggagggccuggaggcaggagguggaaaccccaggg

SEQ ID NO: 3262 - RNA, 65 nt, Human
ucauguuccccgugacaggugggccugaggggucggcgugaccccuccccagcaugguagcauga

SEQ ID NO: 3263 - RNA, 70 nt, Human
gggaaacuccgaggacagagggcuaaauccaugaaguuguggauggccugaugauccacagcggagaccc

SEQ ID NO: 3264 - RNA, 71 nt, Human
ccagguucaagcgauucuccugccucagccuccuaaguggcugguauuacaggagugugccauuagccugg

SEQ ID NO: 3265 - RNA, 65 nt, Human
gguaucgugugucuggaauaucugauauagggguuaucuuaaucaucuuuuuauaacacgguuuc

SEQ ID NO: 3266 - RNA, 76 nt, Human
gcuaccggaccugccugggagccagugaagggcgagucagggcacgcguccuggaggcugccagcguccuuguagc

SEQ ID NO: 3267 - RNA, 60 nt, Human
uuucugcauagacucacuuguuaaauagcaguucuguugagaguggaguuacugcaggga

SEQ ID NO: 3268 - RNA, 61 nt, Human
gaaggugcugacuuccuugggagaugccauaaagcaccuggaugaucucaagggcaccuuu

SEQ ID NO: 3269 - RNA, 62 nt, Human
ggcgccgucgggccccagagaaaaaguuuuuaaaccccauucuguuggggcccgggggggcc

SEQ ID NO: 3270 - RNA, 72 nt, Human
ggcuuccuggcagaagauggugacuggaguggccagugcccuguccuccagauaccacugagcucacuggcc

SEQ ID NO: 3271 - RNA, 87 nt, Human
guuaaagccuaggcuagcaauuuuuuuuaguugcaacuaaguaagauauacuacaaacuaaggaugcugcuagacuaaggaauaaac

SEQ ID NO: 3272 - RNA, 63 nt, Human
ugaaaaugucacccagagauauuaaaauaauuuuuaaaguuuaauucuggucaaaaguuuuua

SEQ ID NO: 3273 - RNA, 77 nt, Human
uaacuguaguuuuaauaagcaugacauuauuugauaaguauauaacauuuacaucauuucaaaaaauacugccguua

SEQ ID NO: 3274 - RNA, 67 nt, Human
uuuucuuuuuuguuuguuuuuguuauugauauuaaacaguguaaucuuugcaagcguauauugaaga

SEQ ID NO: 3275 - RNA, 100 nt, Human; identical to SEQ ID NO: 1173

SEQ ID NO: 3276 - RNA, 70 nt, Human; identical to SEQ ID NO: 1335

SEQ ID NO: 3277 - RNA, 76 nt, Human
uccaagagauagcaaaucgagucuuaaauaauccggggagaaagacgcccggguagauuugaggugcagccuugga

SEQ ID NO: 3278 - RNA, 130 nt, Human
augcuacugugugaauagaaaguaagauaauauguuugaagguguuuccaaaacugggaagugauauacaaaugugaaggggucauuuuuauuuauucaggucuuuuuaguugaugucaucuaguagugu

SEQ ID NO: 3279 - RNA, 86 nt, Human
gggaaaagaacaauauauccaaauaaaagaccuagaaggagacaguaaucuucccuagguuugcauuuguuuacucuauuuuuccc

SEQ ID NO: 3280 - RNA, 70 nt, Human
cauucugagucuuucuggaugaacuuggcuauaucugaaaucugcuaucugagugaggacuccaagaaug

SEQ ID NO: 3281 - RNA, 85 nt, Human
gguuugucugaucauugcucgugcaguuugaguacuggauacucccuuauuccaguugcuugcaccacgcccuggucuuggaacc

SEQ ID NO: 3282 - RNA, 76 nt, Human
ccugcuggguggggccaggcauaaccuggggauagcugucccuaaccucaaugacaagggcacccacccuggcugg

SEQ ID NO: 3283 - RNA, 73 nt, Human
gcgaggagcugaggaggggcacaguucuauugccaccaccaccagggcugugccccuggccgccagugggugc

SEQ ID NO: 3284 - RNA, 66 nt, Human
auccacaguugguugaauuuguggauguggaacccauggauacagagggccaacuguauuuaggau

SEQ ID NO: 3285 - RNA, 61 nt, Human
ccagaauaugugaauaagcagacagaaagaaucuuuugaugucgauguucaacuauuuugg

SEQ ID NO: 3286 - RNA, 61 nt, Human
gguuucuugaagaccuagaacauagaagaaugccuaguuaaaaaaaaaaaucaaugaaacu

SEQ ID NO: 3287 - RNA, 84 nt, Human
ugugcaaucccuaauauaauguaaaugcuauguaaucguuguuauacuguauuguuuuuauuuguauuauguuuuauugucaua

SEQ ID NO: 3288 - RNA, 61 nt, Human
acggcguggagugcagcgacgucaaguucuuccagcuggccgcgcagugguccucgcacgu

SEQ ID NO: 3289 - RNA, 69 nt, Human
gguuuuaagcucaggagggccugcguaaaccaaugugguacacuaguuggcccgaacuugguauaaacc

SEQ ID NO: 3290 - RNA, 73 nt, Human
ugugauggcuaaguccuggacuggcuuaaugguaagauuguaacuaccaguaaguuuuuggcuuggucucaua

SEQ ID NO: 3291 - RNA, 61 nt, Human
agugaaaugguuaaaaauauuuauccuguuagaauaggcugcaucuuuuuaacaacucauu

SEQ ID NO: 3292 - RNA, 69 nt, Human
gcaagauugcagcaagaucaugugcauacacaguucuuuuuguuuuugugugugugugcugucgcuugu

SEQ ID NO: 3293 - RNA, 75 nt, Human
uuuacauuguuuaccaagcuguagugcuuuaagaccacuacuuaaaaagcaaaauaaacuugguuuacauuuaaa

SEQ ID NO: 3294 - RNA, 66 nt, Human
gacacccaaggaggcuauugagggcaccuacauugacaagaaaugccccuucacugguaauguguc

SEQ ID NO: 3295 - RNA, 71 nt, Human
gcggauccucucuggcguggugaccaagaugaagaugcagaggaccauugucauccgccgagacuaucugc

SEQ ID NO: 3296 - RNA, 60 nt, Human
agauacagaucucuucagcucaccaaaacucauauauuugcuuucugaaggauuucaucu

SEQ ID NO: 3297 - RNA, 71 nt, Human
agucacccuuuaaaagaacauuaaauaauaauaauauuaauuauauaugauguauauuaaauauucugacu

SEQ ID NO: 3298 - RNA, 73 nt, Human
agauuauagcaacaauggaguugggaaguugguauggccuauaauuguccuaaguuccagaaugaaaagaucu

SEQ ID NO: 3299 - RNA, 65 nt, Human
auuugauaauagagaagggaguuuuauggaaguuucuuugaagauuucuuuuuuccauuucgaau

SEQ ID NO: 3300 - RNA, 61 nt, Human
gcaagaauggaaagggcaggucagcaagggaggagcuggcugccaggagacaaaggcuugc

SEQ ID NO: 3301 - RNA, 108 nt, Human
acuuacggcaagccuguccaucaugguguuaaccagcuaaaguuugcucgaagccuucaguccguugcagaggagcgagcuggaacgccacuguggggcucugagagu

SEQ ID NO: 3302 - RNA, 85 nt, Human
cugaauucuuacuggguuggugaagauuccacauaccaaauuuuuugagguuauccucauugauccauuccauaagagcuaucag

SEQ ID NO: 3303 - RNA, 93 nt, Human
gcgccgacugggcuacaaggccaagcaagguuacguuauauauaggauucguguucgccgugguggccgaaaacgcccaguuccuaagggugc

SEQ ID NO: 3304 - RNA, 93 nt, Human
gauacugcaaaagugagaaggagauaauagauacuuugcucugaauuuggcauccagaguuaacauuucuccccucacucccuugcugguguc

SEQ ID NO: 3305 - RNA, 102 nt, Human
uaggauauauaaauguugcaagccauuauugcugaaugguucuuuaguuauuaacuagacccaaaucaaagaccaguggauuuaugauauuuauaguucuug

SEQ ID NO: 3306 - RNA, 98 nt, Human
ccaauuccugaauucaguaagcaaguuacaauucaaaaaggaagaagaguaaaaaccuuuuauugacagugacuuugccacugaauucaagggaaugg

SEQ ID NO: 3307 - RNA, 74 nt, Human
gucuaucaguggauggcauaauuaacuuuucgcauauuuugggcuuagaggucggauuaccauccgugguuuac

SEQ ID NO: 3308 - RNA, 65 nt, Human
gugcccucuuucuaagcuuaccaucuaugaaucucacagguuuagacuccauauuaaggggguac

SEQ ID NO: 3309 - RNA, 66 nt, Human
uccagccuugaccaucucugccuuggucauguuauagaccauuuaguguaauuaugguauguuggg

SEQ ID NO: 3310 - RNA, 74 nt, Human
ccucucccauggcuagggaaaauggcacaguuggguccuauuucagaugcuaaagaaaacccuuaugggcgagg

SEQ ID NO: 3311 - RNA, 78 nt, Human
gagguggguacuggcaucacugaugacaaugaagaugaaaauucagccaaucagauugcaggcaaaauacccaacuuu

SEQ ID NO: 3312 - RNA, 76 nt, Human
gggguggaugaagcgcauggccuacaguggaccacuccaagacgugguucccugggugccacgggucacacaucuc

SEQ ID NO: 3313 - RNA, 87 nt, Human
ugagagcugcauucagugcaaccagagacccuuucguuccaaccaggggccaguggggcuggugacgaagcuggcuggagcucugca

SEQ ID NO: 3314 - RNA, 70 nt, Human
aggggugggaucacagcaucucagguccucuagaggggaaauagggggaaugccuaggaacccuguccuu

SEQ ID NO: 3315 - RNA, 81 nt, Human
gcaauaggcgggugggugcgugcuuccucccugccccagggcuucucccugaggcugguaggugggccccucgcuuucugc

SEQ ID NO: 3316 - RNA, 67 nt, Human
uugaagggugcaaagugauuaaggcucugcugggagaauuaaggacccugauccuugcgcucugcaa

SEQ ID NO: 3317 - RNA, 87 nt, Human
ccuauaaauacuuacuucaguuaccagguaaaccaagugagaaccaaauuuucacaggcauuuacucauggcugaaaguuccagagg

SEQ ID NO: 3318 - RNA, 70 nt, Human
ggcaucgggaagagccuaaguccacauuauaaaauaggaaguggaugcggguacaguuacucccgggacc

SEQ ID NO: 3319 - RNA, 61 nt, Human
uugaacuauuagcuugugaaguuuaaauccaaauggagaaagacucaaagaaacaguccaa

SEQ ID NO: 3320 - RNA, 79 nt, Human; identical to SEQ ID NO: 1103

SEQ ID NO: 3321 - RNA, 73 nt, Human
uccuuggcguggcacccaacucaccccagcaccguggcuguggguuccaaagggggagauaucaugcucugga

SEQ ID NO: 3322 - RNA, 71 nt, Human
cucccugaccccagucuuggcucaugcugaggugugcaccucugccccugaccccugggcuggccugggag

SEQ ID NO: 3323 - RNA, 77 nt, Human
gggggaaagccugguuuuggcugcuuugaggcuuucauugaaagcaaaugaggcagaaaggccccggccccaccccc

SEQ ID NO: 3324 - RNA, 78 nt, Human; identical to SEQ ID NO: 99

SEQ ID NO: 3325 - RNA, 65 nt, Human; identical to SEQ ID NO: 247

SEQ ID NO: 3326 - RNA, 80 nt, Human; identical to SEQ ID NO: 100

SEQ ID NO: 3327 - RNA, 125 nt, Human
guauuuuauagcacuaaaauauuaauacagccagaaauauuaucaauugguccaagauuucuguuuauaaaaugucuagacugcuaauugaagaaauguugcuguauaaguaauagcuacaauac

SEQ ID NO: 3328 - RNA, 82 nt, Human
gggagauggcuuccgcucaugcaacaggcagguuugggaguuagaggucaaaagcagcugccugaaugaguuguuguuuccu

SEQ ID NO: 3329 - RNA, 78 nt, Human; identical to SEQ ID NO: 99

SEQ ID NO: 3330 - RNA, 65 nt, Human; identical to SEQ ID NO: 247

SEQ ID NO: 3331 - RNA, 80 nt, Human; identical to SEQ ID NO: 100

SEQ ID NO: 3332 - RNA, 71 nt, Human
ccggguagagggauugagccaagaggugagggugcacgucuucccuccuggucccagcuccccaagccugg

SEQ ID NO: 3333 - RNA, 109 nt, Human
gagcagcgauggaccauguagugcaugggcagugugcgacauccugcucucucacauaccguaucgauagcgcaaccuucucacacuacaaauuggcgaucugcuccuc

SEQ ID NO: 3334 - RNA, 63 nt, Human
uacacucaagcgcggucguaccugcucgugccuucuggagcacaugccgcgagcuugugugua

SEQ ID NO: 3335 - RNA, 68 nt, Human
agaauuuuuggcuuauuuauuuaaaaaaagucaaccuuauacauaaauagaauaaaaacaagaacucu

SEQ ID NO: 3336 - RNA, 131 nt, Human
uccccccaacaaaaggauagugucacaugcucaaaccauuuaagucuugcaguguaguuacccucuguuguuacugcuacauucuaaacauaagguucucauuguguguuccuauaccuaaauaaaaaaca

SEQ ID NO: 3337 - RNA, 85 nt, Human
aggagaaggaauuucagguggguuuaagucagagcuaguuccccaacagaaagaucauuugaaaccaguuuuuaucccuucucuu

SEQ ID NO: 3338 - RNA, 93 nt, Human
gaauauugcauguagaguucgacgcuggacaucugugaagaccaaccugggcuuuuuggguguguugccucuauccuucccauguucuuguuc

SEQ ID NO: 3339 - RNA, 81 nt, Human
uauaaaccugcuaucuugagguccuggucuuuuaaaaauuuuuuuuaauuuaaagcuuuuccaccgagguuuuaguuugug

SEQ ID NO: 3340 - RNA, 61 nt, Human
gggaacugggcaucaucgacagugccuucggccagagcggcaaguucaagauccacauccc

SEQ ID NO: 3341 - RNA, 74 nt, Human
auguuauugguauagugaaaagaagaccagauuuugaacuagaucuggauucucuuuuuaguaacucagggcau

SEQ ID NO: 3342 - RNA, 69 nt, Human
uauauauugugauuuaugcuuuaagaaaaugcauacuuuuuucuaaugaagaguaguucauaauauaua

SEQ ID NO: 3343 - RNA, 65 nt, Human
ugugacuauaaguaaugaacccaauuccacaaaccacaugucaaaauuagucuuauuacuucaca

SEQ ID NO: 3344 - RNA, 69 nt, Human; identical to SEQ ID NO: 1875

SEQ ID NO: 3345 - RNA, 70 nt, Human
guagcaggcuuccugcagacuguauagacugcacaacaaauuucuccuguaccuaugggaagccugucac

SEQ ID NO: 3346 - RNA, 66 nt, Human
acaguagggggaagguguggcucauugacuuuaauccauuuggugaagucacagauucacugcugu

SEQ ID NO: 3347 - RNA, 66 nt, Human
acgcucacaagcuaauagacuuccuuaagcugaagagaaaucagcaggaggacgacugaugagcgu

SEQ ID NO: 3348 - RNA, 77 nt, Human
cugggaagaacugauaucugagaacaacuuaaacggcgauuuuagugaaguugacgcucaagagcaggauuccccag

SEQ ID NO: 3349 - RNA, 84 nt, Human; identical to SEQ ID NO: 374

SEQ ID NO: 3350 - RNA, 63 nt, Human; identical to SEQ ID NO: 375

SEQ ID NO: 3351 - RNA, 78 nt, Human; identical to SEQ ID NO: 376

SEQ ID NO: 3352 - RNA, 116 nt, Human
uuuuguucaaaagauuugaagcaagaccuugcaaagacucuuaacauuacuguucagcuugcuuagauuguguuaacaguucauuuaacaaagauccguuuuaacucugaacaaaa

SEQ ID NO: 3353 - RNA, 67 nt, Human
ggagucuucugcuggagguuccuucacugugcgugcugaccauggugagcccauuggcagggguacc

SEQ ID NO: 3354 - RNA, 95 nt, Human
cccaagcuucucucuguccccuucccuccaagcucugucucuuaaguuauuuaaauuauggcuggggucggggagggguacaggggggcacuggg

SEQ ID NO: 3355 - RNA, 66 nt, Human
ucgggacggauguggucucccacauacaaagguccaacuguugggaacgacgcguauccguucugg

SEQ ID NO: 3356 - RNA, 79 nt, Human
guuguauaaucaucaaagccauucaucuccauaacucuuuucaucuuguaaaacugaaacucuguacccauuaaacaac

SEQ ID NO: 3357 - RNA, 72 nt, Human
uguugagugcagaugaaggguuguaugaggccccauccugggagggcuguacaccuucuuggcacagcagca

SEQ ID NO: 3358 - RNA, 92 nt, Human
uucuagagcugauuugauggacaauggagagagcuuucccugugauuauaaaaaaggaagcuagcugcucuacggucaucuuugcuuaagag

SEQ ID NO: 3359 - RNA, 72 nt, Human
guggcgaguauggugcggaggcccuggagaggauguuccuguccuuccccaccaccaagaccuacuucccgc

SEQ ID NO: 3360 - RNA, 79 nt, Human
aaaauucccacuuaauugaauacuuagaaaaaaauggccaguggcgauugaaagguauauuaaaauuaagggcaguuuu

SEQ ID NO: 3361 - RNA, 130 nt, Human
cugcugaaagucuacagucugugaauauaccaauuccccuuuacaacugaugcagaucauuaugaaauacuggaaggcauacccuacaauuuaggaauugguguggcugccacugcuaugcucucaauug

SEQ ID NO: 3362 - RNA, 69 nt, Human
gaggccagcccacucgccccagccgccgccaugaaggccguggugcagcgcgucacccgggccagcguc

SEQ ID NO: 3363 - RNA, 95 nt, Human
cgaaaggcccggaccgaucgcccuucccaacaguugcgcaaccugaauggccauuggaaauuggaagcgguuuauuugguauuccgggucuuuug

SEQ ID NO: 3364 - RNA, 71 nt, Human
ugcucuggugugugaaggucgguggguuaacugugugccuacugaaccuggcaaauaaacaucacccugca

SEQ ID NO: 3365 - RNA, 107 nt, Human
ggcccaugacugccccugccccagugccauuggccgccccacccgcaccacuggcuggggguccggggguccggccagugcaggcacccuggggcaguagcagggcc

SEQ ID NO: 3366 - RNA, 61 nt, Human
guggcgaggaguccgagccguugggggcauccaggcccagcugcugggagaccuuggccac

SEQ ID NO: 3367 - RNA, 90 nt, Human
cccugcagcaccacaaccuccugggucugcucugugagugguuucuauccagggcagcauugaagucaggugguuccggaacggccaggg

SEQ ID NO: 3368 - RNA, 69 nt, Human
ggguuggugagagcuucacagugcagcggcgaguugagccuaaggugacuguguauccuucaaagaccc

SEQ ID NO: 3369 - RNA, 65 nt, Human
caaaacucccgccuuaccugcgguggcagcacugacaugcugccacgggcccggcgggauuuuug

SEQ ID NO: 3370 - RNA, 62 nt, Human; identical to SEQ ID NO: 206

SEQ ID NO: 3371 - RNA, 92 nt, Human
ucaccaucugcagccuugaaggagcuugguucggagacaggcaaaggagccauguguggagagccugguuucucaguacuuccagaccguga

SEQ ID NO: 3372 - RNA, 72 nt, Human
cggaguuucacucuugcugugcaaagagacugguggcauuuugccccugcuccagagaucuguggaacuuug

SEQ ID NO: 3373 - RNA, 61 nt, Human
cccccacaacuacagccgccaaaauaaccagcaugguguuguaacauccccccaguggggg

SEQ ID NO: 3374 - RNA, 77 nt, Human
cuugaguuggggacaugagugagaacuggggguuuugaggaguaacccuugugaacacauguacuccagcagccagg

SEQ ID NO: 3375 - RNA, 92 nt, Human
gguauuuguccucagccucuccccagagucccugggaguguuucuguuauuguggagggaauaggggaucuggggacagggugggacguacc

SEQ ID NO: 3376 - RNA, 63 nt, Human
uccccauggugaccugugaccugcucccugagacaggggaggccaggcaggucacggugggga

SEQ ID NO: 3377 - RNA, 66 nt, Human
ggaaacuugcuggauaugauguaccgggagccagcacgaugguccuacacauuccagacauuuucc

SEQ ID NO: 3378 - RNA, 74 nt, Human
aacucuggugggucugauacagguagcaauguaauuugaaaucaguugaauuuccuguuuuucucucauagguu

SEQ ID NO: 3379 - RNA, 70 nt, Human
gaggacauuuuaaggaaaaaaagggcuuuaaaaaaauggagaauaauaauaauuuccuuugugugaacuc

SEQ ID NO: 3380 - RNA, 73 nt, Human
caugaaaaaggcauuacuauuguucuggucuaaguacucuaacaggacgaugauuucuaacccuagcaucaug

SEQ ID NO: 3381 - RNA, 73 nt, Human
uuuauuuguaucaaggcauuuaaaaugaauauauguaacauguaccuaaguuuuaaaagcauaauaaaaugaa

SEQ ID NO: 3382 - RNA, 69 nt, Human
agacaccucucucauguacccagaggacacuuguaaaucuggaccaaguacgaauacacagaguggucu

SEQ ID NO: 3383 - RNA, 61 nt, Human
gcuuaacccauuuucaagcaaaacaguucucaggaaaugucaugauugccggggugaaggc

SEQ ID NO: 3384 - RNA, 123 nt, Human
uuuuggcucguccaucagugaucugccauaccacugugacugcauugaaagaugucccuuucucucucugccagucggucggugugggacaaaacacagauauacagcagauagcggccaaaa

SEQ ID NO: 3385 - RNA, 95 nt, Human
ccagguuaaauaaggguuccaaaaauucucugguccgggauuuuaaccuucgcuggaaucugucacacguuuggaacccucaaguguccaccugg

SEQ ID NO: 3386 - RNA, 62 nt, Human
ggcgcguacauggguaauuaagguuuaaaaauaugcgcuaggccucuggcuugugugcgccu

SEQ ID NO: 3387 - RNA, 78 nt, Human
ugggcuuaacucagggagacuuuguacauuucaggcaauuacgcuuuuggacgcaagguuuuaucucaggcaagcgca

SEQ ID NO: 3388 - RNA, 65 nt, Human; identical to SEQ ID NO: 1518

SEQ ID NO: 3389 - RNA, 75 nt, Human; identical to SEQ ID NO: 74

SEQ ID NO: 3390 - RNA, 64 nt, Human
guuggucugaaagcccccgguaucauuccucgaauuucagugccgggaaccaaugcagacuggc

SEQ ID NO: 3391 - RNA, 89 nt, Human; identical to SEQ ID NO: 504

SEQ ID NO: 3392 - RNA, 72 nt, Human
aaucaagcugugaaggagcgagcccagggcguggugcugaaagugcucacaaacuucaagagcagugagauu

SEQ ID NO: 3393 - RNA, 89 nt, Human
cgcuguccucgcgcuuccgccggguggacaucgacgaauuugacgagaacaaauuuguggacgagcaggaggaggcggcggcggcggcg

SEQ ID NO: 3394 - RNA, 74 nt, Human
uggaggaauuuccugguuuuggcuauaaauuauguggaccuuuuuuaagcagccaaaacagaagauuuccuuua

SEQ ID NO: 3395 - RNA, 73 nt, Human
augaaugcuagggggaucccgcguuagaugaccgauagucuaauuaaugcaaaaccccccccuugcaccccau

SEQ ID NO: 3396 - RNA, 85 nt, Human
caggggaccuggaaguuggaacaauuuugcuccugggacaccgaggggcuuacgucgaagauucgccagacuuuugggccuccug

SEQ ID NO: 3397 - RNA, 83 nt, Human
uagggggaauggacauaugcgggguacgggcaccaggcacauauacuguggagccccccccgcgaauuuccugcgacccccug

SEQ ID NO: 3398 - RNA, 91 nt, Human
auguucaagaaauccucuagcaggucuagcaucuggucaucugggaaaagaugaguacacgaugcccacccuccuuaagguucuugagcau

SEQ ID NO: 3399 - RNA, 92 nt, Human
cugcagcagcaauaauuucccagaugcucugauuagggcacugccaucauacaugccauuaggcaucuuaggagcucccauugcagccacag

SEQ ID NO: 3400 - RNA, 84 nt, Human
caugucaguuaucaagagacucaacagaugcagaugaaguuucagcaaguucgugagcagauggaggcagagauagcucacuug

SEQ ID NO: 3401 - RNA, 63 nt, Human
caugacaacagacacauugacauggguggguuuacccgccaagcgucgauggucuucugugug

SEQ ID NO: 3402 - RNA, 65 nt, Human
cagcgacaguguaagccugaaucucuugcuuuucaucaucauuuuaggaucaacacuguauguug

SEQ ID NO: 3403 - RNA, 94 nt, Human
ggcgugucacaaccacugcaacacaaaaaaucuugcaaucucaugcuuguuuuauaaaugugaucccaugguuugaaguaguggguuacaugcu

SEQ ID NO: 3404 - RNA, 83 nt, Human
ggcccagggaucggcagggcugcuggcagaggaaucccagcugggguucccaugccccaggcuccugcaggacuugcugggcc

SEQ ID NO: 3405 - RNA, 86 nt, Human
gccugguaccggcggaugucgguggucuacgggaucggcaccuggucugugugggcucacugcuuuacuauagccgggacaauggc

SEQ ID NO: 3406 - RNA, 64 nt, Human; identical to SEQ ID NO: 2415

SEQ ID NO: 3407 - RNA, 90 nt, Human
gacgcuucaccccaaugguaaccgcuaauuaggggucgcacaaaaauugcgcccuucacagguacaaacacauucggggggggagggguc

SEQ ID NO: 3408 - RNA, 90 nt, Human
ucuaugagcaucuucaacaauauuccuacaguuguaugaguggcauguggccauuugugauguagccgaauauaggaagugugccaaaga

SEQ ID NO: 3409 - RNA, 78 nt, Human
gaagaaagaccugcaccugccugauccgaugggcaaagguggccuuuggaaggggcguuguccaguuccucuuucuuc

SEQ ID NO: 3410 - RNA, 81 nt, Human
uguucuccucaucuggaaaauaauuuggcuguauaaucgugguauucaggaaguuagggcagguguuuagguggaagagca

SEQ ID NO: 3411 - RNA, 88 nt, Human
cuccugaaagucauccucgccagucccggcguucaauguccaucaauggcggucuaaugcuggggaaaaaagguggcauugcaaggag

SEQ ID NO: 3412 - RNA, 78 nt, Human
cucgcuauauggggaagggugucucaaaggcuguugagcacaucaauaaaacuaugugcgccugcccugguuagcaag

SEQ ID NO: 3413 - RNA, 72 nt, Human
uugccgucugccaaagcuggugccguugagaaggggguccccuguacgccacaucgcugacugugguggcaa

SEQ ID NO: 3414 - RNA, 71 nt, Human
gggucaagccagcaccugaugaaacuuccuucagugaggccuugcugaagaggaaucaggaccuggcuccc

SEQ ID NO: 3415 - RNA, 61 nt, Human
gucuuggguugagccccaaaccggguuguguguuaggguauugugugggaaaacccaagau

SEQ ID NO: 3416 - RNA, 60 nt, Human
gcucagucaauagugucacagguauuaagccauuucggaauuuggcacuuuuuucugggu

SEQ ID NO: 3417 - RNA, 60 nt, Human
guuacaccaaauauucguagucugguugcccgaauauaacuaauaguauuaggauguagc

SEQ ID NO: 3418 - RNA, 101 nt, Human
aguguauuaaaaaucauauucuaauucuuuuaauuugguuaucugaguaugauaauauaggagagcucagauaacaagaaaaggcaauugguuagaacacu

SEQ ID NO: 3419 - RNA, 68 nt, Human; identical to SEQ ID NO: 1919

SEQ ID NO: 3420 - RNA, 72 nt, Human; identical to SEQ ID NO: 1920

SEQ ID NO: 3421 - RNA, 109 nt, Human
uggaagcagaggcagggcaacauuaaguagcuuacauaacucacacgguaauuugugcaguugggagauguucagcuucagucccuggccaauugcccguucuuuucca

SEQ ID NO: 3422 - RNA, 89 nt, Human
agcguaaaucacauuuacuuuuuucuacauaacuuuucuaaccacaaaaaaagaaaaugguuuaaaagaagagaugagauaucuuugcu

SEQ ID NO: 3423 - RNA, 65 nt, Human
gcuguauaugguauccugaagcaccugcccuucaagacagaaugcuuguaccacauuuaugcagc

SEQ ID NO: 3424 - RNA, 73 nt, Human
guuccacgcaccgccuuugaguuggacacagauggcaaccccuuugaccaggacaucuacgggcgcgaggagc

SEQ ID NO: 3425 - RNA, 66 nt, Human
cgcuucagucuccugcucggacagcuucucuucugacagaacugacauccagggcgauacggagcg

SEQ ID NO: 3426 - RNA, 69 nt, Human
guguaaaauuucucccgggcacuggagucuugcuccgcguaguaacucuccaagccuucugggaugcac

SEQ ID NO: 3427 - RNA, 84 nt, Human
uuuugggggucggcagcaaguuuuauuugcaaagcagcauuagcaaacagaagcaauugcaccguaaaugaguaaccucuaaag

SEQ ID NO: 3428 - RNA, 61 nt, Human
cagcugucacaacuuguguugagcaagcaguagcauuugcuuccucccaacaaggcagcug

SEQ ID NO: 3429 - RNA, 85 nt, Human
gguuagggaaaaccaugggguaagggacgggacucacuucucuuuuuaguugagggccuucuuaguuaccacauuuacucuggcc

SEQ ID NO: 3430 - RNA, 79 nt, Human
ggucuuucuuggucaagugguccagcauccuggcgucuacaaggcacuccaugaaguagcugcgguacugggggaggcc

SEQ ID NO: 3431 - RNA, 73 nt, Human
uuuccaguucuuuccggucauaauuuaaccuucucaggcacauaauuccacacuggaaacuguuucugugaaa

SEQ ID NO: 3432 - RNA, 73 nt, Human
gggaggagcuagcucucugccuucucagccaauugaaaucguggaaaccaaugggcuucagcuagccucuccc

SEQ ID NO: 3433 - RNA, 76 nt, Human
uuuuuuuuuuuuucggaccagacucuuuuuauuguuuuguuuuuuauaaacaagucucagguggaaaaagaaagaa

SEQ ID NO: 3434 - RNA, 86 nt, Human
cuccagucccaagcaagccuccaggcccugaguguucugaugccugaaggguagucauaggucccgagguggagucggggguggag

SEQ ID NO: 3435 - RNA, 69 nt, Human
gcuggggucccauaggauguccucauaugggcuuagaacugggcccgacagccauccuugagccccagu

SEQ ID NO: 3436 - RNA, 62 nt, Human
uauguauauauuuaacacacacaucuuaaaaauagcuccagaugacagaacaguauugcaua

SEQ ID NO: 3437 - RNA, 81 nt, Human
gucucauuauucugcccaggcugaucucaaaccccuaagcucaaguguuccaauugccucagcuuccugaauagcugggac

SEQ ID NO: 3438 - RNA, 60 nt, Human
aagcagcuagggaauucuuuauuuaguaauguccuaacauaaaaguucacauaacugcuu

SEQ ID NO: 3439 - RNA, 60 nt, Human
ggugacaacaugcuggagccaagugcuaacaugccuugguucaggggaugggaagucacc

SEQ ID NO: 3440 - RNA, 61 nt, Human
cugggaauaaacuggaagcugggucucuuuguugcuauguuuuuuuguuugaaguucccag

SEQ ID NO: 3441 - RNA, 61 nt, Human
ggaguugcucagaggcucacaugggcacccccauugguucgugugagcagcugcccagccc

SEQ ID NO: 3442 - RNA, 72 nt, Human
ggcuggggcucauuugcaggggggagccaaaagggucaucaucucugcccccucugcugaugcccccauguu

SEQ ID NO: 3443 - RNA, 117 nt, Human
gggaagcuugucaucaauggaaaucccaucaccaucuuccaggagcgagaucccuccaaaaucaaguggggcgaugcuggcgcugaguacgucguggaguccacuggcgucuucacc

SEQ ID NO: 3444 - RNA, 62 nt, Human
ggggauccugggguaccuggggcaccggggguuuccucugauuccaccagggaccauucucc

SEQ ID NO: 3445 - RNA, 82 nt, Human
ucagcaggacuaugagauugaauguagcuuuaacuuucuggagaaagagaaguauaagugaacuuguagucuuauuuguuga

SEQ ID NO: 3446 - RNA, 77 nt, Human
uucugguucuucacagacagaaagcccaucaucaaaauauaguggguuuuuuuucugagguuucucaggaccaugaa

SEQ ID NO: 3447 - RNA, 84 nt, Human
ggcacgguuuuuauacauacguacauauauauauauaaacacacacauagguauauaugaauaaacaaaaaugaaaucccugcu

SEQ ID NO: 3448 - RNA, 104 nt, Human
uggauuuauuaaauauuuucuguggugugaagugacuuauuaaauccacagacauugagugacuucuuacaacauccacauaagaauuuguuguaaugaguuca

SEQ ID NO: 3449 - RNA, 79 nt, Human
ccaggaggggaaacaggcacgcucauuucggcaacacacaacgcgcaagggauagagcgggcuuauaaacccucugugg

SEQ ID NO: 3450 - RNA, 62 nt, Human
gauugguugugguuaaugaauauguucaaguuuugaauuuuaauaguaacuccaauucaguu

SEQ ID NO: 3451 - RNA, 65 nt, Human
gcucauuauugacuacuuagcugaguucaauuccacaccagcugucuuuacaaugauaacugagc

SEQ ID NO: 3452 - RNA, 60 nt, Human
ggauuuuacuaauggacauuuucaucaaauauguaugagaaugcacauuucuauaaauuc

SEQ ID NO: 3453 - RNA, 68 nt, Human
ucuccugggcuucucagugucucgccggcgggguucggccugagcuggauugacauagcccuugggga

SEQ ID NO: 3454 - RNA, 61 nt, Human
caguucggcuuccgcgaaaacgacucuugcuguccacauagccagccgugaagccaaacug

SEQ ID NO: 3455 - RNA, 90 nt, Human
gaagccaaacugcaggccucugcccuccccuaaauguccuccuaggaugcagucacucgggaggaagaugugccuguuaccaagugcuuc

SEQ ID NO: 3456 - RNA, 64 nt, Human
gucugggucgaacguuucagcaugccacagaccaaauugaguaaagaaaugucguacuccagau

SEQ ID NO: 3457 - RNA, 63 nt, Human
guuuggcaaggcaucauaacaaccaacuugacuugugggaugcccccccuuuucaaaccaagc

SEQ ID NO: 3458 - RNA, 66 nt, Human
cccccggcccgggucaggccgugggagccgcuauuaucugcguucucugccaaagacucguggggg

SEQ ID NO: 3459 - RNA, 76 nt, Human
gcuggugcucauggcacuuccuccuugcuucccaccccuggcagcagggaagggcuuugccugacaacaccccagc

SEQ ID NO: 3460 - RNA, 88 nt, Human
gcugcuggagcagcugccuucaggcccugcgccgccuccggaguccauggccggcacgcgcuggguacucggggcgcugcuccggggc

SEQ ID NO: 3461 - RNA, 75 nt, Human
gggcugcggcuguaacugcagcagcugccggcgcaccggcgccgccugccugcccuucuacuccgccgcuggcuc

SEQ ID NO: 3462 - RNA, 82 nt, Human
guaugaauuggccccguccaaguuagaagaggaaguggaugaugucuuucucauucgagcucaaggacugcccuggucaugc

SEQ ID NO: 3463 - RNA, 61 nt, Human
gcgacgggcaggacgccccguucgccuagcgcgugcucaggaguugguguccugccugcgc

SEQ ID NO: 3464 - RNA, 64 nt, Human
gucucucaagcugaccagcgagcucaaguuccaucaagaaugcugucgccggugugcgcgagac

SEQ ID NO: 3465 - RNA, 116 nt, Human
gacuccaaaugauguuauggucauucuguuuuucugauacgagaauagauggucuugagaaccuagaauauucaugccuuuaugaaucuagaaugacuuuaauuagguaugggguc

SEQ ID NO: 3466 - RNA, 69 nt, Human
guccugcgccgucagcacaagccacgcuucagacacaagaggcccaagagcuucugcuaggugcagggc

SEQ ID NO: 3467 - RNA, 63 nt, Human
cgggagaaguucguggaaagcccugaaaacagaguuggcuggcaaagggcugagguucucucg

SEQ ID NO: 3468 - RNA, 60 nt, Human; identical to SEQ ID NO: 2705

SEQ ID NO: 3469 - RNA, 72 nt, Human; identical to SEQ ID NO: 1989

SEQ ID NO: 3470 - RNA, 61 nt, Human; identical to SEQ ID NO: 1988

SEQ ID NO: 3471 - RNA, 72 nt, Human; identical to SEQ ID NO: 1989

SEQ ID NO: 3472 - RNA, 122 nt, Human
uucgggggucucccuggcaaggggucccagggccuggagccaaggcccagccaaaagcacgcagcaucaaaacauguuuuuagugggaagcuccaggcccugcccuccccgggggccucgag

SEQ ID NO: 3473 - RNA, 60 nt, Human
gcgccggcccugaccccgacgcucugcccgcaggcaucaagauccccgagggcugcgugc

SEQ ID NO: 3474 - RNA, 64 nt, Human
aggugaguugugacugauugcuuuuccugcagcgcacgugagcaguaucagccaucucucuccu

SEQ ID NO: 3475 - RNA, 83 nt, Human
gugagcuagcagcuuuuuaaucuaccuggaacuaaggccaaaaauuaucagcccuuucguucuggaaggagagcugaucucau

SEQ ID NO: 3476 - RNA, 63 nt, Human
gugccugguaauggaauaauagggucggcgaugccgccaagauuccagaguaagucaggucgc

SEQ ID NO: 3477 - RNA, 66 nt, Human
auuauuucacagauaaugagaccuuaauaacaaauaggcguaaaaaaauuuucacauugaaaugau

SEQ ID NO: 3478 - RNA, 61 nt, Human
cacuuccuuugcccuuccuccugccuuucucaacugucccaaggagggggccucauuugug

SEQ ID NO: 3479 - RNA, 79 nt, Human
ggcuuggaccuauauggccaugcucuggcucuacccuugggaagccugaucccgguguguggcccagcuuguucaggcc

SEQ ID NO: 3480 - RNA, 84 nt, Human
gugcugugugucaccaacuggucuucuaauuuggaaggaguuggaaaggccuuuuuguugaugaaaaguuggaaacaguggcac

SEQ ID NO: 3481 - RNA, 66 nt, Human
uuuguuaaaccaaucacagcgguggguggaaagcaugaauuuuccccucggcagugggguaacgga

SEQ ID NO: 3482 - RNA, 104 nt, Human
ccuugaaagcucugcaucaugggcagugagcucagugguaucuggaggacagggcacuggccacuccagucaccaucuucugccaggaagccugcaccucaggg

SEQ ID NO: 3483 - RNA, 80 nt, Human
gggacugcuuccggauccguuacagaaaaggaggaggugcaguucaccaccguccucugcuccaagauccagcaggaccc

SEQ ID NO: 3484 - RNA, 73 nt, Human
uucagcaagguucuggcgcaggugcagcacccccugcugcugcuuaccucagcguucacaggccugugcagaa

SEQ ID NO: 3485 - RNA, 60 nt, Human
gccccaaccuccuggcuuggucuccgcuuguuguuggcuaccuaguuccagguugagggc

SEQ ID NO: 3486 - RNA, 68 nt, Human
ggaccaacugauaccucgcuauguagcuuuacuccuuuauccucuagguggcguauuagaauggugcc

SEQ ID NO: 3487 - RNA, 62 nt, Human
uauaagaauaugcugccaauuucugucauugucuuugaccuaucuguuuguguauccuaaua

SEQ ID NO: 3488 - RNA, 65 nt, Human
ugcucacagggugugacuggcccacuaucuaggguagugagccuauuuuguggccccugugugca

SEQ ID NO: 3489 - RNA, 66 nt, Human
ggguuucugcgggugaaccaguuaaggguuuucuucugcuuuuacuucucgccuaugcucaagccu

SEQ ID NO: 3490 - RNA, 66 nt, Human
gagacggaguuucaccauguuggccaggauggucucgaucucuugaccucaugauccacccgccuc

SEQ ID NO: 3491 - RNA, 79 nt, Human
cucugucuccuauagaugcagacagugaggauggagacugggucaucuggaugucacaucuggcaccugggaaacagag

SEQ ID NO: 3492 - RNA, 62 nt, Human
gcaggagccccaggagcugagcgaggacccucauguccaugcuguguccugacugggucugc

SEQ ID NO: 3493 - RNA, 70 nt, Human
gucccagaucacugccgcugaaccuguagggaccuuauaguacaaauuagaugcagcguagaucagggac

SEQ ID NO: 3494 - RNA, 81 nt, Human
gaaguugccucagguuacgaggucuuggcacaauuauauguguaauuguguuauccaggauuuuccaagcuucgguacuuc

SEQ ID NO: 3495 - RNA, 63 nt, Human
acuauucaaauuaauaauacuuaguuuuagaauguuuauuuuauguagucauuaauuuuuagu

SEQ ID NO: 3496 - RNA, 62 nt, Human
auuuccuguguacagagaaucacauguauauucacaaugaagcaaucgugugcaccagaaau

SEQ ID NO: 3497 - RNA, 72 nt, Human
agaugaaauaauguucugucacgugaaauauuuaaguauauaguauauuuauacucuagaacaugcacauuu

SEQ ID NO: 3498 - RNA, 91 nt, Human
cugcucuuccaaagcuccugcgucuguuuuuaaagggccuggggaaaaauacugccuaggaaaaugccaaaauggaauuaggagagaguag

SEQ ID NO: 3499 - RNA, 105 nt, Human
gaggccagcauucguucuauguuuguguuaggagcagcggucuccagaauguauugaaggggccacaaguguuauuaaaguuaaauggauggacugcuggacuuu

SEQ ID NO: 3500 - RNA, 99 nt, Human
gcuuuuaccuaugggaguaaauccguggaagaaguuuugcucaauguaugcuaacaugaagcagcuuucuguuuucaguuuauucccucagauauuagu

SEQ ID NO: 3501 - RNA, 71 nt, Human
uagaguacagugucuuaaaauauucauguuuuacuuggauaucuagaagauaaaaggcauucuguauuuua

SEQ ID NO: 3502 - RNA, 90 nt, Human
ccuaaauuacaaaugcauucagaacaaauauaccuuucuccuuuuuuauuauaaaacagauacaagguaaaauucaaaugcagcaguagg

SEQ ID NO: 3503 - RNA, 81 nt, Human
ccugugguucuuucuccugcugguggcagcuacaggaugcguuccuucccgaggugcagcuuucaggaguuugggcccagg

SEQ ID NO: 3504 - RNA, 65 nt, Human
cucggagugggguugggacguuuucacucccaguggaaacgccaacuauaaccccucccuccgag

SEQ ID NO: 3505 - RNA, 64 nt, Human
uuguugaaggcuucggagacccuguucccucaccugcagugucucuggguggcucuucagucga

SEQ ID NO: 3506 - RNA, 80 nt, Human; identical to SEQ ID NO: 174

SEQ ID NO: 3507 - RNA, 65 nt, Human
uuucggcgcugggucgccaaagcagaauggagacggauagagugguggcucccagaaucccgaag

SEQ ID NO: 3508 - RNA, 70 nt, Human
cauuacugauuaucaaauagcauagaaaccacuuccauacauuucaagaugcucuucaguacucagaaug

SEQ ID NO: 3509 - RNA, 62 nt, Human
ccgcuaccggcugguaucgaacaagcugaagaagcgguuccugcggaagccgaacguggcgg

SEQ ID NO: 3510 - RNA, 67 nt, Human
ggccggcgagcaguucggacagcugggccgggagcugcgcgcccaggagugucugcccuacgcggcc

SEQ ID NO: 3511 - RNA, 60 nt, Human; identical to SEQ ID NO: 1551

SEQ ID NO: 3512 - RNA, 79 nt, Human; identical to SEQ ID NO: 1810

SEQ ID NO: 3513 - RNA, 83 nt, Human
ggaggcagacaggugaaugaguacuuaaaaauaucaggggcaucuugacauuuuuucacgaucacuuuauuuccaaugucuuc

SEQ ID NO: 3514 - RNA, 73 nt, Human
gaggcggagcuugcagugagccgagauugcaccacugcacuccagccugggcgacagagcaagacuccgucuc

SEQ ID NO: 3515 - RNA, 81 nt, Human
guugugaacauacguccagugguaccaugugccaaaaauucauaagauacgugguuaccccuauagcaaguguuacacaau

SEQ ID NO: 3516 - RNA, 60 nt, Human
ucacagggguuuccccgggcuguuggcaaaccuaaggccaaguuaggcauuccccugugg

SEQ ID NO: 3517 - RNA, 61 nt, Human
caggaggguauuccacuuuauguggauuaguauuuguccuuauuauguggaguccuuccug

SEQ ID NO: 3518 - RNA, 75 nt, Human
aauagggaucaaguuuuaaauccuccuccuucccuuuuuucuggagucuugagggccagaguuuuuguuuuuguu

SEQ ID NO: 3519 - RNA, 66 nt, Human
gcugccccaguguaugucuugccuucuccgcgucauuguuggaagaggagagaugcaucgagcagu

SEQ ID NO: 3520 - RNA, 60 nt, Human
ucugaugcugucaguuugaccgagcugguuuugcuuauggucaugcugcaauuuguuaga

SEQ ID NO: 3521 - RNA, 60 nt, Human
gagcaacaaguaacuccaaagugucagaaaauaguuaacauucaaaaaaacuuguuucuc

SEQ ID NO: 3522 - RNA, 61 nt, Human
aaugacaccguugauugagcuugucagcagagcugaaagagacagucgacggaugugcauu

SEQ ID NO: 3523 - RNA, 63 nt, Human
gcucuggucaguuacuuucacuaucucaaucuucgagcaaguaguuaggguuaacuaccaagu

SEQ ID NO: 3524 - RNA, 64 nt, Human; identical to SEQ ID NO: 287

SEQ ID NO: 3525 - RNA, 66 nt, Human
gaaauaaucuacuccaaagccuucauuccauaaagggaacuaaagcuuaaaacaguaggaguuuuc

SEQ ID NO: 3526 - RNA, 71 nt, Human
cccaaaacuauuguuuguguuucuguguuucauauucagugauuuaauacaguaucaugggcugagguggg

SEQ ID NO: 3527 - RNA, 90 nt, Human
gcucccucccucagccccugucucugccaggugccuccucucagucaggcuucagagcagcccuggagacaggagggccauguuacaagc

SEQ ID NO: 3528 - RNA, 90 nt, Human
uguaccuauaaauauaugcugucugucaguguacaguaugguacaaacuccuuuucuggcacacuuaaaaugcaagcaaucuaugggaca

SEQ ID NO: 3529 - RNA, 71 nt, Human
cuggcugggcugugagcgcugcgggaagacacuggacccccgguguggcacgcggagcuagcgacggucag

SEQ ID NO: 3530 - RNA, 63 nt, Human
gaguaccucccaucuagaucauuaggcauccaauuagcaaugaauuucuucaaucuuuaacuc

SEQ ID NO: 3531 - RNA, 61 nt, Human; identical to SEQ ID NO: 823

SEQ ID NO: 3532 - RNA, 66 nt, Human
cauugucgucauuggacacguagauucgggcaaguccaccacuacuggccaucugaucuauaaaug

SEQ ID NO: 3533 - RNA, 63 nt, Human
cacucguagaggcaguguccuggaugaaaugccguuugcaggaggugccaucucuucacagug

SEQ ID NO: 3534 - RNA, 97 nt, Human
uggggggaugaccaguacagacaugccaguuaaguuuauacuagugggaucccaaauccaaagcaguguacguggugauauggucagugacuaacca

SEQ ID NO: 3535 - RNA, 66 nt, Human
gggcuuccccagugucuuugggggucugugaaaaagaggauccucugagguuuacugggagggcuc

SEQ ID NO: 3536 - RNA, 72 nt, Human
uccccaaagcccuucuucacuuuguguccccuugcugcgaucauggagaguuaaagaggcuuccuugggaga

SEQ ID NO: 3537 - RNA, 84 nt, Human
cccgaugucuuuuuuuuuacuguggaaauaggaucggaagagaguaacauuuuuuuuuuaauccugauaaagaagauuguuggg

SEQ ID NO: 3538 - RNA, 84 nt, Human
gucaggcagaggugacgccaggagaugauuuaaaggugaaaaugacaagguuuccaccccucaaaccuuggcuccuuuucugac

SEQ ID NO: 3539 - RNA, 93 nt, Human
guauuguuucuggauaucaagauguuaaauauauuucuugcuauugugauaugacaagagacuuaacuuaucuugcucugucuuccacuguac

SEQ ID NO: 3540 - RNA, 71 nt, Human
uaccuuaaauuuaaaauauuuuuugcuauauaaacuuuaacaguuauuaaacaguguuuucuuuuugggua

SEQ ID NO: 3541 - RNA, 84 nt, Human
acgauguugauguccaaauugaccaggaguccuaacuugcugaagacauagcugguuggagucgagaucuaucauggagaucgu

SEQ ID NO: 3542 - RNA, 111 nt, Human
aguccucagagcaagagaugaccuuaucacagaccuacuaaaugaagcaaaacagagacucagcaaggugguaaaagauacaaccagguaccaagugcugcuggauggacu

SEQ ID NO: 3543 - RNA, 71 nt, Human
auuucccaauuuuuaaagccaagauacuugacaaggauuuaagaucuuaagggguccgaggggaggggaau

SEQ ID NO: 3544 - RNA, 62 nt, Human
ucgaucuguagcucccuaugccaaggguggcaaaauugggcuuuugguggugcuggaguugg

SEQ ID NO: 3545 - RNA, 63 nt, Human
gggacucgccgccaucucaggucucuuggcuuugccaggcccaccggagaaaacugacgaccc

SEQ ID NO: 3546 - RNA, 71 nt, Human
gcaaucguggcgcguguccaguagcgcaggcguauucggaugucgucucgcaugggacaggcacacgaugc

SEQ ID NO: 3547 - RNA, 82 nt, Human
uagccgcgugcgcgaggagugcggcccucuaucuggaggcggugaauacagacacaucgcugcaggccugguacuguggcug

SEQ ID NO: 3548 - RNA, 60 nt, Human
agugagagaguugauggauauuaccuagucugccauuacuggacaucauucuuuuuuacu

SEQ ID NO: 3549 - RNA, 85 nt, Human
ucaccgcuaaugaaagcugggcacugcaaauguucugcuaugcuccagaaaucagaaguugccagcuuuuauaucuagacuguga

SEQ ID NO: 3550 - RNA, 70 nt, Human
uuuuaaaauuuuaugauuuaugaguuuagaaaaaaucucuuuuggacuuuaagcauauguuauuuuagga

SEQ ID NO: 3551 - RNA, 68 nt, Human
gcaccuuuuuuuuauuuauuuuuggcuagggaguuuaucccuuuuucgaauuauuuuuaagaagaugc

SEQ ID NO: 3552 - RNA, 64 nt, Human
ucuuaaaaaauaccagcaguuacucauggaauauauucugcguuuauaaaacuaguuuuuaaga

SEQ ID NO: 3553 - RNA, 64 nt, Human
gcgagagugugcguuugugugugugaauguaugcguuuugcccacaguaaauguacaacuucgc

SEQ ID NO: 3554 - RNA, 68 nt, Human
uuuaaauaaaauucacuuuaugaaucaauaagugaaauggcaaaaaggagagguggauauuauuuaaa

SEQ ID NO: 3555 - RNA, 66 nt, Human
cauugaguugaaggauagcaguguaccgugauuucgauggaacaaagaauagaguucaaguugaug

SEQ ID NO: 3556 - RNA, 96 nt, Human
ggcacccagaucggaaacaccaugagagcacuuuaucuguagguccuuugggccagcaauuugggcucacaaauggacaccucugagcugagggcu

SEQ ID NO: 3557 - RNA, 68 nt, Human
ucgucacgccgcggacgccucaacagacgcucuauaagaccacucaggcuggacgacgagcgccacga

SEQ ID NO: 3558 - RNA, 67 nt, Human
cugcaaguccagccagaguguuuuauaucgcgucaacaauaagaacuacuuagguugguaccagcag

SEQ ID NO: 3559 - RNA, 60 nt, Human
ggucacaaagaggcuuucaccagcggcgaagcagucgcucagacggccccaaccguggcc

SEQ ID NO: 3560 - RNA, 109 nt, Human
agaguuggaaaacgggauguugcacgugugucuuaaaagagcaagcuguagaaauuuggauagaauguuaagaagaggagagauuguggagaucugguuuggugacuuu

SEQ ID NO: 3561 - RNA, 66 nt, Human
cuucugaucauggacuuuccacauggccaaaauuuacuggaucauuggaagaaucacuuucagggg

SEQ ID NO: 3562 - RNA, 97 nt, Human
ugucugaaggaaacauugggaucuucugugauauggaugggaaaugcagucucaucaggaaucauuugguuugggucccuugucuugguaauugaua

SEQ ID NO: 3563 - RNA, 102 nt, Human
guuacacugaucaugggucugaccaucauuacagaggaaagagagaugauuucuucuaaugaagacaggaaucaugaugacuggagccaugacuaugauaac

SEQ ID NO: 3564 - RNA, 79 nt, Human
cagugaacccuguuguggacccgguguuggcaguugggacccucucagcaccgauauggacggacgacagcaugcacug

SEQ ID NO: 3565 - RNA, 70 nt, Human
uggccagcaguuuuuaggucugucaguacugcacugcaagaauggcagauuuugggaucucugcuggcca

SEQ ID NO: 3566 - RNA, 70 nt, Human
aggagucagaaaaccaccgauucuguuuuauuguaauaugucagucgaauaauugaacccgggaacuccu

SEQ ID NO: 3567 - RNA, 73 nt, Human
ggagagaaaagaaagccaaaccguucccuggguggaaaaauaucgcccaaauguguggaugaaguugcuuucc

SEQ ID NO: 3568 - RNA, 72 nt, Human
caggccgagaagaacguggagaagaaaauggaaaauaacagaggucucaagaaccauggacuccugggucug

SEQ ID NO: 3569 - RNA, 64 nt, Human
ggcggaccagugcgagguaugcugccccuaagaaacaagcgaggccaggccgcucuggaccguc

SEQ ID NO: 3570 - RNA, 63 nt, Human
ucuggggcgccuggucacgagguugggcuggcaaguaccaggcaguugacaggccacccuggg

SEQ ID NO: 3571 - RNA, 62 nt, Human
cauuucgauuucagaauuuacuuagauucagaagaagaaucgaaguggagaucugugaagug

SEQ ID NO: 3572 - RNA, 98 nt, Human
gguggcuauugcuauagcaaugauguggaguggcauuuccuuaaguuucauuaaauguuuuccauaucuagcauauuauauucaaguaagugguuauu

SEQ ID NO: 3573 - RNA, 60 nt, Human
ugguggccgucgcugccaggcacaagugucccgccgcaucuccuucagcgcgagccaccg

SEQ ID NO: 3574 - RNA, 68 nt, Human
ucuggcgcuggcgcggcuccaagaaggcauccgcauuugcuaccagcggcggccgcggcggagccagg

SEQ ID NO: 3575 - RNA, 62 nt, Human
gguacugcaacaagugagcaucauucacugcaaccuugaaguggucagguucaaccaguacu

SEQ ID NO: 3576 - RNA, 67 nt, Human
cuuuccuuaaaaaaauuggguacacccccaacacggaagcauuuggggccaauuucugguuggaaag

SEQ ID NO: 3577 - RNA, 60 nt, Human
aucucugacuuauugauuauggaaccugucaaguaguuuucaacucucccagugagggau

SEQ ID NO: 3578 - RNA, 65 nt, Human
gccugaucauccuacugcagggccuccagggccggguaaccacuguggaccugcgggaugagagc

SEQ ID NO: 3579 - RNA, 83 nt, Human
uacaucugacuuuauucccaguccucuuauccugugaaggcugguacacuagggaaaggggauauuuaaaaaugucaagugug

SEQ ID NO: 3580 - RNA, 75 nt, Human
ugacuuuggaucuaaucaagauagggaaagaucaaaagauuuauuucugaagcuugcuacaguuuucuaggguca

SEQ ID NO: 3581 - RNA, 63 nt, Human
gguacaguccugucccauuggcauggauauuuauuguuccacauguugggaaaaccaugugcc

SEQ ID NO: 3582 - RNA, 69 nt, Human
uguguuccgucuuuaugcugucacuugcaaacacuuuagcuuugcuaguucuuguauuagaucuucaua

SEQ ID NO: 3583 - RNA, 80 nt, Human
uuauguuauuagguguaaagaaaguguaugcugugccuguuuugguacugcgagcaguucuuccaauucgaugaauauaa

SEQ ID NO: 3584 - RNA, 61 nt, Human
ggugacaacaugcuggagccaagugcuaacaugccuugguucaagggcauggaaagucacc

SEQ ID NO: 3585 - RNA, 79 nt, Human; identical to SEQ ID NO: 1810

SEQ ID NO: 3586 - RNA, 98 nt, Human
gugagagcgguaagauggcggcggcggcggugguggaguuccagagagcccagucucuacucagcaccgaccgggaggccuccaucgacauccuccac

SEQ ID NO: 3587 - RNA, 63 nt, Human
gccagguuccacagcugcaguugagcccuacaaguccauccucaaccaccaguacaaccuggc

SEQ ID NO: 3588 - RNA, 68 nt, Human
gcagcagguggcgcagaugcagcugaaguacuacaacuccgacgugcaccgcgccgccuuugugcugc

SEQ ID NO: 3589 - RNA, 66 nt, Human
cugguaaacaugaccuggacauuuguaagaauauauuuaauauauguacacccauuauguuuucag

SEQ ID NO: 3590 - RNA, 66 nt, Human
ccgucacaggcuuugauucugauaacucuucuggggaauuuucagaggcaaaucagaaagucacgg

SEQ ID NO: 3591 - RNA, 62 nt, Human
cgcgggccuacggggcgggggcggggcggcagugagcucggccggcaaccgagggacccgcg

SEQ ID NO: 3592 - RNA, 71 nt, Human
uccagaucuucagugucuauuggauuuuuccaagagaaaguuuguaaaauuccuuacacuguagaugugga

SEQ ID NO: 3593 - RNA, 82 nt, Human
cugaaacgcuacaccaggcaaauucuuaguccuacugugaaaucgauggggucuuggaaaauggacugggacuguguuucag

SEQ ID NO: 3594 - RNA, 97 nt, Human
cacuuuaaaaaucgaccuugcagauuuugacaaaaauagccguuaugcacaauauacgaauuucaaaguuggagaugacaagaauuucuacgaagug

SEQ ID NO: 3595 - RNA, 62 nt, Human
ccgcucugacaaugggcagggaaauuucggcgcucgaggacugugcccaggagcagaugcgg

SEQ ID NO: 3596 - RNA, 67 nt, Human
augaggaagagggaagugaaaauggacuuuuuggggagauauuuagagucuucaaacucuauuucau

SEQ ID NO: 3597 - RNA, 62 nt, Human
gugucacuguagaccccaaauaccaucccaagauuaucgggagaaaagggggcaguaauuac

SEQ ID NO: 3598 - RNA, 79 nt, Human; identical to SEQ ID NO: 1810

SEQ ID NO: 3599 - RNA, 60 nt, Human; identical to SEQ ID NO: 1551

SEQ ID NO: 3600 - RNA, 81 nt, Human
ccaacugcauuuuauuuuucggcagauuuuccucacccuaaaacuaagcgugcugcuucugcaaaagauuuuuguagaugg

SEQ ID NO: 3601 - RNA, 93 nt, Human
ggcauggaggacgccuucaacaagggacgggccaauuucucagggaugucggagaggaaugaccuguuucuuucugaaguguuccaccaagcc

SEQ ID NO: 3602 - RNA, 82 nt, Human
guguuaugacagggagaacuggacauggaggcccacaguuuguggcagaucauccuuuucuuuuucuuauuaugcauaagau

SEQ ID NO: 3603 - RNA, 93 nt, Human; identical to SEQ ID NO: 3204

SEQ ID NO: 3604 - RNA, 67 nt, Human
ucuuggcgcgcggcacugggagccgcgggccgagccugucaagccccgcagcagcagcgcgucagga

SEQ ID NO: 3605 - RNA, 96 nt, Human
gagcuguuugaagcuaccagucugagcccuauugacuauuuuuuucaggcucugaauagcucuagggaucucagcaggggugggaggaaacagcuc

SEQ ID NO: 3606 - RNA, 74 nt, Human
gcgggcgcggggauauagggucgaagccccacucguaacgggguggauuuuucuauguagcccuuggguugugc

SEQ ID NO: 3607 - RNA, 70 nt, Human
gucuaauccuuuuuguagucacucauaggccagacuuagggcuaggaugaugauuaauaagagggaugac

SEQ ID NO: 3608 - RNA, 81 nt, Human
ugcggccgauggcgggcugcgggcaagcgucacccugcugggugccgggcugcugcugagccugcugccggcccugcugcg

SEQ ID NO: 3609 - RNA, 61 nt, Human
gcaggaacggagguuccucaugagagugcuggacuccuacggggaugacuaccgggccagc

SEQ ID NO: 3610 - RNA, 66 nt, Human
uucaccauugugcuggaggaugagggcagccagggcacggaugcccccaccccaggcaaugcggag

SEQ ID NO: 3611 - RNA, 83 nt, Human
ccaacgucuguucauggcugugguuuuaaaagagucccucaacagaugcucuauuuaauaaccaguuuguuccucagaugugg

SEQ ID NO: 3612 - RNA, 70 nt, Human
cuccuguguagucucugguuguucacauuccaaaaugauguuuacuguuuuccaagggaguguucaggag

SEQ ID NO: 3613 - RNA, 65 nt, Human
gcuagaggccuuugcuagcugcuacagguagguccacacugucgcaggcugcucugucucuuagc

SEQ ID NO: 3614 - RNA, 131 nt, Human
cuggaucugcaaugauagaauuggccugccacagacauugguauuuaaguugaagagcagaauucacaaugauucugcugcagagagcuuuaauggcaaugagacucuggggcacaguucaauugcuucag

SEQ ID NO: 3615 - RNA, 62 nt, Human
uuuaggggaagucagacuaaucccugggugcacuucgagagaaagguuggaccucgccugag

SEQ ID NO: 3616 - RNA, 60 nt, Human
augcugcagugcccuucauugcacgauccccuuccagggccugggugagcaccgcagcau

SEQ ID NO: 3617 - RNA, 66 nt, Human
uguccaugugagcauguauuucuugagggggccucuaacacugugcccaugugcucauauguaaua

SEQ ID NO: 3618 - RNA, 90 nt, Human
ugucccguucaucaauuucuccucugcagggugagcuguggugcccgcagccaaacuggguuccaguuaggggcaguagaguuggggaca

SEQ ID NO: 3619 - RNA, 65 nt, Human
gugugugcaagugugcagguuccuuuguauguauguguacgugugggaaccuguguuugucauau

SEQ ID NO: 3620 - RNA, 104 nt, Human
uaacaccagauuaguguguuaccccaaaugaacgguucuagcccucuauuaaggaaauaaaggggaccauaaggcauuuugggcugcuuaugggcuguguguua

SEQ ID NO: 3621 - RNA, 85 nt, Human
cagagagaugaggggcagcaucagugcagcuggcaggcagaacccaaauucugcaggcccaggacagugggcuccccuuucucug

SEQ ID NO: 3622 - RNA, 60 nt, Human
gccccagcuguguggccucaagcagccuuccgcuccuugaagcuggucuccacacagugc

SEQ ID NO: 3623 - RNA, 61 nt, Human
aucaucauaauagaccaguuaacccaggaguccuaauguuuuaaaacaucauuguggugau

SEQ ID NO: 3624 - RNA, 96 nt, Human
aacucauuacaaggcccagaagacgaugauucagaaggauucgaacucuuuguccaaauccuucugaaucaucgucuucugggcuuguaaugaguu

SEQ ID NO: 3625 - RNA, 62 nt, Human
ccuuccaaguaaguccaacgaaaggccauggaccacaugggaugauaugggaugauggaagg

SEQ ID NO: 3626 - RNA, 62 nt, Human
ucucaggccaguugcagccuucucagccaaacgccgaccaaggaaaacucacuaccaugaga

SEQ ID NO: 3627 - RNA, 96 nt, Human
uugcagugauuugcuuuugccuccuaggaucaccugugccauaccaguuaaacaggcugauucuggaaguucugaggaaaagcagcuuuacaacaa

SEQ ID NO: 3628 - RNA, 79 nt, Human
ccacuuagucucaacccggaaugaaauaugacugaggacucucagagaaacuuucguucaguauauuaugagaaagugg

SEQ ID NO: 3629 - RNA, 60 nt, Human
aaaauaagaguuauauaguaaauccagaaaaaaauucaaauagcugugaaacuagauuuu

SEQ ID NO: 3630 - RNA, 63 nt, Human
gcugugaaacuagauuuuccuauaaaugaucuugaauuuaguuuacaaucaaguauuuauagu

SEQ ID NO: 3631 - RNA, 64 nt, Human
gugggaaaacugcuugacagaauucacauacuccgagguauaugcaguucugagucugugccac

SEQ ID NO: 3632 - RNA, 89 nt, Human
aaaguuuuuuuggggguaaaaaaggcaaccaccuuaggcaaauuucuugaaaaaaaggggcaaagucuuuaaccccccaguuaaauuuu

SEQ ID NO: 3633 - RNA, 73 nt, Human
aaucccauuuugggguuuuccauccggaauuuuuguuuuuaauaaggguucaguuucuuuuuccccagggauu

SEQ ID NO: 3634 - RNA, 71 nt, Human
uuuuuccuugaaaucauaaagguugggccuuugacauaaaaaucccuucccuucccaaaauucaggaaaaa

SEQ ID NO: 3635 - RNA, 60 nt, Human
aucaucggcucucuggguuuuaccauuuucaucugguguuucucucuugggggcuuugau

SEQ ID NO: 3636 - RNA, 61 nt, Human
ccaguccucucgccguuuuccugcuuguccuugugcuugagaucgguuccgcaggagcugg

SEQ ID NO: 3637 - RNA, 61 nt, Human
ugauggugcuugugccgcuccuuguggcccuuaugcuugggcccggccgcgcucaccguca

SEQ ID NO: 3638 - RNA, 62 nt, Human
ugaguaauguggugcagaguguuucagcagugaagcugacagcaaaggcacagacauucuca

SEQ ID NO: 3639 - RNA, 63 nt, Human
gccuuacuauuucuucucuaagaggauggcuuaucaucccuuacucaaaacaaaaucgaaggc

SEQ ID NO: 3640 - RNA, 71 nt, Human
ggagguaugcagcgacuagauucuguccuguugcacugacccaagcaaucagacucuugcagcagaucucc

SEQ ID NO: 3641 - RNA, 61 nt, Human
uaaaacuuucaugccauagaccaggggugacccaauccaacaacagcagagacagguuuua

SEQ ID NO: 3642 - RNA, 70 nt, Human
gagaugcuguuuauuuaucaagguuuacauguacaaaauaauaauaaaucauaguaaugaauugcaucuu

SEQ ID NO: 3643 - RNA, 60 nt, Human
uggccaaugguuuacuuuuuguuucucuuuagaaugaaaugguguaacccuauaaagcca

SEQ ID NO: 3644 - RNA, 95 nt, Human
uuuuaauuuaaaacaauuuauuucaaagggaacaauuaaggggagacuccucuauuuuuuccguaucugaucuuuguaauaauguuugauuaaga

SEQ ID NO: 3645 - RNA, 76 nt, Human
gccggacaugucuuccagguacaccagcugcguaccgcgcacguuggacaacagcuccugguauucggucagcggc

SEQ ID NO: 3646 - RNA, 63 nt, Human
gucgagcauggcaccgcggaugcgcugcguggcgaaugucucgaacugcacgcccugcucggc

SEQ ID NO: 3647 - RNA, 89 nt, Human; identical to SEQ ID NO: 3422

SEQ ID NO: 3648 - RNA, 70 nt, Human
ugagcuguauaugguauccugaagcaccugcccuucaagacagaaugcuuguaccacauuuaugcagcca

SEQ ID NO: 3649 - RNA, 72 nt, Human
cuacucaaggaaagucaguaaucguuuuagccccuaaucuguuagagccguauggugagcagccuugaguag

SEQ ID NO: 3650 - RNA, 61 nt, Human
cgaguggaauagcucccgccugaucagcaagacuaucaagcaggccaagcgcuccaacucg

SEQ ID NO: 3651 - RNA, 95 nt, Human
gggagugggugagaaaucuuuauggcuuuucggugcgccccgacggugcguuuuauuuucaggugcccaucgaggugucgcucgcccgcaucgcc

SEQ ID NO: 3652 - RNA, 64 nt, Human
agcagaacaguaagcuuccagaggaaaccuacacuucuauccuuugggccuggccuguucuguu

SEQ ID NO: 3653 - RNA, 73 nt, Human
gucggcuuuuauuauuccuaaacaaaagagcuuuauuuucucaugaguagguuuuagaguuuuaauuguugac

SEQ ID NO: 3654 - RNA, 61 nt, Human
ccaaggugagccgggcaccaguggggccaauggaaccauuagaguccuccguuccucuugg

SEQ ID NO: 3655 - RNA, 77 nt, Human
ucgcggagaugucagugccugauggaguggccggggcgggugccuucacgucagcuccagaaucacugucagggcga

SEQ ID NO: 3656 - RNA, 90 nt, Human
uuuuuggggaaaauuguucuguuuguuuuaauuaaaccgacugaagaagccaagacacagauggaaagagacuaagaacaagacuggaaa

SEQ ID NO: 3657 - RNA, 75 nt, Human
cuugauacuucucucguuguugaacagagaaaaaauauaccagccuccucuggaagcagcgagggaaaauuuaag

SEQ ID NO: 3658 - RNA, 93 nt, Human
uaggaucccaucucagucacacagaaucugcuuuguuuucagauuaugaaccacaaagauacacacgaacugucuugauuugaagggagccua

SEQ ID NO: 3659 - RNA, 68 nt, Human
aaaaguauuaauuuccauuuuuaacuaguuuagaugguuuucccuugggcuuaaaauggaaagcuuuu

SEQ ID NO: 3660 - RNA, 108 nt, Human
ccuacucuccauuaugauuacuuuuucucuauuucucuguccaucuacuaggaaaauggguguugcuaggaaaugggaaaaggggauccacaguaaggucgggauagg

SEQ ID NO: 3661 - RNA, 62 nt, Human
uguguguaugugugugugugcgcgugcauguguguguaucuguaucuauaucauacagcaua

SEQ ID NO: 3662 - RNA, 72 nt, Human
aauuuuuauuuugguuuucuuacaaagguugacauuuuccauaacagguguaagaguguugaaaaaaaaauu

SEQ ID NO: 3663 - RNA, 75 nt, Human
cugaucaauccuucuuuuucucuuuugcccacaauuuaagcaaguagaugugcagaagaaaugggaaggauucag

SEQ ID NO: 3664 - RNA, 63 nt, Human
cugcccuccaucuaaaggcgcugcuugauuuugaggauaaagauggagacaaggugguggcag

SEQ ID NO: 3665 - RNA, 63 nt, Human; identical to SEQ ID NO: 123

SEQ ID NO: 3666 - RNA, 65 nt, Human; identical to SEQ ID NO: 404

SEQ ID NO: 3667 - RNA, 61 nt, Human
gaucuguaaguaacuucacauuaaaaaaugaaauauuuuuuaauuuaaagcuuacucuguc

SEQ ID NO: 3668 - RNA, 70 nt, Human
gaggagcaaccucuggagccaucgcgauugauuccucccaucccaagauggcuucuggguuccacuccuu

SEQ ID NO: 3669 - RNA, 87 nt, Human; identical to SEQ ID NO: 76

SEQ ID NO: 3670 - RNA, 63 nt, Human
gucggucugaaagcccccgguaucauuccucgaauuucagugcgggaaccaaugcagacuggc

SEQ ID NO: 3671 - RNA, 71 nt, Human; identical to SEQ ID NO: 77

SEQ ID NO: 3672 - RNA, 61 nt, Human
auguuauuuugggcauuugcaguuuucuucccugcugcauguaaugucucagaaucaacau

SEQ ID NO: 3673 - RNA, 89 nt, Human
uaugaagagagagaugaaauuuagugaacagaauugaaaaggugcucauaauuucacuaugcaaacuuaccccagucucuaaaaaagua

SEQ ID NO: 3674 - RNA, 67 nt, Human
agaaucuugccuuucuccuucaggcucauauaaacuauuggcugacaccguggaggguaaagauucu

SEQ ID NO: 3675 - RNA, 106 nt, Human
gguuuuuuucauaugacgcccuauaaagcugaaguccuggauuaagauguuucgagucaagaaacauagaagaaucuugccuuucuccuucaggcucauauaaacu

SEQ ID NO: 3676 - RNA, 61 nt, Human
ucagagcucugcugaauuccacugucauuacuucugacugaacuuugggcagaugcucuga

SEQ ID NO: 3677 - RNA, 70 nt, Human
gacuuacaaacucuucuuaaucauuaucaaucucgguuuuuuuguggugcaguggaaggaaaaauagguc

SEQ ID NO: 3678 - RNA, 68 nt, Human
gggaccucuuauucucaaauagugacauauucuccguagucacaguuucagaacugaguaaggauccu

SEQ ID NO: 3679 - RNA, 84 nt, Human
ucauuguaaagauugccuuuguucugucuaaaagucuggagaaaucccaaagacuuuuccuauguacuaggcauuuuauuuuga

SEQ ID NO: 3680 - RNA, 61 nt, Human
cucauugagccugacuguucugcuccauaaaauaggguaauaaaggucaaacaucagugag

SEQ ID NO: 3681 - RNA, 74 nt, Human
ggagucaaaaggcccagagucugagucccagcccugagcacuuaggagccuucugacuuaggguuugucacucc

SEQ ID NO: 3682 - RNA, 63 nt, Human
ucccaauggcauuucagaagugagcaguggaauuuuccugccauccuaauaagagcccuggga

SEQ ID NO: 3683 - RNA, 62 nt, Human
aaaagguuuuaguuuauuuuucccaaaugcuuguauugguaacauuuucuguauuaccuuuu

SEQ ID NO: 3684 - RNA, 71 nt, Human
guuuucccaauacuuuagaaaaauuacuaaucauuaauaagucgauuuuauacucaaaguaauggccuaac

SEQ ID NO: 3685 - RNA, 67 nt, Human
gagcaagcggggcccgcgcagcuucaggggccgcaagggccggggcgccaagggcaucggcuuccuc

SEQ ID NO: 3686 - RNA, 73 nt, Human; identical to SEQ ID NO: 2833

SEQ ID NO: 3687 - RNA, 120 nt, Human
gagccccuuggcaauacgggcacgagcacgcuucccaagcuuggggugggcaauguaggcaagucgaucgagcuugcggcugacacccuuugggaucuugggcuuaaccuccuugggcuu

SEQ ID NO: 3688 - RNA, 77 nt, Human
gccucggcacgugcacucauggccuuggaauuguuggccugcaucuucuuuaggcccuuuuuguugugcuucuuggc

SEQ ID NO: 3689 - RNA, 63 nt, Human
caaaauaaccauuugagcgcuuggcacaaaacuauuuuugccaaagccuuuacgguccuuuug

SEQ ID NO: 3690 - RNA, 70 nt, Human
ccuccccuuagaaagcugacugggaauugcaagucgacuggugcuuccccucugagauucuggggguggg

SEQ ID NO: 3691 - RNA, 62 nt, Human
ggcuuacccgggcuccgacagcggcugcaggucuccaaguugcggccgcuggagcccgagcc

SEQ ID NO: 3692 - RNA, 68 nt, Human
uccguguucugcaccaguauuguggcucaagacuccagaggccacauuuaccauggucggaauuugga

SEQ ID NO: 3693 - RNA, 71 nt, Human
aagcuuucaucuccagccuucuccauagcucuguggagggcagagaguugagggaaggaagaauggagcuu

SEQ ID NO: 3694 - RNA, 65 nt, Human
gugucgcccggucagguggugcgcucccggucacuagggguguacacgugaaguugggugaacac

SEQ ID NO: 3695 - RNA, 66 nt, Human
gccccguggcccggggaagggggcugggauugcgccagccccggauaccuggacugcuuagugggc

SEQ ID NO: 3696 - RNA, 92 nt, Human
gugggaccuucuguuuggcaggcuuccucucccuugccuggucaugguuuucuggugagaagaguguuccuggccuugcuggagguucccau

SEQ ID NO: 3697 - RNA, 60 nt, Human
uuuuuuuuuuuaugauagccaaaagcaauuuauuauaguuuagccucaaaaaaauaaaaa

SEQ ID NO: 3698 - RNA, 94 nt, Human
cugcaagacugugcccuuccccuccugaaagaugucaucgcaacagauaaagaggacguugccuucaaagaccuggauguggccauucuugugg

SEQ ID NO: 3699 - RNA, 72 nt, Human
gccagcaaagacugccucuucgccaucguggggaacaaaguggaccucacugaggagggggccuuggcgggc

SEQ ID NO: 3700 - RNA, 121 nt, Human
ggacaugaacguggggaagacgucgcugcugcagcgguauauggagcggcgcuucccggacacggucagcacggugggcggcgccuucuaccugaagcaguggcgcuccuacaacaucucc

SEQ ID NO: 3701 - RNA, 73 nt, Human
agcgagaucguggcuggacuggagaagaugccugcccgccgggcuuccuuaucccaccccagagacaucggcu

SEQ ID NO: 3702 - RNA, 93 nt, Human
uacaccugcaacgugaaggcucgauccugcgagaaggaaguggucucugcccagccugccaccuuccuggcccguagcccucacgugggugug

SEQ ID NO: 3703 - RNA, 62 nt, Human
gaggaauauuuuucgccgauacucuucacagcggaugaaggauuggcaggagauuauagcuc

SEQ ID NO: 3704 - RNA, 76 nt, Human
ggcacugcagccugaaauggcagagucuggugcugacgauccgcgagaagaucaaugcugccauccaggacaugcc

SEQ ID NO: 3705 - RNA, 99 nt, Human; identical to SEQ ID NO: 1699

SEQ ID NO: 3706 - RNA, 62 nt, Human; identical to SEQ ID NO: 3062

SEQ ID NO: 3707 - RNA, 65 nt, Human
gcggugggagcagcagccaaguccgcgggaaaccgagcugcucgggccugcccugcaccccccgc

SEQ ID NO: 3708 - RNA, 65 nt, Human
uuuuuuuuuuugagguuugcaauuuuauuaagaaaacaaaaauucaaccuauacaaaaaggaaaa

SEQ ID NO: 3709 - RNA, 100 nt, Human
cgggucccuggucugggccaugucuggcugugaugcuugggagggagacuguuguucccggagaugcggcgcgcaggacaaggagcauccaagauaccug

SEQ ID NO: 3710 - RNA, 65 nt, Human
gcggccucgcugccgcaucccaggcuaagcgcugcgcgcaaagccgugcggagauuggaggccgc

SEQ ID NO: 3711 - RNA, 65 nt, Human
uugcagaaguaaacuggcaaggauuuuuugugcaugucacauuaaaaucaucaccuacuuuucaa

SEQ ID NO: 3712 - RNA, 64 nt, Human
cugcaggucuagucagagccucgugcaugauaauggauacaacuauuuggauugguaccugcag

SEQ ID NO: 3713 - RNA, 77 nt, Human
ccccccccauaugccgccccggagcuguuucagggcaagaaguacgacgggccggagguggacaucuggagccuggg

SEQ ID NO: 3714 - RNA, 64 nt, Human
gaaccucuugcuggaugccgaggccaacaucaagauugcugacuuuggcuucagcaacgaguuc

SEQ ID NO: 3715 - RNA, 64 nt, Human
augggcgcauggggaugauuaacucuuucauguucgagggagccaauaauagucuuuaucucau

SEQ ID NO: 3716 - RNA, 60 nt, Human
ucgggggcaguuuugggggugucuagcaaagaccuggaaggccuucccgguuaacccuga

SEQ ID NO: 3717 - RNA, 83 nt, Human
uccucaaguuccuccagcuuuuuaugucugauaugccaaagccugccuucaugaagcagaaccuggaugagcuuggaauagga

SEQ ID NO: 3718 - RNA, 80 nt, Human
cugaaguuuugcugccuguuaauuaccauuuggaugcuuuaaaacccuacaggugauuccaaugugcagccaagguugag

SEQ ID NO: 3719 - RNA, 67 nt, Human
gcuuguucuguucuaccagugucuugacaguuaaucaugaucuuugcacaguagaugcagaacuagu

SEQ ID NO: 3720 - RNA, 79 nt, Human
cucaagguucccugggcauccugcccacccaagcugacugcuaaggucaucgauacggagcaggagcccaggccuagag

SEQ ID NO: 3721 - RNA, 89 nt, Human
gugagggccugccugggcccgugucauagucccugccccaggccgacggccugcaggucucgggggugacgcucgcuaggcgcuuucac

SEQ ID NO: 3722 - RNA, 68 nt, Human
ggacacuauuccucccugcagcccuugcccacccccuugggccaugaggaauucaggcagcugugucc

SEQ ID NO: 3723 - RNA, 66 nt, Human
caacaugaagguccucuuacuuauuccgccuucacuaggcaaggacgagggcaccuacacguguug

SEQ ID NO: 3724 - RNA, 93 nt, Human
ugccuaguggaccagagccuucgucuggacugccgccaugagaauaccagcaguucacccauccaguacgaguucagccugacccgugagaca

SEQ ID NO: 3725 - RNA, 81 nt, Human
acgaguugagauugggcaguugguuuuuaggauuucuucauacggcucuaagaaaacggacucuccccacagucuuucugu

SEQ ID NO: 3726 - RNA, 78 nt, Human; identical to SEQ ID NO: 99

SEQ ID NO: 3727 - RNA, 80 nt, Human; identical to SEQ ID NO: 100

SEQ ID NO: 3728 - RNA, 84 nt, Human
acacacuuucuaugcauacaaauuuugugaauucccaaaguaugcuuuggaauuggucauagucuuuucguaucaugagugugu

SEQ ID NO: 3729 - RNA, 131 nt, Human
cuguccuccucagugcuuuuuaaugaaauuucaccugccccuuguguuccugcuuuggauaguuuuugcuccuaagcauuggcauucuucuauuguaugguauguauuuauagcaauuguaggauggucug

SEQ ID NO: 3730 - RNA, 60 nt, Human
gaaauccucucggaguccgcuuucauauugagucacgcgagacucccacucgaggaucuc

SEQ ID NO: 3731 - RNA, 65 nt, Human
gaguaaaggagugucucaagguacuugaucacgugguucuugaaguccuuggauuucucuuucuc

SEQ ID NO: 3732 - RNA, 81 nt, Human
ugcgaagggccaggugucgggcgcuguuucucguuuucaucauauagacaaaacagcccugcugcaaagauggucaacgua

SEQ ID NO: 3733 - RNA, 65 nt, Human
caucucacuaagugcugaucaguuuugauucaguuggaguagagcacauagguucuuuggagaug

SEQ ID NO: 3734 - RNA, 81 nt, Human
ucaugucacuuguaauauuuuaggucaucuaauccaaucaacaaagguauauugacucuguauuugaagcauuugucauga

SEQ ID NO: 3735 - RNA, 65 nt, Human
gcggcucaucccagauggcuguugggucaaguacauccccagucguggcccucuggacaaguggc

SEQ ID NO: 3736 - RNA, 114 nt, Human
gcaguguugggagugcuguuggaaagcugagccugagagacagauugaggaaggagauuuacucgguguuuguuucugugucacagcuuuccguccauuuaacucuugaucugu

SEQ ID NO: 3737 - RNA, 72 nt, Human
augaacuaugugguuugaaucggauguagaccauuaguacuacuacuugagcuaaacuucugcaugguucau

SEQ ID NO: 3738 - RNA, 79 nt, Human
uucugcugauuuuaaauauacaauacaucauacauacuuuacaagcaaguuaaauggagauaaaguugaaaucauagaa

SEQ ID NO: 3739 - RNA, 68 nt, Human
cgaaaggggacagaacguaaagguguaccaauaccauccuuaacaccagaaaguuauccaacaguucg

SEQ ID NO: 3740 - RNA, 78 nt, Human
caucuuugacuuuggcuccauguuucaggaugcgugugaacucgauguaauugaaauuccccuuuuugucaauaggug

SEQ ID NO: 3741 - RNA, 68 nt, Human
gcucuuuccuucuguauauaccauggucuuacuuuccaacucuguacagauuuauuuauuggaggagc

SEQ ID NO: 3742 - RNA, 68 nt, Human
gcuggaacuuuuggaccugggucauaggcugaaccuguuauggacccccaaauucugagaguuccugc

SEQ ID NO: 3743 - RNA, 96 nt, Human
gggcuuuaccggguucucggaguacgggggguuacgcacuacuauucaauagguuaagcuuguccaccuggcaugucuccguuuuuuccauugcuc

SEQ ID NO: 3744 - RNA, 75 nt, Human
uacugauacaaguuugauacaugcaauuguugggaggaaagauuccucagaaggcacaaagagcuguauugugua

SEQ ID NO: 3745 - RNA, 71 nt, Human
ggggggggcgcgcgcgcaaaagagaagacucccccgcggggggcgcccacaaugucgcgcgcgcgaccccc

SEQ ID NO: 3746 - RNA, 66 nt, Human
acuggugcagagaaccauugcaagacuucgccuaaagaaaauuuuuaguggugucuuuguaaaagu

SEQ ID NO: 3747 - RNA, 68 nt, Human
gcaccuggggaaguuuggcgucauuugcuuggaagaccucauucaugaaauugccuucccagggaagc

SEQ ID NO: 3748 - RNA, 74 nt, Human
gggggugcugugaugcgugaggcagccgggggaggcccggaguccgagacugcuugagcgcugcgcacaccccu

SEQ ID NO: 3749 - RNA, 60 nt, Human
aaugagaccauccauuacauguacaaacacaaaauguaccgaaagaugguguucuacauu

SEQ ID NO: 3750 - RNA, 82 nt, Human
gucguggguguuuggugugaggcugcgagccgccgcgaguucucacggucccgccggcgccaccaccgcggucacucaccgc

SEQ ID NO: 3751 - RNA, 65 nt, Human
gcuuuggcuccgaggggucccgagcgcggaugcgugaggauuaugacagcguggagcaggauggc

SEQ ID NO: 3752 - RNA, 90 nt, Human
ucgcugacagguccucugauuguccaaguguacucuucaagauuccaguuuggacagugcagccuuggaacaaauuaggacuggggguga

SEQ ID NO: 3753 - RNA, 63 nt, Human
ucucuuagcgguaucaugggugguaacauugacguggccaacuaaacauguaccauugaggga

SEQ ID NO: 3754 - RNA, 99 nt, Human
gccccuagcgccguucgcgccgcuaggccuggcuucugaggcgguugcggugcucggucgccgccuaggcggggcagggugcgagcaggggcuucgggc

SEQ ID NO: 3755 - RNA, 64 nt, Human
uaguugugguuuguccaaacaucaucaauuguaucuuaucaugucuggaucgauccugcgauua

SEQ ID NO: 3756 - RNA, 91 nt, Human
ugaaacauaaaugaaugcaauuguuuguuguuaacuuguauauugcagcauuauaaugguuacaaauaaagcaauagcaucacaaauuuca

SEQ ID NO: 3757 - RNA, 78 nt, Human
gguuaaguuucccuggggggccacccaaaucgggggaacccccggcaaaauaaagggcccccuugggggggaaaaacc

SEQ ID NO: 3758 - RNA, 106 nt, Human
uuuuuuuuuuuuuuuuuuuuuuuuuuuuuuuuuuuuuuuuuuuuuuuucccuuugggggaauuaauuaaaacaggcaauuuaaaaaaccccaaaaaaaaaaaaaaa

SEQ ID NO: 3759 - RNA, 70 nt, Human
gaguuggcguuuccuguucuggggugcuacugccaaacguuaugguacuuagagucgggaugcacaacuu

SEQ ID NO: 3760 - RNA, 74 nt, Human
gcugauuuccucaguuccauuuugaggaauggggaaggcuauucuaaagaaaaaaaugggauuguuuucucggc

SEQ ID NO: 3761 - RNA, 68 nt, Human
uuaguguuuuuggauuuuuagaauucacuacauaaauuguaaguaauugugggucucaaaaacacuag

SEQ ID NO: 3762 - RNA, 68 nt, Human
cagagcucaaaugauacuuuucccacagcaaugcacauugcugcugcauagaaguucaugaaguacug

SEQ ID NO: 3763 - RNA, 67 nt, Human
gcucgcguccccucgugcgggcuccagccgcagccuuagcuucggcucccggcuuggguggcgcggc

SEQ ID NO: 3764 - RNA, 75 nt, Human
ggaugggacguacucauacucaggaugcuguuccccuuacucuugggcaggaauuuaggugguuauguuccaccc

SEQ ID NO: 3765 - RNA, 72 nt, Human
gggggggucagugggcauguacacccugacgucaucgugggccuguuccuccaugccggcauuguccuuccc

SEQ ID NO: 3766 - RNA, 86 nt, Human
gugcacgccaauguguucggcaucaaggacugggugacgccguacaagaucgcggugcuggugcugcugaacgagaugagccgcac

SEQ ID NO: 3767 - RNA, 107 nt, Human
uuuuuugagauggagucucacucugucgcccaggcuggaaugcagugagcagagaucgcaccacugcacuccagccugggcaagagugagacugugucgucaaaagg

SEQ ID NO: 3768 - RNA, 77 nt, Human
gagcgcccugggucuuguuuugguguuucgcuuuucuguaaggauuaagcagauagggagaagggaaaaggggccuc

SEQ ID NO: 3769 - RNA, 69 nt, Human; identical to SEQ ID NO: 2463

SEQ ID NO: 3770 - RNA, 76 nt, Human
gccgcgcuguugccgcggcuuguuauucuuaaaauggcgccgcuagaccuggacaaguauguggaaauagcgcggc

SEQ ID NO: 3771 - RNA, 99 nt, Human
gagcagcaggucccgcuggugcuguggucgagugaccgggacuugugggcuccugcggccgacacucaugaaggccacaucaccagcgacuugcagcuc

SEQ ID NO: 3772 - RNA, 76 nt, Human
gcgcgcucgcguccccucgugcgggcuccagccgcagccuuagcuucggcucccggcuuggguggcgcggccgugc

SEQ ID NO: 3773 - RNA, 61 nt, Human
gcucaaaugauacuuuucccacagcaaugcacauugcugcugcaauagaaguucaugaagu

SEQ ID NO: 3774 - RNA, 126 nt, Human
cuggucaugggcugagaucaggcccucaaucuccucgaugguauggacgaugaacauguccuggagguccuccauggcgcucuccauccaguuguugaagggggccgcgcgcuuggcguauuccag

SEQ ID NO: 3775 - RNA, 75 nt, Human
ggcaccagcugcugcaccuucucccacuuggcaguugaugauuugcggggugacggugguguagggguugcugcc

SEQ ID NO: 3776 - RNA, 68 nt, Human
ugcuuuacugcugugguccauguagugacaacuaaguuacuuugaaaggcucuacaaaguuccaagca

SEQ ID NO: 3777 - RNA, 67 nt, Human
ggugcugcuuccagagacuuccuugggguugcaaccuggggaagccacaucccacuggauccacacc

SEQ ID NO: 3778 - RNA, 96 nt, Human
agcaaagggggaagaauugaaagagagagagaagaaagaauacagagagcuuaccuuuugccuuucuguugauguuacaucucuucuuccuauguu

SEQ ID NO: 3779 - RNA, 61 nt, Human
augugcuucuaugagauuuacuccaacacaaauaggacugaauuuauuguggaaguaacau

SEQ ID NO: 3780 - RNA, 60 nt, Human
ccaugaagcuggugaccauguuugacaagcucuccaggaacagagucauccagccaaugg

SEQ ID NO: 3781 - RNA, 67 nt, Human; identical to SEQ ID NO: 3777

SEQ ID NO: 3782 - RNA, 62 nt, Human
gguggggcacacagcggggggcgccagguuuuccuugucccccagcugcucugccccuuucc

SEQ ID NO: 3783 - RNA, 64 nt, Human
gaaauuccaucgaucugucaugggccccaaagguuccagaauccagcagauuacucgggauuuc

SEQ ID NO: 3784 - RNA, 127 nt, Human
gccaaaggcugcgagguuguggugucugggaaacuccgaggacagagggcuaaauccaugaaguuuguggauggccugaugauccacagcggagacccuguuaacuacuacguugacacugcugugc

SEQ ID NO: 3785 - RNA, 67 nt, Human; identical to SEQ ID NO: 1146

SEQ ID NO: 3786 - RNA, 83 nt, Human
cagcucagcaguagaaagguucuuggacagggugccaggacacacgcuggggcugcugucacaggacaaucuuaaaggagcug

SEQ ID NO: 3787 - RNA, 64 nt, Human
gcauuauauucuacaaguaucacaguaacauaccuugacuuuugauacugguuucucauaaugc

SEQ ID NO: 3788 - RNA, 62 nt, Human
ccucaucaccgucgccaugcccggaggucugcuucucggggacguggcucccaacuuugagg

SEQ ID NO: 3789 - RNA, 131 nt, Human
gagcuucagcuugcucaggaucugcccgcggaucgccucgauccucuugcgcaugaacugguccauaucgagugugcugcagguagacaggcugagcgcgaccgugaccagaugcaggaucagaaaagcgc

SEQ ID NO: 3790 - RNA, 83 nt, Human
gagugugcugcagguagacaggcugagcgcgaccgugaccagaugcaggaucagaaaagcgcucagcacacaguagugcauuu

SEQ ID NO: 3791 - RNA, 102 nt, Human
guuuuuaaaagucagaauaaaaaaaaagaaaucaacaauucucaaaguauagaucaaggagaguuguuugguuuuuuguuguuguuguuuuugaugcgaaac

SEQ ID NO: 3792 - RNA, 70 nt, Human
cauuggacgcaacaaagacgccaagauguaguuguauacaacaauguugguucuuucgucugcuacagug

SEQ ID NO: 3793 - RNA, 68 nt, Human
cgcagccggaugggugccggccaagucuuaaacaccaaggagggccuggcacugcguuuaccggugug

SEQ ID NO: 3794 - RNA, 130 nt, Human
aaaacaugucugauauuuuaauuauuuauuuucaauuaaaggucauaguuaaaauaaauucuacagauuuuuuaaaugugugauuuguucuuuaaaaauuaguaauuaguuguuagauagcuaucauuuu

SEQ ID NO: 3795 - RNA, 62 nt, Human
cuucaugggggaaauguaacagugacacuauuccacaacaaaauuacuuagauuucaugagg

SEQ ID NO: 3796 - RNA, 75 nt, Human
acauauuuuccuuccacaauauggauuugugucauuuaaacugaagaaguugaucuugugugaugacagguaugu

SEQ ID NO: 3797 - RNA, 79 nt, Human
gaaggcgucuuucagagucaucuauccucuuggcaugccaaugcaagaggaaagcauuccucaaaccaaagaaaucuuc

SEQ ID NO: 3798 - RNA, 64 nt, Human
ucauuccuccuccugcccacaccuaccucccuuuaaauauuuuagguugcagaagcacagcuga

SEQ ID NO: 3799 - RNA, 78 nt, Human
uguacugacuacuuucuucacacaucaguugcccuuuaugaucucaguucauaaacucuuugugguauguagcaauca

SEQ ID NO: 3800 - RNA, 72 nt, Human
cugcaucaaagguagacuuucgcacagguugugagguuggagucacaguguuauuuguuguaccugauguag

SEQ ID NO: 3801 - RNA, 74 nt, Human
gaugcucccaaacauccuauaugcauccauggaaauuuaaagauccuggaauagcgucuuccaugugggacauc

SEQ ID NO: 3802 - RNA, 86 nt, Human
ggucuguuuacagagugugguaauuucguucuuuagauuugcagaauuuauaaagaaagaaaauuacagccugcacacccaagacc

SEQ ID NO: 3803 - RNA, 61 nt, Human; identical to SEQ ID NO: 347

SEQ ID NO: 3804 - RNA, 74 nt, Human
gcugcggcgggagcucgacgaaucccuccaggucgcugagagguugaccaggaaauacaacgagcugcuaaagu

SEQ ID NO: 3805 - RNA, 104 nt, Human
cagggccugcggucuggccccaugagucuccuuccguccucagcgggcagggaacaccucuggcuuguagaagggacggcucaguggcugcaccgacgguccug

SEQ ID NO: 3806 - RNA, 102 nt, Human; identical to SEQ ID NO: 2701

SEQ ID NO: 3807 - RNA, 90 nt, Human; identical to SEQ ID NO: 2702

SEQ ID NO: 3808 - RNA, 68 nt, Human
uauacauauauacauauuauguaugguuguaaauucauacacuuaucacaugaauguguuacuguaua

SEQ ID NO: 3809 - RNA, 67 nt, Human
ucauauuuagaaaauguaaaugucuguagcacuuucuugcaguuaauuugaaaacuuuggaugcuga

SEQ ID NO: 3810 - RNA, 88 nt, Human
cucuccgaaugucuuuuuuuaagugaauaucaaugcuucuuuugucaucuccguaucugaucauuucaugagcaaagucaucgguggg

SEQ ID NO: 3811 - RNA, 104 nt, Human
ugaacuuuuuuccuaguacccauucuagcuguaacacgaagggcuccgacuggugaucccaaagcccccucuaguucgaaaacugacuaguacggaagagucca

SEQ ID NO: 3812 - RNA, 63 nt, Human
uuugauaguaagugagcguuuauuuuauucaccauaaaauauuugcaucucuuacuccucaga

SEQ ID NO: 3813 - RNA, 68 nt, Human
gcaauguaauuugaaaucaguugaauuuccuguuuuucucucauagguucaacuacucaauuucaugc

SEQ ID NO: 3814 - RNA, 69 nt, Human
guaaauaacaacuggucauuaccuuauugaguuuagaaaacuuucaaguucgugacauauguuaauugc

SEQ ID NO: 3815 - RNA, 69 nt, Human
guucugaauaacuuuauugcaagucacauaaucuugguuuagacuugacgcaacgggagguuacagagc

SEQ ID NO: 3816 - RNA, 66 nt, Human; identical to SEQ ID NO: 1526

SEQ ID NO: 3817 - RNA, 64 nt, Human; identical to SEQ ID NO: 1527

SEQ ID NO: 3818 - RNA, 64 nt, Human
ugauucuggcacaggaaauggucuccaaaaucucaaaauaucagaucucuaccuugucaaguca

SEQ ID NO: 3819 - RNA, 70 nt, Human
agacauuauacaguggcacguugcuuauaguuaaguuguugagucagcuuuuccauugcauacaauguuu

SEQ ID NO: 3820 - RNA, 80 nt, Human
gagcugcuagccaacaaagguagcuaacucugagcgugagucaugcuaacaucguggaaagccuggauaggcugcgucuc

SEQ ID NO: 3821 - RNA, 82 nt, Human
guugccugacggggauuagacuggagucacuauagcgauaaauggccugucauacuuuccuuugauuucccaggguuucaac

SEQ ID NO: 3822 - RNA, 67 nt, Human
guauuuuauuaguauuuuuccggugaacagaagauuuguuggauuuaaacauuuacuaagacaguac

SEQ ID NO: 3823 - RNA, 76 nt, Human
uauuugcaaaauaaacaauuauaaaaaaagaacauaagagagaaugguacuuaauuacuugugugguuugcaaaua

SEQ ID NO: 3824 - RNA, 69 nt, Human
gccccgcggggagcccgcgggcucgucaccacacacaacgugcgcucgagcacacgggcuacacggggc

SEQ ID NO: 3825 - RNA, 63 nt, Human
gcgcccuuggcggccccugcgccugcagcccuuguugcucccugcgggccccgccgaggccgc

SEQ ID NO: 3826 - RNA, 85 nt, Human
guagaucuugaagugauaaggaagggucaucauaaucauguggggcccauuuugcccuuucuuguuucuuuucucuagggucagc

SEQ ID NO: 3827 - RNA, 62 nt, Human
gccauccacaccugccaguucccugcauccuuucagccccuggccaggugucaccuccuggc

SEQ ID NO: 3828 - RNA, 67 nt, Human
ggagucugugucgggggagggcugccgucgagcccgccgucgccucgccccugaacuguuagacucc

SEQ ID NO: 3829 - RNA, 67 nt, Human
agagaguacacaccaaucauccauaccgcacaacgaugugccuaauuguaucuugggucguacuccu

SEQ ID NO: 3830 - RNA, 72 nt, Human
uaucggacuagcacuauaagaucagcguaucggccacggacauacgcugcauuaucuagugauagacuagua

SEQ ID NO: 3831 - RNA, 61 nt, Human
caaggaacuucaggcacauggugcugaugaguuauuaaagaggguguacgggaguuucuug

SEQ ID NO: 3832 - RNA, 76 nt, Human; identical to SEQ ID NO: 2761

SEQ ID NO: 3833 - RNA, 65 nt, Human
gugaugggcuagcacuuauaucgggugauucgauuuacaccgcguauaacuuuccagcccagaac

SEQ ID NO: 3834 - RNA, 66 nt, Human
guaaugaucucagagacugcgguuuauugaauauaccuuaguaggcguugaucaugagucaggagc

SEQ ID NO: 3835 - RNA, 65 nt, Human
uguacuaacuggucaucaagugguccaugcuuuuaagauggcugacauggaucuauuugaguaca

SEQ ID NO: 3836 - RNA, 80 nt, Human
cuucuucagugaaacgggugcuggcaagcaugugccccgggcaguguuuguagacuuggaacccacagucauugaugaag

SEQ ID NO: 3837 - RNA, 81 nt, Human
ccccagcuggauagagggaacuggccuuuccuagggacaccuaggcuuacccuccugccucccuucccugcugugcugggg

SEQ ID NO: 3838 - RNA, 95 nt, Human
gugcugagguacaagcccccgccgagcgaauguaacccggccuuggacgacccgacgccggacuacaugaaccugcugggcaugaucuucagcau

SEQ ID NO: 3839 - RNA, 77 nt, Human
cgcucacauuccaggcccuuguccugcaggcugccgcgggcggacacgccagaggaggaggccggggaauggccgcg

SEQ ID NO: 3840 - RNA, 113 nt, Human
guuuccacaguuucggacgcaguauauccgccggcgcagccagcugcugcgggagaaugccaaugcugggcaccccccagcgcugcgucggcaguaccugaggcuucgggggc

SEQ ID NO: 3841 - RNA, 108 nt, Human
gggugauugccggccggccagggcugaagggcuuugccagggacuuaaaccaguugaagcaccuuggggccuuguaacccugggaguaccguuuaauggcgggcaucc

SEQ ID NO: 3842 - RNA, 74 nt, Human
guaacagguggggcuggcuacauuggcagccacacggugcuggagcugcuggaggcuggcuacuugccuguggu

SEQ ID NO: 3843 - RNA, 78 nt, Human
ggggaaucugcaguaggucugccggcgauggaguggugggcuagcucgccgcuucggcucuggcugcuguuguuccuc

SEQ ID NO: 3844 - RNA, 72 nt, Human
uuuugggaagggggaccugcuguuuggccaauuuauccuacaggucuuggacggugggaccucuucagagaa

SEQ ID NO: 3845 - RNA, 92 nt, Human
agcuauaccggaaaagcggcaugucaaaaauacuuuagguucuacauagaucucuuucucucuuuuguuuuguuuguuuguuuguuaaaguu

SEQ ID NO: 3846 - RNA, 62 nt, Human
gcuuuuaaaaguuguuuugaaaagacaaucauuuuuuguuuuuuuuuuaacuuucuuguggc

SEQ ID NO: 3847 - RNA, 61 nt, Human
cagaaagcuggcaaagaaaaagaugguacaaaaagaaaaucuuuaucugacagugaaucug

SEQ ID NO: 3848 - RNA, 60 nt, Human
cugacaaaccaagaaggauugccagaggucuugauccugaaagaauaauuggugccacag

SEQ ID NO: 3849 - RNA, 62 nt, Human
gaugcugacaauacuugggaaccugaagaaaauuuagauuguccagaauugauugaagcguu

SEQ ID NO: 3850 - RNA, 79 nt, Human
cggggggagccgagacugagcuuuccugucuuuccuuuuuucugagagauucaaagccuccacgacucuguuucccccg

SEQ ID NO: 3851 - RNA, 77 nt, Human
uuugcacuaagucauuugcacucguuggaguuguggagacggccuugagucucaguacgagugugcgugagugugag

SEQ ID NO: 3852 - RNA, 62 nt, Human
gccuucugguaacugaauauuaccuucuguaggaaaagguggaaaauaagcaucuagaaggu

SEQ ID NO: 3853 - RNA, 98 nt, Human
ucuucaaacauuuaaaucaagcuuuggacuaauuaugcuaauuugugaguucugaucacuuuugagcucugaagcuuugaaucauucagugguggaga

SEQ ID NO: 3854 - RNA, 72 nt, Human
caccaugguggguccaggaugggucuccaucucuuggacuugugauccacucggcugggccucccaaaggug

SEQ ID NO: 3855 - RNA, 70 nt, Human
ugugauuuuucagaauucccagaguuuacucauucuuguuauuaaacucuagccaguugacaucuucgca

SEQ ID NO: 3856 - RNA, 67 nt, Human
cccagaagaacucaagucagaaucagccaaagagaaguggaggccauucugcuugaaguuuaauggg

SEQ ID NO: 3857 - RNA, 70 nt, Human
cggauguuuuaagaaaauggcagacaaaccagacaugggggaaaucgccagcuucgauaaggccaagcug

SEQ ID NO: 3858 - RNA, 69 nt, Human
ggccauucugggcgugccugucccugagggccuagauaaaggggacaggccgcacgccuauuuuggacc

SEQ ID NO: 3859 - RNA, 78 nt, Human; identical to SEQ ID NO: 99

SEQ ID NO: 3860 - RNA, 80 nt, Human; identical to SEQ ID NO: 100

SEQ ID NO: 3861 - RNA, 85 nt, Human
cacauagaauaccccuuccuaucagcucgcucugauuuagccuuaauuuguuaaauuuuuuagagaugaaugaagugcugcugug

SEQ ID NO: 3862 - RNA, 100 nt, Human
gagagaaaaccuggccccaggacugaguggccguggcuuuucuccacaaauaaaaaaaaggccgcgggcgcgcaaaccggaggggucuggaaacaauuuc

SEQ ID NO: 3863 - RNA, 67 nt, Human
gcagcaggagaguguuaggagaugaaaucugagacauaggcaagaaucaguccacauaggccuuugu

SEQ ID NO: 3864 - RNA, 83 nt, Human
uauccugggcuacuguauggagaauauguuguagagacaggcaaaagucuagguaggacauaaugguagcuuagacuaggaua

SEQ ID NO: 3865 - RNA, 70 nt, Human
auagaaaaaagagaagaugagaaucaggaagagcucuuuacuuucacaaucccuuuacuuuaauuucugu

SEQ ID NO: 3866 - RNA, 64 nt, Human
ggguguuaacuaaugcacucaauagugaucacaaagaauacaggaagugccaaguucaaugccu

SEQ ID NO: 3867 - RNA, 74 nt, Human
gaagacaaauugaagggagagaugauggaucuccaacauggcagccuuuuccuuagaacaccaaagauugucuc

SEQ ID NO: 3868 - RNA, 63 nt, Human
aggaauuauaaacuaacuuuaauuacuucaacaggaagaauuucaaacuauguuguaauucuu

SEQ ID NO: 3869 - RNA, 84 nt, Human
aucuaauuaauauauucugacuaacauaaucauccaaagauaaaaguauuugugauggcaaauggacagaacaaucauuuaggu

SEQ ID NO: 3870 - RNA, 84 nt, Human
gggaugagcucagcuaggcaaacaaguccagagagagcagcacuggggcuauacaucugggccuaaugccgcccugcuccuccc

SEQ ID NO: 3871 - RNA, 64 nt, Human
uuguaauccaugaaaaagaccaagguccugguccuugggcacauucuggucuccuggguuguga

SEQ ID NO: 3872 - RNA, 73 nt, Human
ggggccaacggcagcacgcucugggagagaccuguggcccaagacguggcccucguggagugugcugugcccc

SEQ ID NO: 3873 - RNA, 74 nt, Human
gagggguccauacggcgucguucuggauucccgucguaacuuaaagggaaacuuucacaauguccggagcccuu

SEQ ID NO: 3874 - RNA, 67 nt, Human
gggccuuucauguagaggaaccacaccaggaguucuaggcugugaccugcaggcaagugaguggccc

SEQ ID NO: 3875 - RNA, 65 nt, Human
aacaucuuucugauaacauuauuauguugccuucuuguuucucacuuugauauuuaaaagauguu

SEQ ID NO: 3876 - RNA, 66 nt, Human
cuguuugaaugugcugguaacugcuuugcuucuugaguagagccaccaccaccauagcccagccag

SEQ ID NO: 3877 - RNA, 100 nt, Human
ggaaucuuggcguucagcagagucagggauggguccauuauaugauccaugaaccagaaccucacaucuugcuguuccggcgcccacuacccaagaaacc

SEQ ID NO: 3878 - RNA, 81 nt, Human
uaagcugagugugaccccagaagccacgaugugcucuguauccagaacacacuuggcagauggaggaagcaucugaguuug

SEQ ID NO: 3879 - RNA, 68 nt, Human
cgcugcgucccagcgacucugcggggguuucgucgaggcccggcaggcuugggucgggagacgcggcg

SEQ ID NO: 3880 - RNA, 67 nt, Human
gcuuucauuugaagaacauuuucaauuuucaauucuuuucucuuuugggggugugauuauauguugu

SEQ ID NO: 3881 - RNA, 69 nt, Human
uguaaucauuuggcuucaauucugggugccuucagggggcuaaggcucuagaugaguuucuugguuaua

SEQ ID NO: 3882 - RNA, 80 nt, Human
gccccuugaccccagcuagggccucagggacuuucgggccuuuuccaaaauuuccucccugaucuugggguagucggggu

SEQ ID NO: 3883 - RNA, 65 nt, Human
accuauaaagugaaauagaacuuauuuaaacugacuaguaauucuguaacuuuuauuuuacaggu

SEQ ID NO: 3884 - RNA, 62 nt, Human
acugcaacacaauuuaaaugucuguaaauuaggucacaaaagggaugcaaaauguuugcagu

SEQ ID NO: 3885 - RNA, 66 nt, Human; identical to SEQ ID NO: 1526

SEQ ID NO: 3886 - RNA, 64 nt, Human; identical to SEQ ID NO: 1527

SEQ ID NO: 3887 - RNA, 62 nt, Human
cuguacacugacggccuacaagcugacccccaguggcuacgaauggggccgccagaacacag

SEQ ID NO: 3888 - RNA, 71 nt, Human
uucauggucccugcccaguccucguggaacuacaacuuucaaugggugaucgggcaugaccccaacaugaa

SEQ ID NO: 3889 - RNA, 64 nt, Human
guccuaccgacuccugccuggcagcuggaggagcccagguuccagcacaaaggagucuguggac

SEQ ID NO: 3890 - RNA, 64 nt, Human
ucuguccuuucccagcucgcaggccuuggaaccccgcccagggccccgcugagggaggcacagg

SEQ ID NO: 3891 - RNA, 73 nt, Human
gucauuuauuuauacaauaggcuuggucaaaaaguguuuuucagaccucgguauuccuaaugugggaugugac

SEQ ID NO: 3892 - RNA, 94 nt, Human
guguacuuuucaauccuguguaauguuuaauucuugcaacugaaucaaaacaguguuaaauuauggcaauauugcacuuggggaaugaguacau

SEQ ID NO: 3893 - RNA, 61 nt, Human
uaaauuuuuacauucaucauggcuacagguagaacuggggaggggggaauguaauuuuuua

SEQ ID NO: 3894 - RNA, 86 nt, Human
uuuuauuuuuaguagcaaauuuggauguagacugacagacauagcugaaugucuuaauaaauuuaaauuugaagauaaaaaaaaaa

SEQ ID NO: 3895 - RNA, 71 nt, Human
gcagcacaaaggcggcgcggugcacaucggaguuguaguacuucagcugcaucugcgccaccugcugcugu

SEQ ID NO: 3896 - RNA, 81 nt, Human
ggcuuuuauguuuuuguugcauuuauguuuuugcagucaaugugaauucuuacgaauguacaacacaaacuguaugaagcc

SEQ ID NO: 3897 - RNA, 61 nt, Human
uugcuuuuguuacagcuauuguccaaggagauacuuuagaagauauauauaaccaaugcaa

SEQ ID NO: 3898 - RNA, 98 nt, Human
cucucaguguccacccugucccuguaucucccauggaagaugaauaaugucagguguucuuugggucaaaggccccagggcagucuggaggcuuagag

SEQ ID NO: 3899 - RNA, 79 nt, Human
guuaggcuucugaggggucaggcagaauaugguguccauaucuuccauagcucugcagauucuugggaugaagucaagc

SEQ ID NO: 3900 - RNA, 61 nt, Human
acuacuccugaggaugcuacucccgagcccggagaggacccacgcgugacccgggccaagu

SEQ ID NO: 3901 - RNA, 90 nt, Human
gaugaguuucugaggaucagcacugccaguggagaugggcgucacuacugcuacccucauuucaccugcgcuguggacacugagaacauc

SEQ ID NO: 3902 - RNA, 80 nt, Human; identical to SEQ ID NO: 788

SEQ ID NO: 3903 - RNA, 79 nt, Human
ggagaucauugaccuuguguuggaccgaauucgcaagcuggcugaccagugcaccggucuucagggcuucuugguuuuc

SEQ ID NO: 3904 - RNA, 66 nt, Human
ggcagcgaguccucagggcgcccgggagccaccagucugcucucgggcucuacucagacuagcgcc

SEQ ID NO: 3905 - RNA, 124 nt, Human
gugggcucggccaucagcaggcccgguggguuggccgggcuggcccucccaggcugccuuucucucuggucgcggcuggcccgccccggcuccaccgcgcaauucaugcuggugccgcgcccgc

SEQ ID NO: 3906 - RNA, 61 nt, Human
ugugauuccaggaggagagccaggccugcccugcccugcuggcuuccugacuggagagaca

SEQ ID NO: 3907 - RNA, 61 nt, Human
acaaucacuuggacuuuaucugggcaauggaugccccucaagaaguuuacaaugacauugu

SEQ ID NO: 3908 - RNA, 64 nt, Human
uguuugacaugcagugcuucuuucuguaauuuugacuuuagaaauauauuggcaucaacaaaca

SEQ ID NO: 3909 - RNA, 77 nt, Human
gaaaaaaugugaagacugaaaggugugauuuuucaauucuccucccaguuaccgaaucacccucuuauuuuuuuuuc

SEQ ID NO: 3910 - RNA, 81 nt, Human
gaugagaauuuccucuuuuaaauaauguuauuugaacaccacauauuuuagauuaucuuauuugaaaguaucaguuccauu

SEQ ID NO: 3911 - RNA, 95 nt, Human
ccccuccauggcgacggcggccggggccgcuaggacugaagcaccucgccggaggacgaggcugguggcgacgggcugucggcugucgugagggg

SEQ ID NO: 3912 - RNA, 76 nt, Human
ccgucucucugcuugguuaggguuagugucccgccgggcacaucacccuaugaauggagccacugagauagacugg

SEQ ID NO: 3913 - RNA, 76 nt, Human
gccgcgugacgcaccaugauucucgcgaccugcaggagaagccucgagcggggcgagggccgaggucgugacgggc

SEQ ID NO: 3914 - RNA, 89 nt, Human
ggcaguucggcggucccgcgggucugucucuugcuucaacaguguuggacggaacagauccggggacucucuuccagccuccgaccgcc

SEQ ID NO: 3915 - RNA, 65 nt, Human
gccggccugcuuucccaucugucuaucuaucuggcuggcagggaaggaaagaauugcaugugggu

SEQ ID NO: 3916 - RNA, 89 nt, Human
uagaguaaaaccaagcuggcccaagguguucugcaggcuguaaugcaguuuacucagagugcauuuuuuuuuuugguucaaugauuuua

SEQ ID NO: 3917 - RNA, 82 nt, Human
uguuuaacuuuguaagaugcaaagagguuggaucaaguuuaaaugacugugcugccccuuucacaucaaagaauacuggaca

SEQ ID NO: 3918 - RNA, 75 nt, Human
caugggagacaaucgggacacacacacacauucauacaagugagcugcguguggcaucccgaggagcaacccgug

SEQ ID NO: 3919 - RNA, 62 nt, Human
gcgcucgucgucgaccaacggacccggcaugugcaaggccggcuucgacgggacgacgaugc

SEQ ID NO: 3920 - RNA, 61 nt, Human
ucagaaggauuccuaugugggcgacagaggcccagagcaagagaggcauccucaccacuga

SEQ ID NO: 3921 - RNA, 80 nt, Human
aagagaaaaugguacagcaguuacaagaggauguggacauggaagaugcuccuuaaaaaucucuguaaccauuuucuuuu

SEQ ID NO: 3922 - RNA, 80 nt, Human
cagucacuacuuauuugcauuauuccugcauauucagugaaugugaggucauauuugguauuguauuagaaguaguguug

SEQ ID NO: 3923 - RNA, 63 nt, Human
uacuuaaauaagccaauacuuagaucuacuguaaggcagaugcuaauuauaaggcauuaagua

SEQ ID NO: 3924 - RNA, 66 nt, Human
uuacuuuaagguucgcuguauguuugccuuggacaaaaaggcuaccuaccacgugcuauccaguaa

SEQ ID NO: 3925 - RNA, 72 nt, Human
cuguguacgccgccagcugggugagcauggggcagccccaguggccaccggagcugugugagcaagugacag

SEQ ID NO: 3926 - RNA, 63 nt, Human
ugcccacagcugcuggacagccagagccaucaccuguagcacugguugccagugcugugugua

SEQ ID NO: 3927 - RNA, 65 nt, Human; identical to SEQ ID NO: 247

SEQ ID NO: 3928 - RNA, 80 nt, Human; identical to SEQ ID NO: 100

SEQ ID NO: 3929 - RNA, 71 nt, Human
ccacaacuagucugacauuguuggcaguuaaaaucuuauuuugaauuguaaauuaguuaaauuuuaugugg

SEQ ID NO: 3930 - RNA, 82 nt, Human
gcauuaaagauuuauaagaaaauuauucaaacugauuuuuuauaaaaugaaguaugauuuuaaacuuauugauuccucuugc

SEQ ID NO: 3931 - RNA, 73 nt, Human
gcuuguguaaaauaaucuucugacaucaguaauuuaaugagauugcuguagguuucagcauuaaacacaaugu

SEQ ID NO: 3932 - RNA, 61 nt, Human
uuggcgcuuguugaaaacgagcuuucuuucccaugauagugcuucguuuuugaaguguuga

SEQ ID NO: 3933 - RNA, 67 nt, Human; identical to SEQ ID NO: 1347

SEQ ID NO: 3934 - RNA, 66 nt, Human
gcuggcaggagcaucccugagcuggaccgggaggccucucuggccuggggcugcucccugcccggc

SEQ ID NO: 3935 - RNA, 69 nt, Human; identical to SEQ ID NO: 1348

SEQ ID NO: 3936 - RNA, 88 nt, Human
cuucaagccguggcugcacccggagcagagcccguugccgagccuggcgcugucggagcugucggugcagcaugcggacucacuggag

SEQ ID NO: 3937 - RNA, 73 nt, Human
ggagcggaugggcggcgcgggcggcgagggcagcgacgacgacaccucgcucaccugagcgccgcaccgcuuc

SEQ ID NO: 3938 - RNA, 63 nt, Human
gggacggagacaggaccgggcgagcccuggggcggcggccgcuccugcacuuucuccccuccc

SEQ ID NO: 3939 - RNA, 86 nt, Human
guggcaucgaauauggcaagauuugaugggcuacaauauggucacagaugugacauugauguguccacugaagccauguaugcugc

SEQ ID NO: 3940 - RNA, 60 nt, Human
ggcauggcuagcaagccccuucauguuagaaggcugcagaaggcuuugagagacuggguc

SEQ ID NO: 3941 - RNA, 130 nt, Human
ucuuaaaaggacugagcagggggaggaacauuuaagcugauggaaguggaaguggaaguugcuguacauuggcagcaaggccuccgaguuagcuuuugaaugcaguuaacugguuucucuuaacugugga

SEQ ID NO: 3942 - RNA, 74 nt, Human
caugucccugcuccucugugagguggacaugcgagagguaucuugucggccugugaggucggacgagggagaug

SEQ ID NO: 3943 - RNA, 63 nt, Human
cucacuuuccgcucucucuccaugccggagacgggcccggggggaguguuagccgugugugag

SEQ ID NO: 3944 - RNA, 111 nt, Human
gcgcgggcaggccgcccccgccgcuccggacgccgaccaugagcagccauggcaacagccuguuccuucgggagagcggccagcggcugggccgggugggcuggcugcagc

SEQ ID NO: 3945 - RNA, 95 nt, Human
uuuguggucacaugcuuuagccauacacauggguaacauugacuaugggagucuugugaaaguguaaaugugcgaugggcuauguaggacauaaa

SEQ ID NO: 3946 - RNA, 60 nt, Human
uauuuuaauauuuauaaacuugggguuguauaaucuauugcaauaaaaaauauuaggaua

SEQ ID NO: 3947 - RNA, 70 nt, Human
aagcagggacaaccugggccauuccugaggccuuauccugcaccaggcacuuccuccuugucaucugcuu

SEQ ID NO: 3948 - RNA, 73 nt, Human
gaguuuuauuggguuuguugaaguaugacuugagaauaaugcauaccuggguucaaaccacaugcugaagcuc

SEQ ID NO: 3949 - RNA, 66 nt, Human
ccauguuggauaagggaucagccguugaugcccaacccaucaaaggauuuucccaucgcucccugg

SEQ ID NO: 3950 - RNA, 74 nt, Human; identical to SEQ ID NO: 365

SEQ ID NO: 3951 - RNA, 102 nt, Human; identical to SEQ ID NO: 2172

SEQ ID NO: 3952 - RNA, 102 nt, Human
guuuuuauuuuucaauuuuuauuuugguuuucuuacaaagguugacauuuuccauaacagguguaagaguguugaaaaaaaaauucaaauuuuugggggagc

SEQ ID NO: 3953 - RNA, 77 nt, Human; identical to SEQ ID NO: 3082

SEQ ID NO: 3954 - RNA, 100 nt, Human
auguaagcgcuggucauuuuucuucugggguuuacugaucaguguggugauuuuaacuucauuuaguaauuacucuaggagauuuuaccuugacuuauau

SEQ ID NO: 3955 - RNA, 79 nt, Human; identical to SEQ ID NO: 2369

SEQ ID NO: 3956 - RNA, 73 nt, Human
guucuguauaaacugggggacaguaaguuaguuccuuuguuuuaacuuauaagccucaacuucaccgcagaau

SEQ ID NO: 3957 - RNA, 87 nt, Human
ugaauagacuauauggaaauuguauaaaauguuauuaccuuuuaucgguaguagcuuaaacagcacuauaucacuaauugcuauuca

SEQ ID NO: 3958 - RNA, 74 nt, Human
gguuuuuauuuauucacaaaguuguuaacauuaaaauuugaccuuuggaaauauaaggaaauauuuuagaaauc

SEQ ID NO: 3959 - RNA, 66 nt, Human
uccccugguuucuugucggcugugcuugauucuugaacagguaaccacuugagaggaugccggcga

SEQ ID NO: 3960 - RNA, 98 nt, Human
ggacauacccuauagaauuacuaaccuuacugccccuuguagaauauguauuaaucauucuacauuaacagaaaauaaugguucuuacuggaaugucu

SEQ ID NO: 3961 - RNA, 102 nt, Human
ugggcacuggucuccuggaaagugggcgccauuaccuugcugccagccgcgccuucguugucggcauuugugaccuggcccgccuggguccaccagagccca

SEQ ID NO: 3962 - RNA, 67 nt, Human
ggacagugugguggcaacauugaaagccucguacccuggccugcaguuugaaaucauugcuaugucc

SEQ ID NO: 3963 - RNA, 63 nt, Human
ggagaagaaugaaguggaccugguuguucacuccuugaaggaccugcccacugugcuuccucc

SEQ ID NO: 3964 - RNA, 69 nt, Human
aacguguucgacccgccgccgcaagaaugauuuaucuguaaaauacgugucgguguggucacaaccguu

SEQ ID NO: 3965 - RNA, 90 nt, Human
aggagcaucccgcggaugccagaccaggcucaugucgcgccugccgggcggccagugcagggccgggccgaggucgccuccgccgcuccu

SEQ ID NO: 3966 - RNA, 68 nt, Human
uuuuuuuuuuucucaacaagcuuucacuggacaggugcuggguaaaagcuuguugagaaaauaaaaaa

SEQ ID NO: 3967 - RNA, 106 nt, Human
aaggucaccugcgcagccugguccugggggacaacugccucucagagaacuacgaagagacggcagccgcccuccacgcccugccgggccugcggaggcuggacuu

SEQ ID NO: 3968 - RNA, 74 nt, Human
ccucuccuggagagccucagccugcacagcugccaccuggagcgcaucagccgcggcgccuuccaggagcaagg

SEQ ID NO: 3969 - RNA, 68 nt, Human
gugggaaggaauaaaaaugugugcgaggucucuggugacagaguaauggcucgccgacauccacccac

SEQ ID NO: 3970 - RNA, 61 nt, Human
acaucacuagucuuucugaaacugcugaagauauuauugcuaaagaaagagaacagaaugu

SEQ ID NO: 3971 - RNA, 71 nt, Human
cgaaugcugcagaacuaaaaaaaaagaggucaccaaggugcugcuuuuuucacaaaugaaccagcuugucg

SEQ ID NO: 3972 - RNA, 97 nt, Human
uccauauuugauugaauauccuauagacccuguuacacaagaauuuaagaucgaugaagaaugugguaacaaauucuggggaaguucuugauuuggg

SEQ ID NO: 3973 - RNA, 76 nt, Human
aagauauauuuuucaguuauuuuauuuuuucuaaaaacaauagaaaaaaaucaacuuuaaaaagcaaaauguacuu

SEQ ID NO: 3974 - RNA, 77 nt, Human
guuuuauuaaaguuauuuacauuuaauggcaauauuuacagagaaacauuguguaaaucuuaaaauuuuuuaaaaac

SEQ ID NO: 3975 - RNA, 76 nt, Human
cuucuguccaccuguccugcagaggagucguuuccagcccggcugccccaggaugggugaguucaacgagaagaag

SEQ ID NO: 3976 - RNA, 77 nt, Human
gcuccucaucaucuuucugcuggagaucaucgcugguauccucgccuacgccuacuaccagcagcugaacacggagc

SEQ ID NO: 3977 - RNA, 78 nt, Human; identical to SEQ ID NO: 99

SEQ ID NO: 3978 - RNA, 80 nt, Human; identical to SEQ ID NO: 100

SEQ ID NO: 3979 - RNA, 64 nt, Human
cugaaacaaaaagcauuguuguuugccaugauacaagugcacuguggcaaugcccguugcucag

SEQ ID NO: 3980 - RNA, 63 nt, Human
caguuuaauaguaacuuuauuuauuuuaaaaaaaaggaaacacaauuaguuacuguuaaacug

SEQ ID NO: 3981 - RNA, 69 nt, Human
gcacccauuuguacauauaggucauucauacaucacauuuuaaauuggggacugugugugcuggugugu

SEQ ID NO: 3982 - RNA, 77 nt, Human
uccuccaucccagcauagagaauggggacucccugaguaaugggaguucuuucauguccucugcuugggguggggga

SEQ ID NO: 3983 - RNA, 67 nt, Human
agaaggugcugacuuccuuggggagaugccauuaaagcaccugggaugaucucaaggggcaccuuuu

SEQ ID NO: 3984 - RNA, 105 nt, Human
ggggcaaggugaauguggaagaugcuggaggagaaacccugggaaggcuccugguugucuacccauggacccagagguucuuugacagcuuuggcaaccuguccu

SEQ ID NO: 3985 - RNA, 104 nt, Human
aucuuggccaggcuggucuuaaacuccugaccuugugauccacccgccucaccuccuaaagugcugagauuacagggcaugaggccaccaugcccggccaagau

SEQ ID NO: 3986 - RNA, 68 nt, Human
gagugcaguggcaugaucucggcucaccgcaaacucugccccccggguucaagcaacuuuccugccuc

SEQ ID NO: 3987 - RNA, 65 nt, Human
gccauucauuuucauuaacacauauauucuguccugcaauacuggagagguggaaugugucuggc

SEQ ID NO: 3988 - RNA, 84 nt, Human
gguucauggggaaaaacauuaaaauuaaaaaguccaaucaauuauagagguggcuuuaacacuuaaaguuuucucccucaaacc

SEQ ID NO: 3989 - RNA, 66 nt, Human
uuuuuuuuuuuuuucacuuuuauaaacugcauuuauuguacagaguacucugaaaaaagaaaaaaa

SEQ ID NO: 3990 - RNA, 68 nt, Human
uagugaacacuggaaagauuuauuaaagaauuauauuuguguauacuuuauaaauuagucccucauua

SEQ ID NO: 3991 - RNA, 65 nt, Human
uguguuaauuuuaguagaaucaggcacugcucgcagaaggaacacagauuguagagauuaacaua

SEQ ID NO: 3992 - RNA, 69 nt, Human
uuuuucucauuucugucgugcuuggaaaacuaguaaauauuaugucuaagaaaacaaaaaagagaaaaa

SEQ ID NO: 3993 - RNA, 64 nt, Human
gucuguccccgaggguacgucgcccgccacagacuguguccaugacccaccccagcagauagac

SEQ ID NO: 3994 - RNA, 90 nt, Human
uuccagggcccggggccgguggggcuuucggcucgaugggcggcaaggacuucgagcagccucucgccauuucccgcgucacuccuggaa

SEQ ID NO: 3995 - RNA, 81 nt, Human
uuucccgcgucacuccuggaagcaaggcggcucuagcuaauuuauguauuggagauguaaucacagccauugauggggaaa

SEQ ID NO: 3996 - RNA, 131 nt, Human
cagcugccggucuuggcaucuucgaaguaaggagaguuuuagaugcuucuggauguucaaugcuagcaccuuuacagacuggagcagcucgauuuucuucguauuuacuuucaagagcaagaaaagugcug

SEQ ID NO: 3997 - RNA, 65 nt, Human
cuggacuuggaugggcccgaguugggggcaacaccccgggcauuggggcuuuccagcucucacag

SEQ ID NO: 3998 - RNA, 62 nt, Human
gagcaagaaaagugcugggcucccacuuauuuucucccugugguguuccggaguucuugcuc

SEQ ID NO: 3999 - RNA, 116 nt, Human
gcgggcggagcuggcccugccucugccuggccggcgccgcagucggcgcgggccgugcccgccgccgccaacugcccugagcgcuugcugaggccgagggagacgucggggccugc

SEQ ID NO: 4000 - RNA, 88 nt, Human
uacagaaugcuagggaggcaauuugguuaccugcaauggcugcuuuugccagcgaggccaccauucauuggucaucuugguauuugug

SEQ ID NO: 4001 - RNA, 82 nt, Human
agaaucuccuuuuuucagggccauaaugacaugauguaaaaauuugcuuuaaaccauucaugcccuuaaauagcuagauuuu

SEQ ID NO: 4002 - RNA, 63 nt, Human
uucuuuuuccucccuauccuuuccuguaagcaccuguuuuuccauggaauggggguuaaugag

SEQ ID NO: 4003 - RNA, 80 nt, Human
gagaaugggaagauugugggguauguccuggccaaaauggaagaggacccagaugaugugccccauggacauaucaccuc

SEQ ID NO: 4004 - RNA, 92 nt, Human
uuggcugugaagcguucccaccggcgccucggucuggcucagaaacugauggaccaggccucucgagccaugauagagaacuucaaugccaa

SEQ ID NO: 4005 - RNA, 73 nt, Human
ccaccaaaaugcuuacauccguguguaauaucccgagaaauuauggaacaauuauaacauagcauuaaggugg

SEQ ID NO: 4006 - RNA, 62 nt, Human; identical to SEQ ID NO: 2027

SEQ ID NO: 4007 - RNA, 61 nt, Human
aguauccuaagaucagcugggcaugguggcuuacaacuguaaucccagcacuugggagacu

SEQ ID NO: 4008 - RNA, 80 nt, Human
ggcuguggugguugaaaguaauuaauuuaugacauaguaucugagacuuaaauuugcuguguccuuuuggcuuuucagcc

SEQ ID NO: 4009 - RNA, 68 nt, Human
uuaggauaacauugcugucggaggucacgcaagcuaacggcaagugugucuaucaguagugguccugg

SEQ ID NO: 4010 - RNA, 94 nt, Human
gguuuucugcuccuugguccugggugucagcagccgaagcuucuuuucguuccuuggcgaggcuuuugauggggcucgggacauguggagagcc

SEQ ID NO: 4011 - RNA, 69 nt, Human
ucaggcugccaaugaauggggcaggaguggcaaagaccccaaucacuuccgaccugcuggccugccuga

SEQ ID NO: 4012 - RNA, 71 nt, Human
uccucuucacucugcucucaggagaucuggcugugaggcccucaggccagggauacaaagcggggagaggg

SEQ ID NO: 4013 - RNA, 75 nt, Human
caggacacagcauuguugguuuugccauguacuauuuuaccuaugacccguggauuggcaaguuauuguaucuug

SEQ ID NO: 4014 - RNA, 68 nt, Human
gucugaagagaguucagaguuauaaaugcuuacaaugacuuuuuaaauuguacucuuucuuuuuaggc

SEQ ID NO: 4015 - RNA, 93 nt, Human
ucgcugcagcagcaugcacuucuugguagcagaauggaaugaaccauccaucaacuucuauaaaagaagaggugcuucugaucuguccaguga

SEQ ID NO: 4016 - RNA, 88 nt, Human
gguuuaaaaugguauuagguuggagggauuugggcgguaagagaauguuauagcugaauuaucccuuuucuuggacuauuggaggacc

SEQ ID NO: 4017 - RNA, 80 nt, Human
ggccacgcaacacuuccuccccaagccaaggagaaguaucacuuuuagaggcagaggagcggaaggcagugggugugacc

SEQ ID NO: 4018 - RNA, 79 nt, Human
ugccauuuguuaaagacuguuggagcagaacuacugagaaaaaccaggcauuguaucuucaguugucaucaaguucgca

SEQ ID NO: 4019 - RNA, 63 nt, Human
gguccugguguacaauaauacauccauuguucaggaugagauucuugcucaccgucuggggcu

SEQ ID NO: 4020 - RNA, 70 nt, Human
guaucggaaccaaggagaugaaaaaggcacagagauagauacucuacaguuucgucuccaggucagaugc

SEQ ID NO: 4021 - RNA, 71 nt, Human
cuguggccuaccaggugaauauuggcuuggaaaugauaaaauuagccagcuuaccaggaugggacccacag

SEQ ID NO: 4022 - RNA, 89 nt, Human; identical to SEQ ID NO: 605

SEQ ID NO: 4023 - RNA, 81 nt, Human
ggcugguuaacaucagaucccagaaaacaguguucuaaagaagacggugguggauggugguauaauagaugucaugcagcc

SEQ ID NO: 4024 - RNA, 71 nt, Human
agacugggcaauauagcaagaccccaucucuaaaaaauuaggcaugguggugcaugccuguauucccagcu

SEQ ID NO: 4025 - RNA, 61 nt, Human
cuuccaaaaauaucuagguuuguccucauuuuacaaaugaggaaacuaaacucuguggaag

SEQ ID NO: 4026 - RNA, 72 nt, Human; identical to SEQ ID NO: 1989

SEQ ID NO: 4027 - RNA, 78 nt, Human; identical to SEQ ID NO: 99

SEQ ID NO: 4028 - RNA, 65 nt, Human; identical to SEQ ID NO: 247

SEQ ID NO: 4029 - RNA, 80 nt, Human; identical to SEQ ID NO: 100

SEQ ID NO: 4030 - RNA, 63 nt, Human
caauugugacauaauucaaugacucuuugacaaacucaucagcagucuugguuaucacauuug

SEQ ID NO: 4031 - RNA, 66 nt, Human; identical to SEQ ID NO: 2920

SEQ ID NO: 4032 - RNA, 120 nt, Human
gaaauguucaggaugagaccuuucugccuugauuccauauguuucagaauuagcugugucaucuugacuacggaggugauguuacaauggaugaggcucuggauuucauccggugcguuc

SEQ ID NO: 4033 - RNA, 128 nt, Human
ggggucagcaccuggaugaugacuucuuuugcuuuauauuccucuugcagggccuuggaaaaugcgcacacaaacgccuuggaagcugaguacauggaguagagaggccaaggaaacagggcuauccc

SEQ ID NO: 4034 - RNA, 64 nt, Human
uucuuauaucgucguuaaucaucaaggaaucucuucucgauuaaaauacacacgaucuuaagaa

SEQ ID NO: 4035 - RNA, 114 nt, Human
cucauggagaauuuagaaucgccugucuacuuguguuucauuauucuucuaagacguauuuugaauaauuaccugcaaguuguuggaauagguacuucucgaaauucuuaagag

SEQ ID NO: 4036 - RNA, 72 nt, Human
accauuuuaaaacgggcacaaauaucucuaaggcgcauagugcuuuucaccaguaggccuuugugaaguggu

SEQ ID NO: 4037 - RNA, 66 nt, Human
auacgcuuagugcaguauuuauccaauucacacaaagugcgggaucagugguuuaaacaagcguau

SEQ ID NO: 4038 - RNA, 87 nt, Human
guugggaacaucccuuuaaaguuaaguaagcuuaaagaaaacaauuuuuaguaagagugaaauagauuucccaggggugaacgcaac

SEQ ID NO: 4039 - RNA, 78 nt, Human; identical to SEQ ID NO: 99

SEQ ID NO: 4040 - RNA, 65 nt, Human; identical to SEQ ID NO: 247

SEQ ID NO: 4041 - RNA, 80 nt, Human; identical to SEQ ID NO: 100

SEQ ID NO: 4042 - RNA, 84 nt, Human
aucggggaagggucagggcuucuguggaacuuggaacgugccaggaccaccugcaaaagccaggugcguugaucauucucagau

SEQ ID NO: 4043 - RNA, 69 nt, Human
cugguguguguuccagcagugagacgguguuauugugaagguggcauucaucugcggagccaaaaccag

SEQ ID NO: 4044 - RNA, 67 nt, Human
gugcacccgcugccucaucaccuucgcagauuccaaguuccaggagcgucacaugaagcgggagcac

SEQ ID NO: 4045 - RNA, 62 nt, Human
ggauucuuuuugcaugaccugagguguguauggguccaggucauauguagacaugagggucc

SEQ ID NO: 4046 - RNA, 73 nt, Human
gcugcuggucagcgcugcauggcucuuucaacagcaguccuugugggagaagccaagaaguggcugccagagc

SEQ ID NO: 4047 - RNA, 60 nt, Human
caaaauguaggguuauaauaauguuaacauggacaugaucuucuuuauaauucuacuuug

SEQ ID NO: 4048 - RNA, 94 nt, Human
uguaagcagcaucauggagguuugaagaugccgcauuuggauuggaugaauuccaaauucugcuugcuugcuuuuuaauauugauaugcuuaua

SEQ ID NO: 4049 - RNA, 65 nt, Human
guuccucguaauuuucgcuuguuggaagaacuugaagaaggacaaaaaggaguaggcgacgguac

SEQ ID NO: 4050 - RNA, 78 nt, Human
uuagcuggggccuugaagaugaugaagauaugacacuuacaagguggacaggcaugauuauugggccaccaaggcugg

SEQ ID NO: 4051 - RNA, 75 nt, Human
ggccgggcgcgguggcucacgccuguaauuccagcacuuugggaggauuacaggcaugagucaccauacccggcc

SEQ ID NO: 4052 - RNA, 82 nt, Human
caacuuuucagguggagagccauuucuucaagaccggggagaauaccugggcaaguuggugagguucugcaaaguagaguug

SEQ ID NO: 4053 - RNA, 64 nt, Human
cuuugugcugccccuugaggaagcaaagagaggauugcuuuugcuuaaggaagcugguauggag

SEQ ID NO: 4054 - RNA, 61 nt, Human
uccgggagaggugguuccagaauuauggugaguauuuggacauucucgcuaucuccuguga

SEQ ID NO: 4055 - RNA, 80 nt, Human; identical to SEQ ID NO: 100

SEQ ID NO: 4056 - RNA, 77 nt, Human
ccucgagacuaguucucucucucucccucgggccgaauucggcacgagggcucaccgagaccagccucaucucgggg

SEQ ID NO: 4057 - RNA, 98 nt, Human
cuacggccugagccacggccuaaccucccgccagugguggcuggaugugguccugcagaccuuccaccuggcggguguccaggaugcucaggcuguag

SEQ ID NO: 4058 - RNA, 76 nt, Human
gcugugccacugacucacugugaccuugggaucuugugcugugaagacauuucccaagugcuucauguuagccagc

SEQ ID NO: 4059 - RNA, 68 nt, Human
ggagguggagcccucagcccuggaacaaggcuucaggcaggcauacagggcucagagccacagcuucc

SEQ ID NO: 4060 - RNA, 100 nt, Human
gguugcgcagagguggucuuauccagcucagcuuccccugggacccaccgugggaccugaggcagaacugggguggacuuggccuccuccauggcacacc

SEQ ID NO: 4061 - RNA, 76 nt, Human
auguaugucuuuugggauguauuauaugccuagcuuuauaaucaguauaaauuuuaauuauuccaggaauaugcau

SEQ ID NO: 4062 - RNA, 70 nt, Human
gaucacaucuuugucacuggaugcuacuugaagagggaguacuuuguaaccacuuugauaugcuguuauc

SEQ ID NO: 4063 - RNA, 67 nt, Human
caccaccaccccaccuaugggcuugggcacagccagagccugggugcagucaaagggcaggcuggug

SEQ ID NO: 4064 - RNA, 81 nt, Human
ccauugaaaaauuugagaaggaggcugcugagaugggaaagggcuccuuucaaguauugccugggucuuggauuaaacugg

SEQ ID NO: 4065 - RNA, 79 nt, Human
uugucgucauuggacacguagauucgggcaaguccaccacuacugggcaucugaucuauaaaugcgguggcaucgacaa

SEQ ID NO: 4066 - RNA, 102 nt, Human
gcgaacguugggaacauuuuaggguuuaaugaacuuugucauaaguaacagacgauacguucuuaaagcacaguucuuggauccaccaauacaacguucagc

SEQ ID NO: 4067 - RNA, 94 nt, Human
ccgcggggguucccacggugguccacccaaacugggggaggguuagccccacggagaaggguugugggccccauugggaacaaaauccucgugg

SEQ ID NO: 4068 - RNA, 109 nt, Human
gcuacuuccgacagucgcucagcuaccuggaggcuuacaaccccagugacggcaccuggcuccgguuggcggaccugcaggugccgcggagcggcuggcggugcguggu

SEQ ID NO: 4069 - RNA, 66 nt, Human
caccugggccugccccaguggcaauaugccuucaccagcuauggcauuagcccacaggccaaggug

SEQ ID NO: 4070 - RNA, 66 nt, Human
cuucaacaagcucccugucucgcccaaaggaucugaaggccguuccaagcgagggugcuucugagg

SEQ ID NO: 4071 - RNA, 103 nt, Human
ugagaagaguuuugccauucugaagaggcgagccuguggaacuguuuaagguccuguucccagaagaauaaaaguuucucauuauggcauuaaacucuauuua

SEQ ID NO: 4072 - RNA, 60 nt, Human
cuggggcuggugcugaaagaagagcccacagcugacuucauggugcuacaauaaccucag

SEQ ID NO: 4073 - RNA, 83 nt, Human
gcauucuuccuauuuaaagcugcaucgcuugaaaaaaguuuucgcagacugugcuggagcuggugcugaaaaaggggguuugc

SEQ ID NO: 4074 - RNA, 64 nt, Human
ucauucuuauuguuuuauuagggcaauuugucucaauaaaagcccaggaagaagacgaggauga

SEQ ID NO: 4075 - RNA, 92 nt, Human
uuccugccagaaugcgcacagaacauaagucagccaagugugucgugccaggggauacuuugacuuugguuugcugcugcugcugcuagggg

SEQ ID NO: 4076 - RNA, 80 nt, Human
gcccugguauccccggcacuccuggaucccacggccugccaggcagggacgggagagauggugucaaaggagacccuggc

SEQ ID NO: 4077 - RNA, 67 nt, Human
ggcucugugugugggucgcugauuucuuggagccugaaaagaaggagcagcgacuggacccagagcc

SEQ ID NO: 4078 - RNA, 131 nt, Human
uggcaugauccaagagauccagcaggcugcugagcgccuggagcggaacuuuguggacagccggcagcucaagguaugugccaccugcuuugaccucucggucagccugcugcgugucuuggagaugacua

SEQ ID NO: 4079 - RNA, 88 nt, Human
cagggcaaacaaccaggucggccuggcccccguggcuuaagccuaagucucuucagccaccucccaggaagaucuggccucuguccug

SEQ ID NO: 4080 - RNA, 62 nt, Human
cgaaucuggagagcuuuggauccugggugaugucuucauccgccaguacuuuaccgucuucg

SEQ ID NO: 4081 - RNA, 61 nt, Human
caggggguggggaaggcggugcuucuugagccccacuuagcaacuggucacucauccucug

SEQ ID NO: 4082 - RNA, 64 nt, Human
cucuuucauccuguagucaggcagauaggccacaaaggugcugccaaggaccaggaugauggag

SEQ ID NO: 4083 - RNA, 62 nt, Human
ccuguguccguguguucucauuguucagcuuccgcuuacaagugagaacaugugguguuugg

SEQ ID NO: 4084 - RNA, 63 nt, Human
gcauuagcuaguuauccugaugcucuccccgcuacggccccugcaucaggccccagugugugu

SEQ ID NO: 4085 - RNA, 82 nt, Human
gugcggguuuguuacauagguaaacgugucccauggugguuugcugcaccuaucaacguaucaccuagguauuaagccccac

SEQ ID NO: 4086 - RNA, 70 nt, Human
guguggccgaugugucuauugaagauucugugaucucacucucaggagaccauugcaucauuggccgcac

SEQ ID NO: 4087 - RNA, 77 nt, Human
uguguagacgugaagccuuguuugaagagcuguauuuagaaugccuagcuacuuguuugcaaauuugugucuacuca

SEQ ID NO: 4088 - RNA, 83 nt, Human
uguuuaguggcaucagcccuaauccaucugaugcuuuuucauuauuaggcauguuggagacuugggcaaugugacugcugaca

SEQ ID NO: 4089 - RNA, 77 nt, Human
guuaucauggcucuaucuuaauuaauuagaaaauauguguguuuaauucuuugagaauuaaaauagagaauauuaac

SEQ ID NO: 4090 - RNA, 76 nt, Human
aaugaucauuuuccucucgugguaugggcagacuggaucaggaacucagacaaauaugaauguaaaugaagucauu

SEQ ID NO: 4091 - RNA, 70 nt, Human
cagagcucaaaugauacuuuucccacaggcaaugcacauugcugcugcaauagaaguucaugaaguacug

SEQ ID NO: 4092 - RNA, 76 nt, Human
ugucuucugcccauccagcaugggaagugggucccacgugaagggggcccaccacccacuuugggagcugaaggca

SEQ ID NO: 4093 - RNA, 76 nt, Human
cuguuaaguccguguggcuuuuucuuacuuuggauucauuuauccuguacuccauguagcucgcaugguuagagag

SEQ ID NO: 4094 - RNA, 100 nt, Human
gagaggauguuaucccccauagccagaaaccaggguggcuuccaaaagaaaaggguagcauucggugacucugcuuuaggccuugaggaugaaucuuuuc

SEQ ID NO: 4095 - RNA, 60 nt, Human
uaaggucuucgaaccuuauguuagggguuggaggucuuggugugaggaaggaagacuuua

SEQ ID NO: 4096 - RNA, 100 nt, Human; identical to SEQ ID NO: 1173

SEQ ID NO: 4097 - RNA, 70 nt, Human; identical to SEQ ID NO: 1335

SEQ ID NO: 4098 - RNA, 76 nt, Human; identical to SEQ ID NO: 3277

SEQ ID NO: 4099 - RNA, 62 nt, Human; identical to SEQ ID NO: 206

SEQ ID NO: 4100 - RNA, 111 nt, Human
cccuccccagacuucgccuuccucuuuuuaagcugguuuaugaaaaagaccuagaagaucuugauucauuuuuaccauucuuuccauagggagaagagaaagaugauuggg

SEQ ID NO: 4101 - RNA, 69 nt, Human
uuguaauggaugacuacgagagagauacuuugcugaaaagacuuuccccuauugauuaucuauugacag

SEQ ID NO: 4102 - RNA, 104 nt, Human
cuccuguggagcuugcaugguucccuuucauacuacgaccauaauuaaaaccacuaauucucuuuuaaaaugcugcaggaugccauguaggcaucugucuggag

SEQ ID NO: 4103 - RNA, 68 nt, Human
gacaagggugccucuaaaagcuugacagggccuugacugcacaauucgagcugaauuugccccuuguc

SEQ ID NO: 4104 - RNA, 68 nt, Human
uuguacuagcaaaagggucugaucaaaggucuccuguggagcuugcaugguucccuuucauacuacga

SEQ ID NO: 4105 - RNA, 80 nt, Human
ccauuaagucaguuucgaucuucaaacugugccuuguuuuuuaaaagauaagaugcuagaaauucaaugggauuuggugg

SEQ ID NO: 4106 - RNA, 74 nt, Human
cuuugcaagcacagcaagucccuguaauaagauaggcacaacugucugauccagguacgcacgaguuggcaaag

SEQ ID NO: 4107 - RNA, 65 nt, Human
ggaaauauguuaucuucugcaauuccagaaauagguucuguuguccggaagguucuuauacaucc

SEQ ID NO: 4108 - RNA, 78 nt, Human
guguuuugacaguuuauuuugaaggucauuuuaaaaacaaaguuaaagacaaucugagaaaaaaauugcacagaauac

SEQ ID NO: 4109 - RNA, 69 nt, Human
acgcaccugcuauuucaccauacuauggagaauacagcuaaugaagugguggcagaagcuuggccgugu

SEQ ID NO: 4110 - RNA, 74 nt, Human
gcucguauuuauuggaaaagcagaacaguaugcaccuguagggguguagcuuccaugguucuccaagcacgggc

SEQ ID NO: 4111 - RNA, 81 nt, Human
ccuuucgccagcuggcguaauaucgaagaggcccgcaccgaucgcccuucccaacaguugcgcauccugaauggcgaaugg

SEQ ID NO: 4112 - RNA, 86 nt, Human
gagcggcuggccgccugcggggccgaggccgcggcguacggcaggugcgugcaggccuccacggccccgggcggccgcggauccuc

SEQ ID NO: 4113 - RNA, 64 nt, Human
ucuugugaaauuucugguacuuuguauauaaaauacauaaaacaauagauuagaaaucaaaaga

SEQ ID NO: 4114 - RNA, 62 nt, Human
ugauuauuugcauguuauguuuaauaagcuacuagcaaaauaaaacauagcaaauggcauca

SEQ ID NO: 4115 - RNA, 84 nt, Human
agccuuacguggaccucgccgcucgcuggcggucacgauugugagcccuccagacaauuuuuaagguugagucuaaguaaggcu

SEQ ID NO: 4116 - RNA, 60 nt, Human
gccaccuuccugucucucugugcuaaacauucaggacaguguuccacaggcagaucuggc

SEQ ID NO: 4117 - RNA, 60 nt, Human
ucauuucacauaaggcccuuaauauagauaaguaacauuuggccuuuuggugucucguga

SEQ ID NO: 4118 - RNA, 79 nt, Human
cccccacgccgaggcuuuggagugaacagcccgcuuggcuguggcaucucaguccuauuuuugaguuuuuuuguggggg

SEQ ID NO: 4119 - RNA, 64 nt, Human
gaucucaagggcaccuuuugcccagcugagugaacugcacuguggacaagcugcaugugggauc

SEQ ID NO: 4120 - RNA, 66 nt, Human; identical to SEQ ID NO: 12

SEQ ID NO: 4121 - RNA, 86 nt, Human
ccugauguggggacucuccuuucuuuuuaggucuauucaugugggugggcaggaaggaugugaggacucuaggucuccaguucagg

SEQ ID NO: 4122 - RNA, 82 nt, Human
aggacaacauuuaauuauuuugcaaagaaacuaagagcuaaagauguaauuuuucuugcaauuguaaucuuuugugucuccu

SEQ ID NO: 4123 - RNA, 130 nt, Human
gguagcacauucucaauacguuuacagagggugcaagagacauugcuuuuggaagccaugucugaauauaaggccuccuuuuuaauguugggcacccguggucaaaccguacuuguagccuuuuguuacc

SEQ ID NO: 4124 - RNA, 65 nt, Human
ucccuuuauuacuguuguagucccucacuuggauauaccucuguuuucacgauagaaauaaggga

SEQ ID NO: 4125 - RNA, 79 nt, Human
aucagaaauuuuggaaaucaaaggacagaacugggaagaacaagugaauagucugccugaaguuuucagaaaagcuggu

SEQ ID NO: 4126 - RNA, 61 nt, Human
uaguuaucgaagcuuucaccagacuaccauaccugugugaaggcgacauguauaaugacua

SEQ ID NO: 4127 - RNA, 62 nt, Human
gcaucaggggcuaggcucuggcugggcccggaggcugagacuaaggcuuucgacccuggugc

SEQ ID NO: 4128 - RNA, 65 nt, Human
uccauguggaugcugccucagacaaaggcagugagccuucccugccaaagugcccaucccauggg

SEQ ID NO: 4129 - RNA, 100 nt, Human
uggucacuguuagcccaugaacacgugugggccucggucacguggcuuugaagggcagucugaccaggcuagaccacacgugccgugacaggcggugcca

SEQ ID NO: 4130 - RNA, 68 nt, Human
gcuccuccauuuccuugaaaacugaacgauuauuaaaaauagauuaaacuucgcuggaaaugaguagc

SEQ ID NO: 4131 - RNA, 72 nt, Human
ggucgcggagauggaauuggagcagagagaagggaccauggcagccgugggcuuugaggaguucucagcgcc

SEQ ID NO: 4132 - RNA, 66 nt, Human
cuggccauuuggggaaaucgcaugccgucucaccggcuuccucuucuaccucaacauguacgccag

SEQ ID NO: 4133 - RNA, 80 nt, Human
gucccucaagcuccgcaggccccucuacgcacaccauggccugugccuuccuguggguggugguggcuguggccauggac

SEQ ID NO: 4134 - RNA, 85 nt, Human
cacgccaugaccuucacugcugucucagagaaggaugaucaggauggugcuuucacaaaauggagaguggagaauucauggggug

SEQ ID NO: 4135 - RNA, 67 nt, Human
gguuaccugugcaugacagaugaggggugcucugaguaugucuacgaaguggugguggacaggaacc

SEQ ID NO: 4136 - RNA, 74 nt, Human
aaauauugugcaccauauggaaguacugccuuauaugauaaggauaaaguuaaauugguagguguauaacauuu

SEQ ID NO: 4137 - RNA, 61 nt, Human
ccuaauugacugagggaaugcugguacuguuagaaaguaucagugaaagaauuagucuggg

SEQ ID NO: 4138 - RNA, 65 nt, Human
gacagccuauugugggaccucgugaucauguaagugauacuuaauaaauucccuuuauaucuguc

SEQ ID NO: 4139 - RNA, 71 nt, Human
ggcccgaguucuuagauagccuacaucuuucucccaugcuggaugcuuccugccuuugaacaucggacucc

SEQ ID NO: 4140 - RNA, 64 nt, Human
ucuaucaucuauccuauuaguucugucccucuaagagaacccugacuaauacaguggccaugga

SEQ ID NO: 4141 - RNA, 89 nt, Human; identical to SEQ ID NO: 2239

SEQ ID NO: 4142 - RNA, 95 nt, Human
cggagagugcuuggguggugggugcuggaggauuuccaguucugaacacguauuuauauuggaaagagaccagaaccgaagcucggcacuccccg

SEQ ID NO: 4143 - RNA, 88 nt, Human
cucucucuuccagcugcagaugccacacuguccucugcuucccggggacgagggggugggcgggacuggguacagguugggaggggag

SEQ ID NO: 4144 - RNA, 73 nt, Human
gccccucaagucggguaugaaggagcuggccguguuccgggagaaggucacugagcagcaccggcagaugggc

SEQ ID NO: 4145 - RNA, 69 nt, Human
ggcgcaaaagacaaagccagcccacucccugccauugucagguacuggggcccauggcaauucagcguc

SEQ ID NO: 4146 - RNA, 67 nt, Human
caggccugugggcugagccaggcggucuacucgcccagauaggcagccccugggcagccacguucug

SEQ ID NO: 4147 - RNA, 62 nt, Human
ucagcaguuuaaaaauuguccuuuuucuuaaagaggaagaaggcauuuucacacaaggcugg

SEQ ID NO: 4148 - RNA, 76 nt, Human; identical to SEQ ID NO: 1356

SEQ ID NO: 4149 - RNA, 80 nt, Human
gaauuuggggaggacacaguccagggcggaacucuauccaucugucugucugucugucugugucuaucucccuaucuguc

SEQ ID NO: 4150 - RNA, 76 nt, Human
gagaucucuuggugccucuuccucuucuuacaaggaccgcaguccuguuggguuagagccccacccuuaggauuuc

SEQ ID NO: 4151 - RNA, 80 nt, Human
agaggaaaaagcaaguugcuccagaaaaaccuguaaagaaacaaaagacaggugagacuucgagagcccugucaucuucu

SEQ ID NO: 4152 - RNA, 61 nt, Human
gcuagagccgagcgaagcgaugccuaaaucaaaggaacuuguuucuucaagcucuucuggc

SEQ ID NO: 4153 - RNA, 79 nt, Human
ucuuuuuacauuggcuuuuguuuucuaaauguucuccaagcuauuguauguuuggauugcagaagaauuuguaagauga

SEQ ID NO: 4154 - RNA, 75 nt, Human; identical to SEQ ID NO: 74

SEQ ID NO: 4155 - RNA, 87 nt, Human; identical to SEQ ID NO: 76

SEQ ID NO: 4156 - RNA, 71 nt, Human; identical to SEQ ID NO: 77

SEQ ID NO: 4157 - RNA, 67 nt, Human
acagccucagcagccaagacuguuuagcugaguuguucugccggcggcuucuugcuccuuuggcugu

SEQ ID NO: 4158 - RNA, 65 nt, Human
ccgguugccaauguaugcuuguacuccaggcuccuuggaguuauacagguaugaaauggccaugg

SEQ ID NO: 4159 - RNA, 66 nt, Human
ccugaggccacagcggcccccaucucaucuuccuccuaccugaucugggcauguggaucaucuagg

SEQ ID NO: 4160 - RNA, 77 nt, Human
ggcauauuaaauacauauuaaggaguacauauuuuccuauuuaguauacaaaguacuucauaaauaugaauuauguu

SEQ ID NO: 4161 - RNA, 86 nt, Human
uuucuguucacaccagcuuguuucaguuuaguauauuucuuucugucuacauuuauacuuacugauaaauucacugugaucaggaa

SEQ ID NO: 4162 - RNA, 69 nt, Human
ggaaugaaacuggggucuucaaaguggguugugacaaucuggcaaccuuugaaacccuuugcuuauucc

SEQ ID NO: 4163 - RNA, 67 nt, Human
cggcggcaagauggcagugcaaauauccaagaagaggaaguugucgcugauggcaucuucaaagcug

SEQ ID NO: 4164 - RNA, 71 nt, Human; identical to SEQ ID NO: 1145

SEQ ID NO: 4165 - RNA, 67 nt, Human; identical to SEQ ID NO: 1146

SEQ ID NO: 4166 - RNA, 82 nt, Human
agccaaaauguacaagaccacaccggaugucaucuuuguauuuggauucagaacucauuuggugguggcaagacaacuggcu

SEQ ID NO: 4167 - RNA, 70 nt, Human
ggauuaaguacauaggucuuuauuuaaacacugauuuuuuuuuuaaauauauacacacaaaacuuaguuc

SEQ ID NO: 4168 - RNA, 61 nt, Human
ggcuucaugauauacaccaauuccaaaauaaaacaaucaaauggucccgguguagaaugcc

SEQ ID NO: 4169 - RNA, 72 nt, Human
ggaagagauggcccaugagacugaucuauaguaaaacacucuaagaaaugcaguccaauuuuauacacuucc

SEQ ID NO: 4170 - RNA, 98 nt, Human
cccugccauccagacagucccccugcccccagggcaaccaguucuccuaugcucuaugagguugucuaugaggcaggggcccuggagaggaugcaggg

SEQ ID NO: 4171 - RNA, 81 nt, Human
uuauggugccugauuccugcauggucagugagcugcccuuugaugcucaugcccacauccugcccagagcaggcaccguag

SEQ ID NO: 4172 - RNA, 96 nt, Human
gcucaccccuggaggacggccggcucucuauagcaccagggcucacguggggaacccgggugccauggagcgacaggacggcagauaggggcgagc

SEQ ID NO: 4173 - RNA, 62 nt, Human
ggaggggguuugcuggggaacuggcgccaucgccgggacuccagaaccgcagaagccucccc

SEQ ID NO: 4174 - RNA, 84 nt, Human
ggccccaggacgccaggguggccggcugcugggccacgugcuguccguggugagcccugccgcugucccauggcccagggagcc

SEQ ID NO: 4175 - RNA, 63 nt, Human
uccccaaauuaucccagacaggcagcuccguggaggugacaaggugagagggagaggagggga

SEQ ID NO: 4176 - RNA, 99 nt, Human
acaccuggaaguauuagauacauguuuaaaauaucuuuuauagguuuuauauaaaaaugucugaguaugauuaugugugaaaguucugauaccaguugu

SEQ ID NO: 4177 - RNA, 75 nt, Human
aucuaauguguguguauauauguauguguguauguguguguauauauagauguauauauauacacacacagagau

SEQ ID NO: 4178 - RNA, 72 nt, Human
guggugaaaguagucuuguuuuaugaggaugucugcauuaaagcaguaaaauaagcuuuccauuuuauucau

SEQ ID NO: 4179 - RNA, 74 nt, Human
ccaugcaggcuacuccauguuuggggcuggccucaccguaggccugucuaaccucuucuguggagucugcgugg

SEQ ID NO: 4180 - RNA, 65 nt, Human
gcccucccucuggcugaagacugagaagcauuaaggaugcuucuggauuucugcagcggcagggc

SEQ ID NO: 4181 - RNA, 69 nt, Human; identical to SEQ ID NO: 2967

SEQ ID NO: 4182 - RNA, 63 nt, Human
uguguaauuucuggucagugauuccagguuuuaaauaauuuguaaguguucaguuucuacaca

SEQ ID NO: 4183 - RNA, 72 nt, Human
gggaaacuccgaggacagagggcuaaauccaugaaguuuguggauggccugaugauccacagcuggagaccc

SEQ ID NO: 4184 - RNA, 89 nt, Human
cacggguggaaggcguccggcgagcacucguugcacggcccacucguccgugcguucaggcagcucgacaaggaacguguccauccgug

SEQ ID NO: 4185 - RNA, 98 nt, Human
uccuagaaccugaacauuuggcuuggcaggugcgaaacguaucuagaagcuuuacuggagccagcacucgacgcaaaauguccuuuaggucccuagga

SEQ ID NO: 4186 - RNA, 60 nt, Human
augugaaccuuuguauuuuugcuccuaauuuuggacucagugaaaguguacuguuuacau

SEQ ID NO: 4187 - RNA, 76 nt, Human
cagaugcccccagucccuguguguucugcaagacuugcucuugaggaggaagaugcaccucacuaaggcucaucug

SEQ ID NO: 4188 - RNA, 66 nt, Human
ucccaagaguucugcugcaucagccagugaggacaagaguucuucagugcgguucagcucaaggga

SEQ ID NO: 4189 - RNA, 83 nt, Human
uuuaguuccucaggaacagagaacuuugcaaugaugaucucaacucugcaucaucuggugacuccugauucugcaggacuaag

SEQ ID NO: 4190 - RNA, 77 nt, Human
gacgauuuacgaccuuugguggcucuguacuccuuuuaaacgcauccaaggagucaguugccuuccugguacgcguc

SEQ ID NO: 4191 - RNA, 97 nt, Human
gccaugugucugaccccaucggguacgacgagaugucgucgacggguaucccuugugccgcgucuccauuugaccauuguuuagucaguacuauggu

SEQ ID NO: 4192 - RNA, 62 nt, Human
gugguucccaguauuaacagucgugcaguuggccaacguacgugaggugugcuugggacugu

SEQ ID NO: 4193 - RNA, 62 nt, Human; identical to SEQ ID NO: 1277

SEQ ID NO: 4194 - RNA, 62 nt, Human
uugaugacuaaagaaaccugcugcacaucaaugccucuggccagcaggucagugguaaucaa

SEQ ID NO: 4195 - RNA, 67 nt, Human
uugguccauaucuccaugcauggcggauacagugaaaucucgagcaugcaucuucucggugagccag

SEQ ID NO: 4196 - RNA, 93 nt, Human
gcuuguguuaguuucagggagggguguauauuuugauaaaaaaaauacuugacuuuguaauucuguauauucuauaccaauuuauagccgggc

SEQ ID NO: 4197 - RNA, 81 nt, Human
uuauauguggauauuuuuuaaguggacuuguaugcugauaauucuagaccaaaguaaauauggcagaauauuuauacauga

SEQ ID NO: 4198 - RNA, 78 nt, Human
uugaauugauaauuagaauauugaauaagcaauccuaugauccacuaauuuguuuuaucaguuaauaauauuaaucaa

SEQ ID NO: 4199 - RNA, 64 nt, Human
aggggaggggaugucucaccgggcugggggugagaauccccaaccccagggacuccccuucccu

SEQ ID NO: 4200 - RNA, 60 nt, Human
gguccugcugugccagaaacccuuaagaaaaagcgaaggaauuucgcagagcugaagauc

SEQ ID NO: 4201 - RNA, 70 nt, Human
agcugcggggccacccuccgggcagaucgguaauagagcccuccgucuggugggaugcgcacccccugcu

SEQ ID NO: 4202 - RNA, 128 nt, Human
cccccugcugccuguggaaaaugcgggggccauacauggugacgcgcugcaccuccauucaagccaagcugcagaagcaccguggaccuggccaaggccguucugcuggagaaaaggcaugcuggggg

SEQ ID NO: 4203 - RNA, 86 nt, Human
ccuggugucccucgacucugacagugauggggagcugggauccagauacuccuccggguauucaucugcagagcaggugaaccagg

SEQ ID NO: 4204 - RNA, 61 nt, Human
gacucuucagggaaaaggucagugaaguuuaacaagggcuauacugcucuuagccagaguc

SEQ ID NO: 4205 - RNA, 76 nt, Human
gcgacgcggagcccagcgggcgcgcgugcgguugucuaccccgugacgcggcccagcggggcucgggaccgcgcgc

SEQ ID NO: 4206 - RNA, 113 nt, Human
aguagguuaccauuuugaggcaguuggauauaaauuauguaaauauguaugauuaugauuuuuauaaauggcauaacaugaguguacuaacuaccuucuaugcuggccaugcu

SEQ ID NO: 4207 - RNA, 75 nt, Human
gauuuucuggagguaugacaauaguauuuuuuuaugcucagauuaaaaaucagcuuuucaccucuccaguuuuuc

SEQ ID NO: 4208 - RNA, 64 nt, Human
gcugaacuuggauuucuaguucaugaagaaaucucucccaauacccauuuauccuauuuuuagc

SEQ ID NO: 4209 - RNA, 64 nt, Human
ucuuuaaaaaguuaaauguuuuuuuaaucuucaagaaaucaugcuacacuuaacuucuccuaga

SEQ ID NO: 4210 - RNA, 89 nt, Human
agaaauaucgccuuacccuuugugauuaaugguacaaucauaauagauaugaugaauccaaacguggugagggggaggucuuuauaucu

SEQ ID NO: 4211 - RNA, 84 nt, Human
aucuacugggcgccugucacccaggaacucuacuggcagauuggcauugaagaguuccucaucggcggcaggccuccggcuggu

SEQ ID NO: 4212 - RNA, 94 nt, Human
gccccgucuucagcgucuaccucagcaaccagcagggcuccagcgggggagcgguugucuuugggggcuguggauagcagccuguacacggggc

SEQ ID NO: 4213 - RNA, 64 nt, Human
gacaacuguccuuagugugagaaaauguccagauuucucauccucuggccaauggaagguuguc

SEQ ID NO: 4214 - RNA, 66 nt, Human
guggagguucaaagagaauguggaagauggccgagcaaguaucuaucaaucugucguuaccaacac

SEQ ID NO: 4215 - RNA, 83 nt, Human
caguguguguggcagucagaaaaacccauaucuaguuuucaacuucaccucugguguuuuuauggcuuaaccuuauaucauug

SEQ ID NO: 4216 - RNA, 62 nt, Human
acagacauaucuaggagcccugaauagaggcgcagucugccucaccuccugaaugaagcugu

SEQ ID NO: 4217 - RNA, 78 nt, Human
cacaggguggcuugacaaauauuaacuugguuccccagcaauaaacugagucuuccagggucaagucauugccuucug

SEQ ID NO: 4218 - RNA, 72 nt, Human
uaguaauuuagaggugauucauuaaauuaauagauuauuauuauuuucuacaauaguuauucugaauuacug

SEQ ID NO: 4219 - RNA, 86 nt, Human
uuuaaagaauaauuuggaaaauuuuaaacuaauacuuauuaucaaguaauaaagucaucaaaaauuaccagaaauaauucuuuaag

SEQ ID NO: 4220 - RNA, 64 nt, Human
gagagaaaaggggaggaugccacuggagucauccucuucaaugccacuauccuucccaucucuc

SEQ ID NO: 4221 - RNA, 68 nt, Human
gcuggauagucuggagcagcuuagugugucuggggcagaccgaccaccuucuaucuuugagugccagc

SEQ ID NO: 4222 - RNA, 93 nt, Human
uguauucuucacugguuugccaauuggucagguccccagcgugaacguuuccuagaggaccuggguagcuaaggcagugccagaaaaauuaca

SEQ ID NO: 4223 - RNA, 63 nt, Human
gaaugagcugcuaaauccugaagaugaccucuuaccagggaagauucgagacagcaaucguuc

SEQ ID NO: 4224 - RNA, 92 nt, Human
ggugucacagagguugaaguuaauaaguuuccagugguugcagucaugucaacagggaaugagcugcuaaauccugaagaugaccucuuacc

SEQ ID NO: 4225 - RNA, 100 nt, Human
ucaggaacaugguuaccccacgaucaacuuggguauuguaggagacaacccagaugacuuacucaaugccuugaauugagggguauucagucgugcuuga

SEQ ID NO: 4226 - RNA, 65 nt, Human
aaaggagggauaaauacugaagggauuuacuaaacaaauguccaucacagaguuuuccuuuuuuu

SEQ ID NO: 4227 - RNA, 79 nt, Human
aggcuggaaugaagugguaugaucucaguugaaugcaaccuccaccuccuagguucaagcgauucucaugccucagccu

SEQ ID NO: 4228 - RNA, 70 nt, Human
ggaaaaugggagaugauuaagaguugguguggccuagucacaccaaaauguauuuauuacauccugcucc

SEQ ID NO: 4229 - RNA, 81 nt, Human
gcaugauggugaaacggugaccaggacaccucggucuggcuaacaaggguucuaaaaacuuggacacggugccgucaacgc

SEQ ID NO: 4230 - RNA, 73 nt, Human
ucaucuuuguccuuaaauuaaccuuugcucuugagagcaaaagagggaaagacaggggaacaucaaagcauga

SEQ ID NO: 4231 - RNA, 74 nt, Human
uccauucuuaaaaucaagcacaaaaucugacaaugaaacauauccagggguuguguguccccaucugaucugga

SEQ ID NO: 4232 - RNA, 61 nt, Human
ucugaaaacuacaccgcuguggcccagacugugaaccugcuggccgaguggcucauucaga

SEQ ID NO: 4233 - RNA, 69 nt, Human
ugaagaaggagagaccccagcguggcuggaacagaugauugcacauaccacguggcgggaccuuuuuua

SEQ ID NO: 4234 - RNA, 78 nt, Human
ccuuacagugagggcuauacaugguagccaguugaauuuauggaaucuaccaacuguuuagggcccugauuugcuggg

SEQ ID NO: 4235 - RNA, 84 nt, Human
gacuuugguagacacaggcauuggcaugaccaaagcugaucucauaaauaauuugggaaccauugccaagucugguacuaaagc

SEQ ID NO: 4236 - RNA, 67 nt, Human; identical to SEQ ID NO: 3353

SEQ ID NO: 4237 - RNA, 65 nt, Human
cugcggcccgugcgcacccgcgagcucagcacguaguugggguccaggucgucgccgcccugcag

SEQ ID NO: 4238 - RNA, 72 nt, Human
gacuuauuucuucuuggacacacccacggugcggccacggcggccaguggucuugucgaagaggaagugguc

SEQ ID NO: 4239 - RNA, 81 nt, Human
gagcgcguaguaucggcccgccaggucgccguccaggcuggacagggcuuccaccgcgagcuucucgauggcgcggcgcuc

SEQ ID NO: 4240 - RNA, 82 nt, Human
gccacguguugcucagacagggugugcugggcaucaaggugaagaucaugcugcccuggggaaccaacugguaagauguggc

SEQ ID NO: 4241 - RNA, 71 nt, Human; identical to SEQ ID NO: 1145

SEQ ID NO: 4242 - RNA, 66 nt, Human
cgaaucugugcgcguagagcguccguccagcaggcuugacuggugaugacggcgucgcagcauucg

SEQ ID NO: 4243 - RNA, 74 nt, Human
cuguaucgauaugguuccuuuuccgucaccacuggacauuguccaggguauugaaagugccugagauccugcag

SEQ ID NO: 4244 - RNA, 88 nt, Human
ggcuagugccagccugugcauacccaguccagccuguccagcugguucugcacagauacugaaugggugugucggggacauacuggcc

SEQ ID NO: 4245 - RNA, 68 nt, Human
ggcuugauaccaacagccuggcaguggucagaagccagcuuaucauugccuggucaaggaagcaggcc

SEQ ID NO: 4246 - RNA, 61 nt, Human
ugagcugacuguguccugccaaggcaguggcugcccaaggaagccugcauaggagaucuca

SEQ ID NO: 4247 - RNA, 68 nt, Human
ugggcaggguccgcugaucgugggcaucuugcugguguugauggcuguggucuaugcaucucugaaua

SEQ ID NO: 4248 - RNA, 60 nt, Human
uaauuuaacucuauguuguccgccguguagacauccgaggucauuuguugcguugaauua

SEQ ID NO: 4249 - RNA, 66 nt, Human
ggccgggcagcauucuggggcuuguaacacuugguuggugggcgagagccagcaggagguccggcc

SEQ ID NO: 4250 - RNA, 82 nt, Human; identical to SEQ ID NO: 1766

SEQ ID NO: 4251 - RNA, 69 nt, Human
acaucuuuggaaaugaugagauuauuuccuguguuaaaaaaaaaaaaaaucuuaaauuuccuacaaugu

SEQ ID NO: 4252 - RNA, 82 nt, Human
ggcagucuagaauaccagaaacaucuacuuggguagcuuggugccauuauccuguggaaucugauaugucugguagcauguc

SEQ ID NO: 4253 - RNA, 80 nt, Human
uccugauguuugggacagcguaucuguaccagugcucuaaauaacaaaagcuagggugacaaguacauguuccuuuggga

SEQ ID NO: 4254 - RNA, 69 nt, Human
cuucaggaaccuggccucggaauccaauggaaagaccaggacauugagaaucuguaccaaaaccugggg

SEQ ID NO: 4255 - RNA, 66 nt, Human
ggacucaguggccuuugaggauguggcugugaacuucacccaggaggagugggcuuugcugagucc

SEQ ID NO: 4256 - RNA, 100 nt, Human
acagccuaagcugagugugaccccagaagccacgaugugcucuguauccagaacacacuuggcagauggaggaagcaucugaguuugagaccauggcugu

SEQ ID NO: 4257 - RNA, 66 nt, Human; identical to SEQ ID NO: 3876

SEQ ID NO: 4258 - RNA, 76 nt, Human
uggucccuaaaacccaucugaugucugaaucugaauggaggaaucuuggcguucagcagagucagggaugggucca

SEQ ID NO: 4259 - RNA, 73 nt, Human
agcacgcuacaacgggcaucgcuggacuagcaacuuguccugcuaucccucaaugugacgcagugagcgugcu

SEQ ID NO: 4260 - RNA, 99 nt, Human
aggcacugagcgcgaguuccugaggccuugugaugacugccuguugaagaucaccaaguccgacggcauccggggccuguaccagugccuucagugucu

SEQ ID NO: 4261 - RNA, 60 nt, Human
ggcuaguagaggcgguguguaucggccgaggcgucuccggcugucuaccguuccgcugcc

SEQ ID NO: 4262 - RNA, 68 nt, Human
gcugcuggggagcagagagggacccucuaucgcuggcuucagggggugccuugggucccuucaguagc

SEQ ID NO: 4263 - RNA, 77 nt, Human
gggcgugagugcaggaagcacauuuggcuuggcaggagcugucaggaaggggaagcggguuuccugcgauucugccu

SEQ ID NO: 4264 - RNA, 115 nt, Human
uccccugggcuggccuggcugacggcagcugcaaggggaugcgcacugcaggaggaccuggguggugcuauacuucacagcagcagcaaaagaggucagcugacagccuggugga

SEQ ID NO: 4265 - RNA, 77 nt, Human; identical to SEQ ID NO: 1216

SEQ ID NO: 4266 - RNA, 74 nt, Human
uagaaacaugcuugccuuauguaucagaggacaugcucagcagauccaagagauauauuuggcaacuuuuucua

SEQ ID NO: 4267 - RNA, 60 nt, Human
ccaucacggacuuccugggaaaaucagauccauuucuggaguucuuccgccaggugaugg

SEQ ID NO: 4268 - RNA, 62 nt, Human
ucagagucuccuaaagagcccgaacagcugaggaagcucuucauuggaggguugagcuuuga

SEQ ID NO: 4269 - RNA, 71 nt, Human
uugucacauaugccacuguggaggagguggaugcagcuaugcaugcaaggccacacaagguggauggacag

SEQ ID NO: 4270 - RNA, 92 nt, Human
acccgucccugauccuggccgcaggcacagaugcccgcuuaccaggagcuggguggaggaggcgauugccuauggccggaagcugggcgggu

SEQ ID NO: 4271 - RNA, 66 nt, Human
gcgcagaccccucggucuugcuaugucugagcucacccgugaagcgucagaggauggaguccgcgc

SEQ ID NO: 4272 - RNA, 62 nt, Human
ggccgaguauccaucagaaguagacgcaaggucucuccuuugauaaagaugcgaugguggcc

SEQ ID NO: 4273 - RNA, 60 nt, Human
gugccgaggcgggugugacccucaucuccccauuuuguugggcgcauccuugauuggcau

SEQ ID NO: 4274 - RNA, 62 nt, Human
gugguggccgacacgggcgacuuccacgccaucgacgaguacaagccccaggaugcuaccac

SEQ ID NO: 4275 - RNA, 71 nt, Human
gggguggaggggguggugcuggugcugcacugggcugacugcggcgcugacgcagcguuuccccccauccc

SEQ ID NO: 4276 - RNA, 82 nt, Human
uaucugcaggguccuuuccauuccuauuuagagggaguccuggcuccaugacccccucccgaguggacuguccaagcagaua

SEQ ID NO: 4277 - RNA, 65 nt, Human
ugugucccagcuaguucacuccuuucgccgugcgugguggaggcuggccucucuggcugggugca

SEQ ID NO: 4278 - RNA, 65 nt, Human
gcucuucucgcggauccaguguuccguuuccagcccccaaucucagagcggagccgacagagagc

SEQ ID NO: 4279 - RNA, 81 nt, Human
uacgcggcgcagcgcggcaguccugauggcccggcauggguuaccgcugcugccccugcugucgcuccuggucggcgcgug

SEQ ID NO: 4280 - RNA, 87 nt, Human
ugucucugaugagcugagaaacaaagccacccagccaaugaagucuguacucugguggcuuccaguggaaaaggcauuuuggaggca

SEQ ID NO: 4281 - RNA, 64 nt, Human
gaugagccccagccuagccugcuccaaagccacugacacaugcauguuuagcccuuggcccauc

SEQ ID NO: 4282 - RNA, 65 nt, Human
gauggggcccugggaaugaacuggcugcagacccuccuccaucccacacccccaggggcuccauc

SEQ ID NO: 4283 - RNA, 102 nt, Human
gaggugguggugcagagacucuuccaggucaaagggcggcgugugguccgugccaccgagguaccuguguccugggagagcuucaacaauggcgacugcuuc

SEQ ID NO: 4284 - RNA, 89 nt, Human
gcggaguggccgggcccgagugcacgugucugaggagggcacugagcccgaugcgaugcuccaggugcugggccccaagccggcucugc

SEQ ID NO: 4285 - RNA, 81 nt, Human
gcuucgagucggccaccuuccuaggcuacuucaagucuggccugaaguacaagaaaggagguguggcaucaggauucaagc

SEQ ID NO: 4286 - RNA, 79 nt, Human
ggagcgugcucgaccuuucucuccaguggagauuugccaaccugcccaacaaugccaagcuggagauggugcccgcuuc

SEQ ID NO: 4287 - RNA, 77 nt, Human
cucuuugaagcguuuuccaacaguauagaucucaugaaucaaauccuccaugcagaugaugccguauuuaccaagag

SEQ ID NO: 4288 - RNA, 76 nt, Human
gagcaaucaaagcguuaucugucaaagcaauucgcuucuuauugauuuugccauaaccacgcuuguagauuaguuc

SEQ ID NO: 4289 - RNA, 64 nt, Human
gaucguggcuggacuggagaagaugccugcccgccgggcuuccuuaucccaccccagagacauc

SEQ ID NO: 4290 - RNA, 93 nt, Human; identical to SEQ ID NO: 3702

SEQ ID NO: 4291 - RNA, 66 nt, Human
auuuuauuauacuuaaaugaacucaaguacaagaaacaaaguuaaaauauguaaguauaauaaaau

SEQ ID NO: 4292 - RNA, 72 nt, Human
cggcucccaauguugacguuggccagggccuuugcaaacaagccaggccaaaaaggcucaacauuuacaccg

SEQ ID NO: 4293 - RNA, 73 nt, Human
gcaguggagggggcaggaccuccugcuggugcagcaccagcugcuggagcagguccaccggccccuacauugc

SEQ ID NO: 4294 - RNA, 129 nt, Human
aggcugacacucucaaaggucuucucggauggaagucuccggcuccagucgucuguccacuaagcgagaggcgaguugcgagggaggcugcgggggcgggcggacguauguugagacccuaugcagccu

SEQ ID NO: 4295 - RNA, 85 nt, Human
gaguugcgagggaggcugcgggggcgggcggacguauguugagacccuaugcagccuccugcucucccgagggcuccugcggcuc

SEQ ID NO: 4296 - RNA, 60 nt, Human
cgccugccagcuggagcuauucacuuccagcgugaaagggagggacucacagcugcaggg

SEQ ID NO: 4297 - RNA, 68 nt, Human
gcugcuucugggacuccuguuacccgcaagucugaccggcggugucgggagccugaaccuggaggagc

SEQ ID NO: 4298 - RNA, 62 nt, Human
uaaauuucaacuaaugcaauagacuuaaaauauagccuauggaauacugugauugaaguuug

SEQ ID NO: 4299 - RNA, 66 nt, Human
gguucugguguuuggcgucggaauuaaacaaccaccaugucgagcaaaaaggcaaagaccaagacc

SEQ ID NO: 4300 - RNA, 80 nt, Human
augggggccuccuuaaauacacaccagcagucaaguggaggaaaacuugaacaauaaugagucgcuucuugggucucuau

SEQ ID NO: 4301 - RNA, 81 nt, Human
uaagcuauauauauaauauaauuacauauauaugcacauguauauauaguguguacauauauguguguauauauauacuua

SEQ ID NO: 4302 - RNA, 89 nt, Human
ucauauuacaaacugcucuuccauauuuauguaccauauuauaccuuuuaauuaugguaaauaauauaaugggaauucuaauaauauga

SEQ ID NO: 4303 - RNA, 77 nt, Human
cccagaaacuuucaggagaggcaagcagauucacugacccccacguguaucuuuauguguaaugaagguuuuauggg

SEQ ID NO: 4304 - RNA, 78 nt, Human
ggcauucuuuugaaaugugcaacaaaauaaaaaccucugaaccuguuuugacacugcaaacucaguggaugacaugcc

SEQ ID NO: 4305 - RNA, 68 nt, Human
gugugcacagaugaacgaaguuauggcagaguuagcuaaagaacucccucaaguuucauuugugaagc

SEQ ID NO: 4306 - RNA, 131 nt, Human
ugaaccuguuuugacacugcaaacucaguggaugacaugccagcccauuggaagcugaagguguuccugaaguaucugaaaaauaugaaauuagcucuguucccacuuuucuguuuuuucaagaauucuca

SEQ ID NO: 4307 - RNA, 100 nt, Human; identical to SEQ ID NO: 698

SEQ ID NO: 4308 - RNA, 60 nt, Human; identical to SEQ ID NO: 2705

SEQ ID NO: 4309 - RNA, 72 nt, Human; identical to SEQ ID NO: 1989

SEQ ID NO: 4310 - RNA, 89 nt, Human
cccgggauccacgggaggcggcggccgcagccuggagauuccccagggacccccccggagccgccgcgucucccauggacuugcccggg

SEQ ID NO: 4311 - RNA, 130 nt, Human
gccucugacucgagcauuauggggagccaggagcccgaaacggccgagugcugcagcucccgggggccccuucuccccuggaaaaggccucucggcggguccuggccguggugcuagaagaugucauggc

SEQ ID NO: 4312 - RNA, 74 nt, Human
ggagcuccagcgucaaaucgcucagccaggagaugagaugcaccauccggcugcuggacgacucggagaucucc

SEQ ID NO: 4313 - RNA, 63 nt, Human
ggcgagcaccgcgccggcccugagccucccgcucgcuccccacggccgcggugcauguucgcc

SEQ ID NO: 4314 - RNA, 92 nt, Human
guguguccgcaggcgcccgacgcugccgaugucccggggcugagccgcgcccaggugucccggacagugcgugcgagcguguguguccgcgc

SEQ ID NO: 4315 - RNA, 82 nt, Human; identical to SEQ ID NO: 705

SEQ ID NO: 4316 - RNA, 75 nt, Human
ugcuaugaacacuaugggaucaggcugcccaagaaggggaagccugagccaaaccaugaguggacauuauuggca

SEQ ID NO: 4317 - RNA, 99 nt, Human
uuaaaaaaaucugaguaauugucaaauauuaaaagaaagauauucuuccuguaaggaauacaguuuuuagucaaaguggccauuacauccucuuuuuaa

SEQ ID NO: 4318 - RNA, 76 nt, Human
uugagaaaguuguugugguguuguaugccaagaaaauucuuuuuauuggugccuauauuguaacaauuauuuuuaa

SEQ ID NO: 4319 - RNA, 61 nt, Human
gagcuuaagugaaggcaguuuuuauggcguuuguaguaaauucuguaaaauacuuugguuu

SEQ ID NO: 4320 - RNA, 70 nt, Human
gccccaacguggggaugcgcauuccacacgguggaacaggcaccacagaaagguugggcgacguuggggc

SEQ ID NO: 4321 - RNA, 75 nt, Human; identical to SEQ ID NO: 74

SEQ ID NO: 4322 - RNA, 77 nt, Human
gcccccgguaucauuccucgaauuucagugcgggaaccaaugcagacuggcauuaaggcuguggauaagcugggugc

SEQ ID NO: 4323 - RNA, 87 nt, Human; identical to SEQ ID NO: 76

SEQ ID NO: 4324 - RNA, 71 nt, Human; identical to SEQ ID NO: 77

SEQ ID NO: 4325 - RNA, 65 nt, Human
ugguuaacaguaacagcagcacagacccaaacuugauaaaacuuugggacuuguuauuuggacua

SEQ ID NO: 4326 - RNA, 86 nt, Human
uuuguauuuuugagacuggaaacugauaaaaauuucugauuaggaaacuuugagaauagagucuuucuucuuuccaaaauaacaaa

SEQ ID NO: 4327 - RNA, 75 nt, Human; identical to SEQ ID NO: 74

SEQ ID NO: 4328 - RNA, 87 nt, Human; identical to SEQ ID NO: 76

SEQ ID NO: 4329 - RNA, 73 nt, Human
guggucugaaagcccccgguaucauuccucgaauuucagugcgggaaccaaugcagacuggcauuuaggcugu

SEQ ID NO: 4330 - RNA, 71 nt, Human; identical to SEQ ID NO: 77

SEQ ID NO: 4331 - RNA, 75 nt, Human; identical to SEQ ID NO: 74

SEQ ID NO: 4332 - RNA, 67 nt, Human; identical to SEQ ID NO: 836

SEQ ID NO: 4333 - RNA, 87 nt, Human; identical to SEQ ID NO: 76

SEQ ID NO: 4334 - RNA, 71 nt, Human; identical to SEQ ID NO: 77

SEQ ID NO: 4335 - RNA, 75 nt, Human; identical to SEQ ID NO: 74

SEQ ID NO: 4336 - RNA, 87 nt, Human; identical to SEQ ID NO: 76

SEQ ID NO: 4337 - RNA, 71 nt, Human; identical to SEQ ID NO: 77

SEQ ID NO: 4338 - RNA, 65 nt, Human
ggggacucagaaagggaagcagagugggcuguugaugucuggaaagcucccucaccagagugccc

SEQ ID NO: 4339 - RNA, 96 nt, Human
gugggucacacagcaucaugggggaugagcuggggcuggagucggcuguaucugacaccagacccuccauucaagcucccuugaugaaacgcccac

SEQ ID NO: 4340 - RNA, 83 nt, Human
agaugugggaugucaguacuggcaugugccuuaugacccucgugggucaugauaacuggguacguggaguucuguuccauucu

SEQ ID NO: 4341 - RNA, 68 nt, Human
agcaacaaaggaaugcaaggcugagcuccgagagcaugagcaaugugguagaaugcauuuccugggcu

SEQ ID NO: 4342 - RNA, 73 nt, Human
ucucugaagcaacaggaucugagacuaaaaaaagugguaaaccugggccauucuugcugucuggauccagaga

SEQ ID NO: 4343 - RNA, 75 nt, Human
agucccggcggcggcccagccucaguuccagcgccaacgccagcaccggcugcggcuccgguucccgcugcggcu

SEQ ID NO: 4344 - RNA, 83 nt, Human
ccgcccuggcccaccgcugucaacauggcccgcgccgcccgcgaccuggcugauguuagcagcccgggaggccgaacgggagg

SEQ ID NO: 4345 - RNA, 77 nt, Human
gcugggcuuggcugcugcaccaugacccuggaggcgauccgcuacucgcggggcucccuggcagauccuagaccagc

SEQ ID NO: 4346 - RNA, 95 nt, Human
gcuugucucaugccucgccguggagcugcagugcuggugcgccuggggugaccugggacucgccugcugcucuguggccuucgugcgcgacaagc

SEQ ID NO: 4347 - RNA, 67 nt, Human
gagaacaucaaugguguaccgccucauuugggacaucccuuccacuggggugggcaugagcguucuu

SEQ ID NO: 4348 - RNA, 64 nt, Human
ggccagguucucgcucuggucgugucugucaaaccggcacggucugaucgcggaaauuauggcc

SEQ ID NO: 4349 - RNA, 85 nt, Human
ggacucuauagaggggcacgccggggcuauuuaggacuaucaguuggcgaauuuuccuggggacucccuuuuaguacuggagucc

SEQ ID NO: 4350 - RNA, 67 nt, Human
auggagaggaggagguggagacuuuugccuuucaggcagaaauugcccaacucaugucccucaucau

SEQ ID NO: 4351 - RNA, 81 nt, Human
cuuugguagacacaggcauuggcaugaccaaagcugaucucauaaauaauuugggaaccauugccaagucugguacuaaag

SEQ ID NO: 4352 - RNA, 73 nt, Human
guggauucgugugugugugugugugugugugucuuguauaugugugcgcagagugcaucauuucagacucuac

SEQ ID NO: 4353 - RNA, 78 nt, Human
guggggcagaggccaggaggggaccuggugugucaccuggcccacagcuggucaucccucaggccacccugacccuac

SEQ ID NO: 4354 - RNA, 78 nt, Human
gaggagcggagcggcacagccucccacccucccggcugguguuagugcccggacggcgggcucugcgcuccgccccuc

SEQ ID NO: 4355 - RNA, 66 nt, Human
guccccggcagcgguuggcgaguggggaccgaacccccgguucuccaugaucccgcuggccggggc

SEQ ID NO: 4356 - RNA, 76 nt, Human
uuccgcugugaggaucugcccgaccugcacgaauacgccucgauaaacagggccgugccgcagaugcccaccggaa

SEQ ID NO: 4357 - RNA, 73 nt, Human
agaagugaucguuccagcauucuuggccuaggcuuauugccagcgcaaauauaagaugacugaaugaaacucu

SEQ ID NO: 4358 - RNA, 66 nt, Human
gggauguugcaugccauuggauuuugaagcucuaagugaguucaaugugcugugccaugacaugcc

SEQ ID NO: 4359 - RNA, 88 nt, Human
ggccuaaagaggacugugcauuuuugcuauuuaaaggaaucacaaaugaucauacuuaagugagcaaaauugacaaguuuuacuagcu

SEQ ID NO: 4360 - RNA, 94 nt, Human
aggcagggcagugcccagcuccauguaaguccaucugucugggucccugagacccaagaugcagcaguguguggagcagggggccgcccugccu

SEQ ID NO: 4361 - RNA, 66 nt, Human
ugcccugcagggacugcagcugcagagacccaccgagguacuccgcguaggcccgugacgugggca

SEQ ID NO: 4362 - RNA, 64 nt, Human; identical to SEQ ID NO: 1375

SEQ ID NO: 4363 - RNA, 61 nt, Human; identical to SEQ ID NO: 2204

SEQ ID NO: 4364 - RNA, 129 nt, Human
cgcugacgccguguuuccucuuucggccgcgcuggugaacaggacccgucgccaugggccgugugauccguggacagaggaagggcgccgggucuguguuccgcgcgcacgugaagcaccguaaaggcg

SEQ ID NO: 4365 - RNA, 113 nt, Human
agguaggaaugagguauagaaaagagauagcaucuucuuuggcacaagacuaguggcuuaccgcuuaccuuagaguuuuguuuuuuuuuuuucaaacccaucaaaaucuacuu

SEQ ID NO: 4366 - RNA, 60 nt, Human
cuagcccaucauuaccugugaacugcaguggggcagucauggcaaauagaauugggcugg

SEQ ID NO: 4367 - RNA, 84 nt, Human
cggggaggguggagaaaucaucguuacagacauggacaccauugagaagucaaaucugaaucgacaguuucuuuuccggcccug

SEQ ID NO: 4368 - RNA, 63 nt, Human
gaugucacgaaguuaaagucugacacggcugcugcagcugugcgccaaaugaauccacauauc

SEQ ID NO: 4369 - RNA, 88 nt, Human
ggcaggcacucagcccuuggaggugcuggaggcugugcagcgcagccuggugcugcagcgaccacagaccugggcugacugcgugacc

SEQ ID NO: 4370 - RNA, 68 nt, Human
ccuaacuauccaggagaucgcugcgcuggccagguccucccugcaugguauuucccagguggugaagg

SEQ ID NO: 4371 - RNA, 115 nt, Human
gguguggggaagcauuaaaggacugacugaaggccugcauggauuccauguucaugaguuuggagauaauacagcaggcuguaccagugcagguccucacuuuaauccucuaucc

SEQ ID NO: 4372 - RNA, 70 nt, Human; identical to SEQ ID NO: 4086

SEQ ID NO: 4373 - RNA, 77 nt, Human
gaucaauuuuaucaaucuuuucagagaaucaacuucuagcuuugcugauuuucucuauuauuuguccuuuauugauu

SEQ ID NO: 4374 - RNA, 65 nt, Human
uuacuguuuuuucuauguuugauauaccguuguguuacaauugccaaugguauucaguacaguaa

SEQ ID NO: 4375 - RNA, 81 nt, Human
gggcuguggugucuguccgcuuucaggaagacauuauuucaauauggaauaagacugccagugaccaagcaaccacagccc

SEQ ID NO: 4376 - RNA, 70 nt, Human
guggcaaguggauuauucggcugcggaagggcuuggccucccguugcugggagaaucucauuuuggccau

SEQ ID NO: 4377 - RNA, 90 nt, Human
accucagcuggagcuggccauggugccccacuaugguggcaucaaccgaguucgggugucauggcugggugaagagccuguggcuggggu

SEQ ID NO: 4378 - RNA, 62 nt, Human
cccaggcugagagcgcccagagcaacagacugaugaugcuucggaugcacaaucugcauggg

SEQ ID NO: 4379 - RNA, 80 nt, Human; identical to SEQ ID NO: 174

SEQ ID NO: 4380 - RNA, 66 nt, Human
uuucggcgcugggucgcccaaagcaaaauggaaacggauagagugguggcucccagaaucccgaag

SEQ ID NO: 4381 - RNA, 79 nt, Human
aagggcaaagcaaagugagaaacaguuaccugggcaauucagaugccagauaacuggccccgauuucugcuucguccuu

SEQ ID NO: 4382 - RNA, 86 nt, Human
agacagagagaaaaguaacggguugauguuugacucucucagcauuuugagucuggcuucccaauuccugacuugacuuuuugucu

SEQ ID NO: 4383 - RNA, 95 nt, Human
gcagacugcuccagugucuccaucgaggcugggggacagcugcugcccccacuggagacagcggacuguccuucaguagaagacagguggucugc

SEQ ID NO: 4384 - RNA, 65 nt, Human
gucuggguguagugucauuuuaaguauuuggggugggaugagggagagagagcagcuccacagac

SEQ ID NO: 4385 - RNA, 78 nt, Human
uaucuucuuucauuauggagggagguuuggcagauggagaaccugaucgaacuucgcuucuuggugauagcaaagaug

SEQ ID NO: 4386 - RNA, 99 nt, Human
cugcuccaaggccuggccacaugcagacaggaggaagcugagcucgacauuaggccucaaggcugccaucugucuuguagggccuggccuugugggcag

SEQ ID NO: 4387 - RNA, 74 nt, Human
gcauccucuccaccugauuccaaaugcuguugguggcuggcccugccuccgaugcagggggggugggggggggc

SEQ ID NO: 4388 - RNA, 89 nt, Human
gggaggucacacugcccgucggaccuuggcaugcuccauucagcugaccugcugaggacaggcaucgccgagacuccuuggguccuccc

SEQ ID NO: 4389 - RNA, 78 nt, Human
ccgugaccgccaccgccacuucccagguagcccagcagccuccagccgcugccgccccuggggaacaggccgucgcgg

SEQ ID NO: 4390 - RNA, 73 nt, Human
ccucgacuguccccaugcaguaccagcaaagaccgcccagugucccagccuagccuuguggggagcaaagagg

SEQ ID NO: 4391 - RNA, 107 nt, Human
gggagccagcaagcaggaugauaucgaagagcuggagaccaaggccgugggaaugucuaacgauggccgcuuucucaaguuugacaucgaaaucggcagaggcuccu

SEQ ID NO: 4392 - RNA, 102 nt, Human
acuccggggcguuuccgggcuguucgcuccugcuuggcaaugucgcgagaaagguuuucgccuccuguuucagcggugacggcucuuggguuuucucggggu

SEQ ID NO: 4393 - RNA, 73 nt, Human; identical to SEQ ID NO: 4293

SEQ ID NO: 4394 - RNA, 95 nt, Human
gcugccggacgcggugcuagucgccggaugaagugagggccucacccccacgcagccuuagcuuucucgggaggaccgagcaccuuggcggcagc

SEQ ID NO: 4395 - RNA, 87 nt, Human
uuucagaugugcuucgcuuuugaaugucuguaucuaacuaaugagggaugcaaaauaaccaagaaguuaaaagcguaagaucuggaa

SEQ ID NO: 4396 - RNA, 76 nt, Human
ucuguguccagcccuugcagagagcuuuguccucugacaucagcuaccacacaggcucauucucaacuggcacaga

SEQ ID NO: 4397 - RNA, 75 nt, Human
gccgucggaguccaucaugggagguguggucuuguaguuguucuccggcugcccauugcucucccacuccacggc

SEQ ID NO: 4398 - RNA, 89 nt, Human; identical to SEQ ID NO: 2239

SEQ ID NO: 4399 - RNA, 70 nt, Human
ggcuugauuuguuggugaccgaauuacuagugacuaguuuacuaacuaggucauucaaggaagucaaguu

SEQ ID NO: 4400 - RNA, 75 nt, Human
uuaaacaugucaccuaaaugcacuugaugguguugaaaugugcaccuucuuaaauuuuaagaugacuuaguuuaa

SEQ ID NO: 4401 - RNA, 81 nt, Human
uuagaugucuuauuauuaaaguuaccuauuauuguggaaauaaacuaauuguauggguuuagaugguaacauggcauuuga

SEQ ID NO: 4402 - RNA, 62 nt, Human
gauuuaaauaauaugugucuuguuugcagcccugaaugcaaagaauucauagcaguuaauuc

SEQ ID NO: 4403 - RNA, 87 nt, Human
uacccagacuuaaugguauuguucuugcauuggccaaagugaaaauuuuuuuuucuuuggaaaucuaguuuggaauaagucugggug

SEQ ID NO: 4404 - RNA, 93 nt, Human
uuugacccuuuugagauggaacuuucauaaaguuucuuggcaguaguuuauuugcuucaaauaaacuuauuugaaaaguugucucaagucaaa

SEQ ID NO: 4405 - RNA, 79 nt, Human
ucuugugugagacuucgugguggugcuaagaaaaggaagaagaagucuuacaccacucccaagaagaauaagcacaaga

SEQ ID NO: 4406 - RNA, 88 nt, Human
gggcgguaaguuggauuucgaugaaccggucccugaaguugugcucccucugggacuccauccuucaucucuccaaucucaccagccu

SEQ ID NO: 4407 - RNA, 81 nt, Human
gggggcggcgcacugauuccgggccccagagaacugccuaucaguggcaggggggucaaauccuucacugcugccgcuccc

SEQ ID NO: 4408 - RNA, 72 nt, Human
aucuuuguauguaaaacuuuaacugauuucugucauucaucaaugaguagaaguaaauacauuauaguugau

SEQ ID NO: 4409 - RNA, 62 nt, Human
auugcauuuuaugcuuuaaguacgaaaggguuugugccaauauucacuacguauuaugcagu

SEQ ID NO: 4410 - RNA, 75 nt, Human
uccuagaaaucuaauuauucaguuauucaugacaauauuuuuuuaacaguaagaaauucugagugucuucuugga

SEQ ID NO: 4411 - RNA, 78 nt, Human
cgagugugugcuggagaaggccuggcucgcauggaguuguuucuuuuguugugugccauuuugcagcauuuuaauuug

SEQ ID NO: 4412 - RNA, 77 nt, Human
gcccuacauggaugacugugguggcaugagauucagcgguucaucacccucgugcccuccaaccugccccaugaagc

SEQ ID NO: 4413 - RNA, 61 nt, Human
uuccugaaugaaaauggaaaguucaaguacagugacuauuucaagccauuuuccacaggaa

SEQ ID NO: 4414 - RNA, 61 nt, Human
gguguugaagacauggauacuggggaaacaccuucugagaccaaaaugucaaaauaauacc

SEQ ID NO: 4415 - RNA, 82 nt, Human
uugugaacagauuaaggauaaauauaugcagaaucgguggugcgucuguguguguguuucuccaauccuugauccguaacaa

SEQ ID NO: 4416 - RNA, 69 nt, Human
aaggcgggguuucaccauguuggccaggcuggucucaaacuccugaccucaaguggauaugccugccuu

SEQ ID NO: 4417 - RNA, 85 nt, Human
gaauaaaagccucuugagccaaggaauuuugaagggccugcaaguauagggucugcuaagcuuccuucagcaaagggguuuauuc

SEQ ID NO: 4418 - RNA, 100 nt, Human
gugggguaaaaccccagacgcaugaaagcugcauggcccuggagaaaaagcugaaccaggcccuuuguggaucuucaugcccugggguuucugcccgcac

SEQ ID NO: 4419 - RNA, 66 nt, Human
gacuauuuaaaaacugguacaacaggucucuacaacgccaagaucuaacuaaggcuuuaaaagguc

SEQ ID NO: 4420 - RNA, 80 nt, Human; identical to SEQ ID NO: 100

SEQ ID NO: 4421 - RNA, 87 nt, Human
ugcaaauuacuuucaaauacauuuugacauuaaagucaggcaauucacuuggaagaauguuauaaugaaugucacugaauuuuugua

SEQ ID NO: 4422 - RNA, 82 nt, Human
uggaaaggagacaaaguaaaggcucacuauggaggauucacuguacagaaugaagccaacaaauaccagaucucagugaaca

SEQ ID NO: 4423 - RNA, 63 nt, Human; identical to SEQ ID NO: 722

SEQ ID NO: 4424 - RNA, 60 nt, Human; identical to SEQ ID NO: 723

SEQ ID NO: 4425 - RNA, 89 nt, Human
ccugggccugcccacucccacgcccuucaccaaugccguccagcugcugcugacgcugaagcuggugagccuggccagugaaguccagg

SEQ ID NO: 4426 - RNA, 95 nt, Human
gugcccgcccuggccccacggcagaaucagcuucuggguccaucggaggauccgagugugaauucccugcaagaacguggggagagugugggcgc

SEQ ID NO: 4427 - RNA, 66 nt, Human
agauguggcuggucggguauugacauccaagagugccuaggguguaacuaugauuauggcaaaucu

SEQ ID NO: 4428 - RNA, 71 nt, Human
gaugaggcagauaggaugauugacaugggcuugagccagauguccagaagauccuggagcacaugccuguc

SEQ ID NO: 4429 - RNA, 101 nt, Human
ugguggcaucuccagagaagaccaggcuucaggcugcgcauggguugugagauugugauugcuaccccugggcguuugauugaugugcuggagaaccgcua

SEQ ID NO: 4430 - RNA, 131 nt, Human; identical to SEQ ID NO: 1788

SEQ ID NO: 4431 - RNA, 61 nt, Human; identical to SEQ ID NO: 823

SEQ ID NO: 4432 - RNA, 61 nt, Human
ggugacaacaugcuggagccaagugcuaacaugccuugguuccaagggauggacagucacc

SEQ ID NO: 4433 - RNA, 79 nt, Human; identical to SEQ ID NO: 1810

SEQ ID NO: 4434 - RNA, 64 nt, Human
cccucccaaaggcggcaagcuccuucccgggagauggacggcagcggagccgcagaggggcggg

SEQ ID NO: 4435 - RNA, 76 nt, Human
gcguucugacgcuuuguacgcucugcguucccaugggccaggaacgcggaugggagacaacacagccucgggaugc

SEQ ID NO: 4436 - RNA, 60 nt, Human
ggugacaacaugcuggagccaagugcuaacaugcuugguucagggauggcacacgucacc

SEQ ID NO: 4437 - RNA, 87 nt, Human
caccagccgccuccaccaugccgccgaaguucgaccccaacgagaucaaagucguauaccugaggugcaccggaggugaagucggug

SEQ ID NO: 4438 - RNA, 100 nt, Human
ggcuuggugccccccggguggggguccccgggggcccccuccucagucuccuugggacccugggccuucucggggcacccccauuuuuggggccaaagcc

SEQ ID NO: 4439 - RNA, 72 nt, Human
ucaacaguggugcuguggaaugcccagccaguuaagcacaaaggaaaacauuucaauaacaggaucauuuga

SEQ ID NO: 4440 - RNA, 69 nt, Human
uuuguugccuccaaaacucauguugaaaauuaauuccuaauggcaauauugagaggugggguuuuuaag

SEQ ID NO: 4441 - RNA, 71 nt, Human
ugagagaauagcaucuuugugggggauuuuuuuuauauauauuucuagacaauaaagauuguuguuuuuca

SEQ ID NO: 4442 - RNA, 69 nt, Human
ggagcagcggcgcuugaggacccggggagacccucaagaaucgacccaucaggacgccagagcugcuuc

SEQ ID NO: 4443 - RNA, 84 nt, Human
ggggagccgccugccccuggcgcugcccccggccucccaggguugcucuucagggggcggcggcggcggcggcggcggcuccuc

SEQ ID NO: 4444 - RNA, 70 nt, Human
gcugaguaaacuauaacuguuaaacuuaaguuccagcuuuucucaaguuaguuauaggauguacuuaagc

SEQ ID NO: 4445 - RNA, 61 nt, Human
gugcuuaagggcuuccggaacggggcugucuauggagccaaaauccgggccccucacgcgc

SEQ ID NO: 4446 - RNA, 61 nt, Human
ggccuggacaacuucggggacuuugacugggucaucgagaaccauggaguugaacagcgcc

SEQ ID NO: 4447 - RNA, 65 nt, Human
gugacgcagacgguccgcguuguagcguuggagcagagccgacagcagcggggcuggguguucac

SEQ ID NO: 4448 - RNA, 64 nt, Human
uccgcuccagacuuuagucacuagguucuaggagugagcuggggccugcugagguggggguggg

SEQ ID NO: 4449 - RNA, 80 nt, Human
caggaccauagaugauacaugucagugcuguggaaugugcauucucugaguguuguuuugugguaucauugucuuuccug

SEQ ID NO: 4450 - RNA, 62 nt, Human
guuugaucugucagccaguacucccauuaaauucaguguaguuucacuugauagaaucagau

SEQ ID NO: 4451 - RNA, 67 nt, Human
uguuagcagcagcuucauccuccuucugauuaaaguaaguagaaaugggauguuuuguuuaauaaca

SEQ ID NO: 4452 - RNA, 64 nt, Human
gauuucauacuggagagaaaccuuacaaaugugaagaaugugacaaagcuuucaguuucaaauc

SEQ ID NO: 4453 - RNA, 64 nt, Human
ggugucagcgcugucgggggccacggccggcauccucggccucaccggccucuacggcuucauc

SEQ ID NO: 4454 - RNA, 109 nt, Human; identical to SEQ ID NO: 831

SEQ ID NO: 4455 - RNA, 75 nt, Human; identical to SEQ ID NO: 74

SEQ ID NO: 4456 - RNA, 87 nt, Human; identical to SEQ ID NO: 76

SEQ ID NO: 4457 - RNA, 64 nt, Human
uguguccuccaccaugcacucaccccuagcccugguuagcugacagucagcuguggggaacaca

SEQ ID NO: 4458 - RNA, 99 nt, Human
ggucguccagggagaacuuccuuuccagggcuccauccuccagguaucggaauuccguauggguccaggguggaaaacuucucuagaauauaggcagcc

SEQ ID NO: 4459 - RNA, 67 nt, Human
cgguggcuccacaagcgcguaacacggccgcggcggcgcccugccgacccgcgucuuuguggccccg

SEQ ID NO: 4460 - RNA, 65 nt, Human
gcccagguucacaagugugcaucuuuuggcuucggcgacccuuugcgcaaacacaccaccugggc

SEQ ID NO: 4461 - RNA, 66 nt, Human
ggccaucugaucuauaaaugcgguggcaucgacaaaagaaccauugaaaaauuugagaaggaggcu

SEQ ID NO: 4462 - RNA, 60 nt, Human
ggugacaacaugcuggagccaagugcuaacaugccugugguucagggauggaaagucacc

SEQ ID NO: 4463 - RNA, 77 nt, Human
gcgcccccuuggcgccggguguccugccgcugcuugcgcagcggcccuuguuucuucuuacccguuguuaggggcgc

SEQ ID NO: 4464 - RNA, 87 nt, Human
ggagcagauacgguauuuacaugaggaauuccagaguccuggucagcuccagguuggcugaaggcuugaugucgacugaugugaucc

SEQ ID NO: 4465 - RNA, 69 nt, Human
ugaaugaccgggcggggguuauaguacgaacuugacuggccgucguuuuacaccugcguaugucguuca

SEQ ID NO: 4466 - RNA, 75 nt, Human
ugguggaaaaggguguauugacaacagagaaacagaacuuccuacuuuuugacaugacaacacauccccucacca

SEQ ID NO: 4467 - RNA, 82 nt, Human
gagcauuguuuuucucuagauaauuuuauauuuuugaguauaccccacuuccaaguguuuuuuguuuuguuuugcuuuguuu

SEQ ID NO: 4468 - RNA, 64 nt, Human
agccauggccaguacagugguagcaguuggacugaccaugcugcugagggauugcaggccgguu

SEQ ID NO: 4469 - RNA, 61 nt, Human
guaauguauaugagguacuaagcuuuuauaaauaaaauggcucagagcuacaauuuauuac

SEQ ID NO: 4470 - RNA, 94 nt, Human
cugagucagcgcacgaucacugucgggguguacgaagcggccaagcugcucaacgucgaccccgauaacgugguguugugccugcuggcggcgg

SEQ ID NO: 4471 - RNA, 63 nt, Human
gcucucucccugggcgaccugcaguuugcaauaugacuuuggaggaauucucggcuggagagc

SEQ ID NO: 4472 - RNA, 72 nt, Human
gguuuucacaugccaucaucuuuaauucucccagcaauggguccacgggguggccaugggauggggauuacc

SEQ ID NO: 4473 - RNA, 85 nt, Human
uuagagggaaggucuagaauuuccgugcuccuuauaaaauuaccuugaauggauuuuaagaggguaaugaaaccuuccuuucuga

SEQ ID NO: 4474 - RNA, 71 nt, Human
gcauggaggugugcaacccuaaaaaaucuucgggugacaaccuggacauugucaggagcacaccuuugugc

SEQ ID NO: 4475 - RNA, 82 nt, Human
cgugggaacugguguucugcauugcaguagguauuugaaaccaauuucuaauagguaguuuuuauagaacuaaguuccugug

SEQ ID NO: 4476 - RNA, 78 nt, Human
ggcgggaggacaauauuauucauucgauuuuuccuucgacauccauagugaaucagugaguaauaauuaaucaacgcc

SEQ ID NO: 4477 - RNA, 69 nt, Human
guaauuaaucauguuccgucuguggugcaaaaacauuaauucaugcaucucaagaauaacauuaguuau

SEQ ID NO: 4478 - RNA, 73 nt, Human
uuuaaacgaguggccgggagcaaucugccaccugcuggggaggcagagacccugcaauggccaccucuuuaaa

SEQ ID NO: 4479 - RNA, 75 nt, Human
ggaacuauuuggucaucuuuugagaaaaaaauauacaaagaagucaucuuuucauuaaguggauucccugguucc

SEQ ID NO: 4480 - RNA, 60 nt, Human
ugacacaggggccgcgcuguugagaguacaccuuagagcucgguuugcaacgcuguguca

SEQ ID NO: 4481 - RNA, 99 nt, Human
ggcggccgcgggccccccauugguucuaggguacaccguuggccccaugcggugguucccacaagagaacaccccgggggccaaggacacaagguggcu

SEQ ID NO: 4482 - RNA, 70 nt, Human
cacaacacgcugucuucacagccaaaggggugcgcgagggcaucagaguggaucggugaagugugucgug

SEQ ID NO: 4483 - RNA, 76 nt, Human
ccgacggcccacgggacaucacguaagcgcagacacgcugaccgucaggaacggauggucccacauggguugcagg

SEQ ID NO: 4484 - RNA, 66 nt, Human
gagucuauccaaaaucaccaccaccgugggccuaaacaucgcgcacuguggaugugggaaaggcuc

SEQ ID NO: 4485 - RNA, 100 nt, Human
guauuuugacaaaauacgaaguggagauuuacacuacauuguacaagggaaugaaagugucacggguaaaaacucuaaaagguuaauuucugucaaaugc

SEQ ID NO: 4486 - RNA, 64 nt, Human
guuguucuguuagucgcuaacuuaguaagugcuuuucuuauagaaccccuucugacugagcaau

SEQ ID NO: 4487 - RNA, 85 nt, Human
auuagcuggcagccuccagaggugauccaacaguaucugucaggggguauguguggcuaugaccuggauggcugcccagucuggu

SEQ ID NO: 4488 - RNA, 62 nt, Human
ccucaagcaucucuggaagccugcuguggaggccuauggagaguuucucugcauguuugagg

SEQ ID NO: 4489 - RNA, 61 nt, Human
ggguggcggcgaggacgagucugugcuccaucagcugccgcacccgccgccucccgccccc

SEQ ID NO: 4490 - RNA, 79 nt, Human
gguuggguugucccugggcggccaccuccagaagagaagcgggcaaugacugggggggacguccagaaugagcuggacu

SEQ ID NO: 4491 - RNA, 67 nt, Human
augaaauaccaaaguaauucuugaaaggcugguugaaccaccagaaaggaguuauugggggaaucau

SEQ ID NO: 4492 - RNA, 63 nt, Human
ggauugaaacugucucaggaccuugaugaucuugcuauucucuaccuggccacaguucaagcc

SEQ ID NO: 4493 - RNA, 99 nt, Human
ugccuguguccugucgcaagaggugaguccgucuugugggugcugcugucugggugccugugccucaggggauucgccuucuguacaggaagcaaggca

SEQ ID NO: 4494 - RNA, 85 nt, Human
gcggggaacaccaauggcgggguacuugaagcugguguguguuuccuuucagcgucaaggguuccacacuguugggagucgcugc

SEQ ID NO: 4495 - RNA, 77 nt, Human
gcugguguguguuuccuuucagcgucaaggguuccacacuguugggagucgcugcaagaaucggacaggcgcugagc

SEQ ID NO: 4496 - RNA, 75 nt, Human
gugcagaaggucaacgccgcaggcacagaucccagcucuccuguuggcuucgugcuugggguagaucuucuucac

SEQ ID NO: 4497 - RNA, 85 nt, Human
guguuuuaauauauuuacugcauuguuucucaauggaccagucaccagagacuaauuauugcacuuaaauauuugccugagauac

SEQ ID NO: 4498 - RNA, 79 nt, Human
caaguuccagccuccaugcccacagcagccaugaccaguaacuggcuagccccagggaagggagagccucaggagucug

SEQ ID NO: 4499 - RNA, 62 nt, Human
acacacacagagagagcagaggggggagacacacucucacacucucucucucugcugugugu

SEQ ID NO: 4500 - RNA, 72 nt, Human
cagaggguuacacauacucaacucacagccagacggguacuccguggcuguggugugugugcacacucucug

SEQ ID NO: 4501 - RNA, 69 nt, Human
ggcaagacagggacuagcagccagagccaguaaugccuuccugguuugcucugagggguccugucuucc

SEQ ID NO: 4502 - RNA, 64 nt, Human
gcggcucaucccagauggcuguggggucaaguacauccccagucguggccucuggacaaguggc

SEQ ID NO: 4503 - RNA, 91 nt, Human
auccuggcccaucgugcugcugccccacgguucgguaccacacgaauggugcgcugccggccgcggcuucagccuggauggagcucagggu

SEQ ID NO: 4504 - RNA, 69 nt, Human
ccuucgcuagucuccguauggcccgugccaacgcccggcucuucggcauacgggcaaaaagagccaagg

SEQ ID NO: 4505 - RNA, 67 nt, Human
guccagaggccgcauaucugcuggauggcugaccugcaacgagucauccagacuggccccagaggac

SEQ ID NO: 4506 - RNA, 84 nt, Human
ccugcucaguguuuggcaucugguggcuaagcuggucuucagaguucaagacagcuucauucucaugccuggcaccuugguagg

SEQ ID NO: 4507 - RNA, 62 nt, Human
gucucuuugggcggaagacaggucaggccccuggauacucuuacacagccgccaauaagaac

SEQ ID NO: 4508 - RNA, 105 nt, Human
ggaguuucuuccaaacuucaccaucuggauacugguguuucuuuacagauuccuccuucauuucuguugaguagccgggauccuugggaggcauguaggaagccc

SEQ ID NO: 4509 - RNA, 62 nt, Human
aaugcaacagauaguucuuccacauccaaucauaagcaggaugucggcauuucugcugcauu

SEQ ID NO: 4510 - RNA, 65 nt, Human
gaagcgcagcggaacucgaccggauccaacccaguuaguuacuuccugucuagaguuguagcuuc

SEQ ID NO: 4511 - RNA, 64 nt, Human
ggaggcgagacccccuaguaacagaggcgguggcuacugcugcggccacuggguuucggccucu

SEQ ID NO: 4512 - RNA, 82 nt, Human
gaguuagcgguggguggaggagggggccuuggcaucuucucuuuaugucucugagcugugccuucgccaccccuucuggguc

SEQ ID NO: 4513 - RNA, 82 nt, Human
uuuguggggacauuggucugucggugccaguacauccuccuccaugaugacuucccuauggacaaccucaucucccugcuca

SEQ ID NO: 4514 - RNA, 69 nt, Human
gguguaaauguugagccuuuuuggccuggcuuguuugcaaaggcccuggcaacgucaacauugggagcc

SEQ ID NO: 4515 - RNA, 66 nt, Human; identical to SEQ ID NO: 50

SEQ ID NO: 4516 - RNA, 72 nt, Human
uccuguggccuucaauugucuucagagguggaugagaaaaagacaccauuugugaggggguguggcacggga

SEQ ID NO: 4517 - RNA, 92 nt, Human
ccccagaugcaaugcgaucacagggucguuaccaucuucuuuauuaauuggucaacauuuugugugauccagcauuugagugacacuggugg

SEQ ID NO: 4518 - RNA, 68 nt, Human
ccugaguugggacagcccuggagcuggacagacccagccaucaucacagguauuccagcgucuucagg

SEQ ID NO: 4519 - RNA, 64 nt, Human
uuccaauacuuagaaaauuauuguuugucugugcgcauaauaaugaauaauuuggguagaggaa

SEQ ID NO: 4520 - RNA, 64 nt, Human
cgaugccgucacggggcucaguggcagcgggccugccuaugcauucauggcucuggacgcauug

SEQ ID NO: 4521 - RNA, 79 nt, Human
cgccccugcgcuguccgcccuuccccuagcguuacuuccggucccucgcugaggggguucgugcggcucccaggaggcg

SEQ ID NO: 4522 - RNA, 96 nt, Human
cuuuuaagcacaguaauagaggugaguauuauuagcauccaacccaaaaacaaaucuuuggccugucauccugaaagcccacugcuggcuugaagg

SEQ ID NO: 4523 - RNA, 81 nt, Human
cucccagcccagaacuuccagaugcccuggcaccucuagggaccaacugggacucauuauggaagaauggggugagaggag

SEQ ID NO: 4524 - RNA, 67 nt, Human
gguggaagaggacuggugucugucuguccuccgcuccuaccaggcagaacacgggcccgacuucccc

SEQ ID NO: 4525 - RNA, 129 nt, Human
ugguggaugucgauacaauccuggguuguccgaguccugugaaugucacuuucuggcauaaauguaauauccacacuuuagugauguccacaggaaacgcaaacucauguuacuuacuacgcuuugcua

SEQ ID NO: 4526 - RNA, 66 nt, Human
ggaggaguugcgcgcgcugugccgugugcaagcgcugcggcagggcuccgagaccucggcuccucc

SEQ ID NO: 4527 - RNA, 71 nt, Human
ggaaagcuccacacaccauaggcaguggugcuaaaugcaacagaagccuuagugcgaacuggaacuucucc

SEQ ID NO: 4528 - RNA, 83 nt, Human
ggaggcugggaggccgcccccagccgcugcuacccacgcagagccgggcuggcuucgcgggggcggcgggcggcccgagcccc

SEQ ID NO: 4529 - RNA, 92 nt, Human
uguguaccggcacgcccaccgaggcucuggcguccuuuugacuacauuuguccgggagggcaaggucgagccguuggagggugccguggcca

SEQ ID NO: 4530 - RNA, 91 nt, Human
cgcccggccauggcugcgguggcgcugaugccaccgccgcugcugcugcugcugcuguuggcgucgccgcccgccgccuccgcgccguccg

SEQ ID NO: 4531 - RNA, 78 nt, Human
cugggagcugcgugcugcuggcccugugggggagcccuggggcuguaccacacggcgcgguggcaccugcgcgcccag

SEQ ID NO: 4532 - RNA, 81 nt, Human
cuaguguaggguuuuuugacucccuuuagugaaaaacuuguuaagggugguauauuaaugggaaauggagagacuaccugg

SEQ ID NO: 4533 - RNA, 87 nt, Human
gaagacuugguuuguugaauaugacaaugaaaucuguguguaucagauuuuuauugaagcauucaucagcagccucaaccaguuuuc

SEQ ID NO: 4534 - RNA, 87 nt, Human
uaaacauuucaugggagacaauaucauaaggguaaagagguagaaucacuuucagacuuagaauaauguugauucccaagugcuuua

SEQ ID NO: 4535 - RNA, 91 nt, Human; identical to SEQ ID NO: 3000

SEQ ID NO: 4536 - RNA, 63 nt, Human; identical to SEQ ID NO: 3401

SEQ ID NO: 4537 - RNA, 131 nt, Human
cgcgugccccgcccgcuggagcaccugccaccgaggcgcgcguggggccacugccguggcggcggcugcccuccucacacucggcuccgcgccgccuccggccaccgugcgcucccgcguggggcgccucg

SEQ ID NO: 4538 - RNA, 105 nt, Human
uccggaguaaacggcucuucauuagcuuggaguggccgcaggucccgugaccagcaccccgcgagacccugugcgacagcugggcugaugcuccguuucucuggg

SEQ ID NO: 4539 - RNA, 65 nt, Human
ggaggucaugaaaccgccguagcgcuuguccuugggcgggcugccccagcggaagugcuccaucc

SEQ ID NO: 4540 - RNA, 65 nt, Human
aggccagugucagggucggaguggccuggcucuuagcacugaccgaccauugccauuucuggccu

SEQ ID NO: 4541 - RNA, 71 nt, Human
ccucucagcuaguuggcgggggugcuggacuggacucuuguucacuuuaccuucugccaaaugcagagagg

SEQ ID NO: 4542 - RNA, 73 nt, Human; identical to SEQ ID NO: 2436

SEQ ID NO: 4543 - RNA, 69 nt, Human
uacaaagcaaauaagauauacugagccucaacagauugccugcuccucagagucucuccuauuuuugua

SEQ ID NO: 4544 - RNA, 70 nt, Human; identical to SEQ ID NO: 2437

SEQ ID NO: 4545 - RNA, 130 nt, Human
ggcucaugcauguaaucccagcacuuugggaggcugaggugggcggaucacgaggucagggguuugagaccagccuuaagugaucaacccgccgaggccucccaaggugcuaggaucacaaccgugagcc

SEQ ID NO: 4546 - RNA, 124 nt, Human
cagacugagagaaugcagaagagggcugaacgauucaauguaccugugagcuuggagaguaagaaagcugcucgggcagcuagguuugggauuucuucaguuccaacaaaaggucugucaucug

SEQ ID NO: 4547 - RNA, 71 nt, Human
uuucuucaguuccaacaaaaggucugucaucugauaacaaaccuaugguuaacuuggauaagcugaaggaa

SEQ ID NO: 4548 - RNA, 116 nt, Human; identical to SEQ ID NO: 208

SEQ ID NO: 4549 - RNA, 62 nt, Human; identical to SEQ ID NO: 206

SEQ ID NO: 4550 - RNA, 93 nt, Human; identical to SEQ ID NO: 207

SEQ ID NO: 4551 - RNA, 73 nt, Human
acggacacgguuguuuacaccagcaaaucguuccuugccgaaaagcaaaacugguuccagcagcuuguacugu

SEQ ID NO: 4552 - RNA, 66 nt, Human
gcgggcgcgguucaaauauuuccaggggccgcccguucaccuugaugagaccauugccgcguuugc

SEQ ID NO: 4553 - RNA, 67 nt, Human
cuugcaaagcauucacuuaauauuuuaguugaaacaaacuuaaaagguauauggguuuucggugaag

SEQ ID NO: 4554 - RNA, 87 nt, Human
gaccuuugugaguuccagugguguccuuggcacucagagguucagcugaagucccgacuggugaggacaaguggagccacaaggguc

SEQ ID NO: 4555 - RNA, 64 nt, Human; identical to SEQ ID NO: 931

SEQ ID NO: 4556 - RNA, 86 nt, Human
gccagcgccugagcauccccgucaugguggucacccugggaccccacgcgggaccagugcuucggggaccgcuuucagccgccugc

SEQ ID NO: 4557 - RNA, 75 nt, Human
ccaggugaggaagugaucccaaaagaugaaaauggaaaaauacuauuugacacaguggaucucugugccacgugg

SEQ ID NO: 4558 - RNA, 71 nt, Human
gccgugggagaaguguaaagaugcaggauugggccaaguccaucgggguguuccaacuuucaaccgcaggc

SEQ ID NO: 4559 - RNA, 89 nt, Human
caguugguauuugagucuccuagaaucuuucaguccauuuuuuauagaaucauauauuugauaaauaggggaaauuuauguaucuuaug

SEQ ID NO: 4560 - RNA, 88 nt, Human
gagacuucuuucuucagccuuugucuagaauguucuuacucuuuuuaacauugagcaauuuucauuuuccaguugguauuugagucuc

SEQ ID NO: 4561 - RNA, 87 nt, Human
uuugagauggaguuacccuguuguugcccaggccuaaauuacacuaauuauucuuugcauuuuuuggcuaauuccuccugucucaaa

SEQ ID NO: 4562 - RNA, 85 nt, Human
gauagaucaguugcuauauuuucugguguagggucuuucuuauuuagugagaucuagggauaccacagaaaugguucagucuauc

SEQ ID NO: 4563 - RNA, 110 nt, Human
gugccaauacaggacuaauugucagccuagaaaaggaacuugcuccauuguuugaagaacugagacaaguuguggaaguuucuuaaucugacagugguuucaguguguac

SEQ ID NO: 4564 - RNA, 102 nt, Human
ggauuuuagucuguaacaaaguugucgcuauugugcuucauccguucagcugaacaggaggauggauacagccgcgaggcuaaaaaacggauuuccucuucc

SEQ ID NO: 4565 - RNA, 81 nt, Human
ggugauaagugucgcuuucuacguauugcaggugguguuggaauuaccuguuggauuuuagucuguaacaaaguugucgcu

SEQ ID NO: 4566 - RNA, 66 nt, Human
uucuuggacuuuaugagauagucuuauaagaaucacgauuuucuacaccugucauugagccaagaa

SEQ ID NO: 4567 - RNA, 65 nt, Human
uguccucugccaugcgaccgcucaguuaucacacugcacugcuguuggguugcauguggaguaca

SEQ ID NO: 4568 - RNA, 71 nt, Human
cucgagcccagccucucccugccaaagcccaacucccagggcucuggaaauggugaggcgaggggcuugag

SEQ ID NO: 4569 - RNA, 63 nt, Human
gaacgcccacccacgaaggcccagggcgccagacggccccgaaaaggcgcucggggagcguuu

SEQ ID NO: 4570 - RNA, 68 nt, Human
cuaaaaguuuauccuuuauguguguuaaaauugcaauucuauaucagaaaugaaggaaacacuuucag

SEQ ID NO: 4571 - RNA, 81 nt, Human
uguuauguuauuaaaucaaaacaaaacacaagguacggauuacuucacuguccuuuaucuugauugguuucuuacaaaaca

SEQ ID NO: 4572 - RNA, 60 nt, Human
augccucagugauaagaaagaugccuccuugugucucacuguuuucuagcacugaaacau

SEQ ID NO: 4573 - RNA, 68 nt, Human
gcucuguaacuuaggacaucacuugauuaaaauuauagucuccaaauauaguguuuuaggaaaagggc

SEQ ID NO: 4574 - RNA, 68 nt, Human
gcgucguccgagugagcagcggugcuggccgugugggacccgggcccgcuuagcaccauggacggggu

SEQ ID NO: 4575 - RNA, 66 nt, Human
ggguucaaagccuuuauugggucagggcuugcuccagagcucaggggccagguaggucaggagccu

SEQ ID NO: 4576 - RNA, 78 nt, Human
aggucuugcaggaagcuugacaaaugcccucagcaauggccugcugucugggggccuguugggcauucuggaaaaccu

SEQ ID NO: 4577 - RNA, 63 nt, Human
aagcugggcccgcgacucaaaggggacugggauggggaucucguuggacugcguggcuagcuu

SEQ ID NO: 4578 - RNA, 66 nt, Human
gaggcacagccaggggcggcagcaggggggggcauccgggcuaaggcuuuacuuggcggcagucuc

SEQ ID NO: 4579 - RNA, 91 nt, Human
uuuuuuuuuuuuuuuuuuuuuuuuuuuuuuuugacaggggguugcuuugaacuuuauuugaaaaaaacaaaaaauaaauguuucaaaaaaa

SEQ ID NO: 4580 - RNA, 71 nt, Human
gugucuuagugcuucauucuauugguuuauuggaacauguaauaaauaggaguagugauguauuaaaacac

SEQ ID NO: 4581 - RNA, 78 nt, Human
gaaccuuauugugcucuuguuggcuccuauuauuggauuuuccaucgugccguuggaguugcagcgcacauuuuguuu

SEQ ID NO: 4582 - RNA, 84 nt, Human; identical to SEQ ID NO: 135

SEQ ID NO: 4583 - RNA, 61 nt, Human; identical to SEQ ID NO: 136

SEQ ID NO: 4584 - RNA, 85 nt, Human
ggcccucauuuuguauuuuuuaaauuuggguuuuauugaaagugauuucuuguggaaagcucagaauguaaaaauauuauggguc

SEQ ID NO: 4585 - RNA, 75 nt, Human
uucuuauagucuccuaacauuugucucuagccuuugccuuuguacaaucacagauauccuauggagauuuaagga

SEQ ID NO: 4586 - RNA, 77 nt, Human
ccaaguuuaauuuauaggcuuucguggacuucuggaagucaacugacuucgaaguuaggacagcauggggggauugg

SEQ ID NO: 4587 - RNA, 92 nt, Human
gaguagcuaugacaaugaggaguuuuaagagugagaaaacacaaugucuaugagaacauggacuucucuuuuagaggcuccaugagcuacuc

SEQ ID NO: 4588 - RNA, 64 nt, Human
gguuaugaggguugguuaagguacgagaggcacaaagugaaagaagccuucacuacuuuaaacc

SEQ ID NO: 4589 - RNA, 61 nt, Human
ccuguggcauuuuccuuauugaauauuaacauaaguacacacugugagacucugcuacagg

SEQ ID NO: 4590 - RNA, 73 nt, Human
cuguuguggaagaaaagcaaaucgugacgagaaaauggcucuguuaucacaggucugcacguuuacauaacag

SEQ ID NO: 4591 - RNA, 88 nt, Human
cgcugggcaggacgacaaacacgagacgccacuguggaaugagcaacuucggagcacggggugacuugcuugggaccgugcccacgug

SEQ ID NO: 4592 - RNA, 84 nt, Human
gacugccucaggugacgggccgugagaggggacgggucaggagccuucccaagccuucuccucagcccgacacccauggccauc

SEQ ID NO: 4593 - RNA, 65 nt, Human
ggcuaggaugccagacacagccauuugcagaaaucaggcacagugacugcagcucacguccagcc

SEQ ID NO: 4594 - RNA, 91 nt, Human
cucaguucugccuccugacuaugacaguaaucccacccagcucaacuaugguguggcaguuacugauguggaccaugauggggacuuugag

SEQ ID NO: 4595 - RNA, 79 nt, Human
ggccacguacaccgacaaguuguucaaguuccgcaauaaccggugggaagacauccugagcgaugaggucaacguggcc

SEQ ID NO: 4596 - RNA, 95 nt, Human
ggcggcggggccgaugagcgggauggauggcuccgagcgcugaccccggcauguccaggauguuaccguuccugcugucugcucugguuucugcc

SEQ ID NO: 4597 - RNA, 72 nt, Human
ggggcugggagcaagcauggcggcggcgccggcggcagauggcggcagcgaagcgcccgcuucccacgcccc

SEQ ID NO: 4598 - RNA, 78 nt, Human
ccccugcuguauccugcaucauuagaaaaaucaaagccauuggugggaucauucugacagccagucacaacccagggg

SEQ ID NO: 4599 - RNA, 60 nt, Human
auacuuguauuuugugguggcaaauguuugguagaacuguaauuagaaaaauacaaguau

SEQ ID NO: 4600 - RNA, 102 nt, Human
guuucauggaaguuguuuauaaaauucaaagguauuucauuuaggugaaaagucuuauuuauuaaagugguuugaauaaaguagaucaaaacuuccagagau

SEQ ID NO: 4601 - RNA, 79 nt, Human
cuggcggccggcgggcacagccggcucauuguucugcacuacaaccacucgggccggcuggccgggcgcggggggccgg

SEQ ID NO: 4602 - RNA, 66 nt, Human
gcggucgcgacgcugggucuacuauugccuggugaacaucacgcugagugaccugcucacgggcgc

SEQ ID NO: 4603 - RNA, 69 nt, Human
ggcugucgguggccgccagcugccugguggugcuggagaacuugcuggugcuggcggccaucaccagcc

SEQ ID NO: 4604 - RNA, 76 nt, Human
cugccggaaguuuaccagcucacuuucggcgucgcgcccgccuccguggagcaggccggaaguggcuuuccggcag

SEQ ID NO: 4605 - RNA, 67 nt, Human
cggaccgcuggaucgugccgggcgggggcauggagcccgaggaggagccgggcggugcggcgguccg

SEQ ID NO: 4606 - RNA, 85 nt, Human
gacacggaccuacgaccccgagggguucaagaagcgggcggcgaugccugugcuuccggagcgagcgcgaggacgagguccuguu

SEQ ID NO: 4607 - RNA, 64 nt, Human
gguuggccacacagcagcgagaggcgagaggaggcugccucgaggaugaagugcaaacccaacc

SEQ ID NO: 4608 - RNA, 89 nt, Human; identical to SEQ ID NO: 2239

SEQ ID NO: 4609 - RNA, 86 nt, Human
ccgucgucagggauagcaaaagcccuggucagggacuguccuccaguuugccggaaccagguacagugaaguuauccugacaccgg

SEQ ID NO: 4610 - RNA, 63 nt, Human
guugaugaucccaccuugagggagaagcgguugcagcuguuucaucucuuguggacagugagc

SEQ ID NO: 4611 - RNA, 75 nt, Human
ucguguucagcaucagccucuucccugcccugugguuccuugccaaaaaacccuggacggaguauguggacauga

SEQ ID NO: 4612 - RNA, 107 nt, Human
guaacugcaaagaugcuguccgugcgcguugcugcggccgugguccgcgcccuuccucggcgggccggacuggucuccagaaaugcuuuggguucaucuuucauugc

SEQ ID NO: 4613 - RNA, 85 nt, Human
uccuugaacuuggaaccugacaauguugguguugucguguuuggaaaugauaaacuaauuaaggaaggagauauagugaagagga

SEQ ID NO: 4614 - RNA, 128 nt, Human
aauagcugggauuauaggugcccaccaccaggcugggcuaauuuuguauuuuuagcugaaacccagucucuacuaagauacgaaaauuagcugggugugguggugugugccuguggucccagcuacuu

SEQ ID NO: 4615 - RNA, 85 nt, Human
gagaaucgcuugaaccuggaggcggagguugcagugagcagagauugcaccauugcacuccagccugggcaacagagcgagacuc

SEQ ID NO: 4616 - RNA, 68 nt, Human
ugauguauguuaauugucagaaacugcugaaugccuuguuuaguugucacaaacaaauucacauauca

SEQ ID NO: 4617 - RNA, 67 nt, Human
uuccuuuuuuccugcuuuuuuuuuuuuuuguuaaaacauacugggagaaaguaaagaaaaacuggaa

SEQ ID NO: 4618 - RNA, 97 nt, Human
cauuagucuuuuauuauaaccauauugaauggggucgcuuugccaaaaggagaaaucauuucuuaaaucaguaugaguuauagcauaaagauggaug

SEQ ID NO: 4619 - RNA, 76 nt, Human
gagaaagcagucuggccuuugagaaggaagccuggcuugccaggugccauccucaauguauccggccucuucucuc

SEQ ID NO: 4620 - RNA, 60 nt, Human
uguuuaacgaacuuuauauaucuuuuuaacaguauaaaaagagagcuuuaguaaguaaca

SEQ ID NO: 4621 - RNA, 75 nt, Human; identical to SEQ ID NO: 74

SEQ ID NO: 4622 - RNA, 80 nt, Human; identical to SEQ ID NO: 887

SEQ ID NO: 4623 - RNA, 91 nt, Human
gacggccaugcuggucugcaagucagaguccgugccaccugucacugacugggccugguacaagaucacugacucugaggacaaggcccuc

SEQ ID NO: 4624 - RNA, 109 nt, Human; identical to SEQ ID NO: 831

SEQ ID NO: 4625 - RNA, 87 nt, Human; identical to SEQ ID NO: 76

SEQ ID NO: 4626 - RNA, 67 nt, Human
gucugaaagcccccgguaucauuccucgaauuucagugcgggaaccaaugcagacuggcauuaaggc

SEQ ID NO: 4627 - RNA, 64 nt, Human; identical to SEQ ID NO: 4082

SEQ ID NO: 4628 - RNA, 103 nt, Human
gccaaagaagaagacaagucgcauguuccagacguccaaaacgggguccuugucauaaccaugggagucuggguucuucucauacaaguuuucguccucgggu

SEQ ID NO: 4629 - RNA, 67 nt, Human; identical to SEQ ID NO: 1261

SEQ ID NO: 4630 - RNA, 64 nt, Human
gcuggccgagguguguuugguggccggggccgaggugggaucccgggcacaggcagaggccagc

SEQ ID NO: 4631 - RNA, 65 nt, Human
uccgguuagaaauguuacuugguguuuuuugcuuuugugaaacggccgucccaaagcuggcugga

SEQ ID NO: 4632 - RNA, 74 nt, Human
aacuccgccuggcccugccugcaguacuggccagagccaggccggcagcaauauggccucauggagguggaguu

SEQ ID NO: 4633 - RNA, 61 nt, Human
cuggcggcuggucuacgauuacgggugcaccuccaucgucaugcucaaccagcugaaccag

SEQ ID NO: 4634 - RNA, 75 nt, Human; identical to SEQ ID NO: 74

SEQ ID NO: 4635 - RNA, 71 nt, Human; identical to SEQ ID NO: 77

SEQ ID NO: 4636 - RNA, 75 nt, Human
cuccgagcagauuaugagauugcaaguaaagaaagagaccuguuuuuugaauuagaugcaauggaucacuuggag

SEQ ID NO: 4637 - RNA, 78 nt, Human
cugccaccgccugccugagagaagucgucgcggccgaccccgucgccuccgccggcuaccauguccgcccaggcgcag

SEQ ID NO: 4638 - RNA, 123 nt, Human
ggaccagcucaugggcacggcucgggacggagacgaaaccagacagagggucaaguuuacagaugaccgugucugcaagagucaccuucuggacugcugcccccaugacauccuggcugggac

SEQ ID NO: 4639 - RNA, 87 nt, Human
caggaguccagacaaaagacgggugauuuugcucagguugguagcaacagagguaaugagaaguaguuggauuuuggauauauuuug

SEQ ID NO: 4640 - RNA, 61 nt, Human
uggggaguucuuuccagugcccgaguccauucucacauccaugaagaagguaaaaucccua

SEQ ID NO: 4641 - RNA, 69 nt, Human
agcaugagagagaucugucuaugggaccaguggcuuggauucugccacacccauaaauccuuguguguu

SEQ ID NO: 4642 - RNA, 70 nt, Human
cuuuuuuuaauuugcauuuuuuuucauuuggggccaaaaguccagugaaauuguaagcuucaauaaaagg

SEQ ID NO: 4643 - RNA, 84 nt, Human
uucuagcugccuggggcuggcccugcucagacaaaucugcucccugggcaucuuuggccaggcuucugcccucugcagcuggga

SEQ ID NO: 4644 - RNA, 77 nt, Human
cgcccacugugacgaugucaccgaucuggacgucccugaagcagggggacagguguacagacauguucuugugggcg

SEQ ID NO: 4645 - RNA, 74 nt, Human
gccgacccuccaaguuagcugacuucugggggaacaacaacgagauccucagugggcuggacauggaggaaggc

SEQ ID NO: 4646 - RNA, 70 nt, Human
guuugauccucgcccuguuuccaaaaacgcguacaggcucaucuuggcagccaacagggaugaauucuac

SEQ ID NO: 4647 - RNA, 102 nt, Human
ggggcccacuuugcugucauccgccgaucgucccuggagaagaacccguaccaggcugugcaccaaugggccuucucugcgggguugagccuggugggccuc

SEQ ID NO: 4648 - RNA, 70 nt, Human
gucccgugccccacacucugagucugcccuauccacagcugcugggccucucuguggccaccauggugac

SEQ ID NO: 4649 - RNA, 68 nt, Human
guuacacguuuuccuccaaggagccucggacguugucacggguuuggggucggggacagagcggugac

SEQ ID NO: 4650 - RNA, 64 nt, Human
caagaacacuccuugggcguccuugcuguuuuguuugugaagcuuucuaugcccaguguuccug

SEQ ID NO: 4651 - RNA, 72 nt, Human; identical to SEQ ID NO: 3649

SEQ ID NO: 4652 - RNA, 71 nt, Human
gcuggugcagcgcucgcccuggcugaugaugcggaugggcauccucggccgugggcugcaggaguaccagc

SEQ ID NO: 4653 - RNA, 65 nt, Human
gggcugcucccugcaugaggaggacacccagagacaugagaccuaccaccagcaggggcagugcc

SEQ ID NO: 4654 - RNA, 64 nt, Human
uuuucaauuauccuaagugucuucauuccaucacucuucuuggagaacuucucaauauuggaaa

SEQ ID NO: 4655 - RNA, 78 nt, Human; identical to SEQ ID NO: 99

SEQ ID NO: 4656 - RNA, 65 nt, Human; identical to SEQ ID NO: 247

SEQ ID NO: 4657 - RNA, 80 nt, Human; identical to SEQ ID NO: 100

SEQ ID NO: 4658 - RNA, 78 nt, Human; identical to SEQ ID NO: 99

SEQ ID NO: 4659 - RNA, 65 nt, Human; identical to SEQ ID NO: 247

SEQ ID NO: 4660 - RNA, 80 nt, Human; identical to SEQ ID NO: 100

SEQ ID NO: 4661 - RNA, 103 nt, Human
auacaaaaaauuugcagggcgugguggugcgggccuguggucucagccuccugggcugcugggacuacaggcaccugcccccacaucuggcuaauuuuuguau

SEQ ID NO: 4662 - RNA, 64 nt, Human
ccacuuaaagaauuuacaggccgggcgagguggcucacaccuguaguccuaguucuuugggagg

SEQ ID NO: 4663 - RNA, 63 nt, Human; identical to SEQ ID NO: 2263

SEQ ID NO: 4664 - RNA, 60 nt, Human
gcaagacauguuacuagcacuuugagaaugagucuccuguugagcugguaggauguaagc

SEQ ID NO: 4665 - RNA, 66 nt, Human
gggagaggggauucacaaggugaagaacuggaaccccagcuucccuccagccucuccuccauuccc

SEQ ID NO: 4666 - RNA, 60 nt, Human
gucucuauauuaugucuucauuuaguggugucuuccaugugaacagcauaaguuuggagc

SEQ ID NO: 4667 - RNA, 62 nt, Human
gucuuagguaaauaauguacucucuuaauauguuaauacucaugagaauugggaucugaugc

SEQ ID NO: 4668 - RNA, 74 nt, Human; identical to SEQ ID NO: 4312

SEQ ID NO: 4669 - RNA, 92 nt, Human; identical to SEQ ID NO: 4314

SEQ ID NO: 4670 - RNA, 60 nt, Human; identical to SEQ ID NO: 2705

SEQ ID NO: 4671 - RNA, 72 nt, Human; identical to SEQ ID NO: 1989

SEQ ID NO: 4672 - RNA, 77 nt, Human
cuuuuaaugggaucggcaugagcaaaagcucccucagaguuacgaccgaguuaaauaucagagaguccacgugaaag

SEQ ID NO: 4673 - RNA, 81 nt, Human
gccggccugggugcuuaccagcugucucaggauccaaggaacguuuggguuuuccuagcuacaucugguaccuuggcuggc

SEQ ID NO: 4674 - RNA, 130 nt, Human
ggagaucgugccagugggcuccagcuugggugacaagagugaaacuccaucucaaaaaaagaaaagaaaagaauguuuauucuaugucauuuuaagcuaaugaagggagcuuucuuuuggagaaauuucu

SEQ ID NO: 4675 - RNA, 88 nt, Human
gucucaccugcugaccucugagagccucaguuuucucgucuauaaaauggggauacaaaugacugccucacaggauuguuugggaggc

SEQ ID NO: 4676 - RNA, 75 nt, Human; identical to SEQ ID NO: 74

SEQ ID NO: 4677 - RNA, 87 nt, Human; identical to SEQ ID NO: 76

SEQ ID NO: 4678 - RNA, 60 nt, Human
auagcaacgucauggugaagguggccacucagccggcugacaauccccuugacguucuau

SEQ ID NO: 4679 - RNA, 102 nt, Human; identical to SEQ ID NO: 2701

SEQ ID NO: 4680 - RNA, 87 nt, Human
cguuucgggugcuggcggcugcagccggaguucaaaccuaagcagcuggaaggaaccauggccaacugugagcguaccuucauugcg

SEQ ID NO: 4681 - RNA, 90 nt, Human; identical to SEQ ID NO: 2702

SEQ ID NO: 4682 - RNA, 109 nt, Human; identical to SEQ ID NO: 831

SEQ ID NO: 4683 - RNA, 75 nt, Human; identical to SEQ ID NO: 74

SEQ ID NO: 4684 - RNA, 87 nt, Human; identical to SEQ ID NO: 76

SEQ ID NO: 4685 - RNA, 75 nt, Human; identical to SEQ ID NO: 74

SEQ ID NO: 4686 - RNA, 87 nt, Human; identical to SEQ ID NO: 76

SEQ ID NO: 4687 - RNA, 64 nt, Human
cggcugcagaaguaccgccugcggaguaacugcaaagaugcuguccgugcgcgugcugcggccg

SEQ ID NO: 4688 - RNA, 75 nt, Human; identical to SEQ ID NO: 74

SEQ ID NO: 4689 - RNA, 71 nt, Human; identical to SEQ ID NO: 77

SEQ ID NO: 4690 - RNA, 91 nt, Human; identical to SEQ ID NO: 124

SEQ ID NO: 4691 - RNA, 89 nt, Human
ccccggagccccaaggagccccucaucaguggcuggcucuucuuccgcuacauggcaaucgggggcuaugugggugcagccaccguggg

SEQ ID NO: 4692 - RNA, 93 nt, Human
gagccauuguggacguuccaguuggugaggagcugugggucguguaguugaugcccuugguaaugcuauugauggaaaggguccaauugguuc

SEQ ID NO: 4693 - RNA, 61 nt, Human
gcguugcugcggacgugguccgcgcccuuccucggcgggccggacuggucuccagaaaugc

SEQ ID NO: 4694 - RNA, 81 nt, Human
guauucuuggagcugauaccucuguugaucuugaagaaacugggcgugucuuaaguauuggugaugguauugcccgcguac

SEQ ID NO: 4695 - RNA, 87 nt, Human; identical to SEQ ID NO: 76

SEQ ID NO: 4696 - RNA, 80 nt, Human
ccccucagcacccugccuugucuccaggagguccgaagcucugugggaccucuugggggcaagguggggugaggccgggg

SEQ ID NO: 4697 - RNA, 82 nt, Human
gggcugcggcagggacucggccucugggagguuuaccucgcccccacuugugcccccagcucagccccccugcacgcagccc

SEQ ID NO: 4698 - RNA, 87 nt, Human
ggggaaggggcuagcagguguguaaacagaggguuccaucaggcuggggcagguggccgccuuccgcacacuugaggaacccucccc

SEQ ID NO: 4699 - RNA, 122 nt, Human
cucgugugacaucuugcccgccccucagcacccugccuugucuccaggagguccgaagcucugugggaccucugugggggccaagguuggggugaggccggggaguagggaggucaggcggg

SEQ ID NO: 4700 - RNA, 93 nt, Human
ggaggggaaggggcuagcagguguguaaacagaggguuccaucaggcuggggcagguggccgccuuccgcacacuugaggaacccuccccucu

SEQ ID NO: 4701 - RNA, 93 nt, Human
ggggcacuggccacugagcccccuuggagaagucagaggggaguggagaaggccacuguccggccuggcuucuggggacaguggcuggucccc

SEQ ID NO: 4702 - RNA, 60 nt, Human
ugccuggugcugccaguaagggcgagggcacuccucauacuuacugccggcugccccgca

SEQ ID NO: 4703 - RNA, 130 nt, Human
guccaauuaguggagucugggggagacuugguagagccuggagggucucugaggcucucuuguucagccucuggguucgacuucagagcuuuugaaaugaguuggguccgccacacuccagggaaggggc

SEQ ID NO: 4704 - RNA, 72 nt, Human
ugcgcgagagagggggcucgaggugcuuuuccuauauggggccgagggacaauggucaccgucucuucagca

SEQ ID NO: 4705 - RNA, 62 nt, Human
gcaggacuugcccuguugccaccaaauguucucgguaugucacaugcaagucucuuuucugc

SEQ ID NO: 4706 - RNA, 81 nt, Human
uguaccugggaaagcucaguggugggugacacaauucgcuucauuauuguucgcguaaccugcugauccuuucccgggaca

SEQ ID NO: 4707 - RNA, 74 nt, Human
acagugccagcuuacuuuaaugacucucagcgucaggcuaccaaagaugcuggaacuauugcuggucucaaugu

SEQ ID NO: 4708 - RNA, 96 nt, Human
ccaccaacacaguuuucgaugccaaacgucugauuggacgcagauuugaugaugcuguuguccagucugauaugaaacauuggcccuuuauggugg

SEQ ID NO: 4709 - RNA, 64 nt, Human
gccagaaauuauccagcaaaucuaucagggauccuaaucagaacgugaaaugcaagauaguggu

SEQ ID NO: 4710 - RNA, 74 nt, Human
ggaggcgcggugaggagucaggcuuaaaacuuguuggaggggaguaaccaggccugcuccucucgcucuccucc

SEQ ID NO: 4711 - RNA, 61 nt, Human
accucagaguccacuugcuguguagcuaaaucauauaacagggucacaguaacuggggggu

SEQ ID NO: 4712 - RNA, 87 nt, Human
aggagcgccauggauuacuacagaaaauaugcagcuaucuuucuggucacauugucgguguuucugcauguucuccauuccgcuccu

SEQ ID NO: 4713 - RNA, 96 nt, Human
cuccugggagguugcgggguggggaugaaaagucccaauccucuaauccugccuuggucuuuugcugccaguccccauccugaagcuaccuagggg

SEQ ID NO: 4714 - RNA, 78 nt, Human
ggaguuucuaaguguauacgaggaaaugaggucaaagaccaaauauauauauuucacuauaucacacuuacaaacuuu

SEQ ID NO: 4715 - RNA, 67 nt, Human
gguggggaagacugaagaaguguuaacugaaaacaggugacacagagucaccaguuuuccgagaacc

SEQ ID NO: 4716 - RNA, 102 nt, Human
uuguuaguguugguuaaguuguugcuuggaagugagaaguugcuuagaaacuuuccaaagugcuuagaacuuuaaggugcaaacagacaaacuaacaaacaa

SEQ ID NO: 4717 - RNA, 70 nt, Human
gguaaaucuggcugcugcugucagugcaccgacuucucguuuccgauugcuggccguaguucuaguuucc

SEQ ID NO: 4718 - RNA, 81 nt, Human
cgccgcggggaugcugagcuucggcgggcggcuggacguuccuaagcagagcucgcagcguggcuugacggcccgcgagcg

SEQ ID NO: 4719 - RNA, 106 nt, Human
gcggcuggguacauggcgucuguuucucagccagcgggagccgcguggccuggguaagccacgacagcaccgucugccuggcugaugccgacaagaagauggccgu

SEQ ID NO: 4720 - RNA, 61 nt, Human
ucacagacaacagccugguggcagcgggccacgacugcuucccggugcuguucaccuauga

SEQ ID NO: 4721 - RNA, 60 nt, Human
ggcacugacuaagcgaggcucagagcuuccauaucaaauuccucagcuuuguucugugcc

SEQ ID NO: 4722 - RNA, 63 nt, Human
ggcccccgcuggcuugccaagcuuggggaauuccagagaggggcaguuaguauuaguggggcc

SEQ ID NO: 4723 - RNA, 92 nt, Human
uucuuaaagaauaacaguaaacauuccaauguccaaaucuugguuagucuuccacuauauugcuuggauguuucuuugguguugguuaagga

SEQ ID NO: 4724 - RNA, 70 nt, Human
uagcauuugaaagacaguauaauugagauuaagaaugccucaauucaaacucugacucuaucagauucua

SEQ ID NO: 4725 - RNA, 101 nt, Human
uuaaguuuuaggguuauuguaaagauguacagcaguuaaaagagucucuggcacauagaaagcacuauauaaaaguuguauauuauuauuucuagacuuga

SEQ ID NO: 4726 - RNA, 69 nt, Human
uuucaugccuuaaauuccucuauaaaacgagaacgauaaaaguacuuaacuuguagaguuauugugaaa

SEQ ID NO: 4727 - RNA, 61 nt, Human
agcaaacugagacuuaaucaaagaacuugcuacauauucccaguuggaucucagaauugcu

SEQ ID NO: 4728 - RNA, 76 nt, Human
gaaaccaagacuacuaugugccacucauuucucucuucuauugggaauuguaaauguauauaggaguguguguuuc

SEQ ID NO: 4729 - RNA, 66 nt, Human
ugggagguaugcauaucauuacagccagagggcacacugugguaauaaucguguaagauaccccca

SEQ ID NO: 4730 - RNA, 68 nt, Human
uuggaugaggcccgcacacauuauggagggcaauuuucucuacugauuaaaagguuaauuucauccaa

SEQ ID NO: 4731 - RNA, 63 nt, Human
ccuuaaaucauguggcuuaaaagcagugagaaucacugucguauuagggucauugugaauagg

SEQ ID NO: 4732 - RNA, 76 nt, Human
cccgccccugcccguugcagcccccccuagcucuccccuaagaggagccguucggggucgggggucgggggucggg

SEQ ID NO: 4733 - RNA, 97 nt, Human
ggccugcagcgaagggcuggccgggccugcugagcugcuguucugcaugacucagugguuuucggagagggcccuguuggcuuuauugagugaggcc

SEQ ID NO: 4734 - RNA, 106 nt, Human
gcagauguguacagaugcuaaacuguugggaaaaugcugcuuaugagacaucucugcuucuugagaccugaaucugcaaauguugagcacuguaccuuacaaaagc

SEQ ID NO: 4735 - RNA, 67 nt, Human
uggcauucguucacgucagacacuugugaugauaaaguaugguacucugugaguggacugaugacca

SEQ ID NO: 4736 - RNA, 63 nt, Human
uggagaaucuccucaagggcucagcugcgaaacaccugucacucaaccaggagauuuacucca

SEQ ID NO: 4737 - RNA, 71 nt, Human
ucauguuaauacauuagcauucuagccgcauggugucugcuggcacuuucugagaugauugauugacauga

SEQ ID NO: 4738 - RNA, 78 nt, Human
uuuucaauugacucacuggauaucuugguaugugaaucagaggauaaagagacuauuguuccaugucagaauugaaaa

SEQ ID NO: 4739 - RNA, 85 nt, Human
agagguagcuacccggaugcaguccuuugggaugaagacuauaggguaugaccccaucauuuccccagaggucucaggcuccuuu

SEQ ID NO: 4740 - RNA, 62 nt, Human
aagccuaauuuuccuuuucuaauucugguagcuauuaccaggaauuuuugaaaguuuuguuu

SEQ ID NO: 4741 - RNA, 125 nt, Human
uagcucucuggcauacaggccaaugacuucauaccagccagccuauaccacggauggcacaaucuccaugccgguaucuuagcacaacuggucuucagcacuggggccuauaguucagacagcug

SEQ ID NO: 4742 - RNA, 71 nt, Human
ucagcacuggggccuauaguucagacagcugcucagcggaagaggguuugcacuggaggccccucucuuga

SEQ ID NO: 4743 - RNA, 66 nt, Human
uuuuguuuuuuuuucucagcauuaccaaacuuauuuauuaagagguucugaggaaauuguucagag

SEQ ID NO: 4744 - RNA, 84 nt, Human
ugucccgguucgacgcucuagcccugcgagcagccgacgccggaagucucuacugcuccccgcuggcgcgcaggaccgcgggca

SEQ ID NO: 4745 - RNA, 69 nt, Human
ucagugugaagccuucaucaauagcaagcacuuuuuaagggaguaaaaguuguuaaaggcaaacgucga

SEQ ID NO: 4746 - RNA, 64 nt, Human
cggcgacauuguggacuuggcuucagugagguagaagaccaugauggagaaggugauguggcug

SEQ ID NO: 4747 - RNA, 61 nt, Human
gaaacaaaaaagaugcaaaaagcaauuaucaacaugauguuuguuaaaauccagugguuuc

SEQ ID NO: 4748 - RNA, 69 nt, Human
uucaccugauccugaaaguccagaugauucugaaagcgauucagagucagagaaagaagaaucugugaa

SEQ ID NO: 4749 - RNA, 74 nt, Human
cauauccugaacugagauaugcaaaauacucauuuucaaguuauggaaauguguuuguggcauauaggacugug

SEQ ID NO: 4750 - RNA, 78 nt, Human
ggucuguguguguagugagaguguguagccacuauuauaacuggaauuuaauuuacauucauaaacuacuauauuucc

SEQ ID NO: 4751 - RNA, 63 nt, Human
ucauuguaauaauuuuuuagaguuuaauuuguaaagcuuagcaaauaaaaucuuguacuauga

SEQ ID NO: 4752 - RNA, 68 nt, Human
acuguacauaccaguuguuucuacaauugaaacuuuacaauauggaaaauacauuggcuuuguacagu

SEQ ID NO: 4753 - RNA, 77 nt, Human
augugaguuggggaaguguaaaaguuuacacuuuuguuugaagcaaaaggacuuucagagcauuuuccaauucacau

SEQ ID NO: 4754 - RNA, 65 nt, Human
cagaaauucuaguuuuugaaagagaugcggaucagcucaauuuuagaacaaguaugggaaaguug

SEQ ID NO: 4755 - RNA, 75 nt, Human
uagugguggcauauagauuuuaacauauggacaacaauauuuuauacuacuaaauuucugaaauuaccacuacug

SEQ ID NO: 4756 - RNA, 101 nt, Human
uuuaucccaaaauacuauuuaaugacagaaaguucuuaacauuuagaaaauauuuuaaauuuguaggugcuuaauuuugccacccaguauucauggauaaa

SEQ ID NO: 4757 - RNA, 66 nt, Human
cuaaguauuccaaauaaguugacucauacaguguuuauucuuuuaugucuggcuuauuucacuuag

SEQ ID NO: 4758 - RNA, 71 nt, Human
guguuguagcguguauccaaauuucauuuauuuuuaaggcugaauaauaucccauuguacguacauaacac

SEQ ID NO: 4759 - RNA, 83 nt, Human
aggauaauaggacaagacaaauuacagauugucucagagaaaacaaaugaguuacucucucggacaagcuguagguccuaccu

SEQ ID NO: 4760 - RNA, 89 nt, Human
cuuauuuuuaaaauacuuugcgccuugcuuugauaauuuguauuauguauccaaacugaaauuaucugcuuucugcauuagaauguaag

SEQ ID NO: 4761 - RNA, 105 nt, Human; identical to SEQ ID NO: 979

SEQ ID NO: 4762 - RNA, 73 nt, Human
cccacugauggagcccagcagcauugagaaaauuguagagauugaugcucacauagguugugccaugaguggg

SEQ ID NO: 4763 - RNA, 61 nt, Human; identical to SEQ ID NO: 980

SEQ ID NO: 4764 - RNA, 96 nt, Human
gaagauaaugggcuuuuggaagcacugauuguuuaaagauacaaaaaaucuuguauuuuuuuuugguguguguuuacaaguaguaaauuuauuuuc

SEQ ID NO: 4765 - RNA, 70 nt, Human
gacacuuuaugggggcagaauggaacaagcuccaagaauguagauacugauucuuucuccauaaaguguu

SEQ ID NO: 4766 - RNA, 61 nt, Human
aguggcaaagguugaauaaaagaguuucuucuccaacuuacuuccuucuguuaaugucauu

SEQ ID NO: 4767 - RNA, 60 nt, Human
ggccaucgcuacuacaauuuuagaauugcugggcaauuuuuucugcacacugggauggcu

SEQ ID NO: 4768 - RNA, 70 nt, Human
uugggcguccuggggcugaggauccgggucaccggugagggaccauuuuccaucgccagcgacuucccaa

SEQ ID NO: 4769 - RNA, 65 nt, Human
cauggaaucuauagaucuguuugggaaaaccuaguaucuuaaacaacaaguccuuucaauccaug

SEQ ID NO: 4770 - RNA, 77 nt, Human
uccucaggcccuuuaacccuugcagaucggauggagaaagcugccagcacguucuagggaugggggcagauugagga

SEQ ID NO: 4771 - RNA, 65 nt, Human
cgccuccuaaaagaacaccaggccaagcagaaugaacgcaaggagcugcaggaaaagaggaggcg

SEQ ID NO: 4772 - RNA, 72 nt, Human
caaggaauggaaguaugauuuuccaacccaaauuagaaauggaaacuugggugauuguuucuccccuccuug

SEQ ID NO: 4773 - RNA, 80 nt, Human
ggcaccccuggccgggcaccugaugcuucagcaaacagcuguuccuuggcauagaccagcgccaggccaguguggguguc

SEQ ID NO: 4774 - RNA, 104 nt, Human
gggucggcaggaaguugcggcugaugagcagcucccggagcgguggggcggggccuccucuucuccaguuccaguacgcucaucagucguccuccugcugauuu

SEQ ID NO: 4775 - RNA, 82 nt, Human; identical to SEQ ID NO: 182

SEQ ID NO: 4776 - RNA, 70 nt, Human
uaauuuauugaaaggagaugcugcaacaguucuugauuuagcagcaguuauucucuuguuuacauaguua

SEQ ID NO: 4777 - RNA, 73 nt, Human
gauccacaguccugcauuuacugccuuucacuuaaugauuuuggacagguuuuagagagccaggauguugguc

SEQ ID NO: 4778 - RNA, 65 nt, Human
ggguggugaagagugcaugcuccgaggcaguuucgaguucuggugcugccacuuacuugcugccu

SEQ ID NO: 4779 - RNA, 78 nt, Human
cucaguugcugcuggguuaaagggagcacaugugauauaugcuccugaacgauccuuuauaccuucuggcguacuggg

SEQ ID NO: 4780 - RNA, 75 nt, Human
gcauggccaggcuggccagggcgugggcaagugguguccuguggcaccuccauccuccugcccagccggcugugu

SEQ ID NO: 4781 - RNA, 64 nt, Human
gaaucacgugauguuucccaggcacuguggucccacaaaaucauaagugucuucacagucuuuc

SEQ ID NO: 4782 - RNA, 69 nt, Human
uccauacuccaaggccaaaguucuugaucuggagaguuuucuagagaugagaagcaaagggaaugugga

SEQ ID NO: 4783 - RNA, 61 nt, Human
cacuguucuacaugagaauaauguuuuaaaaccaauggaaaugaagcucucuagaacagug

SEQ ID NO: 4784 - RNA, 84 nt, Human
gguuggucuggcugccgcucuuauauuucugaaaugcuugucauuaaaacugaaguauauaaaguuugggcacuuagagcaauu

SEQ ID NO: 4785 - RNA, 86 nt, Human
acauuauugaggaaaauuaauaucacagcauaaccccacccuuuacauuuugugcagugauuauuuuuuaaagucuucuuucaugu

SEQ ID NO: 4786 - RNA, 73 nt, Human
auuaauucaauuaaaaccauuaccuuaaaauuuuuuucuuucgaaguguggugucuuuuauauuugaauuagu

SEQ ID NO: 4787 - RNA, 66 nt, Human
aguugagaguaagaaauaugagagaacacaugaaugaacgcucuuuagcagacauggacuccaacu

SEQ ID NO: 4788 - RNA, 67 nt, Human
ccgagugagcaccuuccccuucaucucaggugauguuuccuggcagaaggcauuuacaaucucucgg

SEQ ID NO: 4789 - RNA, 108 nt, Human
cuguugcucaggcuggucucaaacuccugcauucaagcaaugugcuggacucugucucccaaagugcuggcauuguaggugugagcagccacugugccuggccaauag

SEQ ID NO: 4790 - RNA, 71 nt, Human
gucacccuggcuggaggugcaguggcgugaucucagcucacugcagucuugaccucccaggcccaggugac

SEQ ID NO: 4791 - RNA, 94 nt, Human
augggaagaauuacuguggccuaccaggugaauauuggcuuggaaaugauaaaauuagccagcuuaccaggaugggacccacagaacuuuugau

SEQ ID NO: 4792 - RNA, 89 nt, Human; identical to SEQ ID NO: 605

SEQ ID NO: 4793 - RNA, 84 nt, Human
cgauaacuuuuucaccaguauugcacuucuugauaagcucaguucaauggaacaucaggcaacagguacagugagaaaggaucg

SEQ ID NO: 4794 - RNA, 88 nt, Human
auccgccucacagacaguugcguccagaggcuuuuggaaaucaccgaagggucagaauuccucaggcugcaaguggagggagguggau

SEQ ID NO: 4795 - RNA, 87 nt, Human
ucccuggccgaggggcaggcuccucacggccucccugggaccccaggcgcgucgggaggcgucguccuccagccccgaggccggcga

SEQ ID NO: 4796 - RNA, 109 nt, Human
gcugagggcugcagccccccuggccugggcauugggugccucuuagggaucuugccugggugcccuaaggggucacccgguguccguccuggagggccgcagagucagc

SEQ ID NO: 4797 - RNA, 130 nt, Human
ggacaaggaauggggcaagcuggggcagcgcggaaggcagugcuguuuucaggaggccugaccucuguggccagaguccccgucagcaccgcuuacugcaggccaagaugccucccacacuccagaaucc

SEQ ID NO: 4798 - RNA, 68 nt, Human
uauuuuugugccuggagccaugugaaaaaaaccaacuuuaguucuuuuauccuaaaggaccaaaaaua

SEQ ID NO: 4799 - RNA, 92 nt, Human
cagguucagccuaugacccagguccaaaaguuccagccuucucugccaccuccagagcuagcuucagguucuggucaaagagcucacaccug

SEQ ID NO: 4800 - RNA, 113 nt, Human
uguacagaguuggaaaguaagaccauggcauauacagaaggaaagagcacaguguuaaggcucaggaaucaguacaagucaucagggucagcauucucccacuuucaagugca

SEQ ID NO: 4801 - RNA, 64 nt, Human
acaggcaugagccacugcgcccagccuggaaguuaauuuuuaugguuguguauguguugcuugu

SEQ ID NO: 4802 - RNA, 71 nt, Human
uagagaugggguuucaacuuguuggccaggcuggucuugaacuccuggccccaggugauccacccacuuua

SEQ ID NO: 4803 - RNA, 104 nt, Human
uugagacaagagucucgcucuguugcccaggcuggagugcaauggcucaaucucagcucacugcauccuccaccucccagguucaagugauucucaugucucag

SEQ ID NO: 4804 - RNA, 124 nt, Human
aauuggucuguugggguauuaaaugaauuugugacuuaggauauuuucauuuaugauggguuuaucaggaaguaaccccaugguaaguugaggcauaucuguauauauuuaaaccuaauuaauu

SEQ ID NO: 4805 - RNA, 100 nt, Human
ggcagggaccaaccccuaaucccuccccagcggcaagccccucuuuucagagugggcagaggguugccuauggugggcacuaggaaugagguccccugcc

SEQ ID NO: 4806 - RNA, 65 nt, Human; identical to SEQ ID NO: 1518

SEQ ID NO: 4807 - RNA, 75 nt, Human; identical to SEQ ID NO: 74

SEQ ID NO: 4808 - RNA, 87 nt, Human; identical to SEQ ID NO: 76

SEQ ID NO: 4809 - RNA, 71 nt, Human; identical to SEQ ID NO: 77

SEQ ID NO: 4810 - RNA, 99 nt, Human
gcccugggcuuucuacacccuucacgucagcagucggcacugagucccuggcaccaggcucuggcgcucugcugggugggagggugggccauggagggc

SEQ ID NO: 4811 - RNA, 65 nt, Human
guggcgcucugggucgccuggcuguggaaugacccuguucucaggaagaaguacccgggugucau

SEQ ID NO: 4812 - RNA, 72 nt, Human; identical to SEQ ID NO: 3392

SEQ ID NO: 4813 - RNA, 76 nt, Human
gguggacgggcuccugcggcaaggggacaugcuucgggcauuccaugcagccuugcggaacucucccgucaacacc

SEQ ID NO: 4814 - RNA, 110 nt, Human
uggcccggaacacgcuguccucgcgcuuccgccggguggacaucgacgaauuugacgagaacaaauuuguggacgagcaggaggaggcggcggcggcggcggcggagcca

SEQ ID NO: 4815 - RNA, 78 nt, Human; identical to SEQ ID NO: 99

SEQ ID NO: 4816 - RNA, 80 nt, Human
ucuuguguugcgacuucgugguggugcuaagaaaaggaagaagaagucuuacaccacucccaagaagaauaagcacaaga

SEQ ID NO: 4817 - RNA, 76 nt, Human
gacaaguuucaaaggaagaacauuuaugacucaugccacaaaagcuauuuauagauggcuucuuucugauuauguc

SEQ ID NO: 4818 - RNA, 75 nt, Human
gcauggacaaaauugaaacuaucaacuuucaugaaguuaaggaaguugcgggaaucaaguuugguguuaccaugc

SEQ ID NO: 4819 - RNA, 104 nt, Human
ucacguccuaggagccgcauguucaugauugagaucgcaggcgugaagcuuuuguacacuggugauuucucaagacaagaacguuggcacuuaauuggagguga

SEQ ID NO: 4820 - RNA, 79 nt, Human
ccugauucugggcaucuucaugaccauucugcucgucaucaucccaguguuggucguccaggcccagcgauagaucagg

SEQ ID NO: 4821 - RNA, 82 nt, Human
aaaugguuaacucauaaugaauuauaaaacuuugauaguuacauuguacuaucauuuaugaggcauuuauuuuucauuauuu

SEQ ID NO: 4822 - RNA, 66 nt, Human
agaaacaaaagcaggugcugaaucaugaaaaccucaauuauuuuuagcaugccucuuaauuuuucu

SEQ ID NO: 4823 - RNA, 66 nt, Human
uccccugguuucuugucgucugugcuugauucuugaacagguaaccacuugagaggaugccggcga

SEQ ID NO: 4824 - RNA, 91 nt, Human
auauguaauagaaaauggauaaaaauauuuaagcauagcacacauaguauuacuuuuuugaaauuuuuacuuuaguauauauauuacauau

SEQ ID NO: 4825 - RNA, 84 nt, Human
ccaugccuauccaggugcugaagggccugaccaucacucauuaagaacagaggaggcugccuguuacuccugguguuggcgugg

SEQ ID NO: 4826 - RNA, 64 nt, Human
agugguagcuuuucacuaggaucucuggguacauagcagauuuaaguugacuaaggcaaacacu

SEQ ID NO: 4827 - RNA, 69 nt, Human
aucuuccaguuguucauagucagauugucaugccuugauaaguucauguccugacugggccugggagau

SEQ ID NO: 4828 - RNA, 72 nt, Human
gccuuuaacaaaguccugugaaauuaaauuucuuacuuucaaagauugugauccaggagaagugaauaaggc

SEQ ID NO: 4829 - RNA, 81 nt, Human
ucccuacaguugugccaugcauuuaagcgagugguauugcaggaaguccauucuggcucugguggauggacagccuuggga

SEQ ID NO: 4830 - RNA, 60 nt, Human
cccguggggugguaacagugaagagaccuuagagcccuuucuaugcuguucaaaaauggg

SEQ ID NO: 4831 - RNA, 66 nt, Human
ggcgccaaggucucacuaugcucacaccuguaaucccaggcuuugaggaagagggaucugggcacc

SEQ ID NO: 4832 - RNA, 70 nt, Human
gggucuggguaggaaggaaaguggggaaaggugaaaggacagggaaucuuuuccuuucugcuuacaaccu

SEQ ID NO: 4833 - RNA, 73 nt, Human
ugaagagccagaagugaagagugacuaguacaaauuauaaaaagccacuagacucuucacuguuagcuuuuua

SEQ ID NO: 4834 - RNA, 92 nt, Human
acuggucuaucaguccagacgggggccuuuggucaaauauucuucugauuacuuccaagcccccucugacuacagauacuaccccuaccagu

SEQ ID NO: 4835 - RNA, 61 nt, Human
cuaggcaaugugguacaugcuauacaggcaacugagcagagcauucaugccacugaccugg

SEQ ID NO: 4836 - RNA, 67 nt, Human
ggcaucaacaaagagaaauggcgaacgagggcugcucaccacuacuacuauucucuucugcugagcc

SEQ ID NO: 4837 - RNA, 95 nt, Human
gagccccuccacagaaggccccccucuuccccgacacgaggucaccgcuuuuuucucuguguggggcacaugugggggggcuucuggggcggcuc

SEQ ID NO: 4838 - RNA, 71 nt, Human
ucucucucucuaucucuucuccacacgccgaucucgccgauguguguauagccucucuuuagagagagaga

SEQ ID NO: 4839 - RNA, 73 nt, Human
uguguggggagagcucucccaccacacagagugugccugugaaacucugucucuucucuguucuccccccaca

SEQ ID NO: 4840 - RNA, 76 nt, Human
uuuaaagagguggccauugcagggucucugccuccccagcagguguggcagaugccucccggccacucguuuuaaa

SEQ ID NO: 4841 - RNA, 85 nt, Human
cuacagccaugucacuccuggcgacccuggggcuggaugcuggacagggcccugcucccagcuagugggcugggauggcucguag

SEQ ID NO: 4842 - RNA, 91 nt, Human
gggaaacuccccccggccccugccccccuggcucccuaugagguccuugggggaugcccuggagggcgggcuuccaguggggggagagccc

SEQ ID NO: 4843 - RNA, 84 nt, Human
ccagauccagugauugacuuggcaugaaaaugagaaaaugcagacagaccucaacauucaacaacauccauacagcacugcugg

SEQ ID NO: 4844 - RNA, 79 nt, Human
gaagaggaagauuugugcagaccaagagcaccacagacuacaacugcccagcuucaucuaaauacuuguuaaccucuuu

SEQ ID NO: 4845 - RNA, 101 nt, Human
agcuguuuguguaacuucccuuaacuguguaguagcugucuguguaacucuccuuaccugugcagcugcagguaugucuuagguaagcacaaaguacagcu

SEQ ID NO: 4846 - RNA, 87 nt, Human
acaugagggaggaaaauuaauaucacagcaguaacggcacccuuuacauuaugugcagugauuauuuuuuaaagucuucuuucaugu

SEQ ID NO: 4847 - RNA, 106 nt, Human
cuaucuuuucaucucauuaauucaauuaaaaccauuaccuuaaaauggguuucuuucgaaguguggugucuuuuauauuugaauuaguaacuguaugaagucauag

SEQ ID NO: 4848 - RNA, 69 nt, Human
uucuuuaaaucauuuaucuggauuuuuauguuuuauuagcauuuucaagaagacggauuaucuagagaa

SEQ ID NO: 4849 - RNA, 74 nt, Human; identical to SEQ ID NO: 1525

SEQ ID NO: 4850 - RNA, 66 nt, Human; identical to SEQ ID NO: 1526

SEQ ID NO: 4851 - RNA, 64 nt, Human; identical to SEQ ID NO: 1527

SEQ ID NO: 4852 - RNA, 83 nt, Human
cacugcuugaauacacugagacccggaaucaguuccuugaugagcucauggagcuugagaucuucuuagcccagagagcagug

SEQ ID NO: 4853 - RNA, 60 nt, Human
ucagcugcaacaccuguuuaugauccuggccucaccaagguauguggaccgagugacuga

SEQ ID NO: 4854 - RNA, 62 nt, Human
aggaaagaaaauacuagcuuggaguccagcuucucccaagucuccuugcuccuucuucuccu

SEQ ID NO: 4855 - RNA, 96 nt, Human
gcugggcauagaaagaaaucagaggcuacaccgaaaucaucuaaauaggaauagugaauaccuuugauaguuuugauugccaucuuuuugcuuagc

SEQ ID NO: 4856 - RNA, 61 nt, Human
aaauguuuaauaaaucauauauacacauagaaauuuuuauguuggauucuuacuuacauuu

SEQ ID NO: 4857 - RNA, 91 nt, Human
auguauaguggcacaauuugucuucauucugauggagggggagaaggaagauuuuccccuccaucuguuucuagagagccuacugcugcau

SEQ ID NO: 4858 - RNA, 60 nt, Human
cugaaaagccagaaaaugaaaaucagacuaauucucagucuucggauuucuucuuuucag

SEQ ID NO: 4859 - RNA, 80 nt, Human
ggauugcuccauuaaguuagacuaugauacuuaguuuauaaacagauuauaccaucauagcuauuuaagagaagcccucc

SEQ ID NO: 4860 - RNA, 93 nt, Human
ggaaaaauauuuuucuguuggauuguaggaagagaagauaaacaaaguaguuaguaucuuccauuuuaauaauugguuuggaaauauuuuuuc

SEQ ID NO: 4861 - RNA, 60 nt, Human
ccacgacaucucgggagauacuucaggggauuaccggaagauacugcugaagaucugugg

SEQ ID NO: 4862 - RNA, 63 nt, Human
gcagcgaaaccgaccuccuggacaucagaucagaguauaagcggauguacggcaagucgcugu

SEQ ID NO: 4863 - RNA, 60 nt, Human
ccaguucgaggcugcugcgcgcccugcgcuaugugcuggcaaaucaguggucagagcugg

SEQ ID NO: 4864 - RNA, 60 nt, Human
ucaccugggccgcacccuugggcucuaugggaaggaccagcaaggaggcagcccuagugg

SEQ ID NO: 4865 - RNA, 74 nt, Human; identical to SEQ ID NO: 1641

SEQ ID NO: 4866 - RNA, 99 nt, Human
gagacagacucucacugugucgcccagguuggagugcaguggcgugaucuccacuuacugcaaccucugccucccggguucaagugauucuccugccuc

SEQ ID NO: 4867 - RNA, 74 nt, Human; identical to SEQ ID NO: 1693

SEQ ID NO: 4868 - RNA, 80 nt, Human
aaggaagugagggcagcggcugucuucuguucaggacuauucuguuugcuucacuuccccggccuggcaaucacuuccuu

SEQ ID NO: 4869 - RNA, 75 nt, Human
aguuugaucauuugcagaaaguggagcaccgcaaaaccugugaggguuaccauuaucuuaaacccuggucaagcu

SEQ ID NO: 4870 - RNA, 69 nt, Human
cugaggggucccugcaucuguugagauucccuacugugaaaucaggggacugacaggugaugucugcag

SEQ ID NO: 4871 - RNA, 60 nt, Human
gcuuuggucucugcuggacagcccuugggggagcagggaguccagcagggccaguccugc

SEQ ID NO: 4872 - RNA, 68 nt, Human
cgggugagccccaaggagaagaccguaccaaugaaagaaaucaacgcuugcuccugacagcucauccg

SEQ ID NO: 4873 - RNA, 62 nt, Human
gccaucugcggguccagauccaacaguaauugacuauugaaggcuugcgggcccacaguggu

SEQ ID NO: 4874 - RNA, 71 nt, Human
gugguuagugucuaugcucagaauccaaugcggagagagucucguccucugguucagacuguaguaaccac

SEQ ID NO: 4875 - RNA, 67 nt, Human
agccuggacuagaauuucuucuggguauuacagagacaaguuuaucacagaaauuuuuuuccuggcu

SEQ ID NO: 4876 - RNA, 73 nt, Human
ggugaucgaggaguucuacaaccauacauggguccaccgcuauggggagagcauccugcccaccacgcucacc

SEQ ID NO: 4877 - RNA, 93 nt, Human
cugcaggaagaagaagaucugauggccgugggugucugggaagcucuucguggccucaaugcccuccuuuauccucaucuuucuucuaugcag

SEQ ID NO: 4878 - RNA, 96 nt, Human
ggcuuuacaggaggugacuuaaguucaaaggaggccuguuagucuaauccaacauggguguccuuuggacauaagaagauaccagcacugugugcc

SEQ ID NO: 4879 - RNA, 80 nt, Human
gucgucgcgcgcccuaguggccccgaaaaagccuucagaaacacuuguugagggcaccggcggcccagagguagacagac

SEQ ID NO: 4880 - RNA, 75 nt, Human
acaccacacccagccaggucugaugaguuuuuaaggugcaaaugggaguuuuucaggcugugugggaaguggugu

SEQ ID NO: 4881 - RNA, 61 nt, Human
gcuguaaagcaugcugggcccacaucugcuuugaugcuucucaagcccaggauggugcagc

SEQ ID NO: 4882 - RNA, 98 nt, Human
guuuuuuuuuauuuauuuugguuuggagacggaguuucacuccagccugggugacagagcaaaaaaacuccgucuaaaaaacgaaaaccaaagagaac

SEQ ID NO: 4883 - RNA, 60 nt, Human
gcuugcgcauucccaagucagaugucguguacaccgauuggaaacaggauaagugugagc

SEQ ID NO: 4884 - RNA, 84 nt, Human
acccaggugaccaccguugaaggugccuaugauugaagcguuaggcuguuaacaugcacgcacuguagacgcuggccacugggu

SEQ ID NO: 4885 - RNA, 82 nt, Human
cugggggcucugguucccggaucuccgugucccgcuccaccagcuucaggggcggcaugggguccgggggccuggccaccgg

SEQ ID NO: 4886 - RNA, 69 nt, Human
auauugcgaaaaaauauuuuuacaauuuacagucuugucugacauuugguaaauagcuaauugugauau

SEQ ID NO: 4887 - RNA, 67 nt, Human
gccggcgggccggugagcucacuagcugacccggcaggucaggaucuggcuuagcggcgccgcgagc

SEQ ID NO: 4888 - RNA, 62 nt, Human
ggagcgcggcuugaggagggcggggccgccccgcaggcccgccaguguccucagcugccucc

SEQ ID NO: 4889 - RNA, 117 nt, Human
ggugagcucacuagcugacccggcaggucaggaucuggcuuagcggcgccgcgagcuccagugcgcgcacccguggccgccucccagcccucuuugccggacgagcucugggccgcc

SEQ ID NO: 4890 - RNA, 93 nt, Human
uguucaaaguacucaagaugaauuugaggaacuuacaaugucucagaaaaauggugggaauguucuucagaugauguaugagaaaccugaacg

SEQ ID NO: 4891 - RNA, 94 nt, Human
caccgcccacccauuuaggugcccuauagugugggguugauaugaagaaaugcagaucccuacccccccacaccucagugguugaggggcugug

SEQ ID NO: 4892 - RNA, 65 nt, Human
ucucggugugauugaugccccucaaaacucucguugcaguugggggguagagguugacacuguga

SEQ ID NO: 4893 - RNA, 83 nt, Human
aauuuggcuaaacuuaaaagcaagcuggguuccucuggggauauaaauaagcauuggacugggaggaaacagcuggccaaauu

SEQ ID NO: 4894 - RNA, 67 nt, Human
gcugcagagggagaaggacaggcagugucguggccuggagcucauugccucagagaacuucugcagc

SEQ ID NO: 4895 - RNA, 81 nt, Human
gguggugccaaguguaucccucgcguuuaaagaggggauggucacacuauuccaagaaacuggggcaggcagggaaccacc

SEQ ID NO: 4896 - RNA, 91 nt, Human
uuuauauguguugaaaaccaaaaugacaucuuuuuaaagcuuauccauaaaaaaaaauagaugucuuuuauaguggaaaaacacaugggga

SEQ ID NO: 4897 - RNA, 62 nt, Human
ggaccgaaguagucuucauucaaggaacuaugaaauucaagaaugagagcuagaucgugacc

SEQ ID NO: 4898 - RNA, 63 nt, Human
gaggcccuguaugacaucugcuuccgcacccugaagcugaccacccccaccuacggggaccuc

SEQ ID NO: 4899 - RNA, 101 nt, Human
ggggacuacaauggccacgucggucuggguguuaagugcuccaaggagguggcaccgccauccguggggccaucauccuggccaagcucuccaucgucccc

SEQ ID NO: 4900 - RNA, 97 nt, Human
uccgcggagguuucggcaguggcauccggggccggggucgcggccguggacggggccggggccgaggccgcggagcucgcggaggcaaggccgagga

SEQ ID NO: 4901 - RNA, 65 nt, Human
cccgaaacacggcacugggggacugcagcccugcugaccaggcuguccuccuagcccugucaggg

SEQ ID NO: 4902 - RNA, 119 nt, Human
ucagcagcacaaaucccuuuuauuaaccaucuuccuuuucucgaguauacacaaguagaaaagaaacagugaaguaccccgauagggaggguggggagaggaugggagggggcuccuga

SEQ ID NO: 4903 - RNA, 65 nt, Human
gcguggaggcuucguuuucuauuuauuuacauuauugggcuuucuuuugugagcggaccuuuugu

SEQ ID NO: 4904 - RNA, 87 nt, Human
aaagucuagaaauagccccaacuguaccuagaaaucuacuguaugauaacagugguaucucuaaauacugaggcauauauggacuuu

SEQ ID NO: 4905 - RNA, 78 nt, Human
cugaaguuuccuguuuaaaaacugguaauaccuuuaagaagauuuuuuaaagacuagaaaaaguucggcugauuucag

SEQ ID NO: 4906 - RNA, 87 nt, Human
uucaggaaguacaagaagauaauaaggguucuucuaucacgaaaggggaagaggccuaaaaauuccuucgcauuguaaauucaggaa

SEQ ID NO: 4907 - RNA, 60 nt, Human
ccaaguguguguugugagguguguuccgagaaggaauuccuucacagagucgcguacugg

SEQ ID NO: 4908 - RNA, 64 nt, Human
uccauagcccugguuuggggcccggguucguuguuuccccggggcuucccagcuggguggugga

SEQ ID NO: 4909 - RNA, 62 nt, Human
caggauuucacugcgcuaaccaggaugggucucgaucuccugaccucgugauugaaauucug

SEQ ID NO: 4910 - RNA, 86 nt, Human
cauauagucugcacaauucaauaugaacguuuuauuuccaacaaguauguagguucacuguuccaugacuugugcauaacaauaug

SEQ ID NO: 4911 - RNA, 73 nt, Human
auaugcaacuauauuucauguuguaauacaaaggauuaaacuacaaaagugaaaauuaaaagucauugcauau

SEQ ID NO: 4912 - RNA, 75 nt, Human
aagccauguucacagcauauuauuucugugacuggauuguugauagugacagagaugaccuaaaauuaauggcuu

SEQ ID NO: 4913 - RNA, 90 nt, Human
gaggguugaaguuuaaccuuauuuuggguuuguguaaauugugaaaacaauauuaacuagaugcagcauggguuaaacgcucacaucuuc

SEQ ID NO: 4914 - RNA, 129 nt, Human
ucaggagccucuugggggugcucuggugccgccagccucuccgcucucuccaugcuguggagcaggugagggcagcagcgaggcacagggucagggcuacgggacguucgcauagaggaggcgacguga

SEQ ID NO: 4915 - RNA, 76 nt, Human
gguucgggccaagcggggcacagcccagggcuucgggaugcccgaggugggccaucacacucugcuggagccaacc

SEQ ID NO: 4916 - RNA, 60 nt, Human
ucuuugugagucugaaguauugcccaaagcggaggagcgagaaccacggacucgaaggga

SEQ ID NO: 4917 - RNA, 89 nt, Human
agcaagaaaauggcuggaagagcugucuuguuggcaggaccuccuggaacuggcaagacagcucuggcucuggcuauugcucaggagcu

SEQ ID NO: 4918 - RNA, 64 nt, Human
uggcuuaugggcgggccccggggggacaggauauucugucauggaugggccgucaaugaagcca

SEQ ID NO: 4919 - RNA, 64 nt, Human
uacugugccuuuagguugccuggagaaauuacgaaaugauacaaggaaguuagaaagcagagug

SEQ ID NO: 4920 - RNA, 68 nt, Human
gagcugguguaaccauugggcgggccgcugaggccgcccgccgguggggcccgcuuguucaccgguuu

SEQ ID NO: 4921 - RNA, 73 nt, Human
gaucagacagaucacagcuacggugacauuucugccacuguuggaaguuucuuguucauuugaucugcugauu

SEQ ID NO: 4922 - RNA, 69 nt, Human
uggccauggcgcugcagcucucccgggagcagggaaucacccugcgcgggagcgccgaaaucguggccg

SEQ ID NO: 4923 - RNA, 88 nt, Human
gggacaguuuggugcugcagugaauuaauuacguaggcaaucgagacucuaauaaggauauuuugcuccagcaauuccugauuguccc

SEQ ID NO: 4924 - RNA, 67 nt, Human
acugcuagagccgagcgaagcgaugccuaaaucaaaggaacuuguuucuucaagcucuucuggcagu

SEQ ID NO: 4925 - RNA, 66 nt, Human
gauuagacucaccaauuuauuuuguuuuucuccuucugugggagaagaucuuugggaguaagaauc

SEQ ID NO: 4926 - RNA, 68 nt, Human
gcacugcuccugaucccugcugcccucgccucuuucauccuggcuuggcaccggaguggaguucgugc

SEQ ID NO: 4927 - RNA, 70 nt, Human
acuuccccaggugccuccagcgcacucgcgacaauauucggcguuaaaaaggggcgauauacgggggagu

SEQ ID NO: 4928 - RNA, 60 nt, Human
caagcuucuaugggccaaagucacgcaggugccaagucuagugguggcagggaagacuug

SEQ ID NO: 4929 - RNA, 91 nt, Human
uggacacagacuugccaggcagccuggggcagagugaagagaagcccgugccugcugcgccugugcccagcccugguggacccugugccca

SEQ ID NO: 4930 - RNA, 71 nt, Human
cuugggucgcuugcuguucgugauaugagacagacaguugcggugggugucaucaggagcagguggacaag

SEQ ID NO: 4931 - RNA, 62 nt, Human
uagcuggaggcaugggcaaggggggucccagguaguaaacuccccaggucggcugagggcua

SEQ ID NO: 4932 - RNA, 74 nt, Human
cuagcagaguagaaauaagaggccaggauucagcaccagguaggcuggauuccuucuuagguggcucaagcugg

SEQ ID NO: 4933 - RNA, 76 nt, Human
uauggggcuggucucaucauaucuaaagaacugcccagcuuuuacgcauuuugaaugugguggaaccagcugcaua

SEQ ID NO: 4934 - RNA, 61 nt, Human; identical to SEQ ID NO: 387

SEQ ID NO: 4935 - RNA, 72 nt, Human
aacaaaugcuuccaggugaaaaaacugaucagcuauauagagucacucaguuuuuaauaaaggccauuuguu

SEQ ID NO: 4936 - RNA, 88 nt, Human
uuucaugcuuugaacgaucagacaagcuuuacauucuaccuaugguguucagaaauugaggcuaacauugaaauaucaaagcauuaaa

SEQ ID NO: 4937 - RNA, 79 nt, Human
cccuccuuuauuccccaucccccaacuugagaacagggugacaccugagcucacucgggcuuagggagucuaagggggg

SEQ ID NO: 4938 - RNA, 72 nt, Human
uuucacagacucuaagucguaaaacucuguuacaaaggaaaugauugagaaaaugaauucgagucuuugaaa

SEQ ID NO: 4939 - RNA, 70 nt, Human
ccugaggagaagugcuguguggugggcacucuguucaaggccaugccgcugcagcccuccauccugcggg

SEQ ID NO: 4940 - RNA, 109 nt, Human
cugguggauguggugacgggcagcuuggggacgacaggggagcacgugcagcgccgcccacgucucccggguuaucccucgcuggcaccuccucagccacagcacccag

SEQ ID NO: 4941 - RNA, 70 nt, Human
gagggaugcagcucccaaaauguauaaggaagaaggccuaaaagcauucuacaaggggguugcuccucuc

SEQ ID NO: 4942 - RNA, 69 nt, Human
gcuuugaacguacuguugaagcacuguacaaguuugugguuccuaagccccgcagugaauguucaaagc

SEQ ID NO: 4943 - RNA, 71 nt, Human
augugguccaaccugggcauuggccuagcuaucucccugucugugguuggggcagccuggggcaucuauau

SEQ ID NO: 4944 - RNA, 74 nt, Human; identical to SEQ ID NO: 4179

SEQ ID NO: 4945 - RNA, 66 nt, Human
ccgugggagucugcuacaccauuuuugauuugggcuuccgcuuugauguggcaugguuccugacgg

SEQ ID NO: 4946 - RNA, 83 nt, Human
ggccuccuggcucccucugcugguguuguuggggccuggccggcggguccaggcgggaccggcuguggugugccuucguggcc

SEQ ID NO: 4947 - RNA, 68 nt, Human
gagacgggguuucaccauguuggccagacuguucucgaacuacugaccucagguaauccacccgccuc

SEQ ID NO: 4948 - RNA, 103 nt, Human
uugagacagagucuugcucugucacccaggcuggacuccaguggcacaaucucagcucacugcaaccuccgccuccuggguucaggcaaaucuccugccucaa

SEQ ID NO: 4949 - RNA, 76 nt, Human
caggcugaucaacuaugccaccaauggugccaaguuccugaagcggcacauguaugauguggccaguggccgccug

SEQ ID NO: 4950 - RNA, 85 nt, Human
ucaggaccccaagggggagcugcagggccagaaugugcugaccguccgguacucgcuggagcugacugcugcccgcuuggcuugg

SEQ ID NO: 4951 - RNA, 72 nt, Human; identical to SEQ ID NO: 3359

SEQ ID NO: 4952 - RNA, 84 nt, Human
ucgaccugagccacggcucugcccagguuaagggccacggcaagaagguggccgacgcgcugaccaacgccguggccacgugga

SEQ ID NO: 4953 - RNA, 63 nt, Human
aaguuucugaguuagccauuucuuuuucuucuuugaaucagugauuugguuuuucuuucacuu

SEQ ID NO: 4954 - RNA, 93 nt, Human
agagaaucugccuaagugggaauuaaaauggcuaaaguuuuaaccucaauuauuuugaaaccagaacauuuuccccacuauagacgauuuucu

SEQ ID NO: 4955 - RNA, 60 nt, Human
uggcucaagcuauccucccgccucugccucacuaagagcugggauuacaggccugagcca

SEQ ID NO: 4956 - RNA, 61 nt, Human
ggucaggcaggcugguccguggaacuuaaucagugggggccuggucagagaggacuugauc

SEQ ID NO: 4957 - RNA, 82 nt, Human
cccagauccacaugcgggaggcccugcagcaaauggacaaugccguguauacguucgagacccuccugcaccaggagcuggg

SEQ ID NO: 4958 - RNA, 68 nt, Human
ccaacaaagauuucagggauuuugucagggagaaaaaguaucggacagaagcugagauguuuggaugg

SEQ ID NO: 4959 - RNA, 72 nt, Human
gacagcagagauggugaagggccugugcgggaggcgacagugaaacccuuugccaucgacauauuuccuguc

SEQ ID NO: 4960 - RNA, 81 nt, Human; identical to SEQ ID NO: 4279

SEQ ID NO: 4961 - RNA, 87 nt, Human; identical to SEQ ID NO: 4280

SEQ ID NO: 4962 - RNA, 88 nt, Human
gaugaguuuuccccacuaaagaaugcugauagucagaaugggaaagacaacccuacuacugcaaggcaugcuuugaugucccuucauc

SEQ ID NO: 4963 - RNA, 74 nt, Human
gcugcaauccauggugaugucgcgucaugcaugcacugacuaugagugcccugcacuacugacaauggagcagc

SEQ ID NO: 4964 - RNA, 69 nt, Human
ggacaggcucugcccaggaagagcugccgccuccuggcacagcaaacguuccaggccugggcccuguuc

SEQ ID NO: 4965 - RNA, 60 nt, Human
ccagugaaguguccagaccauugucuuccaaccccagcuggccucuagaacacccacugg

SEQ ID NO: 4966 - RNA, 62 nt, Human; identical to SEQ ID NO: 206

SEQ ID NO: 4967 - RNA, 92 nt, Human; identical to SEQ ID NO: 3371

SEQ ID NO: 4968 - RNA, 68 nt, Human
cccggccucguugcccccuggcgacccucagcucaucgcuaucaucguggggcagcucaagagcaggg

SEQ ID NO: 4969 - RNA, 75 nt, Human
cuccagcaaacgacaaccaacugcacgauggucugaggcagagugugguucagucagggaggucagaagcuggag

SEQ ID NO: 4970 - RNA, 63 nt, Human; identical to SEQ ID NO: 123

SEQ ID NO: 4971 - RNA, 65 nt, Human; identical to SEQ ID NO: 404

SEQ ID NO: 4972 - RNA, 91 nt, Human; identical to SEQ ID NO: 124

SEQ ID NO: 4973 - RNA, 93 nt, Human
ugcagugucucgggacuucgucaguguccugcacacggacuguagugccgaaaaaacaaagagacaugcaggccaucacgcccagacaaugca

SEQ ID NO: 4974 - RNA, 127 nt, Human
agguguuuguauuuccuagagaaucuguuacugaucauguaaacuugaucacaccgcuggagaagccucuacagaacuuuaccuuguguuuucgagccuauagugaucucucucgugccuacagccu

SEQ ID NO: 4975 - RNA, 62 nt, Human; identical to SEQ ID NO: 1277

SEQ ID NO: 4976 - RNA, 62 nt, Human; identical to SEQ ID NO: 4194

SEQ ID NO: 4977 - RNA, 67 nt, Human; identical to SEQ ID NO: 4195

SEQ ID NO: 4978 - RNA, 70 nt, Human
gcaguguaggugguuugaccagaggcgccgacaugcccggugccugccuccccacggccgcgugugcugc

SEQ ID NO: 4979 - RNA, 71 nt, Human
ucaaguucugagauuuuugcucccugaccuaaaauccugugggaauaauugauuucucaucuuuuacuugg

SEQ ID NO: 4980 - RNA, 64 nt, Human; identical to SEQ ID NO: 1375

SEQ ID NO: 4981 - RNA, 61 nt, Human; identical to SEQ ID NO: 2204

SEQ ID NO: 4982 - RNA, 64 nt, Human; identical to SEQ ID NO: 175

SEQ ID NO: 4983 - RNA, 98 nt, Human
gugggguaaaaccccagacgccaugaaagcugccauggcccuggagaaaaagcugaaccaggcccuuuuggaucuucaugcccuggguucugccccgc

SEQ ID NO: 4984 - RNA, 66 nt, Human; identical to SEQ ID NO: 4291

SEQ ID NO: 4985 - RNA, 94 nt, Human
ccgcacuuccagggccuaugcaggaugugcagguggcguucgcgcuccgccgaggugcgaaacuugccuuugcaguaggggcaacggaaggcgg

SEQ ID NO: 4986 - RNA, 65 nt, Human
auguuuuccaacuacuuuugauaacuaagaaauauuauauucugaaaaaaguucauacuaaauau

SEQ ID NO: 4987 - RNA, 62 nt, Human
caagcagaguggggaugucaccugcaacuugcacggauugccggguggcccccagcugucug

SEQ ID NO: 4988 - RNA, 66 nt, Human
gacaaugccgcugcacugccuacuuugagggaucgaggugugaggugaacaagugcagccgcuguc

SEQ ID NO: 4989 - RNA, 71 nt, Human
gucggcacugcagcaaauuggcggcuccuguaccaugaacagcaaaaugaugccugagugccagugcccac

SEQ ID NO: 4990 - RNA, 79 nt, Human
agcauauguuacuuaccuuguuauuaaauauuucuugaaaagcaaauuuuaaugguuuaauuuuauguggacguauguu

SEQ ID NO: 4991 - RNA, 94 nt, Human
gcauuugguuuuaaaauuuuuaugcuaauauaaaugcucaaguaauuuaaaauauugaaagcaucccuguugguauaaauuucugaguaaaugc

SEQ ID NO: 4992 - RNA, 74 nt, Human
gccuuugaaauggcuuugcuaaaaugcucccgccacaaaguuguaggaaaugggaagaggagucaacuagaggc

SEQ ID NO: 4993 - RNA, 106 nt, Human
gagggaaaauuugucgaagaggagggauugcggcaauuaaagagagggaagaagaggaagagaggucccgucguuguuuguuuuucuuucuuuacaaauuucuguc

SEQ ID NO: 4994 - RNA, 97 nt, Human
uuagcuucagggagaaacaagaacuuuuccaaaagucaggaucuucgaaacgugagaaauugaugauugcaaaggugaaauuucggauugaagguaa

SEQ ID NO: 4995 - RNA, 69 nt, Human
cucauggacagcuucgaugcuuuuggaagcauucaccaucuuccaguucaaagucgugucuuucaugag

SEQ ID NO: 4996 - RNA, 64 nt, Human
cuggggacggggccuuccgcgagucucccaccucucgggggacugcagggagaggcgucuccag

SEQ ID NO: 4997 - RNA, 131 nt, Human; identical to SEQ ID NO: 2677

SEQ ID NO: 4998 - RNA, 66 nt, Human
cagggggccuggccacaugagggaguccacagaaaaccuucccuccuggcccacccagguccccug

SEQ ID NO: 4999 - RNA, 83 nt, Human
guagguucucugcagggcccaaggucaacggaacauuccaggccgacuuuccucugggcccugccacccacggaggaaccuac

SEQ ID NO: 5000 - RNA, 85 nt, Human
uccuuccuccucuucuuuucuccuucaucgguggugcugcacaaaagaaaugcuguuguaauugaccaagaccuugggggaacga

SEQ ID NO: 5001 - RNA, 66 nt, Human
uuuccgugacucuccauacgaguggucaaacucgagugacccacugcuuguuucugucacaggaaa

SEQ ID NO: 5002 - RNA, 79 nt, Human
aguacgagcugggcgcagcgcuguacaucggcugggcggccaccgcgcugcucaugguagggcggcugccucuugugcu

SEQ ID NO: 5003 - RNA, 69 nt, Human
aguuuuuuucuuccauuucaggugucgugaaaacuaccccuaaaagccaaaaugggaaaggaaaagacu

SEQ ID NO: 5004 - RNA, 61 nt, Human; identical to SEQ ID NO: 823

SEQ ID NO: 5005 - RNA, 79 nt, Human; identical to SEQ ID NO: 1810

SEQ ID NO: 5006 - RNA, 107 nt, Human
cacuccggccuggccuguaguuugacccugagcuggugcuggucucgugcaggauuugacucagccaucggggacccugaggggcaaaugcaggccacgccagagug

SEQ ID NO: 5007 - RNA, 70 nt, Human
acauuguuaaggucaugauguacagagcagucacuuucaacuuuguuaaauuaauaaaacaugacaaugu

SEQ ID NO: 5008 - RNA, 78 nt, Human
ggaagagagauggagucacauggauuuuuggugggcauuauucugaacuuucguauccaaguuagucccccuuauucc

SEQ ID NO: 5009 - RNA, 61 nt, Human
auccuuuuuaaauguaauguggcagauugugaagggugguugcuaauuagagaagaaggau

SEQ ID NO: 5010 - RNA, 98 nt, Human
gacuauuugaaaagccaggaguaaauuacaagucuugacaauggugccaugucugccagucagggcaguguucugcugauggcacugauucaucaguc

SEQ ID NO: 5011 - RNA, 62 nt, Human
caaccagcuuagaaaaauaaucaugguagacaccuuaguucauucuucuaauaagccuguug

SEQ ID NO: 5012 - RNA, 60 nt, Human
aggguagagcugucucucagguuauaaccucucagguggaggccugagcccucagacccu

SEQ ID NO: 5013 - RNA, 73 nt, Human
ccucaagcucccauggaccugugggcggggaguuaaaucccuguuccaucucgccuguucccagaguuugagg

SEQ ID NO: 5014 - RNA, 62 nt, Human; identical to SEQ ID NO: 206

SEQ ID NO: 5015 - RNA, 93 nt, Human; identical to SEQ ID NO: 207

SEQ ID NO: 5016 - RNA, 65 nt, Human
gcuaggagcugccaaggccucuugagugugacaucacagguuagaggcccugcugagcugcuagc

SEQ ID NO: 5017 - RNA, 80 nt, Human
ggaagcugggcucuugccaugccaguagcuugcuuacgaccuugggcaagucacuuuuuccucucugggguccugugucc

SEQ ID NO: 5018 - RNA, 86 nt, Human
cuggagcgcggaccuggacaagugcauggacugcgcgucuugcagggcgcgaccgcacagcgacuucugccugggcugcgcugcag

SEQ ID NO: 5019 - RNA, 71 nt, Human
ccacaccacuaugcaaccuuucugauauuccuccuguuggcauaaagagcaaagcaguugugguuccaugg

SEQ ID NO: 5020 - RNA, 72 nt, Human
agacagggggcacaugccaaacaccacagggcaucagaugcugcucugugugcucacaaguguucccugucu

SEQ ID NO: 5021 - RNA, 60 nt, Human
cagaagcgagcaacugaagcgaaggggcuuccuaaggugccccuuccaggcuugucucug

SEQ ID NO: 5022 - RNA, 60 nt, Human
uuucuaaccaucacaauucagugaaguacaaaacacugaguuacaggcugugggaagaga

SEQ ID NO: 5023 - RNA, 116 nt, Human
gcuuugggcccucggccgacuuucccaggcagugcaggcuagcccaguccaggagugugcagccuggcuugggucgagcucugucacaucuggauaagcaacugggggcugagagu

SEQ ID NO: 5024 - RNA, 115 nt, Human
uuuauuaccucccagacugagcccccgaccuggcccagccuggcccguccccaauccaaugggcuggccaggccaccugcaccagggaggacagcugcuggcagggacuaauaaa

SEQ ID NO: 5025 - RNA, 68 nt, Human
acgaaugggagguguuauuagaauuguuaauaauauuugauuuaaacugugauacuuagccaggaugu

SEQ ID NO: 5026 - RNA, 62 nt, Human
ggggaucaugaaacagcccaauuagcauuaagcugcauguuaaaauugugguaaugaugccu

SEQ ID NO: 5027 - RNA, 62 nt, Human; identical to SEQ ID NO: 206

SEQ ID NO: 5028 - RNA, 92 nt, Human; identical to SEQ ID NO: 3371

SEQ ID NO: 5029 - RNA, 111 nt, Human
ggcaggcuagagauuucacccauuuugugggcuggaguuaccaguagcuccagcaguuacccugaagagagauugggcuucagccuucagcaggugguucucucccaugcc

SEQ ID NO: 5030 - RNA, 67 nt, Human
ggccugcaggagcuucugcugcugaccccaugcugaguggccaguggggagcggcgcccggcaggcu

SEQ ID NO: 5031 - RNA, 73 nt, Human
uacgaggccuggguugcggugaggcugucaguggauccgugcuuugucggccagcguuucugcagucuuugua

SEQ ID NO: 5032 - RNA, 65 nt, Human
guuucagcacugauggaggcagccuggccaccgggggccgggaucggagucuccucugcugggac

SEQ ID NO: 5033 - RNA, 68 nt, Human
cauuuaauagguuagaauguaaauuaaaguguagcaauagcaacaaaauauuuauucuacuguaaaug

SEQ ID NO: 5034 - RNA, 61 nt, Human
ccaaucuuaccauggacacugaaauucgcauagaguguaaggcguacggugagaacauugg

SEQ ID NO: 5035 - RNA, 71 nt, Human
ggggaguauggggagcauuaucaaggaguaagggggacccauucgaugaaacacuucugcaacaaaucccc

SEQ ID NO: 5036 - RNA, 80 nt, Human
ggugggggccaucuuuauugggcgguggugggaggggguucccaccuaagcccugugcuauaaagagccggccguccucc

SEQ ID NO: 5037 - RNA, 69 nt, Human
uaccaucuugagcaaguuggucacgaggaaaaccaauuauuugauggcuuucacaugcucauucaggua

SEQ ID NO: 5038 - RNA, 70 nt, Human
augucuuauuauuaaaguuaccuauuauuguuggaaauaaacuaauuuguauggguuuagaugguaacau

SEQ ID NO: 5039 - RNA, 71 nt, Human
ggcuugauuugcuuggugaccgaauuacuagugacuaguuuacuaacuaggucauucaaggaagucaaguu

SEQ ID NO: 5040 - RNA, 60 nt, Human
guuggggugugagagguuuucucgcucuagggagauucuucaagcaaucacuaugucaac

SEQ ID NO: 5041 - RNA, 76 nt, Human
uccacaugcguguggcagcccaaggcuuuguuguaggagcaaugacuguugguaugggcuauuccauguaucggga

SEQ ID NO: 5042 - RNA, 73 nt, Human
auguauuauuuuaacuaacaaaggcauauuauacauuuuuuucauauauaaacuuuggaauaggauuuuacau

SEQ ID NO: 5043 - RNA, 85 nt, Human
guaguaaauuuuuaguauuuuuuagauugaauuuguaucauauuugcuagcaaauugaguauaaagaguagcauauuuuuacuac

SEQ ID NO: 5044 - RNA, 64 nt, Human
uacccaugugucaaaguuuuaugcuaaauucugaauagaauaguuguaacucccacucugggua

SEQ ID NO: 5045 - RNA, 90 nt, Human
gagguuuuuauucacaaaguugauggucugucugaugaucacaaaauagaaacacagagggacauucaucaaagggccaaugaugaccuu

SEQ ID NO: 5046 - RNA, 65 nt, Human
ggaugacuacauggaggcuuuaacaagacuucacauuacuguuucuaaagccuacaaaguuaacc

SEQ ID NO: 5047 - RNA, 96 nt, Human
uucaauauuugaagccuuuaguaagguggugcagaaacucauuccacaacugccgaccuuggaaaaccuauuaaauaucuuuauaucaguauugaa

SEQ ID NO: 5048 - RNA, 64 nt, Human
auucagcggcaguggugcuuucccgaaucucagaaugccuguuaaaagaucacugaaguuggau

SEQ ID NO: 5049 - RNA, 81 nt, Human
auucauuugauccuucagaaaucacaaggaagaagaaguguuauaacuuauucuccaacaacuggaacuugucaaaugagu

SEQ ID NO: 5050 - RNA, 65 nt, Human
ggaauaaaaauaacaacucuuugugggcgcggcguuuugggcccgagaagagguuuuuuuaaacc

SEQ ID NO: 5051 - RNA, 74 nt, Human
uauuguuuauguauugucuauggcugcuuuugugcuucauacagcaguguugacaaguuaugacagagacagua

SEQ ID NO: 5052 - RNA, 60 nt, Human
uuuuuuuuuaauuuuaaaacauuuuuauuauaaaauacaaauaaaaacauugagaaaaga

SEQ ID NO: 5053 - RNA, 83 nt, Human; identical to SEQ ID NO: 3611

SEQ ID NO: 5054 - RNA, 70 nt, Human; identical to SEQ ID NO: 3612

SEQ ID NO: 5055 - RNA, 65 nt, Human; identical to SEQ ID NO: 3613

SEQ ID NO: 5056 - RNA, 78 nt, Human; identical to SEQ ID NO: 660

SEQ ID NO: 5057 - RNA, 75 nt, Human
cccuugguagaugggugcacaaugacgaccuggggaacaacugagaaaccaaggugugaaucuguugaccauggg

SEQ ID NO: 5058 - RNA, 67 nt, Human
gguggacaagucagacuaugacaugguggauuaucugaaugagcuaugggaaagcugcuuggaagcc

SEQ ID NO: 5059 - RNA, 68 nt, Human
cccuggagccacgcguugucuucaucaaaaagucccagcuggagcuuggggugcacuugugugguggg

SEQ ID NO: 5060 - RNA, 72 nt, Human
ccugcaugggguguuuguggccgagguggaggaugacaguccugccaaggguccugacggccucgugccagg

SEQ ID NO: 5061 - RNA, 75 nt, Human
gugcaguaccgcccugaggaguucacgaaggccaagggccugccuggugacagcuucuacaucagggcccuguac

SEQ ID NO: 5062 - RNA, 61 nt, Human
cauccacagcuuaccccauucuguacagagcucaccgggauuauucaagccaugguggaug

SEQ ID NO: 5063 - RNA, 60 nt, Human
gcuaaauggccggaccauggagauugagucuaccuuucacauguauguccagccuguagu

SEQ ID NO: 5064 - RNA, 101 nt, Human
ggccaucuuugaacuccuggacuauauugugaacgagccaccuccuaagcugcccaacgguguguucacccccgacuuccaggaguuugucaauaaaugcc

SEQ ID NO: 5065 - RNA, 66 nt, Human
gggccucacuuguccaccuuccagcagauguggauuagcaagcaggaguacagacgagucgggccc

SEQ ID NO: 5066 - RNA, 85 nt, Human
ggguauggaaucuugcggcauccacgagaccaccuucaacuccaucaugaagugugacguggacauccgcaaagaccuguacgcc

SEQ ID NO: 5067 - RNA, 100 nt, Human
gaggaaggagauucugcuaguaaaaaggagugggggaagaauggccauugggagacaacaagcagacucaaccaggccucuuuguuggcuuccuuuccuc

SEQ ID NO: 5068 - RNA, 111 nt, Human
gagggacaggcacuugagcuuggucacagucagaaggguggaggggagucagccgucagccccuccaccaagcugccacucagugaccaggccugucugccucucacccuc

SEQ ID NO: 5069 - RNA, 84 nt, Human
ggcugccuccgguaaccacaguccugccacugucccuuccucccuaggaugacgcggcauggcaagaacugcaccgcaggggcc

SEQ ID NO: 5070 - RNA, 94 nt, Human
caggaacugcgcuucgcuuccgagauccugugcacaggcaccugccaaauacacgguguaugacgcaaagggauaugugaagccccagaacuug

SEQ ID NO: 5071 - RNA, 91 nt, Human
aaacgugcaaauguauuguagagacuuuaugauuagaauggcauauauuuaugaaacuuaaagaugaauguuuuauugaauuuguagguuu

SEQ ID NO: 5072 - RNA, 61 nt, Human
guagacaaaaauaacacaauaacaggagacuuccauaagcuuguguauuauguuagucuau

SEQ ID NO: 5073 - RNA, 70 nt, Human; identical to SEQ ID NO: 1335

SEQ ID NO: 5074 - RNA, 76 nt, Human; identical to SEQ ID NO: 3277

SEQ ID NO: 5075 - RNA, 70 nt, Human
uuuuuuuccuccccucucaguagcacggaguccgaauuaauuggauuucauucacuggggaggaacaaaa

SEQ ID NO: 5076 - RNA, 74 nt, Human
gguuuugaaaauguacaauauguauaauuuuuaaaauguuuuauuauuuugaaaauaauguuguaauucaugcc

SEQ ID NO: 5077 - RNA, 76 nt, Human
uugaccuuuucuuccuggacuauugaaaucaagcuuauuggauuaagugauauuucuauagcgauugaaagggcaa

SEQ ID NO: 5078 - RNA, 125 nt, Human
ccagcccggguguucugaaauuggcgacuucaaauugcuguucuuuuggaauuagaccuuaagguagguuuuaagauucaaggggaacgaauuuaagaggguugguuaggggcaaacgggcgcgg

SEQ ID NO: 5079 - RNA, 65 nt, Human
accuggccacuuguacccgggucccgcggagaucgggggcccgaaagggcacaaaggggucacgu

SEQ ID NO: 5080 - RNA, 62 nt, Human
gagguaucugcugcgccugagaugaguaaacugucguuucgggcgcgggcgcuagacgccuc

SEQ ID NO: 5081 - RNA, 76 nt, Human; identical to SEQ ID NO: 4356

SEQ ID NO: 5082 - RNA, 83 nt, Human
ccacuuuauuauggaugauccagcaggaaacaguuacuugcagaauguguaugcgccugaagaugauccugagaugaaggugg

SEQ ID NO: 5083 - RNA, 89 nt, Human
gguuacccuaacagcuaaugauaagacaaguguuuccuucuccucccucccgggacaaggugucauauacaaugucauuguuugggacc

SEQ ID NO: 5084 - RNA, 68 nt, Human
guaugaugucuaucaguauuuucugccugagaaugaccucacugaggagauguugcugaagcaucugc

SEQ ID NO: 5085 - RNA, 71 nt, Human
uuccugcgcucuacgguuuuccaugcccccuccaguuugggggucuaaaccaaacaggaaaggugcagggg

SEQ ID NO: 5086 - RNA, 87 nt, Human
agaggaagcgggaggagcugagcaacguacuggccgccaugaggaaagcugcugccaaugaaagacugagccccuccccugcccucu

SEQ ID NO: 5087 - RNA, 62 nt, Human
ggcgucugaccaaacacaccaaguucgugcgggacaugauucgggagguguguggcuuugcc

SEQ ID NO: 5088 - RNA, 64 nt, Human
uauggccgugggccucaacaagggccacaaagugaccaagaacgugagcaagcccaggcacaug

SEQ ID NO: 5089 - RNA, 80 nt, Human; identical to SEQ ID NO: 2364

SEQ ID NO: 5090 - RNA, 64 nt, Human
uaugaauaaaugaacauuugcaauuuuaaaaucccaaaucacuugccaauguugcaaauucaua

SEQ ID NO: 5091 - RNA, 64 nt, Human
ccaagucugacccacucugcguccuuuuacaggaugugggagggggcagcugggcugagcuugg

SEQ ID NO: 5092 - RNA, 94 nt, Human
gcuggagugcacucgcgcgggggguaauucggggucuggguucuggugccugcgcagcuuuccccgauggcccacugcgugaccuugguucagc

SEQ ID NO: 5093 - RNA, 81 nt, Human
ggacugaacgggugcggaacugcucaagcccugaguucuccaagacucuacaugcuugaguaccgcuuauugagacagucc

SEQ ID NO: 5094 - RNA, 83 nt, Human
cacuuuacaacuuucaauaauagccuguaauuuauauuuacugugugaauuuuuaguccuauauuuuaauaauuuguaaauug

SEQ ID NO: 5095 - RNA, 75 nt, Human
ggaaauggaagugaaacccaguucggugacugcagccgcaaguccuguguaccagauuucagaacuuauauuucc

SEQ ID NO: 5096 - RNA, 71 nt, Human
uggagagaaaaacaaugcauucauuguugccagcuuugaaaauaaagaugagaacaaggaugagaucucca

SEQ ID NO: 5097 - RNA, 71 nt, Human
augaaccauaaugcugcuucuugugcaugucugcucugauauacgucgaacaauguagcagccacugucau

SEQ ID NO: 5098 - RNA, 62 nt, Human
caggucgagguggugcaucuaucuauggcaaacaguuugaagaugaacuucauccagacuug

SEQ ID NO: 5099 - RNA, 82 nt, Human
gguccacauucacuuucccguggaagguucaggaagcgacaccguuguuaucaggggcccuuccucggauguggagaaggcc

SEQ ID NO: 5100 - RNA, 64 nt, Human; identical to SEQ ID NO: 696

SEQ ID NO: 5101 - RNA, 100 nt, Human; identical to SEQ ID NO: 698

SEQ ID NO: 5102 - RNA, 60 nt, Human; identical to SEQ ID NO: 2705

SEQ ID NO: 5103 - RNA, 72 nt, Human; identical to SEQ ID NO: 1989

SEQ ID NO: 5104 - RNA, 79 nt, Human
gcacgacgacggucgcuggucgcugcaguccgaggcgcaccggcgcuacuucggcggcaccgaggaccgccuguccugc

SEQ ID NO: 5105 - RNA, 117 nt, Human
gccacgacgggcgccugguggcgcgccccgagccggccacuggcuacacgcuggaguuccgcuccggcaagguggccuuccgcgacugcgagggccguuaccuggcgccgucggggc

SEQ ID NO: 5106 - RNA, 67 nt, Human
ucuacagcgucacccguaagcgcuacgcgcaccugagcgcgcggccggccgacgagaucgccgugga

SEQ ID NO: 5107 - RNA, 67 nt, Human
gcugcguaagcaauaugacuugauuucggaaucagaacacaagcacauacugaaggcacuacgcagc

SEQ ID NO: 5108 - RNA, 87 nt, Human
uacucugcugacagagcauuuccuugggugaucauaguuucgagguagaguuuaugaucaucucauaagcuuugucuagaaggagua

SEQ ID NO: 5109 - RNA, 91 nt, Human
guccuucuucaccgacgaugacaagcaagaccaccucagcuggggaguggaaccuugucgauuaagaacggaguuggacagaaugaagugc

SEQ ID NO: 5110 - RNA, 78 nt, Human
guguuaaaggaagguucugaauauagagucaaaauucacuucaaagugaacagggauauugugucaggccugaaauac

SEQ ID NO: 5111 - RNA, 84 nt, Human
ucagcacaccuacaggacuggggugaaaguggauaaagcaacauuuaugguuggcagcuauggaccucggccugaggaguauga

SEQ ID NO: 5112 - RNA, 60 nt, Human
uguggaggaggaugacgaugaugagcuggacagcaagcucaauuauaagccuccaccaca

SEQ ID NO: 5113 - RNA, 106 nt, Human
gccgucuccgccucgggguccgccgggggcgcccugcugagcgcuacccacgugcgucgcgccaccucgcgggcgaccccgcggccaaggcccccggcggagcggc

SEQ ID NO: 5114 - RNA, 83 nt, Human
guuugcagacucugugggaauuguuuuucaucuguuucuaugguugucaaaugaauucuucacccacccuacaguuugcuaac

SEQ ID NO: 5115 - RNA, 69 nt, Human
ugucuucaguauuaggucuccaacucuuguaaaaaguuuauauguaggauaaaaaccuuuuagaggaca

SEQ ID NO: 5116 - RNA, 65 nt, Human
aguuuggguuuguuuuuguuuuaacuauuuugaagguuaggugagaugggcaaauaggcuuaacu

SEQ ID NO: 5117 - RNA, 78 nt, Human; identical to SEQ ID NO: 99

SEQ ID NO: 5118 - RNA, 65 nt, Human; identical to SEQ ID NO: 247

SEQ ID NO: 5119 - RNA, 80 nt, Human; identical to SEQ ID NO: 100

SEQ ID NO: 5120 - RNA, 73 nt, Human
gucauuuugguuuacaauggaaacucggggaauucaaaauuaacauccugugcccggugagcuucuuauagac

SEQ ID NO: 5121 - RNA, 86 nt, Human
uucccacuggaacuuuuucuccaauucgggguacuagccgggacugggauuuucugggaaagauucucaguuggaggaacggggaa

SEQ ID NO: 5122 - RNA, 60 nt, Human
ggcaccccagacaccuuccuucaacccagggcggguuggacaggguuccccugugguucc

SEQ ID NO: 5123 - RNA, 62 nt, Human
agcauccagagucugguguccuuuaaucaguuggcagguucaaccuggaggccacuggagcu

SEQ ID NO: 5124 - RNA, 86 nt, Human; identical to SEQ ID NO: 1403

SEQ ID NO: 5125 - RNA, 71 nt, Human; identical to SEQ ID NO: 77

SEQ ID NO: 5126 - RNA, 84 nt, Human
uccuugaacuuggaaccugacaauguugguguugucguguuggaaaugauaaacuaauuaaggaaggagauauagugaagagga

SEQ ID NO: 5127 - RNA, 91 nt, Human
uggcuaugacacaaucauuuaccagaaacguuuccaugauggguccuguugaaaggaggaaagcugucuggauuuaugugugccaugguca

SEQ ID NO: 5128 - RNA, 101 nt, Human; identical to SEQ ID NO: 5064

SEQ ID NO: 5129 - RNA, 89 nt, Human
ccacuuuguuggcccuuccagugggauuaucgagcauguuguuuuuucauagugccuuuuuccuuauuucaaggguugcuucugagugg

SEQ ID NO: 5130 - RNA, 100 nt, Human
ugaggcaggagaaucgcuugaaccugggaaguggagguugagugagccgggaccgugccauuguacuccagccugugugacagagcgagauuccgucuca

SEQ ID NO: 5131 - RNA, 63 nt, Human
guugaccuaaacugugaaugagcuauccauuuuuaccuacacgauaguauugagcaagucaac

SEQ ID NO: 5132 - RNA, 82 nt, Human
uggggaaaaggucagaaagaccuccugacuccauguuacaguagacaaaacaaguuggacucuuuuggaccuauaaacccua

SEQ ID NO: 5133 - RNA, 76 nt, Human
agcuuguacaaauuucaagaaaauaagaagauaccuaaagguuuuuagcuaaggaaaauaagauuuguaaauaguu

SEQ ID NO: 5134 - RNA, 62 nt, Human
agucuauuaaagaauucaacuaugcaaauuugugucuauuuaacaugaggcucuuuaagacu

SEQ ID NO: 5135 - RNA, 86 nt, Human
ucagaaccaauaauuaggauagauuuuaugcucucuucauuacauugugaagugucuuguguagucauauucuauuguuggaauga

SEQ ID NO: 5136 - RNA, 94 nt, Human
gcgugguucugaugaaguugaacugguuuguguugcaggucucucucgagaauggguacguguccuaaaggauuccaucaaagugaaccuucgc

SEQ ID NO: 5137 - RNA, 131 nt, Human
gcuucuggugacacacagcugggauuagcccagggcuugugcgaaacccuggacuuccggccaggaaggcacggaagagggcauggguguugccgggcccgggugggggcucagcuuuggucaccaggggc

SEQ ID NO: 5138 - RNA, 72 nt, Human
aucgugccuuagcaaacaucuucgugugagcuacuucgugagcccacauguauguguuuguugaggggcgau

SEQ ID NO: 5139 - RNA, 67 nt, Human
uacaucuuagaaucuuucugugguauauaauuaucucauuuuuuaccacauaauauuuuauaaugug

SEQ ID NO: 5140 - RNA, 98 nt, Human
ggauccucucuuggacuuuagcucuccaucucugcugaggggauaugaagguauuugcauuucuccuguuaaugaagggauuaaguucauaagauucc

SEQ ID NO: 5141 - RNA, 74 nt, Human; identical to SEQ ID NO: 2717

SEQ ID NO: 5142 - RNA, 62 nt, Human
gcuucuguuugugcacaaguaacacgacgacugaaaucugcaacuacugcaaagacgcgggc

SEQ ID NO: 5143 - RNA, 82 nt, Human
gacgcauuuaacaugcaaaugagacaacggaaaggcacucucucuguuaacuuuguugaucucuauguuguauguagugguc

SEQ ID NO: 5144 - RNA, 71 nt, Human
gagcuuugggagagauggccgauaauggagucuggauaaugaauaggcccggcauaugguuccccaaacuc

SEQ ID NO: 5145 - RNA, 65 nt, Human
gugucccuaaaaugugucgcgcgagggaaugguagcagaccucgagaaggcuuuggauuugacac

SEQ ID NO: 5146 - RNA, 64 nt, Human
ucuguaugcuuugagcaagaucguggccagcaaaggagguuugaaauggucaccaaagagaaga

SEQ ID NO: 5147 - RNA, 84 nt, Human
gggaauuuugauaugaaaagaaacuagucauuuauuuauacaauaggcuuggcucaaaaguguuuuucagaccucgguauuccu

SEQ ID NO: 5148 - RNA, 61 nt, Human; identical to SEQ ID NO: 3893

SEQ ID NO: 5149 - RNA, 87 nt, Human
uuuuauuuuuaguagcaaauuuggauguagacugacagacauagcugaaugucuuaauaaauuuaaauuugaagauuaaaaaaaaaa

SEQ ID NO: 5150 - RNA, 81 nt, Human
gaugaguggcuuuucgagggaccuggcacguacaucccccggaaggaaguggaggucguggagaucauucaggccaccauc

SEQ ID NO: 5151 - RNA, 60 nt, Human
gggcaugagggacuagagcgcauuggauucccaaguguuacucaaguguucucagagucc

SEQ ID NO: 5152 - RNA, 65 nt, Human
gauguccuucccucccuaauaacuguaaauauauaaauaugucagguuaaagggaaaagguguuc

SEQ ID NO: 5153 - RNA, 81 nt, Human
ggcagcguggcgggaacggcugcuucuccucugcccagggcccuguucuuggugggacucggcugccccuccucugcugcc

SEQ ID NO: 5154 - RNA, 76 nt, Human
accagcuggauaaggacaucaauaccuucucuaugcgugucagggagugguacggguaucacuuuccggagcuggu

SEQ ID NO: 5155 - RNA, 61 nt, Human
gcacgaggacugguccauuaucaucuucaccaacacgugcaagaccugccagauucugugc

SEQ ID NO: 5156 - RNA, 65 nt, Human
aaggcuucgucugccaaacagagacucaagugugccagucuccaaaaauuuggagaaagagcuuu

SEQ ID NO: 5157 - RNA, 123 nt, Human
cuuuuaugccccggaacuccuuuucuuugcuaaaagguauaaagcugcuuuuacagaauguugccaagcugcugauaaagcugccugccuguugccaaagcucgaugaacuucgggaugaagg

SEQ ID NO: 5158 - RNA, 77 nt, Human
uggagaucugcuugaaugugcugaugacagggcggaccuugccaaguauaucugugaaaaucaagauucgaucucca

SEQ ID NO: 5159 - RNA, 60 nt, Human
gaagcaggagccggugaaaccugaagaaggcagagauauggcaaacaggauuggcgcuuu

SEQ ID NO: 5160 - RNA, 64 nt, Human
ucuucagcuacccgccuucgucuccgaguuugcgacucgcggaccggcguccccggcgcgaaga

SEQ ID NO: 5161 - RNA, 79 nt, Human
ugugcccacaguguuugagaacuauguggcagauaucgagguggauggaaagcagguagaguuggcuuugugggacaca

SEQ ID NO: 5162 - RNA, 78 nt, Human
cugggguguuuauggcaagucacuuugacagacauuauuguggcaaauguuguccgacuuacuguuucaacaaaccag

SEQ ID NO: 5163 - RNA, 80 nt, Human; identical to SEQ ID NO: 100

SEQ ID NO: 5164 - RNA, 60 nt, Human
acaagacuugcauagaaaaauaagauauuauauuuuguuuguauguauuuagagauuugu

SEQ ID NO: 5165 - RNA, 72 nt, Human
ggauacuuauagacagacuuauuggacaauuaugauuuuugcagagaaccagaaucagggucuguuuauucc

SEQ ID NO: 5166 - RNA, 71 nt, Human
uacuaagucugaagaugggcauuaugcaagaacagauuaugcagagaaugcuaacaaauuagaagaaagug

SEQ ID NO: 5167 - RNA, 81 nt, Human
gccccucucugcccagggaaggcaccgcccucaaagacaaggcuuggccgggcagugaccuucccugagcggagggguggc

SEQ ID NO: 5168 - RNA, 72 nt, Human
ccgugcgcguagcugcggccgugguccgcgcccuuccucggcgggccggacuggucuccagaaaugcuaugg

SEQ ID NO: 5169 - RNA, 86 nt, Human
guggucucccgcgcgggacggagggacuggccggagcuggcgcuuucucagcacuagaucuggacuccgacccggcgccagaauac

SEQ ID NO: 5170 - RNA, 84 nt, Human
ugccugccaagccaguggcucagcuucucuuauggugacauucugcaugucauuaaugccucugaugaugagugguggcaggca

SEQ ID NO: 5171 - RNA, 108 nt, Human; identical to SEQ ID NO: 710

SEQ ID NO: 5172 - RNA, 75 nt, Human; identical to SEQ ID NO: 74

SEQ ID NO: 5173 - RNA, 79 nt, Human
gcccccgguaucauuccucgaauuuccagugcgggaaccaaugcagacuggcauuaaggcuguggauaagcuggguggc

SEQ ID NO: 5174 - RNA, 87 nt, Human; identical to SEQ ID NO: 76

SEQ ID NO: 5175 - RNA, 71 nt, Human; identical to SEQ ID NO: 77

SEQ ID NO: 5176 - RNA, 89 nt, Human
cauccacccaggaggaggcacuggcaggcugggagcccaugggaguaauuggccucauccugccaaccacauucuccuuccuugagaug

SEQ ID NO: 5177 - RNA, 71 nt, Human
cuaugugaaugggaagugguuaaagccugaacacagaaauucagugccuugccaggaucccaucacaggag

SEQ ID NO: 5178 - RNA, 89 nt, Human
gcggcugcuguggacccuggaaucccuggugacugggcgggcuguucgagagguucgagacggggacguccagcuggcccagcagcugc

SEQ ID NO: 5179 - RNA, 65 nt, Human
gagggugaaugcugcugagcccacccagagguuguuggaguucagcggggcagcuugucucccuu

SEQ ID NO: 5180 - RNA, 70 nt, Human; identical to SEQ ID NO: 999

SEQ ID NO: 5181 - RNA, 61 nt, Human
auuucauuuacuucaauaaucuagaguuaauguuuuaaucucacuguaauguuaaugaaau

SEQ ID NO: 5182 - RNA, 92 nt, Human
cauuucauaucuaccucccaaagauauuccuguagauucagucuuacacacuuaauuugacuuggaauugucuuaaggaugcuuuugaauug

SEQ ID NO: 5183 - RNA, 131 nt, Human
uuauuuaaccaaucaaaucagagucaccuuaauguuuaucuuuuauuuuuuuacugaguagaaaaagaauuauuuaaaaauaaaugugagcacagguugucauacuuugaauaucaagaugaaaauaauga

SEQ ID NO: 5184 - RNA, 63 nt, Human
cuccacuuccaguugcaugggacucuccccacauuaagaguuccaauagcugguucuauagag

SEQ ID NO: 5185 - RNA, 64 nt, Human
ugaaauacagcauuuuuguugccaauguuucguaccagcagaaucuucugggugcuguauuuga

SEQ ID NO: 5186 - RNA, 60 nt, Human
ugggcguaauccuuguucuccucuggaguaaagaggauuuggaauauggaaggcacucca

SEQ ID NO: 5187 - RNA, 62 nt, Human
cuuacagcugagaccuguuccugcaagccagcugccuugucugaacagaacguagugguagg

SEQ ID NO: 5188 - RNA, 85 nt, Human
ggagcagugagcacagcaguucuggcuugcuguccaaagcaugggauucuggagugcagccagagcccugcugaguuccugcuuc

SEQ ID NO: 5189 - RNA, 65 nt, Human
ucugcuacugggcucagucccaggccuuuucuugggcuuucgggacuggcugaggccuagacaga

SEQ ID NO: 5190 - RNA, 68 nt, Human
acagcagccuccacugcccgaccugggagggacggcgagggacugggaugggcagcugagcugugggu

SEQ ID NO: 5191 - RNA, 81 nt, Human
gcuucugacacaggacggucguggagaagaugcccuggaggagccacuugggcuuguuuuuccaccagaccccgaagaagu

SEQ ID NO: 5192 - RNA, 74 nt, Human
ccaaugggagguuuguguacagucagugaaauugaagaacauuuaugucauuaauggacuuacauagcuauugg

SEQ ID NO: 5193 - RNA, 84 nt, Human
guauuuuuuauguuggcacgaauuggagaccugagccaguaaaagcagacgcugggcucuaagagauacagaugugaaggauau

SEQ ID NO: 5194 - RNA, 105 nt, Human
agacaaggccucgcucugucacccagggcuggagugcaguggguguggaucaauaccucacugcagccuccaacuccuggggcucagggcaauccuuccuugucu

SEQ ID NO: 5195 - RNA, 83 nt, Human
gggggaguuguggugcuucugggucucugggccccgccugcuggccugggaugcccucauguugggaagcauuccgugccccc

SEQ ID NO: 5196 - RNA, 72 nt, Human
ggcuuggugagggccaccaccccacuguggggggcuaacuuuccggguggugaaaaagcccuccucauugcc

SEQ ID NO: 5197 - RNA, 71 nt, Human
ucacccgcuugugaaauggccccgcuauaucagguugcagcggcagagagccauccucuauaagcggcuga

SEQ ID NO: 5198 - RNA, 65 nt, Human; identical to SEQ ID NO: 1245

SEQ ID NO: 5199 - RNA, 76 nt, Human
ccggggcggccucgcgggugacuccgggcuccguggcugucccggaccccaccucuucccugccgcccgccaccgg

SEQ ID NO: 5200 - RNA, 84 nt, Human; identical to SEQ ID NO: 1246

SEQ ID NO: 5201 - RNA, 61 nt, Human
gaccaaggccagcuucucugugguggggauggugaagucccugacgcggagcuccaugguc

SEQ ID NO: 5202 - RNA, 86 nt, Human
gggcgugcuagcaguucgcccggugguucacguacuacuggagcucaccaagaucgcagucaccguggcggucuguaguagugccc

SEQ ID NO: 5203 - RNA, 74 nt, Human
ggugcugcugugcugggccacgcgccuggaaggagaccaacauggcgcugcacccagauaccucugcagccacc

SEQ ID NO: 5204 - RNA, 83 nt, Human
gguguggcucacggccaucgugcuguucugcuagguucuauguguaccgcucagaguggcaugaaggucuacaacuccacacu

SEQ ID NO: 5205 - RNA, 63 nt, Human
augggguugggaucacaauauggucugguccaaucugcaucuuguugugucccaagacccuau

SEQ ID NO: 5206 - RNA, 81 nt, Human
caguucugauggggcuccaacagccaggcugugguccuuugacguuccucaccuguugccaaccuaucccguagugaacug

SEQ ID NO: 5207 - RNA, 72 nt, Human
gagcugcugggucccucaucucccucaucuauuauagauugacuuacagcagggagagaaucucuuuagcuc

SEQ ID NO: 5208 - RNA, 65 nt, Human; identical to SEQ ID NO: 2386

SEQ ID NO: 5209 - RNA, 72 nt, Human
uagagauguaugcagauguguccauauuauguccauauuuacauuugaauagccaugauguaugcaucucug

SEQ ID NO: 5210 - RNA, 62 nt, Human; identical to SEQ ID NO: 3062

SEQ ID NO: 5211 - RNA, 90 nt, Human
ccuuccgcuugcgcugugagcugaggcgguguaugugcggcaauaacaugucaaccccgcugcccgccaucgugcccgccgcccggaagg

SEQ ID NO: 5212 - RNA, 70 nt, Human
gugaagaauggcauuccuucuaacagaauuauuucgggaggguuuucucagggaggagcuuuaucuuuau

SEQ ID NO: 5213 - RNA, 65 nt, Human
cuagaaggagaaucugugguuuucgccugauagaccacagggccaaucaccacagcuucuuguag

SEQ ID NO: 5214 - RNA, 85 nt, Human
cgugagcuucuuauagacaccagaaaaaguuucaaccuuguguuccacauuguucugcuguucuuuguccaaaugaaccuuuaug

SEQ ID NO: 5215 - RNA, 79 nt, Human
agcaugacugacacgucugaccccugagaagguggucucugccuuccuaaaggugucaucuguguucaaggacgaagcu

SEQ ID NO: 5216 - RNA, 87 nt, Human
gugaggauggcagugcaggaugcaguagaugcccugaugcagaagugcuuucaacuccucguccuucaacuccaacaccuuccucac

SEQ ID NO: 5217 - RNA, 100 nt, Human; identical to SEQ ID NO: 698

SEQ ID NO: 5218 - RNA, 60 nt, Human; identical to SEQ ID NO: 2705

SEQ ID NO: 5219 - RNA, 72 nt, Human; identical to SEQ ID NO: 1989

SEQ ID NO: 5220 - RNA, 130 nt, Human
uggcccuccaggcccccgcccccaucccguccacguugcugugucgugaggugcagcgggucacccuguggcccguccugugacccauauuuagccguguuugggacuccgugucuucaaugguuuguua

SEQ ID NO: 5221 - RNA, 99 nt, Human; identical to SEQ ID NO: 2179

SEQ ID NO: 5222 - RNA, 80 nt, Human
cauguggcuugcucaguguuuaauugcaaguuuucaaucuuggacuuugaaaacaggauuaaaccguuaguauucgugug

SEQ ID NO: 5223 - RNA, 93 nt, Human
gacauuuaaaaaaugaggugaaagaaagcuauaguggcauagaaaaaguauaaagcucaguuaguuuuuuuauuauuauuauuauuaaaaguu

SEQ ID NO: 5224 - RNA, 70 nt, Human
gaugugaccuaccagauuucagaacauguguuaauaguauauaugccacugaaaacuuagguccuguauc

SEQ ID NO: 5225 - RNA, 88 nt, Human
gccucuucugaaggaaaagacaguguaguccugcaaaacaucuugaggacuacuguucgaagauuuuuggaagaauacugagaacggc

SEQ ID NO: 5226 - RNA, 84 nt, Human
cuaacaaucgcagccaugguaacagcuccaaauugcuuuucacaugugccacauggagcugaagaggcugccuugacuuguugg

SEQ ID NO: 5227 - RNA, 90 nt, Human
gagaucacuuuacccucaucagcauuuacaaggcuuaccaagacacaacucugaauucuagcagugaguacuguguggaaaagugguguc

SEQ ID NO: 5228 - RNA, 64 nt, Human; identical to SEQ ID NO: 3180

SEQ ID NO: 5229 - RNA, 74 nt, Human
uggaaguuacuuuaguucauuuaauuuuaauuuuauauuuugugaauauuuuaagaacuguagagcugcuuuca

SEQ ID NO: 5230 - RNA, 81 nt, Human
cgcccguccggcgcacgcuccgccuccgucaguuggcuccgcugucgggugcgcggcguggagcggcagccggucuggacg

SEQ ID NO: 5231 - RNA, 61 nt, Human
ggagggggcgggcggggggcgccgaccgcggccugaggcccggccccuccccucucccucc

SEQ ID NO: 5232 - RNA, 95 nt, Human
guuuuguuuuguuuuuuuuuugacggaguuugggcucugucacuccagcuggagugcagugucgagacuuacaccugggaacaacagaucacugc

SEQ ID NO: 5233 - RNA, 77 nt, Human
ucuggaggcugggagguccaagaucaaggugccagcagacauggugucuggugagggccgucuuccuggcuugcagg

SEQ ID NO: 5234 - RNA, 122 nt, Human
ccugcggaguaacugcaaagaugcuguccgugcgcguugcugcggccgugguccgcgcccuuccucggcgggccggacuggucuccagaaaugcuugggguucaucuuucauugcugcaagg

SEQ ID NO: 5235 - RNA, 106 nt, Human
ggcuuaaaggguauguccuugaacuuggaaccugacaauguuggugugucguguuggaaaugauaaacuaauuaaggaaggagauauagugaagaggacaggagcc

SEQ ID NO: 5236 - RNA, 126 nt, Human
guuggucugaaagcccccgguaucauuccucgaauuucagugcgggaaccaaugcagacuggcauaaagcugggauagcuggggugcccauugggcguggcaggugaaccgguaauugggaccgac

SEQ ID NO: 5237 - RNA, 71 nt, Human
gccuggagcaaauucuucuccucugcucuacgccaccucaggcagcagggacagggcaaagggcuccaggc

SEQ ID NO: 5238 - RNA, 60 nt, Human
gugacuccugcgggcgcccccacuucuuuuugggggugggagggccaggcgucggguuau

SEQ ID NO: 5239 - RNA, 68 nt, Human
agcugaugcugugugcugccagaugaccaggagcuccucaagggcugugccugcgcccagaagcagcu

SEQ ID NO: 5240 - RNA, 63 nt, Human
cucgagggucuguauaucacagagccaaagacaauucaggaacugcugugcagccccucagag

SEQ ID NO: 5241 - RNA, 109 nt, Human; identical to SEQ ID NO: 831

SEQ ID NO: 5242 - RNA, 128 nt, Human
ggugggauugcuugguggccuuggucguggucggugacugguuuggggccggcgccggaaccccugguuuggccucuuuccgaaguuccguggucuugaaaaacggcgguuuggcuuggcaaccugcc

SEQ ID NO: 5243 - RNA, 87 nt, Human; identical to SEQ ID NO: 76

SEQ ID NO: 5244 - RNA, 75 nt, Human; identical to SEQ ID NO: 74

SEQ ID NO: 5245 - RNA, 86 nt, Human; identical to SEQ ID NO: 1403

SEQ ID NO: 5246 - RNA, 71 nt, Human; identical to SEQ ID NO: 77

SEQ ID NO: 5247 - RNA, 65 nt, Human; identical to SEQ ID NO: 247

SEQ ID NO: 5248 - RNA, 80 nt, Human; identical to SEQ ID NO: 100

SEQ ID NO: 5249 - RNA, 93 nt, Human
agaucuaugauuuucauauauauacgaucuuucaucuuucauauacauaugaaaaucacagauccgauucauauauaugaaaaucauagaucu

SEQ ID NO: 5250 - RNA, 72 nt, Human
ccaggaacgaaaaugacggaacgggugcuggaggccucaggguugcccacuucccgugcuccaaguuucugg

SEQ ID NO: 5251 - RNA, 110 nt, Human
ccguguuugaggcagggcagugcccagcuccauguaaguccaucugucugggucccugagacccaagaugcagcaguguguggagcagggggccgcccugccugacccgg

SEQ ID NO: 5252 - RNA, 74 nt, Human
uuuuuuuuuuugggcuuucaaaaugugaacuuauaauaacaggucaaagugugggggucccccaggaacgaaaa

SEQ ID NO: 5253 - RNA, 82 nt, Human
cggcuccgagaagcagguucuucgugaguuccucgcaagggccggucagagcuacacauugagaaccugaacauggaggccg

SEQ ID NO: 5254 - RNA, 61 nt, Human
cuuccuccccgagcccaugggcacggccaacauccagcuccacgggccucccagagugaag

SEQ ID NO: 5255 - RNA, 80 nt, Human; identical to SEQ ID NO: 788

SEQ ID NO: 5256 - RNA, 79 nt, Human; identical to SEQ ID NO: 3903

SEQ ID NO: 5257 - RNA, 70 nt, Human
gucgcggccgaccccgucgccuccgccggcuaccauguccgcccaggcgcagaugcgggcccugcuggac

SEQ ID NO: 5258 - RNA, 100 nt, Human
ucaugggcacggcucgggacggagacgaaaccagacagagggucaaguuuacagaugaccgugucugcaagagucaccuucuggacugcugcccccauga

SEQ ID NO: 5259 - RNA, 60 nt, Human
gcagguauuuagaggugguucugucaggugaagucugaggagccaaagcuauguaugugc

SEQ ID NO: 5260 - RNA, 75 nt, Human
ucagcgcacgccacagggccaguuuuggcuggagaggccugaagcagagccagagcagguccaggugaguucuga

SEQ ID NO: 5261 - RNA, 76 nt, Human
ucucuggccgguuccgaaaagugaggaucagguaguggguggcugauugcacaaguuuagaacccaggauuaggga

SEQ ID NO: 5262 - RNA, 65 nt, Human
guaugaagcuaguugauuuccaguugcacuauuuccaguugccucugaaguucacagggcaauac

SEQ ID NO: 5263 - RNA, 78 nt, Human
caaugugcaacugacaucugcuagugaugaucugguaauauacaaccuguccaguagccgaacaguuuguuuuuauug

SEQ ID NO: 5264 - RNA, 82 nt, Human; identical to SEQ ID NO: 1938

SEQ ID NO: 5265 - RNA, 61 nt, Human; identical to SEQ ID NO: 1940

SEQ ID NO: 5266 - RNA, 73 nt, Human
ugaugcacaaaaugggacugcugaagaguggacaguuggaccuuacuuuggugaccccauacauuugugguca

SEQ ID NO: 5267 - RNA, 66 nt, Human
ccgaccuggcccagccuggcccguccccaauccagugggcuggccaggccaccugcaccagggagg

SEQ ID NO: 5268 - RNA, 98 nt, Human
ccucggccgacuuucccaggcagugcaggcuagcccaguccaggagugugcagccuggcuugggucgagcucugucacaucuggauaagcaacugggg

SEQ ID NO: 5269 - RNA, 67 nt, Human
gaagaggcagaccagcuuuauuuuugaacccaaucacugggugcccaacuaugacucugcuaucuuc

SEQ ID NO: 5270 - RNA, 68 nt, Human
uccuucucgggugccaaaguccugcaggccuccgacuggggagcagcgagacaagcagccgugaggga

SEQ ID NO: 5271 - RNA, 95 nt, Human
ugccgcucacagaguccggacaggaugucuuugauggagaagcccgccuugacagccaccacgcaggaugucccauccgggagaugaaugcagca

SEQ ID NO: 5272 - RNA, 89 nt, Human; identical to SEQ ID NO: 288

SEQ ID NO: 5273 - RNA, 79 nt, Human
ccgggugcggcuccaccccuuccacgucauccgcaucaacaagauguuguccugugcuggggcugacaggugagcuugg

SEQ ID NO: 5274 - RNA, 62 nt, Human
ggaggcugcccgaauuugugccaauaaguacaugguaaaaaguuguggcaaagauggcuucc

SEQ ID NO: 5275 - RNA, 66 nt, Human
gucucgcuucugccgaggugucccugaugccaagauucgcauuuuugaccuggggcggaaaaaggc

SEQ ID NO: 5276 - RNA, 70 nt, Human
gcugacuggggaagccauauuuacaucauccuguuuccuugaugaguccugugccugcccccucuccagc

SEQ ID NO: 5277 - RNA, 71 nt, Human
uaggaagucugagaaugaccuuuacuuuccuauuguuuguuaggagaguuuaacuucaaacuccaacccug

SEQ ID NO: 5278 - RNA, 79 nt, Human
agggagcuugucagaucacaccuuuuugccuuggaaauccuacagauuuccuguacgccuucauaucugauucuucccu

SEQ ID NO: 5279 - RNA, 70 nt, Human
auggaaggaugaagcggagaaagugccuucgagacauucacacauuucucuggacucagucuguuaacau

SEQ ID NO: 5280 - RNA, 67 nt, Human
ucuugcauucauuacauucaaaaggcauuucugcagugggaagucuccuguguguuaugaagcuaga

SEQ ID NO: 5281 - RNA, 74 nt, Human
ucaucagguucggaugagucucauguggcugcugcaccuccagauauaugcucucgaacaguguggccugauga

SEQ ID NO: 5282 - RNA, 66 nt, Human
gggauuacaggcguugagucaccgugcccggccaguacccacuucucuuaaugcucuaugaguucc

SEQ ID NO: 5283 - RNA, 102 nt, Human
ugagauggaauuucacucuuguuacccaggcuggagugcaauggcgcaaucucagcucacugcaaccuccaccuccuggguucaagugauucuccugccuca

SEQ ID NO: 5284 - RNA, 69 nt, Human; identical to SEQ ID NO: 3814

SEQ ID NO: 5285 - RNA, 69 nt, Human; identical to SEQ ID NO: 3815

SEQ ID NO: 5286 - RNA, 112 nt, Human
gagugacugggacuccaggugcgugccaccaagccaaacuucccuuucaguucuugacauuccuuuucugcuuuguaucaugcaucuccccagaucuccccuaacuucauuc

SEQ ID NO: 5287 - RNA, 70 nt, Human
ggaggcucucuguguugcccaagcuggacuugaacucuugggcuccagcaguccucccacaugagccucc

SEQ ID NO: 5288 - RNA, 77 nt, Human
gggccagcagacuaucuaggaagcaggaguagcaugacuuuaaagugauucucugugccaaucucugcaacugguuc

SEQ ID NO: 5289 - RNA, 71 nt, Human
caggggcgaguauccguugcugugucggagacacuaguccccgacaccgagacagccagcccucuccccug

SEQ ID NO: 5290 - RNA, 83 nt, Human
cgcggcgggagagcgugucccgccggcccugaacgccaugagccuggguccccgccgcgcccgcuccgcuccgacugccgucg

SEQ ID NO: 5291 - RNA, 70 nt, Human
guugaugccgcugagcucccccaacgccgccgccaccgccuccgacauggacaagaacagcggcuccaac

SEQ ID NO: 5292 - RNA, 80 nt, Human
uauuagguggugcauaaguaaugugguuuugccaugacuuuuauggcaaaaccugcaauuacuuuugcaccaacuuaaua

SEQ ID NO: 5293 - RNA, 87 nt, Human
uuugcaaucuaaagguaugaaucaaauagguacuuugaagcauuuaucaaguguaagcuauugaagugcauguauuuaaaaggcgaa

SEQ ID NO: 5294 - RNA, 75 nt, Human
acagagccacuggcacaagugcccuuagugcugccacacucccuggcagccaggugcccuggugcccaccccugu

SEQ ID NO: 5295 - RNA, 60 nt, Human
ggauggggagguugggggggcaggagcuucugucccccacauuccaugcaccuccccucu

SEQ ID NO: 5296 - RNA, 87 nt, Human
uggguauggaaucuugcggcauccacgagacaccuucaacuccacucaugaagugugacguggacauccgcaaagaccuguacgcca

SEQ ID NO: 5297 - RNA, 72 nt, Human; identical to SEQ ID NO: 3359

SEQ ID NO: 5298 - RNA, 79 nt, Human
cagcucuuaucugaaaacuacaccgcuguggcccagacugugaaccugcuggccgaguggcucauucagacagguguug

SEQ ID NO: 5299 - RNA, 69 nt, Human; identical to SEQ ID NO: 4233

SEQ ID NO: 5300 - RNA, 72 nt, Human
ugauucuggagaaggagaggaugaugcggagguucagcaagaaugccugcauaaauuuuccacccgggauua

SEQ ID NO: 5301 - RNA, 84 nt, Human
gcugaaacggcugugggaggcugggcccugggacgcccucucauagcguccagcgauccagacaaauaggagagccgugacggc

SEQ ID NO: 5302 - RNA, 78 nt, Human
aaggaguuuuucucguagugauucucaaagucuugguaggcauucgaacugguccuuucacuuugagauucuuuucuu

SEQ ID NO: 5303 - RNA, 62 nt, Human; identical to SEQ ID NO: 484

SEQ ID NO: 5304 - RNA, 70 nt, Human
gauggaaguaaucugcuuaacaaucucagaaggacugugcaagucaaugagucgcuugugaauucucauc

SEQ ID NO: 5305 - RNA, 80 nt, Human
guacucugcccgugugggcacuguccugggccagcgauuucugcugccagcugagaacaacaagccccaaagacagguac

SEQ ID NO: 5306 - RNA, 120 nt, Human
agcuggucagauacaaauaauagugacuucacaguuuaguaauuauaauggguacuuguuaacauuugguacuaaauuauguugcugcaaaguaauuaaaauuaguaucuagagcuaguu

SEQ ID NO: 5307 - RNA, 78 nt, Human
uggugaauuaucauuuauuuuguacuguguuaggcagcucuguaguugcuacauuuaaccaaauaagucaauuugcua

SEQ ID NO: 5308 - RNA, 64 nt, Human
uuccaacauacucaccucuucccauaaucccuuuccaacugcaugggagguucuaagacuggaa

SEQ ID NO: 5309 - RNA, 75 nt, Human
ggccuaaagcaagguguguauuuguuauucugaaauuguuuugcaucuggacaaauacuaaauaucccaguggcc

SEQ ID NO: 5310 - RNA, 62 nt, Human
uuaugcguuuaguuugacuuauuuuuaacaaaauauuagaaguuaugcuuuaaaauguuuaa

SEQ ID NO: 5311 - RNA, 61 nt, Human; identical to SEQ ID NO: 3214

SEQ ID NO: 5312 - RNA, 65 nt, Human
gaugcuccacagauaauccuaagagguuuucauuacauuuagccuaaucuggaagaucuggcauu

SEQ ID NO: 5313 - RNA, 64 nt, Human
uaccucaagcagagagagggcuucaggccaccccacuucuggcucuuuccaguccuagcaggua

SEQ ID NO: 5314 - RNA, 70 nt, Human
ggagcagcggcggcuugaggacccggggagacccucaagaaucgacccaucaggacgccagagcugcuuc

SEQ ID NO: 5315 - RNA, 84 nt, Human
ggggagccgccugccccuggcgcugcccccggccucccaggguugcucuucauggggcggcggcggcggcggcggcggcuccuc

SEQ ID NO: 5316 - RNA, 63 nt, Human
ucccucuaacacauucuucccuucuucacaaacggcccaugucagacgaaggcucaaggggga

SEQ ID NO: 5317 - RNA, 73 nt, Human
gaauuggcuugacauaauaaauauaaacauaagggcaauuuaaacauuggcaguaguuuauguaagucaauuc

SEQ ID NO: 5318 - RNA, 80 nt, Human; identical to SEQ ID NO: 174

SEQ ID NO: 5319 - RNA, 64 nt, Human; identical to SEQ ID NO: 175

SEQ ID NO: 5320 - RNA, 66 nt, Human
uuucggcgcugggucgcccaaagcagaauggagacggauagagugguggcucccagaaucccgaag

SEQ ID NO: 5321 - RNA, 98 nt, Human
ggacucgguccccgagcugcgcuggcugcccgugcugcggcacuacgacuuggacuuggugcgcgccgcgauggcgcaagucaucggggacagagucc

SEQ ID NO: 5322 - RNA, 62 nt, Human; identical to SEQ ID NO: 3691

SEQ ID NO: 5323 - RNA, 97 nt, Human
caccaacacaguuuuugaugccaaacgucugauuggacgcagauuugaugaugcuguaguccagucugauaugaaacauuggcccuuuaugguggug

SEQ ID NO: 5324 - RNA, 80 nt, Human
ucuuccauugacauaaaaauagucucaggcuugugugggaaaauuaaguauauagauacuauugcauuuaucaagggaga

SEQ ID NO: 5325 - RNA, 65 nt, Human
cuguccagagcuuccuccagugggacaauuagcauauuuguucgcaaaggagguuggaaggacag

SEQ ID NO: 5326 - RNA, 67 nt, Human
gaucuauuuuuuuucaaaccaggugucugagcugggugaauuccagccuggggagaggacuuugauc

SEQ ID NO: 5327 - RNA, 111 nt, Human
ucugauuuccugucguaagauuuuuucuuuucauuuucuccagggaggguaaaucaauauaaccucuucucuagagaggaggugguuagguuggucuuaagcaguguuaga

SEQ ID NO: 5328 - RNA, 61 nt, Human
ggccugccacuggucauggguagcuagagcugcuggcuucccuguggcuuagcugguggcc

SEQ ID NO: 5329 - RNA, 85 nt, Human
uguuacugggcugugguccuguacccagaggucccagggaucggcuccuggccccucgggugacccuucccacacaccagccaca

SEQ ID NO: 5330 - RNA, 85 nt, Human
cucccugaguagcuuaauaaucaaccuucugaguuauuuauuucgcaauucagagacuucuugauuuggacccauugcuggggag

SEQ ID NO: 5331 - RNA, 78 nt, Human
ggguagacuauuucaguggaaaaaucuggaacucaagggcuguuguucagauucuuuuguaccacguugguggucccc

SEQ ID NO: 5332 - RNA, 93 nt, Human
cauccggauuucccaccagaguguggaacccggggucaugaugcacacugaacauucaagauucuggcacacagccuggugguguuccgagug

SEQ ID NO: 5333 - RNA, 87 nt, Human
ucaucaggccaugguggcagcuguugccuccgcgugcgcaguacagcaggugccaggcuucccaaacagcuccaacccgggugguga

SEQ ID NO: 5334 - RNA, 67 nt, Human
gaauuuccuguaccguuuucuguuuuugccaaauuucuacuuaacagcaucaccuuauaggauucuc

SEQ ID NO: 5335 - RNA, 71 nt, Human
ugucccugcaaagaugacacuccucuccaaggugcuugugagguacagggauguuguuguugcugggugca

SEQ ID NO: 5336 - RNA, 86 nt, Human
ccagggcccaaggacucagaagaggugcccaccaagacuggacggaagucgaugacgauggcacaacggugacucgcggggcaugg

SEQ ID NO: 5337 - RNA, 66 nt, Human
ggggcugcugcaccgcguuuccauagcagcauguccuacggaaacccagcacguguguagagccuc

SEQ ID NO: 5338 - RNA, 66 nt, Human
gucaucucugguuauuguuuuuuccuuguguuuuaaaggggacaaaaaaaaaaaagggauugugac

SEQ ID NO: 5339 - RNA, 74 nt, Human
ugcugggcccccgcccccggcucccccgcacgcaugcauccacugcggccggaggaggccauggagcccgagua

SEQ ID NO: 5340 - RNA, 90 nt, Human
cacugcuuuuauuuaguuugauauguuucuuuacagaaugcagaaaacacaucuuaaaaucauauagaaggaaauaaaaacacaucagug

SEQ ID NO: 5341 - RNA, 85 nt, Human
ucgccuccaguugcuauggaacagggcauucugggcagccacgucucugcauggagugcccaauggguggaguugcuaggggcga

SEQ ID NO: 5342 - RNA, 72 nt, Human
uuuggaaggccuuucaaaagccucaccugggaacauugggaauugguuaauuuuuugaugaggucauccgga

SEQ ID NO: 5343 - RNA, 65 nt, Human
ggauggauaacauaguuguuucucuggggaccaccagacuucuugaagugacuugugucccaucu

SEQ ID NO: 5344 - RNA, 60 nt, Human
gguucggauauggguaguaugacggcgggggaguuguaacagcacacugcauuccgggcc

SEQ ID NO: 5345 - RNA, 105 nt, Human
gugcucguagggagguacacauagucgguugcucccggcaccaaggccgcaggcggcggucggugcagggcgccccgcuggcguaguaguccaucccgcgcagac

SEQ ID NO: 5346 - RNA, 69 nt, Human
uugggguugaagaguuuauuuauugcucugcccccuuggcacagcaagcccaggcucuaccagcaacga

SEQ ID NO: 5347 - RNA, 69 nt, Human
accuauuaaagucuugugucggagaguugaaauauuaaaugaacacagaggagagaaguuaaacagggu

SEQ ID NO: 5348 - RNA, 65 nt, Human
ucacauaaguggaaagaaaaagacauuuaaggauguggaaaucuucuucgaagccauggaauuga

SEQ ID NO: 5349 - RNA, 63 nt, Human
uuggaccauaauagauuuuuaauuuuacagggugaaguugaacaaaugcuaugaugaaaccaa

SEQ ID NO: 5350 - RNA, 104 nt, Human
uugagacagagucuugcucugucacccaggauggaaugcaguggcaccaucucggcucacugcaaccuucgccuucccagguucaagcaauucuccugucucag

SEQ ID NO: 5351 - RNA, 88 nt, Human
cugugacugagucggcccauucuguuuagaaauauauuuuaaauguuuaguaauugacaugugugguuguccuugauuaaguucacag

SEQ ID NO: 5352 - RNA, 101 nt, Human
gaaaaaaaacuacauaauuucuaccagggccauauuagcagugaaacauuuuaaacugcagaaauugugguuuugguucagaaacaaguuguauauuuuuc

SEQ ID NO: 5353 - RNA, 91 nt, Human
agguuggugucugugaaaagcugacagagaugugagaggucccacccugaggccaacaaagacucugcagcucuggcagaaccacuaagcu

SEQ ID NO: 5354 - RNA, 67 nt, Human
uuuauucccagcaccuaccauugugccccccuuauaauagacaguaaugguauagugaaugaaugaa

SEQ ID NO: 5355 - RNA, 84 nt, Human
cccuguacauaaaauguauuugguuuuguuggagagugucagacugauacucuccaacaaaaccaaauacauuucguauggagg

SEQ ID NO: 5356 - RNA, 72 nt, Human
ccgugcgcguugcugcggccgugguccgcgcccuuccucggcgggccggacuggucuccagaaaugcugugg

SEQ ID NO: 5357 - RNA, 87 nt, Human; identical to SEQ ID NO: 76

SEQ ID NO: 5358 - RNA, 74 nt, Human
aaaaccuaacuugcgcagaaaacaagaugagauuggcauggcuuuauuuguuuuuuucguauaguuuagguuuu

SEQ ID NO: 5359 - RNA, 60 nt, Human
acguggacauccgcaaagaccuguacgccaacacagugcugucuggcggcaccaccaugu

SEQ ID NO: 5360 - RNA, 64 nt, Human
cucgacucgaggcuuacaaaccgggcacacggucgccggugaccgcagcucgguggcgagcgag

SEQ ID NO: 5361 - RNA, 87 nt, Human
ggccuuggauggccauggugguuucucuacauagucuuuccacuuaugagaugcguuguacaggaauguccuggccauccuaaggcc

SEQ ID NO: 5362 - RNA, 90 nt, Human
guggaucggcggcuccauccuggccucgcuguccaccuuccagcagauguggaucagcaagcaggaguaugacgaguccggccccuccau

SEQ ID NO: 5363 - RNA, 76 nt, Human
ggaucaggugauagccccggaauguacagugucuuggugcaccaagaugccuucuaaaggcugacauaccuggacc

SEQ ID NO: 5364 - RNA, 76 nt, Human
uuauuagagggaugggacaguuuuccauauccuugcuguggagcucuggaacacucucuaaauuucccucuauuaa

SEQ ID NO: 5365 - RNA, 67 nt, Human
auugccaacugauggaaugugccucugcugacuuguacccaggccagcccacaccacagacugcagu

SEQ ID NO: 5366 - RNA, 64 nt, Human
gaagcucuguagaacuuaggcuacaagacuacaaccuguaucacuuaaggaaguuauuaugcuc

SEQ ID NO: 5367 - RNA, 70 nt, Human
gccccccacccucuguuuauuaaggccacauggagccagccugggaggaacagggcuaggauggaggggc

SEQ ID NO: 5368 - RNA, 72 nt, Human
cauuugaauugguagaccgaguaaugaagaggcagcccucccuaaugugcauggacaucauccaauucauug

SEQ ID NO: 5369 - RNA, 98 nt, Human
gucaacuacaucuaucguucagacagaguacuguggacugcugagaauguccucuauucuugaaguagcguauucuuggagcugauaccucuguugau

SEQ ID NO: 5370 - RNA, 89 nt, Human; identical to SEQ ID NO: 504

SEQ ID NO: 5371 - RNA, 76 nt, Human; identical to SEQ ID NO: 5041

SEQ ID NO: 5372 - RNA, 81 nt, Human; identical to SEQ ID NO: 201

SEQ ID NO: 5373 - RNA, 65 nt, Human
cuuggaugguaucuaugucucugaacccaggaacuguucagcaggcugaugaacuacgaucuaag

SEQ ID NO: 5374 - RNA, 64 nt, Human
ggucucuuguugaaauccgaaauuucuugggugaaaaauacauccgcaggguucggaugagacc

SEQ ID NO: 5375 - RNA, 71 nt, Human
ccagccucuuuaaggagauguguuaccgauaccgggaagaccugauggcgggaaucaucaucgcaggcugg

SEQ ID NO: 5376 - RNA, 61 nt, Human
agccaguuuauaaaguggaaguauuaggagauucauaaaucuucuauauugagaauuggcu

SEQ ID NO: 5377 - RNA, 81 nt, Human
uuuuaaaauuucaaauugguuuuucuacuaguagauuguguuucuagagaaagauacaagggcauaggugauuguuuaggg

SEQ ID NO: 5378 - RNA, 71 nt, Human
aggguccaguuuauguugcaugucaguuuccuauuucauuacuucaagcaugcagugguaugaaugauccu

SEQ ID NO: 5379 - RNA, 102 nt, Human
ugaagauauaccaaauguagcaguuuauccucauaaugggaaugauagacuuaaaauauuucccauauuauggggaaaaaacugcauguugggguaucuaca

SEQ ID NO: 5380 - RNA, 82 nt, Human
uuuuggcuauucucaaggaaacccuuguauucuugugaaaaugaacagaauaauuggauuaaagccugaaggagugccaagg

SEQ ID NO: 5381 - RNA, 67 nt, Human; identical to SEQ ID NO: 1146

SEQ ID NO: 5382 - RNA, 75 nt, Human
ucucuguaaugugccugugccuguggccagaggggagcccccugaccgugcugugggagagcacauugacagaga

SEQ ID NO: 5383 - RNA, 74 nt, Human
ggucuuuuaaagcauuuuagcaguagcuauguaaaaaaaguuaaugguuauuauuccuaaauuuucauaagacc

SEQ ID NO: 5384 - RNA, 127 nt, Human
uguauauaugagguuaguuaagcugcauuuaguuaggaacauuuaauuuuuaccuaaaugauccuuuuuuucauccagagguagagauuuuuauugucauuaugaauguuacuccccauuuagucca

SEQ ID NO: 5385 - RNA, 69 nt, Human
aggaguucugcugggcgucgcgaaggagcuucuccucccgccgcuuccguaaccucucuuugaauuccu

SEQ ID NO: 5386 - RNA, 73 nt, Human
ucccucuugcgcuguaugacaucguccucaaaccacucggccugauuggaaacccagaacauagccacaggga

SEQ ID NO: 5387 - RNA, 84 nt, Human
uggugauagcauuacuauagagauggcgcagcggggauggcaccauauguuccucgugccuauccuggugguacucuagaacca

SEQ ID NO: 5388 - RNA, 86 nt, Human
cuggggggcuucggcagaacccggagaccaccauggccucauuugggccacaagugaaaaacaugguucaggcuggagccuuccgg

SEQ ID NO: 5389 - RNA, 77 nt, Human
gcgggcggcagcccggcuggggucucgggaaggggcgggucgcgcagggaccugggagccgggcaggggccgcucgc

SEQ ID NO: 5390 - RNA, 63 nt, Human
cuugcguuccuuucguugcuuucuugaggucuuuuucuucucauacaggccaugucuugcaag

SEQ ID NO: 5391 - RNA, 64 nt, Human
gaguucugaauccaaauacaaagaugacauccgguguggucuuguacauuuuggcuaguuuuuc

SEQ ID NO: 5392 - RNA, 66 nt, Human
gugaggcgagggaaagagcggauuauugaguuugaugcccagaaucagaucaacccauagucucac

SEQ ID NO: 5393 - RNA, 75 nt, Human
uucagguugaaagucacaaacaguagccuuuuugagaaaccucaaacaauggaauaaaagauuuuauaaccugaa

SEQ ID NO: 5394 - RNA, 68 nt, Human
gacugauauuaaccagccagguaaauugaacgacaauguggcauuagguauuuggcuguuuauugguc

SEQ ID NO: 5395 - RNA, 61 nt, Human
gaguuguuuucauaacugacagcauggugaauccauuugagucaaagugaagaauuuccuc

SEQ ID NO: 5396 - RNA, 60 nt, Human
uacuaugguuuugcaauaugauugaugguaaaagagugaugucauauugauacuagagua

SEQ ID NO: 5397 - RNA, 89 nt, Human; identical to SEQ ID NO: 288

SEQ ID NO: 5398 - RNA, 94 nt, Human
uuuuuuuucucauuuaacuuuuuuaaugggucucaaaauucugugacaaauuuuuggucaaguuguuuccauuaaaaaguacugauuuuaaaaa

SEQ ID NO: 5399 - RNA, 73 nt, Human
ccugggaaacugguuuguauauccugugacccaaagcauccacuuccucaaagguguagccaggaggcucagg

SEQ ID NO: 5400 - RNA, 61 nt, Human
gaagcuaggcaccugcccauuuccuugggaguaaagcugaugguguagguggucuggcuuu

SEQ ID NO: 5401 - RNA, 62 nt, Human
guugucugcuuuuaaaaguacuguguaauuucuaaauuacuauuuuucaaaaucaggcuaac

SEQ ID NO: 5402 - RNA, 101 nt, Human
ggcgccuagggcugcggcagggacucggccucugggagguuuaccucgcccccacuugugcccccagcucagccccccugcacgcagcccgacuagcaguc

SEQ ID NO: 5403 - RNA, 80 nt, Human
acgucgugaacgcccgccuccagugaauguaaugggacuguuucacugcgcccucagcuggcaagcaggucuuaggacgu

SEQ ID NO: 5404 - RNA, 69 nt, Human
agccacguguccucauuuguguccucucauuggcuggcugggcuggggguacugggggacaaacaagcu

SEQ ID NO: 5405 - RNA, 64 nt, Human
cacagggauacuccauuguccccuccucuggcugucccuuggagaggcacuuuggauccuugug

SEQ ID NO: 5406 - RNA, 82 nt, Human
ccauuccaacggagucaguugggacuacaagccacucauuguuaaacacuuagugcuuuuaaaccaacuugcggaauacagg

SEQ ID NO: 5407 - RNA, 61 nt, Human
gaagcccuagaggugucucuaaucacuagaaagauuaaugacccuuuugcuuuaggguuuu

SEQ ID NO: 5408 - RNA, 64 nt, Human
ggaucugggcccugcacauauaccaucucuggcuccagggaaugugagguaugaaccaugaucc

SEQ ID NO: 5409 - RNA, 67 nt, Human
uucacuuucccguggaagguucaggaagcgacaccguuguuaucaggggcccuuccucggaugugga

SEQ ID NO: 5410 - RNA, 73 nt, Human
gcugacgccggcuagggaggagcagcccccacaacaucgauccaagagggggagcucagugggcggcgugugc

SEQ ID NO: 5411 - RNA, 110 nt, Human
cccacagccuaagcugagugugaccccagaagccacgaugugcucuguauccagaacacacuuggcagauggaggaagcaucugaguuugagaccauggcuguuacaggg

SEQ ID NO: 5412 - RNA, 66 nt, Human; identical to SEQ ID NO: 3876

SEQ ID NO: 5413 - RNA, 83 nt, Human
auucaucacguuggguugaaaaguuggaagauuuugcaucuuauugaaaagaauuuuucaaaaauguuucuguacaaaugaau

SEQ ID NO: 5414 - RNA, 65 nt, Human
gcgcuggcuggggucgggcuccaugcucuggaugggacugggccgucgcacacgccagccggugc

SEQ ID NO: 5415 - RNA, 78 nt, Human
guggaguuugugccucggcagcugggccugacggagcgccggguccacaucagccaucugcuggcccacacgcgcuac

SEQ ID NO: 5416 - RNA, 62 nt, Human
ugucaucugcaagaagugccauggggcuggaggggccucagccugcucacgcugugaugaca

SEQ ID NO: 5417 - RNA, 76 nt, Human
aguggcguucagccacccgagauugagcaauaacaggucugugaugcccuuagauguccggggcugcacgcgcgcu

SEQ ID NO: 5418 - RNA, 89 nt, Human
gaugguuuagugaggcccucggaucggccccgccggggucggcccacggcccuggcggagcgcugagaagacggucgaacuugacuauc

SEQ ID NO: 5419 - RNA, 65 nt, Human
agacuccuugcggggcuucaguugcaucuaaauagaugugagaguugaaagaccuauaaggggcu

SEQ ID NO: 5420 - RNA, 76 nt, Human; identical to SEQ ID NO: 5199

SEQ ID NO: 5421 - RNA, 84 nt, Human; identical to SEQ ID NO: 1246

SEQ ID NO: 5422 - RNA, 65 nt, Human
agggccgggcgugcuggagccugggaaaugccuacguguccauggggcgcccagucgcaggcccu

SEQ ID NO: 5423 - RNA, 90 nt, Human
agaucgggaggacuguggccagcaauuaacaccauguagacuuccuuaguucuuaagugguugaauucgcugcuuguucuguaacguucu

SEQ ID NO: 5424 - RNA, 75 nt, Human; identical to SEQ ID NO: 74

SEQ ID NO: 5425 - RNA, 71 nt, Human; identical to SEQ ID NO: 77

SEQ ID NO: 5426 - RNA, 87 nt, Human; identical to SEQ ID NO: 76

SEQ ID NO: 5427 - RNA, 71 nt, Human; identical to SEQ ID NO: 77

SEQ ID NO: 5428 - RNA, 67 nt, Human
cccguuaagucccccaaagaugagauuuaccugugagauguuucaucccaacaucuacccugauggg

SEQ ID NO: 5429 - RNA, 73 nt, Human
gggaggcauugaucaugggcccagaagacaccugcuuugaguuugguguuuuuccugccauccugaguuuccc

SEQ ID NO: 5430 - RNA, 63 nt, Human
uuccauccuccacgcgccaggcgaugaccccaugggcuacgagagcagcgcggagcgguggag

SEQ ID NO: 5431 - RNA, 77 nt, Human
cacggcccccguggccaccauggccuucugaccccaccuccacucugcuagccacagguggcugugauggggccgug

SEQ ID NO: 5432 - RNA, 65 nt, Human
gcgcgucugggacaucgugcggcacuacgggacacaccacuuccgaggcucgcccggugucgugc

SEQ ID NO: 5433 - RNA, 71 nt, Human
aacucggguauuagguuggcuaaccacaagcuuagcggcggcggggauuauucaacacaaguaauugaguu

SEQ ID NO: 5434 - RNA, 84 nt, Human; identical to SEQ ID NO: 5126

SEQ ID NO: 5435 - RNA, 87 nt, Human; identical to SEQ ID NO: 76

SEQ ID NO: 5436 - RNA, 68 nt, Human
cgauuggcggcggaaauauguguagaagcgcgcucaaccgcgcgggcgaauaacagggcugccagucg

SEQ ID NO: 5437 - RNA, 77 nt, Human
gcuccaacccgggaaagaggguaacucccggcggaggggucccacccggcugguaaacccaucaacccggagggagc

SEQ ID NO: 5438 - RNA, 67 nt, Human
ggcagcucuucggccgcauccccaugcgcuucucggugcugaugcagaugcguuucgacgggcugcu

SEQ ID NO: 5439 - RNA, 85 nt, Human
ggccugaaccgggugcugggccugggccugggcugccugcgccucaccgaggccgacuaccugagcucgcaccugaccgagggcc

SEQ ID NO: 5440 - RNA, 71 nt, Human
ggcuaagugccagcuccucuuugcccucaaggugcuccacaugaugcccgaggagaagcugguugagggcc

SEQ ID NO: 5441 - RNA, 70 nt, Human
ggguggaggcgaugcgccuagggccgggcuggagccacucgugccacgccaugcuguacgccgccaaccc

SEQ ID NO: 5442 - RNA, 70 nt, Human
gugaagauuuaauggauauuuauuaguuccccaaauuaauacuuuuauaauuucuuacgccugucuuuac

SEQ ID NO: 5443 - RNA, 61 nt, Human; identical to SEQ ID NO: 5062

SEQ ID NO: 5444 - RNA, 60 nt, Human; identical to SEQ ID NO: 5063

SEQ ID NO: 5445 - RNA, 84 nt, Human; identical to SEQ ID NO: 384

SEQ ID NO: 5446 - RNA, 70 nt, Human
acggucauucugguagguagggguagggccagagcaaggaguccugguuugugaaccaccagcuggccgu

SEQ ID NO: 5447 - RNA, 60 nt, Human
ccugcuguuuucugaagcauuccuaaggaaccuuagagugugggagagagaaauagcagg

SEQ ID NO: 5448 - RNA, 80 nt, Human
uccuuaaccuaguccaacccuuuuauuuuacaguuagggaaaccuaagcugagagaggagauggaaaccugguuguagga

SEQ ID NO: 5449 - RNA, 69 nt, Human
cuguggugagcuccaaggaagugaauaaguuucagauggcuuauucaaaccuccuuagagcuaacaugg

SEQ ID NO: 5450 - RNA, 89 nt, Human
gcgucgccgcgaaugguguuguuggagagcgagcaguuccugacggagcugaccagacuuuuccagaagugccggacgucgggcagcgu

SEQ ID NO: 5451 - RNA, 60 nt, Human
uauaucaccuugaagaaguaugacggucgaaccaaacccauuccaaagaaagguacugug

SEQ ID NO: 5452 - RNA, 63 nt, Human
gugauaccucuguugaucuugaagaaagcugggcgugucuuaagauauuggugaugguauugc

SEQ ID NO: 5453 - RNA, 89 nt, Human; identical to SEQ ID NO: 504

SEQ ID NO: 5454 - RNA, 63 nt, Human
caaguaguucaauggcuagcuuuucucauuaucccaaugagaucaagugcuaggacuggauug

SEQ ID NO: 5455 - RNA, 96 nt, Human
gucugaaaagugccaggggcaauuucuucacaguauuucacaugcaaaggggaaaggaaggaaggggagaaggaagccccaugcugcuuuuaaggc

SEQ ID NO: 5456 - RNA, 60 nt, Human
aagguccaaauaguggccaagcugggacugagaucucgaguuuggguuuguuuggguuuu

SEQ ID NO: 5457 - RNA, 81 nt, Human
guuguucuuucccucguguccaugacuuuucucugccauuagcagggaagugugcggagggcuuccagggaaucaagugac

SEQ ID NO: 5458 - RNA, 109 nt, Human; identical to SEQ ID NO: 831

SEQ ID NO: 5459 - RNA, 75 nt, Human; identical to SEQ ID NO: 74

SEQ ID NO: 5460 - RNA, 71 nt, Human; identical to SEQ ID NO: 77

SEQ ID NO: 5461 - RNA, 67 nt, Human
gugggauggugaccacuaugaugcccugagggacugccucaaggccaucucccuaaacccaugccac

SEQ ID NO: 5462 - RNA, 64 nt, Human
aacaucuuucugauaacauuauuauguugccuucuguuucucacuuugauauuuaaaagauguu

SEQ ID NO: 5463 - RNA, 81 nt, Human; identical to SEQ ID NO: 3878

SEQ ID NO: 5464 - RNA, 74 nt, Human
cgccugacgggcccggcggcggcugagccgcgcugcgcagccgacgcgggaaugaagcgggcgcugggcaggcg

SEQ ID NO: 5465 - RNA, 66 nt, Human
gaggaagcggaccgagcccgucgccuuggagcaugagcgcugcgccgccgcgggcucguccuccuc

SEQ ID NO: 5466 - RNA, 61 nt, Human
gaguuccccuauuuccauugcauuugaaaaaaacccaacaggauccaaggguuuugaauuc

SEQ ID NO: 5467 - RNA, 73 nt, Human
uugccauuccauuucucaucaaacuauguccugggaauacaggccaaacuugauuuuucuuggaauuucguaa

SEQ ID NO: 5468 - RNA, 63 nt, Human
auagguuuaugguuugguuucuccuacuuaguucaagucagagaaagaaaaaccaauaucuau

SEQ ID NO: 5469 - RNA, 63 nt, Human
uccuauuggccuucuuuaaaucccuaugagauggcuuaaaaaggaugucacuggccaagagga

SEQ ID NO: 5470 - RNA, 130 nt, Human
acaaaucuuacaaaggggggugcuucuggguauuuagguccacauucuauuuuaaggcuguauauucggcuuucauaaauuguucuuggaggcccaauuaucaucccuguccaucuuguaagugucaugu

SEQ ID NO: 5471 - RNA, 79 nt, Human
gaauugcuuuuauuucgguaugcauccacauuucagcauuuagugguccugaacagcaaguggaaagacgcagcaauuu

SEQ ID NO: 5472 - RNA, 80 nt, Human
ggauucaagguucuuuuuguuccaguugucagauuccaaacuagaccccaauggauugcaaggaugaccaaaugaaagcc

SEQ ID NO: 5473 - RNA, 69 nt, Human
gggaucugcugugcacaccggguuccuucuuaaucccugcugaggaucuugggaagcagcagcagcacc

SEQ ID NO: 5474 - RNA, 104 nt, Human
guggagcugcucacucugccaugugcucccugaccugaaggaggaggauggcagccucagccuggauggugcagacagcacuggcgugguggccaagcucucac

SEQ ID NO: 5475 - RNA, 65 nt, Human
guuuugccccaggaugugggccgcauugucaaggcgaauuccacuaguuaacugagggacaaggc

SEQ ID NO: 5476 - RNA, 63 nt, Human
ucucccuggaccagcccgguggcacccuggaucugacccugauccgugcccgccuccaggaga

SEQ ID NO: 5477 - RNA, 64 nt, Human
gcagaagaacauagacaaauaugucgcucuugggacacaaggugcugacauguauacuugcugc

SEQ ID NO: 5478 - RNA, 60 nt, Human
guggcucuguucaucuuauucgccagccaaaguaggaacagcguaagaggagagagacac

SEQ ID NO: 5479 - RNA, 61 nt, Human
cggaggugucugagguugccaucagccagggcgaggucacccuggcccucaggaaccuccg

SEQ ID NO: 5480 - RNA, 128 nt, Human
ccugcuggugcuucucucaccucugacgcccuugacuguagucacccugcuccaggccuccaaugugccugcuguggugguggggaggguggguaccaggagcaagggacaagaugugugggggcagg

SEQ ID NO: 5481 - RNA, 85 nt, Human
gugugcuacugggggaggcaugggaaagagcuccggugacagaagccaagguucaauucuccccuagauucuccagggagcacgc

SEQ ID NO: 5482 - RNA, 63 nt, Human
caguuuguacagcuuugcuaaaucgugcuuugaaccaagaacaagucauugcugugcacauug

SEQ ID NO: 5483 - RNA, 68 nt, Human
gccagaacagagaacuugaguguauucgcagagaucaaagagagaguaggcacgucaaaaguuuuggu

SEQ ID NO: 5484 - RNA, 76 nt, Human
guagcugauggauucaagguuguggcacguucuggaaacauaguagcaggcauagcaaaugaaucuaaaaaguuau

SEQ ID NO: 5485 - RNA, 61 nt, Human
ggauaacuuuuguuccaccacccauagguucaccugugucuguccucacugcgaaugaucc

SEQ ID NO: 5486 - RNA, 67 nt, Human
ugcugaggacucccaagcguacugcucaucaucgauauguuuggugaucacagcuacuuucucagca

SEQ ID NO: 5487 - RNA, 93 nt, Human
auaucuagaauagcccaaucuuauagugccagaaaguagcacaguaguugccaagggcugggaggaagaagagaauugggaggugauagcuau

SEQ ID NO: 5488 - RNA, 61 nt, Human
gauuucaagcucucuuguaaaaagcaaaauccuaguguauuuucucaaggaccuuggaauu

SEQ ID NO: 5489 - RNA, 70 nt, Human
uacaaaguaauacgcuuuccucucucccuaaaaaaaauagcuggagaccuugaaaacauuguacuaugug

SEQ ID NO: 5490 - RNA, 87 nt, Human; identical to SEQ ID NO: 76

SEQ ID NO: 5491 - RNA, 100 nt, Human
agagucuggagacugggagccuucacuucggccuccgauugguggcgcauaggguguaaccaauaggaaaccccuaaaggguacuuaaaccccagauuuu

SEQ ID NO: 5492 - RNA, 60 nt, Human
gcuacuguuuuccccaaaguggaacauagcccagggccuccaccagucgauaaacagugc

SEQ ID NO: 5493 - RNA, 125 nt, Human
gcucuggagccgcucccucagggcauccaggagucucuaaacaacucuuccccuggggauuuagaggaaguugucaagauggaaccugaagaugcuacagaggaaaucaguggauuucuuugagc

SEQ ID NO: 5494 - RNA, 75 nt, Human; identical to SEQ ID NO: 74

SEQ ID NO: 5495 - RNA, 72 nt, Human
gcugcggcugcagaaguaccgccugcggaguaacugcaaagaugcuguccgugcgcgugcugcggccguggu

SEQ ID NO: 5496 - RNA, 72 nt, Human
augauuggagacaaaguuuauguccauuacaaaggaaaauugucaaauggaaagaaguuugauuccagucau

SEQ ID NO: 5497 - RNA, 76 nt, Human
gaagaaaggagagauaugccauuuacugugcaaaccagaauaugcauauggcucggguggcagucucccuaaauuc

SEQ ID NO: 5498 - RNA, 60 nt, Human
ucgaaugcaacucucuuuugagauugagcuccuugacuuccaaaggagagauuuauuuga

SEQ ID NO: 5499 - RNA, 98 nt, Human
cggcgcccgccggggauccggacgcagggccgaggcggcagcgcgcucgcagcccgcgcccccggccgaccccgacggcagccccgguggagcggccg

SEQ ID NO: 5500 - RNA, 72 nt, Human
cgggagcgcuggcggcagcagaacguuaacggcgccuucgccgagcugaggaagcugcugccgacgcacccg

SEQ ID NO: 5501 - RNA, 77 nt, Human
ccagcagcccgcucuggccggggccgacuggcagcuccuaguggagaccucgggcaucagcaucuaccggcugcugg

SEQ ID NO: 5502 - RNA, 60 nt, Human
gguguguguauacagcgcggaauaauguauuacuuaaucaucgcgcgcgagaaccacacc

SEQ ID NO: 5503 - RNA, 67 nt, Human
ggugcgcggggccggggcggagcagucgcguuccccgcgugugagcccccacccaucccugugcgcc

SEQ ID NO: 5504 - RNA, 84 nt, Human
gaagaaauggucugaauauuguuacugccgcugauuuguguuuuuuuugacauaguuuguguggaguaagagaguuucaucuuc

SEQ ID NO: 5505 - RNA, 65 nt, Human
aacaccccaugccaucugacagaugggaaccuaggggaccccuucgucagagaaucugggagguu

SEQ ID NO: 5506 - RNA, 127 nt, Human
guguuugggagcucacgugugcaugugugugcauacacaugcaggcauaugugucgugugggcguguuugcaagugugcgugugugucuugugugugcaggccccauacuugggcuccuauuaaagc

SEQ ID NO: 5507 - RNA, 83 nt, Human
gcucucagccuuaguaaggaagcacguggaggagggacggaggagguucccuugcugggcaugcuucguagagggccaggagc

SEQ ID NO: 5508 - RNA, 74 nt, Human
uauguucugaauagauuugcugauuguugaguauguuuugcuuacacuuaaggccaaauucuuccuugaagaug

SEQ ID NO: 5509 - RNA, 77 nt, Human
uuuaguucacuuguuuuuccucuuuguguuaaggcuaucauucagagggcaaacaguucccgguguugugaauugaa

SEQ ID NO: 5510 - RNA, 72 nt, Human
ucauuagugcauuucuuccugcugaucacuguaaacaugugaaucaguuuccauuucuuaugcaggucauga

SEQ ID NO: 5511 - RNA, 71 nt, Human
uuuggauguauaauaguuuagcaagauguuacuuuuguaagacaucagauguucaaaaaagugcauccgaa

SEQ ID NO: 5512 - RNA, 62 nt, Human
gcagacgucagaacgaugaagaggcaggcggaugugaaacucuucaaguauaucuggaaagc

SEQ ID NO: 5513 - RNA, 71 nt, Human
guucuuaagguugaagugugguucagggccagugcaauauuaguggacagcacuuaguagcuguggaggac

SEQ ID NO: 5514 - RNA, 78 nt, Human; identical to SEQ ID NO: 99

SEQ ID NO: 5515 - RNA, 65 nt, Human; identical to SEQ ID NO: 247

SEQ ID NO: 5516 - RNA, 80 nt, Human; identical to SEQ ID NO: 100

SEQ ID NO: 5517 - RNA, 71 nt, Human; identical to SEQ ID NO: 77

SEQ ID NO: 5518 - RNA, 75 nt, Human; identical to SEQ ID NO: 74

SEQ ID NO: 5519 - RNA, 87 nt, Human; identical to SEQ ID NO: 76

SEQ ID NO: 5520 - RNA, 71 nt, Human; identical to SEQ ID NO: 77

SEQ ID NO: 5521 - RNA, 76 nt, Human
gagauguccucuauucuugaagagcguauucuuggagcugauaccucugaugaucuugaagaaagcugggcguguc

SEQ ID NO: 5522 - RNA, 87 nt, Human; identical to SEQ ID NO: 76

SEQ ID NO: 5523 - RNA, 71 nt, Human; identical to SEQ ID NO: 77

SEQ ID NO: 5524 - RNA, 74 nt, Human
gccucccggauccaggcguccgggaucugcgccaccagaaccuagccuccugcagaccuccgccaucugggggc

SEQ ID NO: 5525 - RNA, 84 nt, Human
gcggcacgcccgggaggcuuucucuggcugguaaccgcuacucccggacaccagaccaccgccuuccguacacagggugcccgc

SEQ ID NO: 5526 - RNA, 92 nt, Human
cagccaaagagucuacuucagaagcggaggcacugggaguccgguuugggauugccaggcugugguugugagucugagcuugugagcggcug

SEQ ID NO: 5527 - RNA, 89 nt, Human
ggugcucugggcacugcaggggugcuggcuggacugcgguuaccgcagcgcggaacccccuaggcgaccccgcgcuggccgggagcacu

SEQ ID NO: 5528 - RNA, 94 nt, Human
aacuucagaucagacugaggauguccuggaggcuguagcugcaaagcuggaucuuccagaugacuugauuggauacuuuagucuauucuuaguu

SEQ ID NO: 5529 - RNA, 86 nt, Human
acugcugagauguccucuauucuugaagagcguauucuuggagcugauaccucugugaucuugaagaaacugggcgugucuuaagu

SEQ ID NO: 5530 - RNA, 108 nt, Human; identical to SEQ ID NO: 710

SEQ ID NO: 5531 - RNA, 120 nt, Human
cccgguaucauuccucgaauuucagugcgggaaccaaugcagacuggcauuaaggcuguggauagcuuggugccaauggucguggucagcgugaacugauuuuggugacgacagacuggg

SEQ ID NO: 5532 - RNA, 127 nt, Human
auaccucuguugaucuugaagaaagcugggcgugucuuaaguauggugaugguauugcccgcguacaugggcugaggaauguucaagcagaagaaaugguagaguuuucuucaggcuuaaaggguau

SEQ ID NO: 5533 - RNA, 95 nt, Human; identical to SEQ ID NO: 1030

SEQ ID NO: 5534 - RNA, 85 nt, Human; identical to SEQ ID NO: 4613

SEQ ID NO: 5535 - RNA, 85 nt, Human; identical to SEQ ID NO: 5439

SEQ ID NO: 5536 - RNA, 60 nt, Human
aacaaguaaaaaguuagacaaauguuacaaaauaaccuuuucaauagccaguugcuuguu

SEQ ID NO: 5537 - RNA, 73 nt, Human
cccaacuuuaauuuugaaugcauuuccagaguggccaugccuagagggcagaugcagagcaggugguaguggg

SEQ ID NO: 5538 - RNA, 85 nt, Human
ccaaugcuacacaaccagaaaguaagguguucuacuugaaaaugaaaggagauuauuuuagguaucuuucugaaguggcaucugg

SEQ ID NO: 5539 - RNA, 69 nt, Human; identical to SEQ ID NO: 528

SEQ ID NO: 5540 - RNA, 63 nt, Human
cuuccuuugguuucugccggccucgggcuucugcggcccgauguggcaggcgccgcgagagag

SEQ ID NO: 5541 - RNA, 78 nt, Human
ucaagucugacguguggucuuuuggaaucuuacucacagagcuggucaccaaaggaagagugccauacccaggcauga

SEQ ID NO: 5542 - RNA, 70 nt, Human
gggggguccccagguuaguaaacuccccaggugggcugagggcuagggcugagccucaggugggucuccu

SEQ ID NO: 5543 - RNA, 73 nt, Human
ucccaguugcuacccugcauagcggccuccuucccaggcucugguggcagcgcauggagggguagugcuggga

SEQ ID NO: 5544 - RNA, 90 nt, Human
ggcugugggaagcgauuugcgauguucaccuccacgauauuugcugugguuggauucuugggagcuggauacucguuuaucaucucagcc

SEQ ID NO: 5545 - RNA, 66 nt, Human
ccuuccagccugcgcuuccucuggugguucuugugccuagcccaggaggggacgccguugagaagg

SEQ ID NO: 5546 - RNA, 71 nt, Human
cucucauucaguacgucgaagacgggauuggccaugaguuuaguggccgcuuuuuccaugacagaagagag

SEQ ID NO: 5547 - RNA, 85 nt, Human
gauggucugaugcuacaggacuugguuucagcuaagcugauuucagauuacacuguuaccgagaucccugauaccauuaaugauc

SEQ ID NO: 5548 - RNA, 67 nt, Human
cacaacagaaaguaagguguucuacuugaaaaugaaaggagauuauuuuagguaucuuucugaagug

SEQ ID NO: 5549 - RNA, 69 nt, Human; identical to SEQ ID NO: 528

SEQ ID NO: 5550 - RNA, 60 nt, Human
ccuggaucggauagguggucuucccaugccuccuuggagaagccgagccgaguauccagg

SEQ ID NO: 5551 - RNA, 61 nt, Human
cuguggcaggggaggacagaacuuugauccuuaccucccaaccucugucuacucaccacag

SEQ ID NO: 5552 - RNA, 92 nt, Human
ggagggccagugacccagcccaggcugcugaccguccugcuccaggcuagaguccagagguucaagagccugggcuguguccauaccccacc

SEQ ID NO: 5553 - RNA, 67 nt, Human
cccccucagauguuccugcagugcugaaauucauccuacagaaguaaccgcaaaacucuagaggggg

SEQ ID NO: 5554 - RNA, 76 nt, Human
cuaacccugcuguccuuuuuauuguuuuuaauuaauauuuuuguuuuaauugauagcaaaauaguuuauggguugg

SEQ ID NO: 5555 - RNA, 90 nt, Human
ucaucaacauggauaugacauuucacaacagugacuaguugaaucccuuguaacguaguaguugucugcucuuuguccauguguuaauga

SEQ ID NO: 5556 - RNA, 62 nt, Human
gcaggggcccagaacaccugcucucaccugagccccaggugaaggggcccgggaacaccugc

SEQ ID NO: 5557 - RNA, 88 nt, Human
gcucucacugagcccaggugaaggggcccggaacaccugucucacugagcccaggugaaggggcccggaacaccuggcucaccugagc

SEQ ID NO: 5558 - RNA, 114 nt, Human
ggggcgcuguccuccaucugacggugaccuugccugauugaagcuggccagcuguggguccgccugaccgcucucgguuccccgcggugucaccgcguuggggacaguugcccc

SEQ ID NO: 5559 - RNA, 71 nt, Human
ggugggcucuucgggggccggccggcgcggccuaccuguggccgcgcacguuggccccgggggggcccgcu

SEQ ID NO: 5560 - RNA, 75 nt, Human
ccauucccgauacaccuuacuuacuguguguuggcccagccagagugaggaaggaguuggccacauuggagaugg

SEQ ID NO: 5561 - RNA, 61 nt, Human
ucccuggugugcuccuggaaggaagaucuuggggacccccccaccggagcacaccuaggga

SEQ ID NO: 5562 - RNA, 76 nt, Human; identical to SEQ ID NO: 273

SEQ ID NO: 5563 - RNA, 103 nt, Human
ugaugagagccugaggagccauuugagcaauggggaacgcucacggacugugugguaaugagagauccaaacaccaagcgcuccaggggcuuggguugucaca

SEQ ID NO: 5564 - RNA, 71 nt, Human
uggaugcagcuaugaaugcaaggccacacaagguggauggaagaguguggaaccaaagagagcugucucca

SEQ ID NO: 5565 - RNA, 84 nt, Human
ccaaccaaauuucugcauucgagucuuaaccauauuuaaguguuacugugguucaaagaaguaugauucugaguaggggguugg

SEQ ID NO: 5566 - RNA, 91 nt, Human
ccguggguccgauuagccuuuucucugccuugcuugcuugagcuucagcggaauucgaaauggcuggcgguaaggcuggaaaggacuccgg

SEQ ID NO: 5567 - RNA, 73 nt, Human
gaacuggcaggaaaugcaucaaaagacuuaaagguaaagcguauuaccccucgucacuugcaacuugcuauuc

SEQ ID NO: 5568 - RNA, 80 nt, Human
ggggugacuggucucaaacaacuguuggucauugugacugccaauuauaguaccaacuuugguugccagacuuuuccccu

SEQ ID NO: 5569 - RNA, 76 nt, Human
ccuagaccccgcguuguccgauguucaugaguuccgcagaagggguuuauucccacacggcacccgcgccucuugg

SEQ ID NO: 5570 - RNA, 66 nt, Human
gggaucggcggcuuucgguuuauccucaucaguugaccauagaagagcugacgaccgcucgaugcu

SEQ ID NO: 5571 - RNA, 88 nt, Human
guggcgguugagacuugaagagccaagaaacccacguuaccgcaugaaacucguuaagugauagcucgccuucgaauuuuagcgccac

SEQ ID NO: 5572 - RNA, 66 nt, Human
gccaaccuugaagccaguggggcaccaauucacaaacuggaugcugcgcuugguuuugaugguggc

SEQ ID NO: 5573 - RNA, 65 nt, Human
uuggggaccacgucaccacgguacaacaggcagcaagcccuguuuuuaccauggcagggucacaa

SEQ ID NO: 5574 - RNA, 78 nt, Human
acauuaacaugauaauaccaacauguauuuggucaaagucuaaacacuuuuuugauaaaauacauuuuauguuaaugu

SEQ ID NO: 5575 - RNA, 68 nt, Human
gcacucaaaguagaauuauaaagaagaucauguccauguuaacauuauuauaacccuacauuuugugc

SEQ ID NO: 5576 - RNA, 68 nt, Human
uuggaaguuaacuuaugcacgcuuaacuaucuuaacaagcuuugagugcaagagauugaagaguucaa

SEQ ID NO: 5577 - RNA, 90 nt, Human
cacaaucuggagacauggaggcagcuguggcggguguuagagaugucugacaucguccugcuuaucacugauauccgacauccaguugug

SEQ ID NO: 5578 - RNA, 60 nt, Human
ucagugcugaguuguuggagcuggacauccgggagguguaucagccuggcucaguucugg

SEQ ID NO: 5579 - RNA, 72 nt, Human
ugagccaagaggaacggagcuuccaagacuaucuugggaagauucauggggcuuacuccucugagaaacuca

SEQ ID NO: 5580 - RNA, 61 nt, Human
cagcgcggugcacucgcgcgaacacggccuggaggugcugggccucgugcgggucccgcug

SEQ ID NO: 5581 - RNA, 76 nt, Human
gcuggaggacggccugaaccgggugcugggccugggccugggcugccugcgccucaccgaggccgacuaccugagc

SEQ ID NO: 5582 - RNA, 67 nt, Human; identical to SEQ ID NO: 5438

SEQ ID NO: 5583 - RNA, 70 nt, Human; identical to SEQ ID NO: 5441

SEQ ID NO: 5584 - RNA, 94 nt, Human
ccacccucuugcauuggccaguggaggaagaucuuugaugaugaaccaacuaucauuagaagagcuuuuuacucuuugggcaauuauauugugg

SEQ ID NO: 5585 - RNA, 64 nt, Human
gccacugaggugagugggggucuccagcaccugcccccagcccaucacccuguguaccaguggc

SEQ ID NO: 5586 - RNA, 117 nt, Human
aggagacccgugucauguuugagaagauagcgaaauacauuggggagaaucuucaacugcugguggaccggcccgauggcaccuacuguuuccgucugcacaacgaccggguguacu

SEQ ID NO: 5587 - RNA, 61 nt, Human
gcucuggauuaccuugcaccuuaugccaaguauaaaguuuggauaaagccuggugcagagc

SEQ ID NO: 5588 - RNA, 88 nt, Human
guccuugaacuuggaaccugacaauguugguguagucguguauggaaaugauaaacuaauuaagugaaggagauauagugaagaggac

SEQ ID NO: 5589 - RNA, 96 nt, Human
ugacuugcugagauguccgucuauucuugaagagcgguauucuuggagcugauaccucuguugaucuugaagaaaguugggcgugucuauaaguua

SEQ ID NO: 5590 - RNA, 90 nt, Human
ggcggggagugggaaaggguccggggcggagugccguugguuaaggagaagccaaaaauguuugccaagggaacugagaucacccaugcu

SEQ ID NO: 5591 - RNA, 82 nt, Human
guucaauaucaucgccucucucuuaugacuacaacccaaaccuggaagcuacaugagccagagauguggggaagugcuggac

SEQ ID NO: 5592 - RNA, 102 nt, Human; identical to SEQ ID NO: 2701

SEQ ID NO: 5593 - RNA, 90 nt, Human; identical to SEQ ID NO: 2702

SEQ ID NO: 5594 - RNA, 60 nt, Human
ucuggagcugugagucucccuguacgguguacaucccgacauugauaaauguucuccagg

SEQ ID NO: 5595 - RNA, 60 nt, Human
uucugcauacaaguuggcaggaacauuauacauggcagugauucuguggagagugcagag

SEQ ID NO: 5596 - RNA, 74 nt, Human
cggcgcuuccgcaaguuccugguguuuguggcaaacuucgaugagaaugaccccaagaccuuugaggggcguug

SEQ ID NO: 5597 - RNA, 82 nt, Human; identical to SEQ ID NO: 119

SEQ ID NO: 5598 - RNA, 63 nt, Human; identical to SEQ ID NO: 722

SEQ ID NO: 5599 - RNA, 60 nt, Human; identical to SEQ ID NO: 723

SEQ ID NO: 5600 - RNA, 83 nt, Human
gcgggcggcgcggugcaaccucggccgaggccuuccuagccgccggcuacggggucccuguucuuguaucgcgcucgcucugc

SEQ ID NO: 5601 - RNA, 104 nt, Human; identical to SEQ ID NO: 114

SEQ ID NO: 5602 - RNA, 76 nt, Human
ccagcugugugugaggaggaccugaugcccgaggaugaccagcgggccacgcgcaaccucuucauugguaaccugg

SEQ ID NO: 5603 - RNA, 72 nt, Human
cucccgcuacacggaggcuaccaguacgagcagcgcucgcugucccccgucgcugccccgccccugcgggag

SEQ ID NO: 5604 - RNA, 73 nt, Human
gccgugggacugucccgggagcgggcccuggacuacuacgggcuguacgacgaccgugggcgccccuaugugc

SEQ ID NO: 5605 - RNA, 64 nt, Human
aucuccuacgccugcuaguccugcaucgaacagagcuguuaccccuucuagugaggcuaaagau

SEQ ID NO: 5606 - RNA, 72 nt, Human
gggggaacguggucaucaguggucagugggguuccaagauuauccccuaaaacucauagacccaggucuccc

SEQ ID NO: 5607 - RNA, 81 nt, Human
gaccucaagucaucugcccgccuuggccacccaaagugcugagauuacaggggugagccacugcgcccugacuuggagguu

SEQ ID NO: 5608 - RNA, 66 nt, Human
cccccuaaaauauaaucaccgacuuuacaaacugaaggaagcagguuuuggaaggcgggaaggggg

SEQ ID NO: 5609 - RNA, 85 nt, Human
ggaucacagauggagaagugucaaacaaggaugguugcgggcaagagggcugcacccuaucuuggagaccuucucccaggugucc

SEQ ID NO: 5610 - RNA, 73 nt, Human
guaugagggaagggagguggaagcucauaucccaccccaggggguuuugaggaucuuuucccuucucucucac

SEQ ID NO: 5611 - RNA, 105 nt, Human
guaugcuggagcagaggacuuugagaaauggaggucauguggacagcaguguugacuaccugccucuaccacaguacuccuucuauauagucacuugcuagcuac

SEQ ID NO: 5612 - RNA, 63 nt, Human
uuuuuuuuuacaacuuuaaauacggaauauaaauaaauuuuacauuuaaaaaauagaaggaaa

SEQ ID NO: 5613 - RNA, 62 nt, Human
ucuuaaagaaauuggacagcauaugaagacaggacaucacauaugaaugcacgauaugaaga

SEQ ID NO: 5614 - RNA, 74 nt, Human; identical to SEQ ID NO: 365

SEQ ID NO: 5615 - RNA, 89 nt, Human
uggguuuuauuuuucaauuuuuauuuugguuuucuuacaaagguugacauuuuccauaacagguguaagaguguugaaaaaaaaauuca

SEQ ID NO: 5616 - RNA, 77 nt, Human; identical to SEQ ID NO: 3082

SEQ ID NO: 5617 - RNA, 99 nt, Human
ccgcgaccaaccugcucuugaaugacacggcuuaacacagggaacuucuuguuucuucucuuaagcuggaccucacugucggcaugugcugguucgcgg

SEQ ID NO: 5618 - RNA, 62 nt, Human
ccauugcucagugacaguaucuuaaagcuuguccagagcuugaaggaccacacagguagugg

SEQ ID NO: 5619 - RNA, 100 nt, Human
ggcuaugcaggauggcugcagccuaggagcugguggaggcucggcucaugcuagccucuacgucuucugagaucuggcgugucguacuauccuguaugcc

SEQ ID NO: 5620 - RNA, 78 nt, Human; identical to SEQ ID NO: 99

SEQ ID NO: 5621 - RNA, 80 nt, Human; identical to SEQ ID NO: 100

SEQ ID NO: 5622 - RNA, 63 nt, Human
gaaaugggcuucuggagcccacaccaugaguuauccuugggaacgggguucuccguccauuuc

SEQ ID NO: 5623 - RNA, 76 nt, Human
uuuuuuuuuuuuuugaugacucccagucucguuuuauugccgcugacaacuuugggggaaacagauaaaaaaaaag

SEQ ID NO: 5624 - RNA, 60 nt, Human
ccccuuuuuuuuugaaaaagggcgccccucaauaggggcgcuauuauaaaaaaggggggg

SEQ ID NO: 5625 - RNA, 129 nt, Human
cggagaccucacccuguaccaguccaauaccauccugcgucaccugggccgcacccuugggcucuaugggaaggaccagcaggaggcagcccugguggacauggugaaugacggcguggaggaccuccg

SEQ ID NO: 5626 - RNA, 65 nt, Human; identical to SEQ ID NO: 1518

SEQ ID NO: 5627 - RNA, 75 nt, Human; identical to SEQ ID NO: 74

SEQ ID NO: 5628 - RNA, 87 nt, Human; identical to SEQ ID NO: 76

SEQ ID NO: 5629 - RNA, 71 nt, Human; identical to SEQ ID NO: 77

SEQ ID NO: 5630 - RNA, 69 nt, Human
acuaugccauaugguuuuucagaaacaugauacuucauguaauaaugaauaauccagacagguacaagu

SEQ ID NO: 5631 - RNA, 72 nt, Human
ucaguaaauaugguaauauaggaacaaacuuaggcucauaagccuuuuaacuuuuuacauaaucuuuaauga

SEQ ID NO: 5632 - RNA, 72 nt, Human
cagagauaugcuauauaugauauacauaugauacauaucauauguauguauaugauacauauauaauuucug

SEQ ID NO: 5633 - RNA, 61 nt, Human
cccggauccucagucgugcgggagucugggaggccuggcuuccucaggggugagguuuggg

SEQ ID NO: 5634 - RNA, 84 nt, Human
cugcccaggcugcccgccagguccacuuaugccgaggagucuuccccuugcuuuaccgugaaccuccagaagccaucugggcag

SEQ ID NO: 5635 - RNA, 72 nt, Human
gaucgccgggugcaauuuggcauugaaaguggaaagcuccguggcuuccuccguguuggagaccuggugauu

SEQ ID NO: 5636 - RNA, 70 nt, Human; identical to SEQ ID NO: 3612

SEQ ID NO: 5637 - RNA, 87 nt, Human
gccccaacgucuguucauggcugugguuuuaaaagagucccucaacagaugcucuauuuaauaaccaguuuguuccucagauguggc

SEQ ID NO: 5638 - RNA, 96 nt, Human
ggccuacagggggcaccccuggucuugaugccucaagcccagcauuucuggguccccucugcaagcucagagagcagggaggcuucugguagugcu

SEQ ID NO: 5639 - RNA, 83 nt, Human; identical to SEQ ID NO: 1471

SEQ ID NO: 5640 - RNA, 73 nt, Human; identical to SEQ ID NO: 4762

SEQ ID NO: 5641 - RNA, 112 nt, Human
cuuuaauugauaaagccagaguggagacacagaaccacugguucaccuacaaugagacaaugacaguggagagugugacccaagcuguguccaaucuggcuuugcaguuugg

SEQ ID NO: 5642 - RNA, 85 nt, Human
gaugcagauccaggugccaugucucgucccuuuggaguagcauuauuauuuggaggaguugaugagaaaggaccccagcuguuuc

SEQ ID NO: 5643 - RNA, 61 nt, Human; identical to SEQ ID NO: 980

SEQ ID NO: 5644 - RNA, 101 nt, Human
aucccgacgugugugccgggugcgcugcgucgugucgagccgugcgaagcacggugcguacgucuccaugacgccguggcuaguggcgcgcacggagggau

SEQ ID NO: 5645 - RNA, 86 nt, Human
gccacccgucacugucuucucuucaucccuaucgucgacagacgcaucgauucgcgguaagacaguggagggaaggucguaauggc

SEQ ID NO: 5646 - RNA, 87 nt, Human; identical to SEQ ID NO: 76

SEQ ID NO: 5647 - RNA, 78 nt, Human
gaauauuuccacaaugucugugaacuggaccugguguucaacuucuacaagguuuacacggucguggacgagauguuc

SEQ ID NO: 5648 - RNA, 77 nt, Human
auugguuccaagacgcguaggcgaguuggucugaaagcccccgguaucauuccucgaaucucagugcgggaaccaau

SEQ ID NO: 5649 - RNA, 87 nt, Human; identical to SEQ ID NO: 76

SEQ ID NO: 5650 - RNA, 71 nt, Human; identical to SEQ ID NO: 77

SEQ ID NO: 5651 - RNA, 85 nt, Human
guccuugaacuuggaaccugacaauguugguguugucguguuuggaaaugauaaacuaauuaaggaaggagauagugaagaggac

SEQ ID NO: 5652 - RNA, 129 nt, Human
ugcggaguuaacugcaaagaugcuguccgugcgcguugcugcggccgugguccgcgcccuuccucggcgggccggacuggucuccagaaaugcuuuggguucaucuuucauugcugcaaggaacuucca

SEQ ID NO: 5653 - RNA, 75 nt, Human; identical to SEQ ID NO: 2289

SEQ ID NO: 5654 - RNA, 70 nt, Human
acaauuuuguauggaaugcuagauggccaagccucagccuuugguccagugcaacccuugccucgcuugu

SEQ ID NO: 5655 - RNA, 65 nt, Human
ggccagggcguugagaaaaggugacucuccugaggccaaaccuuugcaucucagaagcccuggcu

SEQ ID NO: 5656 - RNA, 66 nt, Human; identical to SEQ ID NO: 12

SEQ ID NO: 5657 - RNA, 131 nt, Human
cagcuuuggugggggaacugguucuggguucaccucccugcucauggaacgucucucaguugauuauggcaagaaauccaagcuggaguucuccauuuacccggcaccccagguuuccacagcuguaguug

SEQ ID NO: 5658 - RNA, 70 nt, Human
gcaaggaagaugcugccaauaacuaugcccgagggcacuacaccauuggcaaggagaucauugaccuugu

SEQ ID NO: 5659 - RNA, 61 nt, Human
ugaagagaauguuccuuaucugaguuguaauagccuacuuguaggucuauauuuaucuuca

SEQ ID NO: 5660 - RNA, 62 nt, Human
uuucuuguaauaucaaaauauauguauauguacuaaguuuauuuugcaaguguuucaaggaa

SEQ ID NO: 5661 - RNA, 102 nt, Human; identical to SEQ ID NO: 2701

SEQ ID NO: 5662 - RNA, 90 nt, Human; identical to SEQ ID NO: 2702

SEQ ID NO: 5663 - RNA, 73 nt, Human
ggagcgcaccuucaucgccaucaagccggacggcgugcagcgcggccuggugggcgagaucaucaagcgcuuc

SEQ ID NO: 5664 - RNA, 61 nt, Human
ccaucacggacuuccugggaaaaucagauccauuucuggaguucuuccgccagggugaugg

SEQ ID NO: 5665 - RNA, 96 nt, Human
gcggggcggaggcacucgcgcgggggguaauucggggucuggguucuggugccgcgcagcuuuccccgauggcccacugcgugaccuugguucagc

SEQ ID NO: 5666 - RNA, 78 nt, Human
ggacugaacgggugcggaacugcucaagcccugaguucuccaagacucuacagcuugaguaccgcuuugagacagucc

SEQ ID NO: 5667 - RNA, 64 nt, Human
ucggcuccaagucugacccacucugcauccuuuuacaggaugugggagggggcagcugggcuga

SEQ ID NO: 5668 - RNA, 68 nt, Human
ugcauuuccucauccuguucucucugucauagaucuaccuguucuuaacagagggaugagaaaaagua

SEQ ID NO: 5669 - RNA, 74 nt, Human
uggggcugagaggcgagacacugauggcacucuuacuucugucagcugccgcaaagucucguccacuugcugca

SEQ ID NO: 5670 - RNA, 69 nt, Human
gagaugcagcagaaguugguggagcugucggcugagaacgagaagcugcaccagcgcguggagcagcuc

SEQ ID NO: 5671 - RNA, 82 nt, Human
gcagggcagcccaccccgcccacgucgccggagccgccgcgcagcagccccaggcagacccccgcgcccggccccgcccugu

SEQ ID NO: 5672 - RNA, 69 nt, Human
gaggagcaacccccuuguagaaugcuuuuaggccuucuuccuuauacauucucgggagcugcaucccuc

SEQ ID NO: 5673 - RNA, 73 nt, Human
uccagcuauguaaccugcuacaaauguuacaaccagcugcucuggcuuugaacauucacugcggggcuuagga

SEQ ID NO: 5674 - RNA, 71 nt, Human
uguuggcauaaccuggcuggguaugaauucgaaccuuagcagcuuccauacgagccaggccaaugucagca

SEQ ID NO: 5675 - RNA, 61 nt, Human
ggauaacagcaauguucagggaacaaaggagauaacuuuaaacucugacgugccgugagcc

SEQ ID NO: 5676 - RNA, 69 nt, Human
gugaagauuucauggacacuuaucacuuccccaaucaauacccuugggauuuccuaugccugucuuuac

SEQ ID NO: 5677 - RNA, 62 nt, Human
ggcuggagcuugacacgguugagaaucccugaugcucaacccguauuuucuggcuaccaguu

SEQ ID NO: 5678 - RNA, 77 nt, Human
gugcaccugugugcgcaggcauccgaguccaugucacgugcuggcacggcaaucgccauccuuucacaacaggucac

SEQ ID NO: 5679 - RNA, 72 nt, Human
uuccagcaacuggucacugcagcagcgcacucacauggcggugggcgcucgggcugaccucaccuucuggaa

SEQ ID NO: 5680 - RNA, 65 nt, Human
gaaacauaaauucaacuuuguaaaaaucuuuugaagcauagauaauauuguuugguaaauguuuc

SEQ ID NO: 5681 - RNA, 66 nt, Human
uacuggcuauuaauauucaggguaaauaggaaucauucagaaauguugagucuguacuaaacagua

SEQ ID NO: 5682 - RNA, 90 nt, Human
uuuaaagacccuccuauucuauaaaacuuugcauguagaggcuuuguuaacuuucucucucuaagguuuaaauaggaguggugauuugaa

SEQ ID NO: 5683 - RNA, 96 nt, Human
uaauuacuguaagccagaaugauugcugaaaugucaaaauguaagauugaaugaggcuauuuaaacauuuuaguauauuuugucuuacugaaauug

SEQ ID NO: 5684 - RNA, 81 nt, Human
cccaaggcugcgcaaagugacacacugagucgcccauccacgggcgccaagaccugcuucaccuuuugcuacgcggccggg

SEQ ID NO: 5685 - RNA, 64 nt, Human
ugucgacauccguggaggauggccagauccccgaggucaucuucuacaccuaggcuguccgaca

SEQ ID NO: 5686 - RNA, 85 nt, Human
guccgugaauuuuaaacuaggguaccgccgcccauuauaggggcuuuugggcgccuaaagcggauugaaccauguguuaccgggc

SEQ ID NO: 5687 - RNA, 62 nt, Human
uucuuugggacaaaccuugaaaauguuuauuucaaaaaaacaaaaggcuuugcacaagagaa

SEQ ID NO: 5688 - RNA, 60 nt, Human
auuuuugggucuccggucacugccacuucacgcuuggcacacccaaacaaacccaaggau

SEQ ID NO: 5689 - RNA, 83 nt, Human
ucccccaggggguaaaggaagugguaucuuugacgaaucaacccccgugcagacucgacagcaccugaacccaccuggaggga

SEQ ID NO: 5690 - RNA, 62 nt, Human; identical to SEQ ID NO: 5011

SEQ ID NO: 5691 - RNA, 61 nt, Human
uuaggaaaggagaucaacauuuucaaauuagauguuucaacugugcuccuguuugucuuga

SEQ ID NO: 5692 - RNA, 81 nt, Human
uugcgcuuuccuuucugucaagaagcaguuugaagaauuaacccuuggugaauuuuugaaacuggacagagaaagagccaa

SEQ ID NO: 5693 - RNA, 80 nt, Human
gaggagguggcggcgcuggagcuccucccggggaccagcgacccggggagcgagcacgucgcuccgcaccgcucuuccuc

SEQ ID NO: 5694 - RNA, 62 nt, Human
ggcuccgcccccacccugccugcccccucgcuggagcaacgcaagcaggaggcgggggaguc

SEQ ID NO: 5695 - RNA, 79 nt, Human
aaguuguugauauucuuugaguuuacaaguuaauccuuauuggagaugugccaauauacaguuagaauaucauuaauuu

SEQ ID NO: 5696 - RNA, 67 nt, Human
uaaauaugugcaguuauuaucacaugaagaaacgcaguguggucgggcuguaauauuaccauauuug

SEQ ID NO: 5697 - RNA, 103 nt, Human
agucuauacacuguggccucaaccucccagacagggcagagaacugugggcagcucguuugcuuucuaggcuggcuggagaggugggagcucauugauagacu

SEQ ID NO: 5698 - RNA, 73 nt, Human
gcuccugucccucuugcuuuauagcuagcugcccggggaccaagguacaggugaaagcaagguagcagcuugc

SEQ ID NO: 5699 - RNA, 77 nt, Human
guccaaagccacacugaaaacagaggcagagacauguacucuggugugaucucuuguccucagugucucuucugggc

SEQ ID NO: 5700 - RNA, 85 nt, Human
ggcuccucauuuaccaccuuuucccacugucugcauugguaacucuuuugaagacaccccuuuaauugcuauuugaaccugggcc

SEQ ID NO: 5701 - RNA, 77 nt, Human
auuccaagugcuccaaggguaacucauaaagucaaggggccaaucggcggcccaaugggcccuccaagaguuggaau

SEQ ID NO: 5702 - RNA, 61 nt, Human
ccccuuuuuggacacuuauacaaggugugggaaacccacugguaccagugcaagaaugggg

SEQ ID NO: 5703 - RNA, 84 nt, Human
cgccccuggcccucccgggcucuucucuggcccggggcucacaguagcuccgaggccccgaggcccggcggggcggcgggggcg

SEQ ID NO: 5704 - RNA, 73 nt, Human
gcagaguccaggcgcgcccggaggccguggcgcucgcgcgggacuuucgagccucgggcccggccuggcaugc

SEQ ID NO: 5705 - RNA, 62 nt, Human
gcgucgccgcgccgcagggccagcaucacgcucuggcucugcaucucgcggcgccgcgacgc

SEQ ID NO: 5706 - RNA, 90 nt, Human
gccgccccccgaggagagcugcccggccaagcccguggcccccgggcccugcuucgggggccgcaccuuggaggagaucuggagggcggc

SEQ ID NO: 5707 - RNA, 80 nt, Human
uugggacaggccuuccgcccggaggaaugaacaagugucagucgaguguuuacagauccggccaggaccccggcccccaa

SEQ ID NO: 5708 - RNA, 73 nt, Human
auauacaucgcaauuucuuuguacaauaggugagaaaaaucugcaguauagaagaauagaggcagagaaauau

SEQ ID NO: 5709 - RNA, 116 nt, Human
gaaagccuggugggaccacagggguugccauucagcuacugacaaggucagcaucauugcuuucagcuggccuuuuaguacaguuuuucuggugaccuugugcugaucaaacuuuc

SEQ ID NO: 5710 - RNA, 61 nt, Human
guuaagaagcaugguucugacuuuccuaaacugggguuucuagagcccaagcuccauuagc

SEQ ID NO: 5711 - RNA, 74 nt, Human
uaaguaguaaguauaccuuaaucaccugagguucugguaaauauuagguauuauaaagguugcuuucacacuua

SEQ ID NO: 5712 - RNA, 71 nt, Human
aacgucaucagcuuccuaaccauguuuaagaggaauaacuucaugaacauuuugcccugaacugaagaguu

SEQ ID NO: 5713 - RNA, 65 nt, Human
gcgcgccuucgggcccucucgagaaaaagccuuucucuuaagagccacucucucgguuggcgcgc

SEQ ID NO: 5714 - RNA, 73 nt, Human
cguuccuucccagccucagcccacggcaggggugcagccccaucuuucugcuguaggcugggcuacagggacg

SEQ ID NO: 5715 - RNA, 66 nt, Human
cucagcuuuuacucauguuuagauaaugugauauagcuguucuagauauuugagauuaggguugag

SEQ ID NO: 5716 - RNA, 77 nt, Human
uauuguuguuaaucacuuacugugccuaauuuauaaauuaaacuuuauuguagguauguauaggaaaaauaauagua

SEQ ID NO: 5717 - RNA, 61 nt, Human
gguggagcgguucauuuauuuggaaacuaugacaugaaaaccaaauuugaaaacucacauc

SEQ ID NO: 5718 - RNA, 63 nt, Human; identical to SEQ ID NO: 527

SEQ ID NO: 5719 - RNA, 79 nt, Human
augcuacacaaccagaaaguaagguguucuacuugaaaaugaacaggagauuauuuuagguaucuuucugaaguggcau

SEQ ID NO: 5720 - RNA, 63 nt, Human
ggggguuggagcuaccgccaccgccgcgccgauuccggagccgggguagucgccgccgccgcc

SEQ ID NO: 5721 - RNA, 69 nt, Human; identical to SEQ ID NO: 528

SEQ ID NO: 5722 - RNA, 62 nt, Human
aaggcucuuguagguaacucuccuccagucggugauucagggacccagccuccuucugccuu

SEQ ID NO: 5723 - RNA, 71 nt, Human
uuaugguaagcaaaauaaauuguauuuuuccauccuuggggaggauaaaggaacucuuugcacugcuauaa

SEQ ID NO: 5724 - RNA, 106 nt, Human
cggauuauccccauaccccacccauucccgauacaccuuacuuacuguguguuggcccagccagagugaggaaggaguuuggccacauuggagauggcgguagcug

SEQ ID NO: 5725 - RNA, 67 nt, Human
gacucccuggugugcuccuggaaggaagaucuugcgggacccccccaccggagcacaccuagggauc

SEQ ID NO: 5726 - RNA, 62 nt, Human
ucuuugcccgucuccuggggaccccccaacgaaauguggaguccucgggggccgugcacuga

SEQ ID NO: 5727 - RNA, 74 nt, Human
cucugacaacaguggcuggacugaaauccgccgggaagccugggucuccucuagcuuauuuggugucuccagag

SEQ ID NO: 5728 - RNA, 88 nt, Human
ggucggacgucguggauccgcgggucugucucuugcuucaacaguguuggacggaacagauccggggacucucuuccagccuccgacc

SEQ ID NO: 5729 - RNA, 71 nt, Human
gucgaacagccuggucaauuuguaccugcaggccguccuacaccuaccucucucugggcuucuauuucgac

SEQ ID NO: 5730 - RNA, 85 nt, Human
ucuccugcuucugggaccugccagcaccguuuuugugguuagcuccuucuugccaaccgaaccaugagcucccagauucgucaga

SEQ ID NO: 5731 - RNA, 86 nt, Human
cggacagacauuugguauggaucacuggucauuccuacgucaccuaugggccacuggccaauggugccaccagauguuuuuguuug

SEQ ID NO: 5732 - RNA, 83 nt, Human
ucaugcccagaugugcagaucucauggaaccaauggugauugacuugugguggcaugagcucaugcaaugaggcaggggauga

SEQ ID NO: 5733 - RNA, 89 nt, Human
ugugagcccgaguggugugaugccugaggacccacucuucauccuguacaccaguggcuccacaggcaaacccaagggugugguucaca

SEQ ID NO: 5734 - RNA, 63 nt, Human; identical to SEQ ID NO: 527

SEQ ID NO: 5735 - RNA, 90 nt, Human
uucccaaugcuacacaaccagaaaguaagguguucuacuugaaaaugaaaggagauuauuuuagguaucuuucugaaguggcaucuggag

SEQ ID NO: 5736 - RNA, 72 nt, Human
ccaacaggaugccacgcugggccgagcgacuauuuccugccaauguugcucacucgguguacguccuggagg

SEQ ID NO: 5737 - RNA, 81 nt, Human; identical to SEQ ID NO: 272

SEQ ID NO: 5738 - RNA, 97 nt, Human
gaguccacuggugcccaguaacacccuccgugggaccaccuugggaagcaugugccgcggaguccaccacgggggguccugggucccgggagggcuc

SEQ ID NO: 5739 - RNA, 78 nt, Human; identical to SEQ ID NO: 99

SEQ ID NO: 5740 - RNA, 80 nt, Human; identical to SEQ ID NO: 100

SEQ ID NO: 5741 - RNA, 60 nt, Human
gcacaagauuuucuuauugaagguguuacuaccuuugcacaaagugaaaucucugagugu

SEQ ID NO: 5742 - RNA, 112 nt, Human
gagcaucaccugggaauuugcuagaaaugcaaauucacaggccucacucccaaccugaaucaaauucuggggugggguccaggaaucuguucuaacaagccaggugauuuuu

SEQ ID NO: 5743 - RNA, 67 nt, Human
caagaacaacacaccucuauuuguggucgccgccucgcgugcccccugcgagaagauguuguuuuug

SEQ ID NO: 5744 - RNA, 62 nt, Human
uaguuuucauacguauauuauacaccgaggguguuaacuacucguggugagcguguaaauua

SEQ ID NO: 5745 - RNA, 66 nt, Human
gaggcgggcagaucacaaggucaggagaucgagaccauccuggcuaacacagugaaaccccaucuc

SEQ ID NO: 5746 - RNA, 76 nt, Human; identical to SEQ ID NO: 2134

SEQ ID NO: 5747 - RNA, 65 nt, Human
gcuuggacuagaauuucuucuugguauuaaagagacaaguuuaucacagaauuuuuuuuccuggc

SEQ ID NO: 5748 - RNA, 73 nt, Human
gcgggggggcccccaggacggucacggugagaccuaggcccacaaagggggguccaaaaagagaaaacuccgc

SEQ ID NO: 5749 - RNA, 95 nt, Human
ggauaucuuaauccuuccacauacagauauccuuauauccacaggaggccauguggaauauaaggauaucuguauguggaaggauuaagaucucc

SEQ ID NO: 5750 - RNA, 62 nt, Human
cauguguuguauaaaauguuguuggaauucagguggacgaaagacaagauaaucaauacaug

SEQ ID NO: 5751 - RNA, 78 nt, Human
ggggucaaguacauucccagucguggccucuggacaaguggcgggcccugacucaugaggguuccaaugugcugcccc

SEQ ID NO: 5752 - RNA, 65 nt, Human
gucucgcuucugccgaggugucccugaugccaagauucgcauuuugaccuggggcggaaaaaggc

SEQ ID NO: 5753 - RNA, 72 nt, Human
cugugacuaguauguugaguccuguaaguaggagagugauauuugaucaggagaacgugguuacuagcacag

SEQ ID NO: 5754 - RNA, 65 nt, Human
gagaaugggggaugguguaugaacaugaggguguuuucucgugugaaugaggguuuuauguuguu

SEQ ID NO: 5755 - RNA, 76 nt, Human
ucugcaccucccagccuggagaggagccugugacuugcccuguuccuuggcuccucaggcugggguaagguguggg

SEQ ID NO: 5756 - RNA, 68 nt, Human
ccauuuuuauuucgcuaugcagaaacauacauucaccaugggcugugaugcaggugaucguguaaugg

SEQ ID NO: 5757 - RNA, 72 nt, Human
uuucucagcuaugacacagagacagggggcaauucacuuguaccucuccuguccugcucaacauuugggaga

SEQ ID NO: 5758 - RNA, 70 nt, Human
uuaagacuccugacccccaaguggcaugcagcccccaugcccaccgggaccuggucagcacagaucuuga

SEQ ID NO: 5759 - RNA, 87 nt, Human
aggaccuggaggucaggugugaaugcuguaucggcacagggaauaaauauccuggcgucuggagccuucaccucuccgucaaguccu

SEQ ID NO: 5760 - RNA, 63 nt, Human
ggguuuuuguggcuuuguucaaugcuuccacucuagggcaggcagagcagucuauacucuccc

SEQ ID NO: 5761 - RNA, 80 nt, Human
uucccuuuuuccuuccucagguuuugucucuuccuguguuguccccagcaagggagagacugugggguggauugggagaa

SEQ ID NO: 5762 - RNA, 84 nt, Human
gccacaguggggcaccaugguggagugccagcgucacaccuacggggacgucgaggcgccuaagccaaggcgcccucugugcgc

SEQ ID NO: 5763 - RNA, 73 nt, Human
uccuggcugcagaugaguccacugggagcauugccaagcggcugcaguccauuggcaccgagaacaccgagga

SEQ ID NO: 5764 - RNA, 82 nt, Human
gccacaugaaagccguagaauuugaccuugcgaagacucgaguagucguaaagggcaaggguccaaauggcucgcaaauugc

SEQ ID NO: 5765 - RNA, 62 nt, Human
gccccgguaucuuccucgaauucaggccggaccaugcacggcuuaagggggauaacuugggc

SEQ ID NO: 5766 - RNA, 61 nt, Human; identical to SEQ ID NO: 1202

SEQ ID NO: 5767 - RNA, 64 nt, Human
gaugcuugugacuuccucuugugaugucuuaugaugaacaaagucagaucuggucagaaguauu

SEQ ID NO: 5768 - RNA, 61 nt, Human
aucaucuguaccauuggcccaugcuucccugaucaguggagacuguugaaugugagaugau

SEQ ID NO: 5769 - RNA, 66 nt, Human
gccacucucaaaaucacgcugugauaacgccuacauggaacagugugacugagaacauccuguggc

SEQ ID NO: 5770 - RNA, 86 nt, Human
cccggcgggaggaagcugucaagcgccaggggggccuucgggggcucccggguuaaggcugggguuugccacggcuuccuaguggg

SEQ ID NO: 5771 - RNA, 76 nt, Human
ucugagcucguccgcgcauggcuucaucguccuccagaggccgcacuccacuaccugcguuauuggacgacucagg

SEQ ID NO: 5772 - RNA, 88 nt, Human
cuggccacaccgaccagacagacccagccuugaucuugcuaugacucucuaucacugggccugccucaacuguaacgcugcugcccag

SEQ ID NO: 5773 - RNA, 63 nt, Human
gcacacucuaguaccccuuugcauaccaacaaaccaugguacccacaucgccacuuuuccugc

SEQ ID NO: 5774 - RNA, 98 nt, Human
accuggaggcccaggcccuguugggaaggagccgggcagcagugucccacugaguguggaugcugagugugugcccaugggucggggccuucucaggu

SEQ ID NO: 5775 - RNA, 62 nt, Human
ggggcccccugugacccuggagagugucccucucucagggaugccacaaccaugggggcccc

SEQ ID NO: 5776 - RNA, 92 nt, Human
uggagcguggcgaacaggugcucugggccuggcgcugcugcugcugcucggccucggacuaggccuggaggccgccgcgagcccgcuuucca

SEQ ID NO: 5777 - RNA, 77 nt, Human
ggggucaguacaucccccagucguggcccucuggacaguggcgggccugccucaugagggcuccaaugugcugcccc

SEQ ID NO: 5778 - RNA, 66 nt, Human; identical to SEQ ID NO: 5275

SEQ ID NO: 5779 - RNA, 65 nt, Human
uggggccaauuuuguaacucagaucuugcugagaccaggagcaucugauuuaacaggaaguuuca

SEQ ID NO: 5780 - RNA, 79 nt, Human
uucggugcuuuuaccuaccuacaacgagcgcgagaaccugccgcucaucguguggcugcuggugaaaagcuucuccgag

SEQ ID NO: 5781 - RNA, 72 nt, Human
gagcucauauuuuaugcagaugaucagucaacacauaagcaaguguugacacuguacaaucccuaugaguuu

SEQ ID NO: 5782 - RNA, 70 nt, Human
ggaaaacggcaaaauuguguacguugauguaccgccgagaggugggacuuugaccugcaauuagguuucc

SEQ ID NO: 5783 - RNA, 77 nt, Human
agguccgcgcugugucccguguuuucugcgugagaggaaaagaugcuagaaccacaggagaauggcgugauugaccu

SEQ ID NO: 5784 - RNA, 64 nt, Human
cuuccagccuuaaggcauguauuugauaaggcaaaauucaaagguaaaggucaugaggcugaag

SEQ ID NO: 5785 - RNA, 71 nt, Human
accgcgagguuuuuccuagggcugucugggcuggucuacgggucgucccggcugccuuucaugccuccggu

SEQ ID NO: 5786 - RNA, 113 nt, Human
gcuucucugcuccccugggugaugggugggcccagaagguggcagucccacaccuuguccucccaccucccugaaacuguccauugcuuuuauagggugagguaagugacagc

SEQ ID NO: 5787 - RNA, 98 nt, Human
gggcuggggugggguggguggggucgggugguggagaggccuuagcuguccuggcuggugccccucccaggcuccuuuucacccugcccccugggccu

SEQ ID NO: 5788 - RNA, 63 nt, Human
augcccgugagcgagcugacugacaagcuggggcuacagcacuuacgcagccgcacgugguau

SEQ ID NO: 5789 - RNA, 79 nt, Human
cuccccccauggccaggccuugcuccuguucugccugauguucccugguugugggccugggcuuggcucuggggagggg

SEQ ID NO: 5790 - RNA, 72 nt, Human
guccccggcgggguuggccagugaaaaaccuuauaucagguagaacaaauaggucggacaccggcgggaggc

SEQ ID NO: 5791 - RNA, 70 nt, Human; identical to SEQ ID NO: 5314

SEQ ID NO: 5792 - RNA, 66 nt, Human
aaaaacuuuacaaaaaauggcagcaaaggguaguuuucaucugggugucuuucauuuaaaguuuuu

SEQ ID NO: 5793 - RNA, 60 nt, Human
ugcugccgaugaccaagcacgccuuauugaccccgaaggcugcgacgcugcacggcacca

SEQ ID NO: 5794 - RNA, 71 nt, Human
cugguugugggggagggaaaagcggcaaaaggggauuauucaaaguaccgaaaaccuucucccgggaucag

SEQ ID NO: 5795 - RNA, 62 nt, Human
guugcaguuuuccggcagcaugguaguaugagauaguauguugugucucuggaauaugugau

SEQ ID NO: 5796 - RNA, 80 nt, Human
aagguaaauagccaugggugggccuacaaaauucccugucaaugacuuggggaugacccugugggcacccuaugguccuu

SEQ ID NO: 5797 - RNA, 67 nt, Human
guugugcaccgccggccucguuugaaccaaucagccguccagcgggacuggcccgcgggugcacaau

SEQ ID NO: 5798 - RNA, 70 nt, Human
aagagggggcaacucaaggagggacacaugacuaagcaagaaaaugugacucugugagcugaccccgcuu

SEQ ID NO: 5799 - RNA, 63 nt, Human
ccgcgguggcuuccgaggagguuucgagcauguggcauucgagggccggggucgcggccgugg

SEQ ID NO: 5800 - RNA, 62 nt, Human
cugaggccugggugguuaacacaacauggcggaugacgccgcgugcagcuaagggggcccgg

SEQ ID NO: 5801 - RNA, 78 nt, Human
ggcucauggaguguuaaagugcauccacaggaggauggccaccggccaucacguggugagccaaucauaccauggacc

SEQ ID NO: 5802 - RNA, 73 nt, Human
uccuaguggugcgggcacacacacccugcacgccacacaccaccuacaggguggccgugagccgcacccagga

SEQ ID NO: 5803 - RNA, 105 nt, Human
gcaaaauauucuacaguuuaaugguuuuuuugaggacccucauauuuuauaaguuuauaauaaagugucuuaaguuucuuaaaaguaucaacuguuuucguuugu

SEQ ID NO: 5804 - RNA, 72 nt, Human
guguaugggucaauaguuuacuuuuuauuaucuccgaccagcugauaaaagacaauaauuaaauacauacau

SEQ ID NO: 5805 - RNA, 61 nt, Human
ugcgggccgucacacggagcccggagacaacugccuaugcgcacuggaaggaacgcccgca

SEQ ID NO: 5806 - RNA, 61 nt, Human
gccaaguuucgucccguuuugcaagggcccaaggggggauauagcaagcgggggguaaggc

SEQ ID NO: 5807 - RNA, 60 nt, Human
cacgaaaauguacccaguauuccuagguaguggccuaauuuuaccaauuguacacacgug

SEQ ID NO: 5808 - RNA, 61 nt, Human
ugggcucaucauucccuuggagccuggaaggccgggugcuccaggggcgugacaacgucca

SEQ ID NO: 5809 - RNA, 60 nt, Human
gcauggcugacaaauugcucgacacaaccugcagaaggucaauggggcaggaggccaugc

SEQ ID NO: 5810 - RNA, 76 nt, Human
gcgcagcgggugaagcuaucaagcccagagagagacguggagagggacgucuuccuguauagagcguaccuggcgc

SEQ ID NO: 5811 - RNA, 75 nt, Human
caacgagauuuggucguaguggggcgccuuggucaccagggcugcuuuuaacucuggguaaaguggauauuguug

SEQ ID NO: 5812 - RNA, 61 nt, Human
gccaucacugccaccagaagacuguggauggccccuccggggaaaacuguggcgugauggc

SEQ ID NO: 5813 - RNA, 88 nt, Human
ccuggcacucuagugcacccaggagucuggacaggagggcagugcugcugcaugcagccccaguauuuaccugggguaagaugccagg

SEQ ID NO: 5814 - RNA, 99 nt, Human
gcuuggcagcaaggugccuuagcuaagcuuccucucaacccuggucaggaagccugggaggguugggguggcugcauagcggacccggggucuucaagc

SEQ ID NO: 5815 - RNA, 90 nt, Human
ggagaaagcaagccccuccacacugcguccuagaccggauauugagguuggugucucaggcccagugccccggaggagcgggcugucucc

SEQ ID NO: 5816 - RNA, 64 nt, Human
guacccuucugcugagcagucuaaccccuaugccuguauaugcucacuguucaccaguaccuac

SEQ ID NO: 5817 - RNA, 67 nt, Human
ugucuacgacagcucucaauugcccagucaugaccgucagcugggauaaccauugcccuacuggaua

SEQ ID NO: 5818 - RNA, 60 nt, Human
ggcuggcaguuccaguuggcgccgaacucggggacaccuuccggcuucugggguccagcc

SEQ ID NO: 5819 - RNA, 66 nt, Human
ggggccucuagugggcaccuuuauuuuuagauuuuuccugaacauggcggucucgccucugguccc

SEQ ID NO: 5820 - RNA, 85 nt, Human
ggugacucagugcucaggaucuuauggcuccuuccuccagcuugggggacucuuaaaggggcugggguagagacuaagaguugcc

SEQ ID NO: 5821 - RNA, 63 nt, Human
acuguguucagcugccacaggccuggaggaguuuccuggccugucacgugagguuggaucagu

SEQ ID NO: 5822 - RNA, 65 nt, Human; identical to SEQ ID NO: 4540

SEQ ID NO: 5823 - RNA, 71 nt, Human; identical to SEQ ID NO: 4541

SEQ ID NO: 5824 - RNA, 70 nt, Human
gugcacgcuuggccacccuugccauuucugcucccagagucucaggcuccccuucugacccagugugcgc

SEQ ID NO: 5825 - RNA, 60 nt, Human
gccucugagagaagcagcugggggcccucacccugcaucgucuugcgucucuuggcaggc

SEQ ID NO: 5826 - RNA, 62 nt, Human
gugacugccugguuaagaucuacaaaucugaugggauuaagggccuguaccaaggcuuuaac

SEQ ID NO: 5827 - RNA, 61 nt, Human
ucugugcaggguauuaucaucuaccgagccgcuacuucgguaucuaugacacugcaaggga

SEQ ID NO: 5828 - RNA, 72 nt, Human
ggguugcuuauguuaacuuuccaaauguacauuaacuccgguuuagaauuuggggggaaaauuuggcaauuu

SEQ ID NO: 5829 - RNA, 60 nt, Human
uuaaccauggacauggaucuucuuuauaauucuaauuugaagugcugucuccauggucgg

SEQ ID NO: 5830 - RNA, 77 nt, Human
uuauucaaaaucaacaucuuggguccgaauuugaacuucuuccaaucucuuggcacuucaaggguuguuaagaauag

SEQ ID NO: 5831 - RNA, 90 nt, Human
ccacccaagggcuacuuccugaccaagaucuuccacccgaacgugggcgccaauggcgagaucugcgucaacgugcucaagagggacugg

SEQ ID NO: 5832 - RNA, 73 nt, Human
gccggcggcccagcggcggccggagccggucggccuggccugggcugaagcuccucccgagcugggccccggc

SEQ ID NO: 5833 - RNA, 65 nt, Human; identical to SEQ ID NO: 1245

SEQ ID NO: 5834 - RNA, 76 nt, Human; identical to SEQ ID NO: 5199

SEQ ID NO: 5835 - RNA, 82 nt, Human
ucuacaccugggaggcuugcgacgaugcuugcuggaggauagaaaaaguucccaaaguuugccggcugcaagugagugugga

SEQ ID NO: 5836 - RNA, 63 nt, Human
ggaagauugaauauuuaucuagagaauacaaagacccacauguaaaugauagguauuaucucc

SEQ ID NO: 5837 - RNA, 64 nt, Human
uauauguacccacuuagucauguaagugcauauacacauacacacacaugaguguagacaugug

SEQ ID NO: 5838 - RNA, 69 nt, Human
ugacccaaaucucuuccacaagacuuaaaaccaaauucagggacaaauggauagagaagaaaaggguca

SEQ ID NO: 5839 - RNA, 75 nt, Human; identical to SEQ ID NO: 4496

SEQ ID NO: 5840 - RNA, 88 nt, Human; identical to SEQ ID NO: 2733

SEQ ID NO: 5841 - RNA, 68 nt, Human; identical to SEQ ID NO: 2734

SEQ ID NO: 5842 - RNA, 75 nt, Human
uuuuucgaaugaaugacaacuuuauuuuucuuacacuuuuaaggcugaugaaaaaccuucauuucaauugaaaag

SEQ ID NO: 5843 - RNA, 88 nt, Human
ccagaagaaacugagaagcaugacggacaaguacaggcugcaccugucaguggccgaccuccucuuugucaucacgcuucccuucugg

SEQ ID NO: 5844 - RNA, 69 nt, Human
gccaucguccacgccaccaacagucagaggccaaggaagcuguuggcugaaaagguggucuauguuggc

SEQ ID NO: 5845 - RNA, 63 nt, Human
guugaugccguggcaaacugguacuuugggaacuuccuaugcaaggcaguccaugucaucuac

SEQ ID NO: 5846 - RNA, 77 nt, Human
aacuuuaaugauuauuuauucagacccuggaaaaccacacuauaaaauagggcacuggaucacaaguucguuugguu

SEQ ID NO: 5847 - RNA, 103 nt, Human
ucucacucuccuacuagacuuuucauugaaaaguuaggcaggaaaaaggaaaggaaucccaauuugcugccagcucugaugagagaucagguggggggagaga

SEQ ID NO: 5848 - RNA, 60 nt, Human
uuuuuuuuuuuuuuuuaaaaauagagccuaagggccuguauuuuaaugagaaaaaaaaaa

SEQ ID NO: 5849 - RNA, 65 nt, Human
cuggauugaagguaugagucaccacgccuggccacacacacuuuuaauaaugcuucauaaaccag

SEQ ID NO: 5850 - RNA, 84 nt, Human; identical to SEQ ID NO: 286

SEQ ID NO: 5851 - RNA, 89 nt, Human; identical to SEQ ID NO: 288

SEQ ID NO: 5852 - RNA, 66 nt, Human
gaaaaguuaaagcgaugccauuaguugaagaaacuucuuuacuggaagauucgucagugacuuuuc

SEQ ID NO: 5853 - RNA, 70 nt, Human
ggccgcgcucgggcgccccucgcgcagcgcuccaugcccguguggugcugccgcugcucccuggccgguc

SEQ ID NO: 5854 - RNA, 62 nt, Human
ugugguaauaauaggaaauggacccucaggaauaugccuuucuuauauguuaucaggcuaca

SEQ ID NO: 5855 - RNA, 64 nt, Human; identical to SEQ ID NO: 287

SEQ ID NO: 5856 - RNA, 89 nt, Human; identical to SEQ ID NO: 288

SEQ ID NO: 5857 - RNA, 102 nt, Human; identical to SEQ ID NO: 2172

SEQ ID NO: 5858 - RNA, 77 nt, Human; identical to SEQ ID NO: 3082

SEQ ID NO: 5859 - RNA, 80 nt, Human; identical to SEQ ID NO: 367

SEQ ID NO: 5860 - RNA, 79 nt, Human
ccggaaccugcucaucuggaucaagaagaauuugcuaaaagagcggccagaguuguucauccagggagacagcgugcgg

SEQ ID NO: 5861 - RNA, 72 nt, Human
cuucaucuccacucugcacggcggcugagggcccuucucugggccugggcacccuuagaggggagaacgaag

SEQ ID NO: 5862 - RNA, 60 nt, Human; identical to SEQ ID NO: 1720

SEQ ID NO: 5863 - RNA, 73 nt, Human
uucaguuauugugcuuguuucaaaaugcuuuaaaauuaguuccugcauuguauugagagacauaucaacugaa

SEQ ID NO: 5864 - RNA, 88 nt, Human
ggagaaucacuugaacccaggaggcagagguugcagugagcugagauggugccacugcacuacagccugggcaacagagugagacucc

SEQ ID NO: 5865 - RNA, 82 nt, Human
uuaguagugcauuuuauuuauucuaaguugcauacuuuuuacuuuuuaaacaucugugcaauugaauggaucucacaacuga

SEQ ID NO: 5866 - RNA, 88 nt, Human
accccgcccgggaaggcagccgcaccauggagucuuccaguucaucuaacucuuauuucuccguuggcccaaccagucccagcgcugu

SEQ ID NO: 5867 - RNA, 71 nt, Human; identical to SEQ ID NO: 1006

SEQ ID NO: 5868 - RNA, 64 nt, Human
uagaagagaggaggcaugucagugacuugaaauuugcaaugaaaugcuacacaccucuugucua

SEQ ID NO: 5869 - RNA, 67 nt, Human
gcuuccuucgucuaccacucugugccagcuccaacagaccuggcaacuaauaggacuagaaggaggc

SEQ ID NO: 5870 - RNA, 65 nt, Human
gugcaccauuugauaauacccuggaccaaguuggcuacaagucagggggugauaugugugugcac

SEQ ID NO: 5871 - RNA, 60 nt, Human
aaguggcccugauaaugcguugaaagcuaauucguuugcagccguguauuugggccaguu

SEQ ID NO: 5872 - RNA, 67 nt, Human
gcugagcucauaugcuaagacagagcuggggucucagacuccagaaaguagucgcagugaagccagc

SEQ ID NO: 5873 - RNA, 82 nt, Human; identical to SEQ ID NO: 5835

SEQ ID NO: 5874 - RNA, 68 nt, Human; identical to SEQ ID NO: 1986

SEQ ID NO: 5875 - RNA, 91 nt, Human
ccugcacagccaugcccgggcaagaacucaggacgcugaauggcucucagaugcuccugguguugcuggugcucucguggcugccgcaugg

SEQ ID NO: 5876 - RNA, 62 nt, Human
gcggcgucagcucagccuugcaagaccccaggcgcccgcgcugcaccugcgacugucgccgc

SEQ ID NO: 5877 - RNA, 81 nt, Human
ccgccucaaugauguuugcaaaggagcugaagcuggugucccgggcgcccagcgaaugaaccgauggucgacaugaagugg

SEQ ID NO: 5878 - RNA, 80 nt, Human
gcucagccuguaauucuggaauuucgggaggccgaggcaggaagauuccuugagcacaggaguuccagaccagccugggc

SEQ ID NO: 5879 - RNA, 73 nt, Human
ggggcgcgcccugcggcccccggagaaaggccuuuucagaaccccucuccgguguggggcgcccgcgggcccc

SEQ ID NO: 5880 - RNA, 72 nt, Human
cguggggaucagcguaggugagcuguggccuuuugcgaggugcugcagccauagcuacgugcguucgcuacg

SEQ ID NO: 5881 - RNA, 60 nt, Human
cuuggaggagucacccaggagucauuugaucuuaugauuaaagaaaauccauccucucag

SEQ ID NO: 5882 - RNA, 87 nt, Human; identical to SEQ ID NO: 76

SEQ ID NO: 5883 - RNA, 109 nt, Human
agaucggucaguuugaugcucgaugaaugcugggaauucagaggaaugucuucaccuuauacuuggauuugcucucuucccauuucugaucguguauagcuuucgauuu

SEQ ID NO: 5884 - RNA, 65 nt, Human
gcuuacaguaguuccccuuaucuucgggagauacauuccaaggcccccagugaacuccugaaagc

SEQ ID NO: 5885 - RNA, 63 nt, Human
gugucacacagcaaaaugacaauaaaaucuagggauccaaucagaugcagagaauguggauac

SEQ ID NO: 5886 - RNA, 90 nt, Human
guuggaagagaaaaugguacagcaguuacaagaggauguggacauggaagaugcuccuuaaaaaucucuguaaccauuucuuuuauguac

SEQ ID NO: 5887 - RNA, 86 nt, Human
gauauauuagaguauagacuacaaggagagcugcuaauauuaagauauauagacuucucugcaugauauuuacacucuauauaauc

SEQ ID NO: 5888 - RNA, 61 nt, Human
gguuuuucuaugagaugagaauuaugaacacuucauauagguaaauuccauagguugagcu

SEQ ID NO: 5889 - RNA, 63 nt, Human
acuuugggaaaauuauuuauuucuccccacgggguucagacaaguaauuucacauuucauugu

SEQ ID NO: 5890 - RNA, 77 nt, Human
guacagagauugcuuuuuaauggauuucuauaaguaguauuaauaggaaaaagcauauaauacaaucuacucuguau

SEQ ID NO: 5891 - RNA, 98 nt, Human
uguggugccugguggagaccuggccaagguacagagagcugugugcaugcugagcaacaccacagccauugcugaggccugggcucgccuggaccaca

SEQ ID NO: 5892 - RNA, 84 nt, Human
gccucucugcauggcugggggagucagggcagagcuuacuuuaaaaaagaauguucgauuugauacuuaaacuugaggagaggc

SEQ ID NO: 5893 - RNA, 60 nt, Human
uggccagucaaggguccacagggugccagccucucacccucagaauaaagacaucagcca

SEQ ID NO: 5894 - RNA, 78 nt, Human
ucauuguggcuuugguucaaaaggaaacacuacauuugcucacagaugauucuucugaaugcuccccgaacuacuuga

SEQ ID NO: 5895 - RNA, 70 nt, Human
ugggauguaguuuuuacccagguucuauccaaaucuaugugggcaugaguuggguuauaacuggauccua

SEQ ID NO: 5896 - RNA, 63 nt, Human
ugcgaggcucagacgaggaucacucgagcccacgcuuuagugaacacucugggcccccuagua

SEQ ID NO: 5897 - RNA, 63 nt, Human
ggccaaacagaaauucaagugaauuguccuccugcaguuacugagaauaaaacuguuacagcu

SEQ ID NO: 5898 - RNA, 61 nt, Human
gggaucccuaaauguaucugugauauuuggcuuucuaaauaugauacucuggggaggaacc

SEQ ID NO: 5899 - RNA, 71 nt, Human
aacuggugauuguuggugauggagccuguggaaacgacaugcuugcucauagucuucagcaaggaccaguu

SEQ ID NO: 5900 - RNA, 99 nt, Human
agauuuaacaauuuagcauggacauguacuuguagacaggauucaaagcaguuaagaaugucucugccaagucgacaaacagcuauuauuguuaacccu

SEQ ID NO: 5901 - RNA, 78 nt, Human
gacauuguucuuauggcacaagcucuagagaagcuguuuaugcagaaauuaucucagaugccacaagaagagcaaguc

SEQ ID NO: 5902 - RNA, 89 nt, Human
ucaacuucaguaucuacaaaaaguuguccuaaaggauuuauggaagcauaguuuuucauggcccuuucaacguccuguggaugcuguga

SEQ ID NO: 5903 - RNA, 67 nt, Human; identical to SEQ ID NO: 4715

SEQ ID NO: 5904 - RNA, 69 nt, Human
aaacaguaggaagagcuugcuuguuuuaacagaacauuuauuuguacacauuaagcucuuuagauguuu

SEQ ID NO: 5905 - RNA, 85 nt, Human
aacaaauaugggaaguaaauuugaaauuaagaaaaaugaauagaauuuauuacaugcuuugagguuggguauguuucccuuuguu

SEQ ID NO: 5906 - RNA, 86 nt, Human
guuuccgugauuuuuugaguuauuuuaaaacuuauuuuuuaaucaugguuuuaaaacuucucauacugaaaauuuuuauuagaaac

SEQ ID NO: 5907 - RNA, 75 nt, Human; identical to SEQ ID NO: 74

SEQ ID NO: 5908 - RNA, 87 nt, Human; identical to SEQ ID NO: 76

SEQ ID NO: 5909 - RNA, 117 nt, Human
ugaggagcuguugggucguguaguugaugcccuugguaaugcuauugauggaaaggguccaauugguuccaagacgcguaggcgaguuggucugaaagcccccgguaucauuccucg

SEQ ID NO: 5910 - RNA, 74 nt, Human; identical to SEQ ID NO: 365

SEQ ID NO: 5911 - RNA, 77 nt, Human; identical to SEQ ID NO: 3082

SEQ ID NO: 5912 - RNA, 80 nt, Human
cuauuucucuauguuuauucuaguuaaggaaauguugagggcaagccaccaaauuaccuaggcugagguuagagagaugg

SEQ ID NO: 5913 - RNA, 68 nt, Human
ggacuuagaaguaguauguuauuccugguuaagcaggcaugcuugcccuggagcagcuauuuuaagcc

SEQ ID NO: 5914 - RNA, 68 nt, Human
gcucaaccucuuuguucaguauguguaaccuugaagcuaauugguacuacuggauaucugacuggagc

SEQ ID NO: 5915 - RNA, 68 nt, Human
uccguggcugcucauucuugccuacuuuacucucccacugaagcagguuagcgugaaggugguaugga

SEQ ID NO: 5916 - RNA, 97 nt, Human
auauaaaccugguugcuagcauucugugaaaucagugaagagacuggaguucucucagugcacacacugauuuuucacuuagucccuagguuucugu

SEQ ID NO: 5917 - RNA, 61 nt, Human
gucggggcugcuugcuaacuccaggaacagguuuaaguuuuugaaacugaaguaggccuac

SEQ ID NO: 5918 - RNA, 79 nt, Human
gugcacaaccaaaaaauggagggaaacugaagcaagaauucgaauuaagagacuuuuuccauucccucacgguuugcac

SEQ ID NO: 5919 - RNA, 104 nt, Human
ggcaucaucacugcuaucaucauuaacagcguaaauuauacaagcauauuuaaugcugaguuuaauuuaauauguaauacauaugguaaugguaggguaauacc

SEQ ID NO: 5920 - RNA, 70 nt, Human
guauaucuaauaaguguuuuucauauuauuuccacguaagggaaauaagguaguacuuuucuuuuuauau

SEQ ID NO: 5921 - RNA, 91 nt, Human
gaaagauauauucgaauuguaaagaugcuuuuucucaugcauugaaauuauacauuauuuguagggaauugcaugcuuuuuuuuuuuuuuc

SEQ ID NO: 5922 - RNA, 73 nt, Human
gggacuacgggugugcacuccucgccuggcuaauuucaauuuuugguacaggcaggaucuugccaccuugccc

SEQ ID NO: 5923 - RNA, 100 nt, Human
uugcucgggcgcccaggcuggagucacaggggcaugaucugggcucacuucagccuugacuggggcccaagugauccuccuaccugagccuucugaguaa

SEQ ID NO: 5924 - RNA, 76 nt, Human; identical to SEQ ID NO: 758

SEQ ID NO: 5925 - RNA, 71 nt, Human; identical to SEQ ID NO: 1764

SEQ ID NO: 5926 - RNA, 64 nt, Human
ggcuagguacgaggcuggguugugcagcucugugcugccagucggugccccucccgcuccagcc

SEQ ID NO: 5927 - RNA, 69 nt, Human
gaaguugagaaaugugacagaggcauuuagaguauggacuuuucuuuucuuuuucuuuuucuuuuuuuc

SEQ ID NO: 5928 - RNA, 103 nt, Human
gggcagaauacucuaaaaacuugauaaaaugaaauauagauuuaauuuaugaaccuuccaucaugauguuguguaugcuucuuuuggauccucauucucaccc

SEQ ID NO: 5929 - RNA, 89 nt, Human; identical to SEQ ID NO: 1509

SEQ ID NO: 5930 - RNA, 66 nt, Human
ucgcccgugugcagagcggacaaggcaaaaucucagcaaguucggaccucuaguacaauaaggcga

SEQ ID NO: 5931 - RNA, 78 nt, Human
cagggacaggccagcugauauuggccauuggcacaggaucuugucugucugggaaagauaucggugagacuguuucug

SEQ ID NO: 5932 - RNA, 90 nt, Human
ccuggcauggacagaagccaggggacacauccacccagugaacuggacuguggccaugaacccaggguaucagguccaaacucugccagg

SEQ ID NO: 5933 - RNA, 69 nt, Human
cuggagaucucugguuccccggggagucugagagcuucgaggaugcccauguggagcacagaucuccag

SEQ ID NO: 5934 - RNA, 69 nt, Human
gguggcauggagccucuccgggugcucaucuuacucuugucacagagucuguccggagcccacaacacc

SEQ ID NO: 5935 - RNA, 79 nt, Human
uggcgggccagucccugcaggugucuugccccuaugacuccaugaagcacugggggaggcgcaaggccuggugccgcca

SEQ ID NO: 5936 - RNA, 67 nt, Human
acaggugguugcuuugaacuuuauuugagaaaaacagaagauaaauguaucaaaagaacacacaggu

SEQ ID NO: 5937 - RNA, 64 nt, Human
caggggugggcauccgggcuaaggcuuuacuuggcggcagucucaucggauuuugcagcuucug

SEQ ID NO: 5938 - RNA, 69 nt, Human; identical to SEQ ID NO: 1724

SEQ ID NO: 5939 - RNA, 64 nt, Human
cgccauccuuggucuugaccgucagcucguccggggcgaagugguugacauccagggacacgcg

SEQ ID NO: 5940 - RNA, 63 nt, Human
ugaugguguuggugucgcgugcuguggagcauccgagugugccagagucuccagaauccguca

SEQ ID NO: 5941 - RNA, 66 nt, Human
uuuuccuuauccaauguacucacgggauuauguuuauguucggcgguauaguguggaucaggaaaa

SEQ ID NO: 5942 - RNA, 60 nt, Human
caggaggcgucaucccguguggcgggacuagguggggugaucagauaggccguccuccug

SEQ ID NO: 5943 - RNA, 62 nt, Human
agguuacaacuagaggcuuguggaaugagacguaaaaagucuauuaacaagaaagguaaucu

SEQ ID NO: 5944 - RNA, 70 nt, Human
gaugaaccagcuucgaggcaagaaguccugcgcacacgggucguaggcagguccgcugggcuggaacauc

SEQ ID NO: 5945 - RNA, 81 nt, Human
gcucagcgccgcacccggaagaugaggcucgccgugggagcccugacuggucugcgccgucaacuggggcugggucugggc

SEQ ID NO: 5946 - RNA, 73 nt, Human
ggcagcugugccccuugugcggaugggacggacuucccccagcugugucaacuguguccaggguguggcuguc

SEQ ID NO: 5947 - RNA, 66 nt, Human
cauuuauuaauacagcgaaagaaauuuaugaaaaaauucaagaaggagucuuugacauuaauaaug

SEQ ID NO: 5948 - RNA, 62 nt, Human
ggcgacacagguguugguaaaucaugcuuauugcuacaguuuacagacaagagguuucagcc

SEQ ID NO: 5949 - RNA, 71 nt, Human
cggaguugagaaacugcaaggaacacaaaagacucaaacaacagaguucgagggucuacuugcuaacucug

SEQ ID NO: 5950 - RNA, 69 nt, Human
cguuccagugcauuaugaugagcccguuugucagccuagaagaaugggagaaagaacacauuaggaaug

SEQ ID NO: 5951 - RNA, 78 nt, Human
gaaucgcuccugcagcagagccaacaugcccaucacucggaugcgcaugagacccuggcuagagaugcagauuaauuc

SEQ ID NO: 5952 - RNA, 73 nt, Human
cacucaguucugacucuagagaccagagaggugacguaagacuucuuccuuaagaaucugggacuaccaagug

SEQ ID NO: 5953 - RNA, 61 nt, Human
ccuggcacagaaucugggaauuuguauuucuggcgaguuuccaauugaugcugaugcuggg

SEQ ID NO: 5954 - RNA, 84 nt, Human
ggcagcuuuaauaugagaagauauuuacacuuuuaccuucgcugauugaaaauacccuuagcuuauauauucuuucaagcugcu

SEQ ID NO: 5955 - RNA, 90 nt, Human; identical to SEQ ID NO: 1285

SEQ ID NO: 5956 - RNA, 63 nt, Human
gugguggccgauacggggcgaguuccacgccaucgacgaguacaagccccaggaugcuaccac

SEQ ID NO: 5957 - RNA, 73 nt, Human
ucauggcagugauucaguaaacaagugcugaaaaagaaaucagccuaugguuuaagccugaagaacugguuga

SEQ ID NO: 5958 - RNA, 70 nt, Human
ggcaaggaaagcuccaaauccaugacagucgaagucucugcuccuucaggaauaggacgucuuccucucc

SEQ ID NO: 5959 - RNA, 63 nt, Human
ggcguggugggcguggcccccacuggcaucccagcugcuguggaagguaucguccccagcgcc

SEQ ID NO: 5960 - RNA, 73 nt, Human
gcucgguccuggcggcuguuauggccgcgccaccgggcgugggccuugggguggcccuccguuggggccgggc

SEQ ID NO: 5961 - RNA, 65 nt, Human
uuuugggggcucuggguguggcgguugccguagcugaaauggcugcaccaugucggccuucgaga

SEQ ID NO: 5962 - RNA, 72 nt, Human
agucccggagauccgugauguaacaaggauugagcgaaucggugcccacucccacauccggggacuggggcu

SEQ ID NO: 5963 - RNA, 92 nt, Human
uguacuucaggacccgaagacccggacucucuggcaagggacuggggccaagcccaguaagaggucugaccggcgaaagucuugaggguaca

SEQ ID NO: 5964 - RNA, 71 nt, Human
auccgguguacauacaacccacauauugggggcuaccaaugccccuuuggggguugguacaagcagcggau

SEQ ID NO: 5965 - RNA, 63 nt, Human
guaggauuagaucauuagcucagugaccuccuaggguuucgaugugcuauguucucauccuac

SEQ ID NO: 5966 - RNA, 101 nt, Human
augcucuuccggcagcugcaucaggagcugcccucucaugggguacccuugauaaaccaucucuagagaggacaucccugcugggcugcugugcagaguau

SEQ ID NO: 5967 - RNA, 62 nt, Human
ggucagcaucuauggaacccaccacaaccccacaguguggccugacuccaagguguacaacc

SEQ ID NO: 5968 - RNA, 71 nt, Human
cugcggcuccgggcugguggccacgcgaggguguccgcccucuucgaccugccuggauuuuugugcugcag

SEQ ID NO: 5969 - RNA, 70 nt, Human
ugugaaccaauacauugaaaguugguguugucauguaagugacugcuguagcuuuucugagugccucaca

SEQ ID NO: 5970 - RNA, 105 nt, Human; identical to SEQ ID NO: 979

SEQ ID NO: 5971 - RNA, 62 nt, Human
cuugguucuacagccauugggauccagacaucagagggugugugccuagcuguggagaagag

SEQ ID NO: 5972 - RNA, 62 nt, Human
ggugccaugucucgucccuuuggaguagcauuauuauuuggaggaguugaugagaaaggacc

SEQ ID NO: 5973 - RNA, 81 nt, Human
cggacacaucacagguauugacugggcucccaagagcgaccgcauugucacuuguggggcagaccgcaaugccuaugucug

SEQ ID NO: 5974 - RNA, 68 nt, Human
caguucgugguguuggcgggccugaggaguaugaacggugccuuagcguuuguggacacuucggacug

SEQ ID NO: 5975 - RNA, 64 nt, Human
cggauaucugugucuuucuaccacgucaaaaacaacgggaagauugaacucaucaagauguucg

SEQ ID NO: 5976 - RNA, 68 nt, Human
ggagugaccuggagcacugugggggacgggacuccgccugcuguucccgcgcugagcuacaggacucc

SEQ ID NO: 5977 - RNA, 92 nt, Human
caccaucuacuagggcauuauuaugcgagaauuuucgauaacaagguguugaccacgauuauaucuuaauauucuugccuuuccccguggug

SEQ ID NO: 5978 - RNA, 74 nt, Human
ggggaccaggggaagggggaggaggggaagugaggccccagccccacuaccccuccccgcccaccccuuucccc

SEQ ID NO: 5979 - RNA, 78 nt, Human
caugugucaugggaggaauguagugggaaguaauugaaucaugggggcaguuaccccaaugcuauucucgugauagug

SEQ ID NO: 5980 - RNA, 60 nt, Human
ccuccaagcgcaaauuccgcaccaaggucauggacuuggugcacgacuggcgaagggggg

SEQ ID NO: 5981 - RNA, 90 nt, Human
gcccccuuguuuuuugugggccuguucaccauaggccagaauugggcccacccaaauggccucauggguggccggguuaggaaaaggggc

SEQ ID NO: 5982 - RNA, 65 nt, Human; identical to SEQ ID NO: 5179

SEQ ID NO: 5983 - RNA, 62 nt, Human
ggggcguaagggcuggguuuggccauacaagguuggcuacgcccucaaucccugaccguucc

SEQ ID NO: 5984 - RNA, 97 nt, Human
ucccacugcuucuaaaggaaguccugggcaggagguggcuuuggugguugguuccaaaguugaaaaugcuugcaguuugaccuuagaagaaguggga

SEQ ID NO: 5985 - RNA, 115 nt, Human
ugauggccccaacagguucugggcuucaguggagcccuacugugcugacaucaccagcgaggagguccgcacacuugaggaguuacugaagcccccaagaagaugaggcugagca

SEQ ID NO: 5986 - RNA, 69 nt, Human
uggaagggaaggcaggacaugggccgggcccuggcccaggacggcccaaauccaaaaaccuucagccca

SEQ ID NO: 5987 - RNA, 65 nt, Human
cuccccgaaaagaagaccgcagugccagcagcggggcugagggcgacguguccucugaacgggag

SEQ ID NO: 5988 - RNA, 81 nt, Human
cuggagcagcugcguaaaacauacaggccggagcuuaucaaagauggcaaguuuggggccuacaugcaggugcacauucag

SEQ ID NO: 5989 - RNA, 62 nt, Human
cccuggaagagggacuccaaugggcauugccccuccggggaaugcggacuccucccccuggg

SEQ ID NO: 5990 - RNA, 61 nt, Human; identical to SEQ ID NO: 1238

SEQ ID NO: 5991 - RNA, 83 nt, Human; identical to SEQ ID NO: 3404

SEQ ID NO: 5992 - RNA, 109 nt, Human
ggugaugaccccacaaggaagagguacuguugcagccgcugcagcugcugccacagccaguauugccggggcuccaacccaguacccaccuggccguggggguccuccc

SEQ ID NO: 5993 - RNA, 96 nt, Human
ccggcggagagcgaccucgggguuaagggguggggcugacgucaggagccaagauggcggcgguggucgcacucuccuugaggcgccgguugccgg

SEQ ID NO: 5994 - RNA, 76 nt, Human
gcagcaguaucugcaguccauagaagagcgugagaaacuggacgggcucuacgagugcauucucugugccugcugu

SEQ ID NO: 5995 - RNA, 76 nt, Human
cuuaggagaucggagagccaagacugugacacccuuucuggggcucugugguuccuggcgucuccaagcuucuggg

SEQ ID NO: 5996 - RNA, 68 nt, Human
uccggaaaagugaguuuuaaacaaguagauuaugcuaaucuuaucagaaaaaaacgacaugguccggg

SEQ ID NO: 5997 - RNA, 88 nt, Human
gcgaaucagggacccucgggcgcguucggacugucgagggcguguccaaacccgaaacacgcgaccaggucgaggcgagacuguucgc

SEQ ID NO: 5998 - RNA, 72 nt, Human
ccagcuucccuacuccuacccuggcccuuuuauacuaggacuccuuaggaggagugagacaggugauaaugg

SEQ ID NO: 5999 - RNA, 79 nt, Human
uccuuaacagaugaacuauccacagaaggaagagggauccgucucuuaaguaauugguuaguuaacacugaauuuugga

SEQ ID NO: 6000 - RNA, 77 nt, Human
ugaccccaacccauccugccagggcagggccuaucuuccugccucuggaagacuuguugcagguggguaguggguca

SEQ ID NO: 6001 - RNA, 68 nt, Human
aaccuggggacgcauagccaaggggaagcgcgacucacaacggcgcgacuucuugaguucuccagguu

SEQ ID NO: 6002 - RNA, 93 nt, Human
aguggcagguaccgcaguuugugcugaaugauauguaugggguaaaucaguuuuuuucuuauagaauuucggcguuuugcugcaacugccacu

SEQ ID NO: 6003 - RNA, 124 nt, Human
gguauuaagccauuuggaaauugccacuuuuuucuggguaaccuguuuuagguucagcucuaccgccauuuagacacacgacgguaccuuuauagaaguaacaccaauauccuaggugguugcc

SEQ ID NO: 6004 - RNA, 89 nt, Human; identical to SEQ ID NO: 3914

SEQ ID NO: 6005 - RNA, 86 nt, Human
gagacccccacggacaugcccaugaacuugcccucgugccgaauucggcacgaggcugcgaaccacgugggucccgggcgcguuuc

SEQ ID NO: 6006 - RNA, 73 nt, Human
ggcuucguguggaauaucacugucgcugaguacccagucuuggcacaguugaugcugacuuuuccuccgagcu

SEQ ID NO: 6007 - RNA, 72 nt, Human; identical to SEQ ID NO: 3442

SEQ ID NO: 6008 - RNA, 117 nt, Human; identical to SEQ ID NO: 3443

SEQ ID NO: 6009 - RNA, 70 nt, Human
ggucguaugggcgccggucaccaggcugcuuuuaacucugguaaaguggauauuguugccaucaaugacc

SEQ ID NO: 6010 - RNA, 65 nt, Human
uuccacccauggcaaauuccauggcaccgucaaggcugagaacgggaagcuugucaucaauggaa

SEQ ID NO: 6011 - RNA, 106 nt, Human
cuuccuccucgggacucuacucaaggccgaccggcggaauagauuuugguaccauauagccgcucggaaaaaaaaccggcucuggggggaagggggaggcgggaag

SEQ ID NO: 6012 - RNA, 76 nt, Human
ggcuggguggcugcaucggaggcguucagcugcuucaagaugaagcugaacaucuccuucccagccacuggcugcc

SEQ ID NO: 6013 - RNA, 65 nt, Human
ccucacaaaagcaagccccagcccagcccccgcugagggaagggcugucaacaaugagccugagg

SEQ ID NO: 6014 - RNA, 66 nt, Human
gcgagugccggguggugcacggcgaaaugagacuguucgugagugcuggcgucccggguugcuugc

SEQ ID NO: 6015 - RNA, 64 nt, Human
ucugccgauauuuuuuuuuguuaucuggcugggagcaagaugaccucacuaaccaguggcugga

SEQ ID NO: 6016 - RNA, 70 nt, Human
ggucaccagauggaggcauggucuucccuugaauucaauuugaguggaaucucuaagugcuuugaugacc

SEQ ID NO: 6017 - RNA, 66 nt, Human
agacaaugacuuuuguaaggauugguacuaucuaucuaucauuccuuauugacauguacauugucu

SEQ ID NO: 6018 - RNA, 65 nt, Human
gaaagcuuuuuuuuaacaggaaaagauaccaaugccugcugguaccaccuuuucaauuggcuauc

SEQ ID NO: 6019 - RNA, 78 nt, Human
uugaaguggcuugaaaaaggcaagauugacuuuuaugacauuggauaaaaucuacaaaucagcccucgaguuauucaa

SEQ ID NO: 6020 - RNA, 99 nt, Human
ccuuuggagaaagccaauggucgagcagauccagugaguucccacggccuuggagcuugcuggccgcgucaaaucaacgaccaaaggacaagacggagg

SEQ ID NO: 6021 - RNA, 79 nt, Human; identical to SEQ ID NO: 3720

SEQ ID NO: 6022 - RNA, 63 nt, Human
gguugcugugucuagggugaaguaggcaaaacguugccuuaaacugggccugaagacgguucc

SEQ ID NO: 6023 - RNA, 71 nt, Human
ugcugcuucuuggcuggcuugcuuuggcagucacugccacuggccuugccuuuggcacauggaagcaugca

SEQ ID NO: 6024 - RNA, 79 nt, Human
gcuggaacugaagcuggggcugcagccugggccuugguuugauccuuggccuuggccuuggccuuggccuuuggccggc

SEQ ID NO: 6025 - RNA, 79 nt, Human
gggcuuuacgagggccuugauagccucggcacgugcacucauggccuuggcauuguuggccugcaucuucuuuaggccc

SEQ ID NO: 6026 - RNA, 100 nt, Human
cagcaaagauugccuuguccccaagagccuccucgauccucaugaguugguuguauuuggccagacgcuccgagcggcagggggcgccagucuugaucug

SEQ ID NO: 6027 - RNA, 97 nt, Human
ggccuucuucucaacggacugugcaauccucuugggguuggugacugucaagucaucccccacaaucuggauguucacccccgagaggaaggagguc

SEQ ID NO: 6028 - RNA, 69 nt, Human
guguccucagucuccccagagcgguggcucaccaucaccccccagccauuagacugagccaguuugcac

SEQ ID NO: 6029 - RNA, 83 nt, Human
caucauggauucaucccuuacccgccggggacagaucugcugguaucagaagccgggcguggguuuggaugccaucaaugaug

SEQ ID NO: 6030 - RNA, 87 nt, Human
gccaaggaaacaggaugcugauagucuccagcgggccuggacugugggcugguguguggaacugcugcaagcuuucuuccugguggc

SEQ ID NO: 6031 - RNA, 62 nt, Human
gcccuauuaccugaaccugaucgagcucuuccugcagaguuccuaucagacugagauugggc

SEQ ID NO: 6032 - RNA, 60 nt, Human
guuuaacuuuauuuuaagcuucuauuacauuguaauuaauaauaauauacuaaguuaagc

SEQ ID NO: 6033 - RNA, 70 nt, Human
cagcaccgaggcgcugugccucgccaucucuaggaacuccgagcagauggccagccacagcgcagugcug

SEQ ID NO: 6034 - RNA, 82 nt, Human
gcagccagucacggcgucaggugucggcccgucgguagcugcugcagacaugcgggucgcccauacccgugacagugguugc

SEQ ID NO: 6035 - RNA, 67 nt, Human; identical to SEQ ID NO: 1806

SEQ ID NO: 6036 - RNA, 62 nt, Human
gggagaagcugugguacgucgccuggauuucgagcaggggauggcccccgccgaauucuccu

SEQ ID NO: 6037 - RNA, 63 nt, Human
uguggauauugauuacuuuuaaauggauuagcaaguuuauuucaguauuucugauugucuaua

SEQ ID NO: 6038 - RNA, 76 nt, Human; identical to SEQ ID NO: 758

SEQ ID NO: 6039 - RNA, 71 nt, Human; identical to SEQ ID NO: 1764

SEQ ID NO: 6040 - RNA, 72 nt, Human
ggggcccugugccuuccugaagugcuggcagaccagaggcaccuccuucaggaccuuagagagguauucccc

SEQ ID NO: 6041 - RNA, 97 nt, Human
guacugccugcccggggcuuaggaggguggcaccggugcugggacacacgggacuguguccucgccaacccccgaccugcccccugccagccagugc

SEQ ID NO: 6042 - RNA, 88 nt, Human
guccuggacauaucggaguaggggguggucagacaucacaggagcugucaacuccugcggaaugggccaacucacucgguggcaggac

SEQ ID NO: 6043 - RNA, 70 nt, Human
ucuccccgcaguccuacccagccuuuuaaccugcuaaaggagaggcugugguuuuagcaccuuggggaga

SEQ ID NO: 6044 - RNA, 68 nt, Human
uguuucaugacugguaacagaguagucucgaggggauccuuggagaaccuguucugacuuuagaagca

SEQ ID NO: 6045 - RNA, 64 nt, Human
gaagaagaauuggccaucuuaaaaagcggguaaaaaaccuggguuaggguguguguucaccuuc

SEQ ID NO: 6046 - RNA, 67 nt, Human
agcgcaggcccacuucccccaguucuccuacucggcagggaggccugaggcggggguggacugcgcu

SEQ ID NO: 6047 - RNA, 66 nt, Human
uucgggcugugcaaggaggggaucaaggacggugccaccaugaagaccuuuugcggcacaccugag

SEQ ID NO: 6048 - RNA, 69 nt, Human
cgugaaaaagggcgguuucugcgcucccuuggcucggaugcgcgcgggguuggcugccuauuuuucucg

SEQ ID NO: 6049 - RNA, 63 nt, Human
auaauucugucucauacuuuggcguuguaauuggugaccuuuguauuggugacgcaaaauugu

SEQ ID NO: 6050 - RNA, 74 nt, Human
gucgccuguugaguagacauggugggcuuuuuacaacggggugaaugaauccaugucuuaaccagcagguguac

SEQ ID NO: 6051 - RNA, 66 nt, Human
guguguacacggguccuuuuuugcaaugaaauacaugguuaugacuugaauccaaaguguauacac

SEQ ID NO: 6052 - RNA, 62 nt, Human
aaaaagguccugguucacccuggagagucaccuuuccugggccaccggauuugggccuuuuu

SEQ ID NO: 6053 - RNA, 60 nt, Human
ccguggagagugacgagacuaggcggcucucuugccuggcuccuggcacuugacuccagg

SEQ ID NO: 6054 - RNA, 67 nt, Human
gacagaagaugguccagaagcuggcccuguacgaggauggggcccuggacagucugcagcugcuguc

SEQ ID NO: 6055 - RNA, 63 nt, Human
gguguggggugugggguguuccccggcaucagcacagcuaugaacauugaacaaccucucacc

SEQ ID NO: 6056 - RNA, 78 nt, Human
aaggguuugccacuuaaccuucgacacgggagggaaaauaaagaauucccuuucacuaagaacacacggcaaacuguu

SEQ ID NO: 6057 - RNA, 78 nt, Human
acgcauccuacaagcaauaguuauggggaucugauggugcaacaaagauccaauaucuacugaucuucgauggagugu

SEQ ID NO: 6058 - RNA, 83 nt, Human
ggagaaauuguugggggcuucagggguccaccacgaugaccuuuauaaacucccggguuucccccugaucccgcaaccuuucc

SEQ ID NO: 6059 - RNA, 61 nt, Human
aguuuguccucuccuuuuauccaagcaggaagauucuauauccugaugguagagacagacu

SEQ ID NO: 6060 - RNA, 68 nt, Human
gcccugggacuugcuagcccaaagaaggaggaugugguuaaucuguuucaccugguuuguccuaaggc

SEQ ID NO: 6061 - RNA, 64 nt, Human
gcagauguggauuagcaagcaggaguacgacgagucgggccccuccaucguccaccgcaaaugc

SEQ ID NO: 6062 - RNA, 80 nt, Human
ggugcugucgggcggcaccaccauguauccgggcauugccgacagaugcagaaggagaucaccgcccugggcccagcacc

SEQ ID NO: 6063 - RNA, 87 nt, Human; identical to SEQ ID NO: 2862

SEQ ID NO: 6064 - RNA, 66 nt, Human
uucaaauauuuccauuuuuuaaaccucuagaauauuauccggacauuuaaaauauugauauuugag

SEQ ID NO: 6065 - RNA, 62 nt, Human
ccggcggauucuuggaggaacccccucggggggccucaugggacccuccgaaauaacgccgg

SEQ ID NO: 6066 - RNA, 79 nt, Human
gaaguuggagcaggggugggcggaggucaccuaaccaaucaauggaaggcaacucacaccugcuccaagccucagcuuu

SEQ ID NO: 6067 - RNA, 84 nt, Human
gccaccaggccaaccugcauauaagaucgaaguaaguuaaauacucaccuaacuaauacgagagguaaucagauggucuagggc

SEQ ID NO: 6068 - RNA, 79 nt, Human; identical to SEQ ID NO: 1810

SEQ ID NO: 6069 - RNA, 60 nt, Human
aggcccuauuggacaaauuugguggggagcauaauccaccaucaauauaucuggaggccu

SEQ ID NO: 6070 - RNA, 65 nt, Human
uuguuguuuuguuuaucuuucucuuucaguuuuagaucgcuaaggcauuuuagauaaggcaacag

SEQ ID NO: 6071 - RNA, 60 nt, Human; identical to SEQ ID NO: 1551

SEQ ID NO: 6072 - RNA, 74 nt, Human
gcugccgaggcucggggcgcgcgcaguuggcgucugccagugccaagacugugccgcccccacagccgaggcgc

SEQ ID NO: 6073 - RNA, 61 nt, Human
guauauuagccaagcuacaggaagcaguagaagcuaaucuuggaaccgcuaugaccuauac

SEQ ID NO: 6074 - RNA, 73 nt, Human
guccaguuucuuuucaauauaggauaggugaaaauggugaucccaaagccuucuuaauagagauuuccuggac

SEQ ID NO: 6075 - RNA, 79 nt, Human; identical to SEQ ID NO: 1810

SEQ ID NO: 6076 - RNA, 60 nt, Human; identical to SEQ ID NO: 1551

SEQ ID NO: 6077 - RNA, 66 nt, Human; identical to SEQ ID NO: 3532

SEQ ID NO: 6078 - RNA, 60 nt, Human; identical to SEQ ID NO: 1551

SEQ ID NO: 6079 - RNA, 60 nt, Human; identical to SEQ ID NO: 1551

SEQ ID NO: 6080 - RNA, 67 nt, Human
ccgcugugccgggucccagccccaagccagagcagcauggguggcccgggacaccagacaagugcgg

SEQ ID NO: 6081 - RNA, 98 nt, Human
ccaccauggugcggccgguggccgagagcggggccaccaagaccagccgcgucuacggcuucaucggccucugcuggcugcuggccgcgcugcugggg

SEQ ID NO: 6082 - RNA, 66 nt, Human; identical to SEQ ID NO: 4602

SEQ ID NO: 6083 - RNA, 69 nt, Human; identical to SEQ ID NO: 4603

SEQ ID NO: 6084 - RNA, 67 nt, Human
gucgggggcccgcaccuuccgucuggcgcccugcccagugguuccuacgggagggccugcucuucac

SEQ ID NO: 6085 - RNA, 89 nt, Human
gagcuccgguagcccgccgcuggaggagcuguucgcccggggcgggcccuugcggaccuuccucgagcgccaggcggggucugaagccc

SEQ ID NO: 6086 - RNA, 68 nt, Human
gaugaaaaugauuugauccuggaaguaacugcaggaguuggaggucaggaggcaauguuguuuacauc

SEQ ID NO: 6087 - RNA, 64 nt, Human
gcugccgguggcucuggccccgccgggccguuggcccagcccgccggcccugagcuccgguagc

SEQ ID NO: 6088 - RNA, 88 nt, Human
cuguaacuaaugauggggccaccaucuuaagcaugauggauguugaucaucagaugccaagcugaugguggaacuguccaagucucag

SEQ ID NO: 6089 - RNA, 65 nt, Human
cccuaaauaccccagcgggcuccgggggguuaccaaccccaguaaaacccgcggggugaaccggg

SEQ ID NO: 6090 - RNA, 73 nt, Human
augaguaguagcccuuuugaaaaugauagaccaaccuuauuucucugacagccaacaggguuaugauacuuau

SEQ ID NO: 6091 - RNA, 80 nt, Human
ggcggcgcccccuccggagggacuggggcgccgaacucacccccagggggggggccggaacguccccgggggggcccgcc

SEQ ID NO: 6092 - RNA, 66 nt, Human
aacggauugcggccuuuuugugucacgcucucgacgcugcguggcgaaaaaagaugccacuccguu

SEQ ID NO: 6093 - RNA, 104 nt, Human
cggugaggguggcuuucuccggcuuccuuagaaggcuugccgaggcagaucagacccaguuggcgaugcugucggggaugcugcugggaaaguguacccugccg

SEQ ID NO: 6094 - RNA, 101 nt, Human
ugauuaucgucgucuaugcagacacacucuucugauauccugguggcguaggcaugguaugcuugcgcccguggaggaacgcugcauagaugauggugacg

SEQ ID NO: 6095 - RNA, 62 nt, Human
gggauugacgaguaagguauaaaggaguuuggggucacaggaaucuuuaauuuaucaacacc

SEQ ID NO: 6096 - RNA, 63 nt, Human
ggguccgucuucuuccugcugcugccgggaccuucugcggccgaugagaagaagaaggggccc

SEQ ID NO: 6097 - RNA, 72 nt, Human
ugaagcacuacgggccuggcugggugagcauggccaacgcaggcaaagacaccaacgggucccaguucuuca

SEQ ID NO: 6098 - RNA, 61 nt, Human
gagggcccaggauuuuggauccccagcccugugacaaggguuccuguccaguuucccccuc

SEQ ID NO: 6099 - RNA, 83 nt, Human
gccaguacaacccggucaaacagcagcuagugcguuacgcccaccagcuguuacagcuguugucggacuggcucggugcuggu

SEQ ID NO: 6100 - RNA, 131 nt, Human
ggcuuagagcacagccccgaggcgccgucuaccaggccccguccccucccccggcuccugucggccugggcagcauggccguauuccggucgggucuccuggugcugacgacgccgcuggccucccuagcc

SEQ ID NO: 6101 - RNA, 69 nt, Human
cuccagagcuccuauagggcaagacacuguuucucauauauuucuggauccuuggagcuuagcucggag

SEQ ID NO: 6102 - RNA, 80 nt, Human
auacucuggucauuuuucaagccauguuuuauuguaucuguuuucuacuuuaugugagcaagguuugcuguccaaggugu

SEQ ID NO: 6103 - RNA, 60 nt, Human; identical to SEQ ID NO: 1551

SEQ ID NO: 6104 - RNA, 67 nt, Human
gcucuucgugauaaugagacuuccuggguacaaaccgggauugaauccuuaugaacggaguuaaagc

SEQ ID NO: 6105 - RNA, 63 nt, Human
ugggacaagagccacagguauuggaagaagucuucaagaaaauauugccuauggccugaccca

SEQ ID NO: 6106 - RNA, 71 nt, Human
ggccaucugaucuaucaaaugcgguggcaucgacagaagagaagcccauugaaaaauuugagaaggaggcu

SEQ ID NO: 6107 - RNA, 64 nt, Human
caugggcggugaaacccgagugaaugggccgggaacggcuuuuggcaagugggaauggccgaug

SEQ ID NO: 6108 - RNA, 60 nt, Human
gcuacacagagagaaaacccacggcggcaaaaaugagggguagagagagaaagguggagc

SEQ ID NO: 6109 - RNA, 63 nt, Human
ucccagcacuuuguggagugccugaugugcaagcgcgggacuccacgggaagggcuccaggga

SEQ ID NO: 6110 - RNA, 73 nt, Human
ggaaggucacgugcgacaaaaguucuggaggccuuuugaaaggcacaccgagcaugugguucgcaccacuucu

SEQ ID NO: 6111 - RNA, 61 nt, Human
augaagucauauugugaugguaggcaaaguugguucacuucaucagaagaugacuauucau

SEQ ID NO: 6112 - RNA, 60 nt, Human
gugguguuguuuugguccugauaagaagcugaagcugucuauccucuacccagcuaccac

SEQ ID NO: 6113 - RNA, 66 nt, Human
aggcaaaagagaaauccucagacacauucugaaggauccggacauggucugggacuucuggagccu

SEQ ID NO: 6114 - RNA, 77 nt, Human
gaagaugguaacugggaucucguuggaaauaacacccccauuuucuucaucagggaucccauauuguuuccaucuuu

SEQ ID NO: 6115 - RNA, 67 nt, Human
gcggaacgggcagauuugccugcugaggguggagacccacgagccgaggccuccugcaguguucugc

SEQ ID NO: 6116 - RNA, 86 nt, Human
gcgggcucucucacgccgcggccucacccggcggugcuucggcaggcggccggcgcggggcgcaggcggcgcggccaugggcucgc

SEQ ID NO: 6117 - RNA, 68 nt, Human
ggcacggcauggagaagaucuggaggcccaaccgaguguucagccugcaggaccucugcugccgggcc

SEQ ID NO: 6118 - RNA, 97 nt, Human
ggggauccucuugguguaugacaucaccaaccgcugguccuuugacggcaucgaccgcuggaucaaggagaucgaugagcaugcacccggagucccc

SEQ ID NO: 6119 - RNA, 73 nt, Human
cgggcugcgcgcacagcucagaccucguaacgcgacgggccccccacugccgacaucugcgccccgccgaccg

SEQ ID NO: 6120 - RNA, 72 nt, Human
cuggguucaagccauccucccaccucagccucccaaaaugcugggauuacaggcaugagccacuguacccag

SEQ ID NO: 6121 - RNA, 107 nt, Human
ggccaguaaaucuuagcaggugcaaacuucauucaaauguuuggagucauaaauguuauguuucuuuuuguuguauuaaaaaaaaaaccugaauagugaauauugcc

SEQ ID NO: 6122 - RNA, 69 nt, Human
aacugaaggacaucgcauguuuaaaaugugggaacauuguagguuaucaugugauuguuccauguaguu

SEQ ID NO: 6123 - RNA, 70 nt, Human
cccccccccggggggggggggggggguguuuuuuucucuuuaaaaaaaccccuccccgcccggggggggg

SEQ ID NO: 6124 - RNA, 61 nt, Human
gauguuucacagccaggcaguuuaugauauuaacagacuagacuccacagguguaaacguc

SEQ ID NO: 6125 - RNA, 67 nt, Human
aaaaaguugucucuagagaaaauacuauuacaaucuaagcaugauucucuguggagacuaauuuuuu

SEQ ID NO: 6126 - RNA, 60 nt, Human
ggaaaagaaaaaaauugaacuguaagcuuuaaugauuacuuuaaauuuguuuuauuuucc

SEQ ID NO: 6127 - RNA, 78 nt, Human
gguuuucaagcaugcaaaacaguuuauuguaacuuacugaaaaauauuaacaauuaauugugaauacaugcuguuacc

SEQ ID NO: 6128 - RNA, 73 nt, Human
uauuucugaucgauauuuuuguguaauaagcauggaaaugaacuuuauacacaccacuguguugucagagaua

SEQ ID NO: 6129 - RNA, 80 nt, Human
gcagaaccccagccccaccugccuggagcgcguuugauuuggacucgacuguuguggugauggaggggggcuggaucugu

SEQ ID NO: 6130 - RNA, 71 nt, Human
gauacuguggccagaugccuuauugagauguugccugcuaucaaagcagauucaagggguuggcugguguc

SEQ ID NO: 6131 - RNA, 67 nt, Human
gacauguacuauacauaguaaggcguccuaugcaucuacgugcauaauagcguguauagugcaucuc

SEQ ID NO: 6132 - RNA, 61 nt, Human
aucggggucauugcuauuccccucugauauucaacccuauagaaggagccuggacucugau

SEQ ID NO: 6133 - RNA, 69 nt, Human
uccacacuuccugggaggucagagacaacuguuucagaagagucagaugggcuucccaagacuugugga

SEQ ID NO: 6134 - RNA, 81 nt, Human
caccuaguucuaguaaccaucagcuuguggccaaucuuaucucauccauacaucucuccagcuaccaucucuuacuaagug

SEQ ID NO: 6135 - RNA, 73 nt, Human
gugucguugcauguaacaagucuuuuuuacaauuuuauucuaugcuguaugaaauucaguuauaugaguauac

SEQ ID NO: 6136 - RNA, 115 nt, Human
aagcauauaucugcuuuuuuuuauuuugcaauucucuguauucuaugucuuuaaaaauuugaucuugacauugaaugucacagaguuguguuuuuuuaaaaagugauuuagacuu

SEQ ID NO: 6137 - RNA, 77 nt, Human
cauuuugacuuuguuggcauaaugucaguaacauacauauuccagugguuuuauggacaggcaauuuagucauuaug

SEQ ID NO: 6138 - RNA, 74 nt, Human
gauccgacauuuuuuguauucuuuaagauuuuacaccuaaaaaaucucuccuaucccaaaaauaaugugggauc

SEQ ID NO: 6139 - RNA, 71 nt, Human
gggacucuggcuaaggcucuucauuuccccuggagcaggggcagaagugaggaggggagggucggagucuc

SEQ ID NO: 6140 - RNA, 69 nt, Human
agcaggacgggcggcgcucugcuacuggucccguuaagccagaguagcccaagcccugaagucacugcu

SEQ ID NO: 6141 - RNA, 73 nt, Human
uuuagccuggguugccugugguuauauaauauggcaaaauucuacugaagacacaugguauaaaaugguaaaa

SEQ ID NO: 6142 - RNA, 60 nt, Human
aauuggauuauuagauuguuuuucguauuaaguugucuaagcuauuuacuuauucuaguu

SEQ ID NO: 6143 - RNA, 62 nt, Human
cauuuggcaaugugcucccuguggcaaccaugccugaaggguacaaucguguugcuugcuug

SEQ ID NO: 6144 - RNA, 68 nt, Human
ggcaugucauccgaaaagucaggacucccagacucagucccucacacuucuccgccgccuacaaugcc

SEQ ID NO: 6145 - RNA, 63 nt, Human; identical to SEQ ID NO: 527

SEQ ID NO: 6146 - RNA, 72 nt, Human
gcuuaccaggaagcauuugaaauuaguaagaacagaaaugcagccuacacacccaauucgucuuggucuggc

SEQ ID NO: 6147 - RNA, 90 nt, Human; identical to SEQ ID NO: 5735

SEQ ID NO: 6148 - RNA, 62 nt, Human
aggugucugucccuaaagaacugguggcacuuaugagugcuauucgugauggagaaacaccu

SEQ ID NO: 6149 - RNA, 131 nt, Human
gcguugggcuguaggucgcugugcugugugaucccccagagccaugcccgagauaguggauaccuguucguuggccucuccggcuuccgucugccggaccaagcaccugcaccugcgcugcagcgucgacu

SEQ ID NO: 6150 - RNA, 88 nt, Human
ugcucuccaguggcucacuccugaacagacuucugggaaggaacacccauaucucuuuagucagugccaggccauccacugcagagca

SEQ ID NO: 6151 - RNA, 86 nt, Human
aggcuucugcaaugugauccuggcugaaagcgcagcugagaaccacaacgguuaucagggugcuugggcugguaucuggcaggcuu

SEQ ID NO: 6152 - RNA, 65 nt, Human
cuggaggcuaguacacuccauuccuggggaaguaucgccccuauauguggguacgcuguugccag

SEQ ID NO: 6153 - RNA, 69 nt, Human
ucagcccaagguagcagcccacagugugccgagaggcuagccuuguggucugucaggcuuugggacuga

SEQ ID NO: 6154 - RNA, 74 nt, Human
gcaaagcguugccuucgaacagaacgcccgugguccuucucauuuagcguucacaguuccccgggcgccuuugc

SEQ ID NO: 6155 - RNA, 64 nt, Human
gcucugaugucauaaugaucggaaaaaaugaucuaaaaucaccguaacuucagaacaucagagu

SEQ ID NO: 6156 - RNA, 72 nt, Human
gugcaguguacaaugugaaguauuauuuauugcuaaaguccaugcuuugagucuuuacagaaaagccugcau

SEQ ID NO: 6157 - RNA, 70 nt, Human
cuucugcaauccaaacguuacuuagacugcaagcuacaaagccaccaaggccagucuuuguuaaaagaag

SEQ ID NO: 6158 - RNA, 87 nt, Human
uugugaagaaccaucgaaaccuguuuguucccagcccacccccaguggaugggaugcauaaugccagcaaguuuuguuuaacagcaa

SEQ ID NO: 6159 - RNA, 75 nt, Human
ggauugaguaugucuuucuuguuuuuccuggucuugaugaccuugaugugacuaugaauuacagaucucaacucc

SEQ ID NO: 6160 - RNA, 75 nt, Human
uuuauuuuuucaaauuauagaaguuguagaugcaaaauaugccauuuuauuaaaaaaaaacuaugaaaaauuaaa

SEQ ID NO: 6161 - RNA, 69 nt, Human
cccagcagugagccuaggcuugugugucucucuggucacagucuuucccuuacucccucuaaugcuggg

SEQ ID NO: 6162 - RNA, 76 nt, Human
ucucuuguccccuccuuuggcugccauuuuccaaugcaaugauaaggucugacagcugguagaggcagacaucuga

SEQ ID NO: 6163 - RNA, 79 nt, Human
ugaugaaugcaaagacuuuuauuuguccagaugacagaagaaugugaagaaacuggucauuugaaaucuagcuccauca

SEQ ID NO: 6164 - RNA, 128 nt, Human
cagcccuuugcucggcugcaccagcgggagauccaggugaugaugggcagccugguguaccugcggcugggcuuggagaagucacccuacugccaccugcuggacagcagacacugggcagagaucug

SEQ ID NO: 6165 - RNA, 61 nt, Human
ucaagcugcaccgacugcacuucauccgccucuuggcaggaggccccgcgaagcagcugga

SEQ ID NO: 6166 - RNA, 89 nt, Human
aaggauucagucaaacuaagcagguacucaugccagguacuccuuucucuacccacauccauguuugaaugcuauugccugugaucuuu

SEQ ID NO: 6167 - RNA, 90 nt, Human
caguccucugggcuggaggccuguguuccuucccauaagcagggccuggugggguguauggggcagaacauaggccuccacaccaaacug

SEQ ID NO: 6168 - RNA, 70 nt, Human
gccaggcaacccuguucaaucgccccagcagugaccugguucuaugugugggggagugaacugcugcggc

SEQ ID NO: 6169 - RNA, 70 nt, Human
guccucucugucuuuucuguccaugccagggaaauguauugcuggugcuagagggagaggaaacguggac

SEQ ID NO: 6170 - RNA, 83 nt, Human
cugcggugcaggucgaccagggccugggagcgcugcuggucccggagcuccuccagccgcugccagcccugcuccugcagcag

SEQ ID NO: 6171 - RNA, 61 nt, Human
gcgaccgggaccauaugauagaccaauaggaggaagaggggguuauuauggagcugggcgu

SEQ ID NO: 6172 - RNA, 62 nt, Human
augccuuaacauguggaguguaccguggggccucacuagccucuaacucccugugucugcau

SEQ ID NO: 6173 - RNA, 76 nt, Human
cucugcugcccuuucugugccccccagguucuaucuccccgucacacccgaggccuggcuucaggagggagcggag

SEQ ID NO: 6174 - RNA, 84 nt, Human
gcugcugcugcuccccagcccaccagugccuggccagccugccacccauucccuggacagggcuguggagauggcuccggcggc

SEQ ID NO: 6175 - RNA, 81 nt, Human
gggaugcacggccucgugggggccgggccguccuccagccccgcugcucccugugccagcccccuugucgcugucgguccc

SEQ ID NO: 6176 - RNA, 74 nt, Human
cccugucgaaaacacgaaaauacuggcgggugaagacaucacccaggauccaaagcuuuucaaauucggugggg

SEQ ID NO: 6177 - RNA, 79 nt, Human
ggucaugcccuggaagccaaugaugcaacuucccucucucuucaagaaguaugcacugggugggacgggguacuggacu

SEQ ID NO: 6178 - RNA, 63 nt, Human
ucaagcuggugauggcugagcagcugaccaccaugucgacaucugaguucucgcuggcuucga

SEQ ID NO: 6179 - RNA, 65 nt, Human
augaugaacaguaugcuugggagucuucugcuggagguuccuucacugugcgugcugaccauggu

SEQ ID NO: 6180 - RNA, 88 nt, Human
uucucaguucauaggcuaucccaucacccuuuauuuggagaaggaacgagagaaggaaauuagugaugaugaggcagaggaacgagaa

SEQ ID NO: 6181 - RNA, 68 nt, Human
gggggguguggcacucucuguggucaucgcugccaggaacugaccaccuagguggcugccacccccuc

SEQ ID NO: 6182 - RNA, 87 nt, Human
uuccaacaagacgauccacgcagagcucucaaagcuggugaagaagcaugcggcgcagcggagcacggagaccgccuuguaccggaa

SEQ ID NO: 6183 - RNA, 78 nt, Human; identical to SEQ ID NO: 99

SEQ ID NO: 6184 - RNA, 81 nt, Human
ucuuguguugagacuucgugguggugcuaagaaaaggauagaagaagucuuacaccacucccaagaagaauaagcacaaga

SEQ ID NO: 6185 - RNA, 70 nt, Human
uccauccaguugggcagcagggaaaggcuaggugggcccagccugcccuuccuuccuccagcuggcugga

SEQ ID NO: 6186 - RNA, 90 nt, Human
ucuuuuguuguuuguuuuguuuuuuuuuucugagggaagccuuagcuuaauguaugccgguccuucaaaagacaugauagcaauuugaga

SEQ ID NO: 6187 - RNA, 74 nt, Human
aguuagcaguggggauggcagcaguagaaggaaucacuguuucuccuaggagucugaaggccucgcugcuuucu

SEQ ID NO: 6188 - RNA, 65 nt, Human
gcucuaggggaauccugugguuauguagagacuccauguccuggugugaugagcaggaucagagu

SEQ ID NO: 6189 - RNA, 67 nt, Human
accuggugccugagcucgaugggguccgcaucuucucccgcagcacccacgaguuccugcaugaggu

SEQ ID NO: 6190 - RNA, 75 nt, Human
gauggcugucuccuucaccuaccgacaccuggcacucuucacagacacaggcuacaucuggauggggacagcauc

SEQ ID NO: 6191 - RNA, 81 nt, Human
cccagccuggacccccgaggaggcggccuccuuuucaaaagugggagggggcagggccugaaguguugggggcagccuggg

SEQ ID NO: 6192 - RNA, 110 nt, Human
ccuccugcgcagccuucagguucuccuucuucccgccccaggccuucagggcaaaggccugcagggcucggccguaggagaaggucagggcccagggcuucagcaggggg

SEQ ID NO: 6193 - RNA, 73 nt, Human
gcaggaggcucaugggugguugcugaaugaagaacagaaucuuggugcuuuguggcucaccacagccaucugu

SEQ ID NO: 6194 - RNA, 68 nt, Human
cgcucgucaccaggacccaaggaaccaaaauugcaucugauggucucaagggucguguguuugaagug

SEQ ID NO: 6195 - RNA, 70 nt, Human; identical to SEQ ID NO: 999

SEQ ID NO: 6196 - RNA, 82 nt, Human
gccaagaggcuguccaggagcugcccaguggguccucauggccugcgggauaccucaagugcucccggaggcagccuaggac

SEQ ID NO: 6197 - RNA, 72 nt, Human
ggcucgucccggagucagaaaaggcaggucaacuacccaaggcggccaaaggcccuuccugucuccagagcc

SEQ ID NO: 6198 - RNA, 61 nt, Human
uccguuggccacauugggccacugugcaccacagugccaguccccagguggccagggcgga

SEQ ID NO: 6199 - RNA, 110 nt, Human
ccuccugcgcagccuuaagguucuccuucuucccgccccaggccuucagggcaaaggccugcagggcucggccguaggagaaggucagggcccaaggcuucagcaggggg

SEQ ID NO: 6200 - RNA, 73 nt, Human
acuguuaauauuaaaaggaacauaauaaaauggcccaguccaacuaaaacaguccuugagucuauuggucagu

SEQ ID NO: 6201 - RNA, 61 nt, Human
gaugugguaagugaacuggaacacugguguuccccagugggucaucagcuacauauacauc

SEQ ID NO: 6202 - RNA, 63 nt, Human
ggcaaugaggguuggacaggcagauaauacacauauauucuuuaacuuugcaaacccauuguc

SEQ ID NO: 6203 - RNA, 96 nt, Human
ucacaugaugauccagcgcuuugagaggccauauacuguuaacaagaacaugucuauauccuuuuuuaaggcuuacuggacaaucaaacauaguga

SEQ ID NO: 6204 - RNA, 64 nt, Human
aguuuccuuuuuggaaaauggucuacauucagaaaugucuuagaacaagcauuuaaaaaaaacu

SEQ ID NO: 6205 - RNA, 79 nt, Human
agauuuucaagaucagauuccaccgguuuaguaguuuucaguggaggagccaguggaauuugggcucauuuggaaaucu

SEQ ID NO: 6206 - RNA, 127 nt, Human
caugcuuugucaagugcaguggauacgacagcuuuggggugccaauaguuauagguccugccuggauuguagggaaaguacaccucacaggaaaguggagcuacugacuaguugaauugauggcaug

SEQ ID NO: 6207 - RNA, 78 nt, Human
ggucgcaucgacggaaguggacccagucgaagcagagcaaccugacgcgacuuuagggaaagaaacgucggugucacu

SEQ ID NO: 6208 - RNA, 118 nt, Human
cucuuccgggcaaaauggcgaugggacuaaugugcggacgccgggagcuucugcgcuugcuacaguccgggcgucggguccacagcgucgcagggcccucgcaaugugcuugggaaag

SEQ ID NO: 6209 - RNA, 69 nt, Human
gcugcauguacagucuuugcccgcugcugauuuuccucuccaucgugaacgggcagcgacgagugcagc

SEQ ID NO: 6210 - RNA, 102 nt, Human
ucugcuaucucuuuugcagaaguccagguucaggccccuccuguuguugcugcaaucccucaccacagcaguaccugagguggcuucuggagagacugcaga

SEQ ID NO: 6211 - RNA, 69 nt, Human
aacacaguaaaaaaaaaaauuuuugggcgggccugggcccuggaaaagguuuuuaaacaccacuguguu

SEQ ID NO: 6212 - RNA, 76 nt, Human; identical to SEQ ID NO: 758

SEQ ID NO: 6213 - RNA, 71 nt, Human; identical to SEQ ID NO: 1764

SEQ ID NO: 6214 - RNA, 64 nt, Human
cugucaaacugguugauaaucaaagaaaagguugguuagaauaaguaaaauuucaguuagaaag

SEQ ID NO: 6215 - RNA, 70 nt, Human
ccuccacuuuuuuuaaucggaacaccuccauuugauuacauaugggguaugggauugaugagggcauggg

SEQ ID NO: 6216 - RNA, 61 nt, Human
uuucugucaagaagcaguuugaagaauuaacccuuggugaauuuuugaaacuggacagaga

SEQ ID NO: 6217 - RNA, 97 nt, Human
aaacauuacugcuuaaaaguggcuaagaaauauuuugcauguaauaaauauauuucauguuuagguuaacaggcaccaucuugagagcaguuuguuu

SEQ ID NO: 6218 - RNA, 65 nt, Human
gaaaacaagggguuuauaucugaguauaucauuaaauguuuuucuucauauagcacccaaacuuc

SEQ ID NO: 6219 - RNA, 73 nt, Human
guuucaauauuuugguuuauuuuuucuuccagauugaaaggagcaauuuaaauaauuaucaggauauagaaac

SEQ ID NO: 6220 - RNA, 72 nt, Human
uacaguuuauauucuuaauuccccauucaauaaaauaucgauugccaauuuaauaaaaguaaaugaacugua

SEQ ID NO: 6221 - RNA, 79 nt, Human
ggacuuccagaguucaguuccuucuggcagagagguaucuuucuccaugccauauggaugugacucaaaugaggggucc

SEQ ID NO: 6222 - RNA, 79 nt, Human; identical to SEQ ID NO: 2369

SEQ ID NO: 6223 - RNA, 74 nt, Human; identical to SEQ ID NO: 365

SEQ ID NO: 6224 - RNA, 102 nt, Human; identical to SEQ ID NO: 2172

SEQ ID NO: 6225 - RNA, 77 nt, Human; identical to SEQ ID NO: 3082

SEQ ID NO: 6226 - RNA, 80 nt, Human; identical to SEQ ID NO: 367

SEQ ID NO: 6227 - RNA, 71 nt, Human
cccggcccggaauggaaugggauucacgcgacugcaccaggugggcaauuuguugaucucagggcacgugg

SEQ ID NO: 6228 - RNA, 71 nt, Human
ggcggugagccccugugcaccguggacgugugagggagguggcacgggccagggcgcgggggccgccagcc

SEQ ID NO: 6229 - RNA, 73 nt, Human
gaccuugcugaugugcaugugagggggaaugagguguguauaugccuaacuccugacugaccauucaaguguc

SEQ ID NO: 6230 - RNA, 72 nt, Human
gaggaagcuggggaaagugguuagggagggagacggaggcaagacugagaaaucucugcauccccagaacuc

SEQ ID NO: 6231 - RNA, 71 nt, Human
gcaacccagcucuuuuaucaugaggagagguagccaugcugacucaugaacagguggaggaaagggguagc

SEQ ID NO: 6232 - RNA, 79 nt, Human
uaguuaccaccagcuuggccuagaaucucauugaacgcaacuugacuaguuaugacagagaggaccagggugagaacua

SEQ ID NO: 6233 - RNA, 87 nt, Human
ucuggcagcggagcugcaggccugaggaaacaugcucaguucaugcacauguguugacccauguuucagaugcagucugaugccagg

SEQ ID NO: 6234 - RNA, 99 nt, Human
auauacuucauacaguguauuucucccuuuaauuauauuccgguaggagguggaauaccuccuuggcuaugaggggcagauguauuugaugaacugugu

SEQ ID NO: 6235 - RNA, 62 nt, Human
ugacaaagccauuacuuuuauuagaaacaaauaaugcuucucaagguguuggcaacauguca

SEQ ID NO: 6236 - RNA, 68 nt, Human
auggugaacaaccaugcuggagccaaagugcuaacaugccuugguucaaggggauggaaagucaccgu

SEQ ID NO: 6237 - RNA, 89 nt, Human; identical to SEQ ID NO: 288

SEQ ID NO: 6238 - RNA, 84 nt, Human
ccauggaccgccuguacuuugugauggaguacgugaaugggggcgaccucauguaucacauccagcaagucggccgguucaagg

SEQ ID NO: 6239 - RNA, 61 nt, Human
gaagcggguguuggcccugccugggaagccgcccuuccugacccagcuccacuccugcuuc

SEQ ID NO: 6240 - RNA, 62 nt, Human
cuuaauagggaacauacauacagcuauguaacugugaauaauuguauauaucucuaguuaag

SEQ ID NO: 6241 - RNA, 80 nt, Human
agauaaagauugugaugugcugguugguuauaaagcuguguaucggaucagcuuugccauggccaucuuuuucuuugucu

SEQ ID NO: 6242 - RNA, 73 nt, Human
gguuggcucuuucuacaucccugggggcuauuucagcucagucuggucugucgucggcaugauaggggccgcc

SEQ ID NO: 6243 - RNA, 75 nt, Human; identical to SEQ ID NO: 74

SEQ ID NO: 6244 - RNA, 73 nt, Human; identical to SEQ ID NO: 75

SEQ ID NO: 6245 - RNA, 71 nt, Human; identical to SEQ ID NO: 77

SEQ ID NO: 6246 - RNA, 73 nt, Human
cuggaucuuuacgaaguauuccggacccuucauguucuggaaagcaggccgggccugggauagaagaguucag

SEQ ID NO: 6247 - RNA, 68 nt, Human
gcaggaauugaagcuuuuacagcuggagacugagaaguaggcaucuguacuguaaaccuuugaccugu

SEQ ID NO: 6248 - RNA, 88 nt, Human; identical to SEQ ID NO: 2733

SEQ ID NO: 6249 - RNA, 68 nt, Human; identical to SEQ ID NO: 2734

SEQ ID NO: 6250 - RNA, 60 nt, Human
agccucagugcucuugacauuuuggaccauacaguucuuuacuguggggagcuauagguu

SEQ ID NO: 6251 - RNA, 63 nt, Human
uuuauuaauaaucacccaaacuuugaaauaauccaauuguccuuaaacuggugaauggauaaa

SEQ ID NO: 6252 - RNA, 62 nt, Human; identical to SEQ ID NO: 4909

SEQ ID NO: 6253 - RNA, 85 nt, Human
cauauagucugcacaauucaauaugaacguuuuauuuccaacaaguauguaguucacuguuccaugacuugugcauaacaauaug

SEQ ID NO: 6254 - RNA, 83 nt, Human
gcacuuuuaacuuuucgccauggaacaacgacccuaaagaaaggauaaaagggggcaguugccaugcuggaacgugaaaaggc

SEQ ID NO: 6255 - RNA, 70 nt, Human
ggcucugcuccucacauugccaguuaaucuucgugugacuacaguaccuggaaaaacggggacagcagcc

SEQ ID NO: 6256 - RNA, 77 nt, Human
uggauuccggaugacacacacagucaccaccaucaguuaccugaaccuggccguggcugacuucuguuucaccucca

SEQ ID NO: 6257 - RNA, 63 nt, Human
cagcagaggcuggggugacucauggauagagaugaugugugugaucuuauuucggcccagcug

SEQ ID NO: 6258 - RNA, 60 nt, Human
cccauuaaggcggcagcaguggaugaaguugauacauucuuugaagugcuuuucgauggg

SEQ ID NO: 6259 - RNA, 118 nt, Human
ucuuauuucggcccagcugauccaggucuuuggcaucaaugaaguuuccgagguagaguccaggaaguaccgagggaaccaagggaggccagcuuggguaugagaggggagaggagga

SEQ ID NO: 6260 - RNA, 64 nt, Human; identical to SEQ ID NO: 696

SEQ ID NO: 6261 - RNA, 100 nt, Human; identical to SEQ ID NO: 698

SEQ ID NO: 6262 - RNA, 60 nt, Human; identical to SEQ ID NO: 2705

SEQ ID NO: 6263 - RNA, 72 nt, Human; identical to SEQ ID NO: 1989

SEQ ID NO: 6264 - RNA, 78 nt, Human; identical to SEQ ID NO: 99

SEQ ID NO: 6265 - RNA, 80 nt, Human; identical to SEQ ID NO: 100

SEQ ID NO: 6266 - RNA, 126 nt, Human
gacacccuuccucgccuguuggugcuggcccuuggggagcuggagcccagcaugcuggggagugcggucagcuccacacaguaguccccacguggcccacucccggcccaggcugcuuuccguguc

SEQ ID NO: 6267 - RNA, 71 nt, Human
guguggcuucggcagggucagccuugcgggugcuuguggacguggguggcuauggcagccggagccucuac

SEQ ID NO: 6268 - RNA, 66 nt, Human
ccaggucuuguagcagcgccuccucgagaagccaacagagcaguaagcgcagcagccggagugugg

SEQ ID NO: 6269 - RNA, 79 nt, Human
cccuaccagaggagguaccgggagcgccgugacagcgauacauaccggugugaagagcggagcccauccuuuggagagg

SEQ ID NO: 6270 - RNA, 67 nt, Human
ggaggagguccuacagucgggaacaugaagggagacugcgauacccgucccgaagggagccuccccc

SEQ ID NO: 6271 - RNA, 60 nt, Human
aucguggggcuugugggaaaugguggggagugccaauggccguaaauuaugugucgcgau

SEQ ID NO: 6272 - RNA, 66 nt, Human
ggugugcguuggaugguugacccaguauccugugaggacugugcuggcuacaugugaugcugcacu

SEQ ID NO: 6273 - RNA, 100 nt, Human
ucgucaauggaagaaccgccuuucggggcguuggaccuuccaauucccggucagauggagaaccagcgcaguacccgagaaaagggucgcccguugacga

SEQ ID NO: 6274 - RNA, 82 nt, Human
ggaagaggaagaugaggaagaagaugaggacagugacucuggaucagaugaggaagagggagaagcugaggcuuccucuucc

SEQ ID NO: 6275 - RNA, 80 nt, Human
agccagagggaucgaaauggaaaucagcugagaucaccgcaagaggaggcguuacagcgauuggucaaucucuauggacu

SEQ ID NO: 6276 - RNA, 70 nt, Human
gcugguggggccaggaguggaacugcucuugacaccccgagagccagcccugcccuuggaaccagacagc

SEQ ID NO: 6277 - RNA, 61 nt, Human
ggccuacaggcagcuguggcccagcaggacacucugauggaagcccgguucccugagggcc

SEQ ID NO: 6278 - RNA, 80 nt, Human; identical to SEQ ID NO: 100

SEQ ID NO: 6279 - RNA, 70 nt, Human
gccauggcuucauggcauucagugauuagugguaaugguaaacacugguguguuuugaaguugaaugugc

SEQ ID NO: 6280 - RNA, 87 nt, Human
ggcugcguuuuuuuuaguuuggcagguguagacuuuuuaaguugggcuuuagaaaaucuggguuagccugaagaaaaugccucagcc

SEQ ID NO: 6281 - RNA, 78 nt, Human
uaagcuagcaaugaaugcuagggugggaagcuggugagccaguggccauuagauaaauaccuuucaagugugagcuua

SEQ ID NO: 6282 - RNA, 60 nt, Human
gcuucccacacuucugacucggacguuccuuccgagugucacuagagguggacgugaagc

SEQ ID NO: 6283 - RNA, 76 nt, Human
uccuccuugcuggagcagcugaacgagcaguauaacugggugucccggcuggcaaaaccucacgcaaggcgaagga

SEQ ID NO: 6284 - RNA, 68 nt, Human
cgggagucgagcagugauucuugggagcugcucauuuuagcugccugucccagcucugcucccucccg

SEQ ID NO: 6285 - RNA, 79 nt, Human
cucugcucccucccgcugagguaauguggccacggcccccggcugccacgacuguccuucucucguggaggaggcggag

SEQ ID NO: 6286 - RNA, 61 nt, Human
cugagguuccaagcaugcuuguccuaagcucaggucccugcuggugccuggaccaccucgg

SEQ ID NO: 6287 - RNA, 73 nt, Human
cuuccuccauccugagguuuggggggagaugcagugaaccugcaaauuccccaauuugaaagggugcuggagg

SEQ ID NO: 6288 - RNA, 67 nt, Human
ucuuuuaaauccagucaaagccgccuuaaauuuccggaggugguuuuucccccuguuaagaaaaaga

SEQ ID NO: 6289 - RNA, 66 nt, Human
uacagugaaaccccaugucugcuaaaauuacaaaaaauuagcugggcgugguggugcacgccugua

SEQ ID NO: 6290 - RNA, 72 nt, Human
ucuuuaggugugguuuuugucauguagcaguuuuuauguagaucuauauauaaaaguccacaccuccucaga

SEQ ID NO: 6291 - RNA, 82 nt, Human
aggaggacgcgcugcccggccagaaaacggaguucaagguggacuccgacgaccaguggggagaguacuccugcgucuuccu

SEQ ID NO: 6292 - RNA, 91 nt, Human; identical to SEQ ID NO: 4623

SEQ ID NO: 6293 - RNA, 64 nt, Human; identical to SEQ ID NO: 287

SEQ ID NO: 6294 - RNA, 131 nt, Human
ucuuuuacuacuaaacuuaaauggccaauugaaacaaacaguucugagaccguucuuccaccacugauuaagagugggguggcagguauuagggauaauauucauuuagccuucugagcuuucugggcaga

SEQ ID NO: 6295 - RNA, 64 nt, Human
gagccaagccgccagcgcugcgaugugggccacgcugccgcugcucugcgccggggccuggcuc

SEQ ID NO: 6296 - RNA, 80 nt, Human
cccuaguccgccuucguucaagggucaggaauggaccagaacagauggguucuggaggccccugaacaggagggcuaugg

SEQ ID NO: 6297 - RNA, 67 nt, Human; identical to SEQ ID NO: 1994

SEQ ID NO: 6298 - RNA, 78 nt, Human; identical to SEQ ID NO: 1996

SEQ ID NO: 6299 - RNA, 71 nt, Human
acacugguauaaaacacaguuuaaacaauuagaaaaaugaaaacugauaccacuuuaugccucuauagugu

SEQ ID NO: 6300 - RNA, 79 nt, Human
ggauuguugaacuuguuaccagcaccaugcuuuucagcaacauuucagcggaguuggaaacauuuuuuacagcaaaacc

SEQ ID NO: 6301 - RNA, 70 nt, Human
ggcuuuuccauaccaccuucaacgcuaaccugcuucagugggagaguaaaguaggcaagaaugagcagcc

SEQ ID NO: 6302 - RNA, 75 nt, Human; identical to SEQ ID NO: 74

SEQ ID NO: 6303 - RNA, 107 nt, Human; identical to SEQ ID NO: 4612

SEQ ID NO: 6304 - RNA, 89 nt, Human; identical to SEQ ID NO: 504

SEQ ID NO: 6305 - RNA, 62 nt, Human
caaucacauuauuauuccuaguuaugcaucaugguuugauuauaacuguauucaugugauug

SEQ ID NO: 6306 - RNA, 71 nt, Human
cggcgugcucuuccugaguucuucaauggaaaaaacaaauccaagacuccagaaauauacuuggcauaucg

SEQ ID NO: 6307 - RNA, 72 nt, Human
cuuacaaaguauaucuaaggauuauucugcugaagauucaguuuaagaguuuccuugggagaacuaaguaag

SEQ ID NO: 6308 - RNA, 80 nt, Human
gcagcacccaccuccaaccucgggccagugucuucaggcuuuacuggggaccugcgagcuggccuaaugugguggccugc

SEQ ID NO: 6309 - RNA, 60 nt, Human
ugauuuuuauuaauuucauaacugggaaauuccaugugaaagugaaacaagcaugaguca

SEQ ID NO: 6310 - RNA, 77 nt, Human
gggacuuggagaagccugcccugccaggccuggaggcacaucccugccaaggcucagcaucuucuccagcagguccu

SEQ ID NO: 6311 - RNA, 88 nt, Human
cuugguuguagagcuguguugaaauccauuuuggugguugguuuuuaacccaaacucagugcauuuuuaaaauaguuaagaauccaag

SEQ ID NO: 6312 - RNA, 99 nt, Human
gaggcaggagaaucacuugaacccgggaggcggagguugcagugagccgagaucgcaccauugcacuccagucugggcaacagagugagauuccuucuc

SEQ ID NO: 6313 - RNA, 72 nt, Human
ugagaauacacauuguauguuucugugcacaugacagugugugugugugcacguacauacuguauagucuua

SEQ ID NO: 6314 - RNA, 65 nt, Human
gcagucgccgggcugcccgcgcugggcuucaccggcgccggcaucgcggccaacucgguggcugc

SEQ ID NO: 6315 - RNA, 61 nt, Human
cucagcugcuuaagcuggcccacaaguacagaccagagacaaagcaagagaagaagcagag

SEQ ID NO: 6316 - RNA, 60 nt, Human; identical to SEQ ID NO: 2705

SEQ ID NO: 6317 - RNA, 72 nt, Human; identical to SEQ ID NO: 1989

SEQ ID NO: 6318 - RNA, 72 nt, Human
gccuuuuaaacuggagaguuaagucauaaucccuccuggcuuugugugaauagcuugcuccacuuugcuggc

SEQ ID NO: 6319 - RNA, 67 nt, Human
gggugaacaccaugcguugggugugaagguggcuaggaugccauaaugaaccaacugggacucaccc

SEQ ID NO: 6320 - RNA, 60 nt, Human
ucuucauggagauugcagcugacaaacugcugagccugccaaugcaacagccacggaaga

SEQ ID NO: 6321 - RNA, 64 nt, Human
gggcgacuacgcgugcggcccgcacggcuacggcgccauccccgccgcgcccccgccgccgccc

SEQ ID NO: 6322 - RNA, 61 nt, Human
gaaauggaaagguuggcaggcagcucccacugcgcacuuguuaaacccugaaguccaguuc

SEQ ID NO: 6323 - RNA, 70 nt, Human
uaccuggauaauacacccguuuugccucgugccgaauucggcacgagaacauauggguuaaaucucggua

SEQ ID NO: 6324 - RNA, 71 nt, Human
cuggauugcaguggcccaaucugggcucaugaaaccucugggucccggucaagugguucuucugccuucag

SEQ ID NO: 6325 - RNA, 60 nt, Human
gggagaaacuucuuuuuuuacccuuuuucauaggcgugccuuaaaagagauaauuuuccc

SEQ ID NO: 6326 - RNA, 61 nt, Human
ucccgaguuagcgugggauacacgggugcacgcaccccccacgcccagcuuaauuugcgga

SEQ ID NO: 6327 - RNA, 74 nt, Human
gcgaucuacacugagacaaggaaguuggaaaagccgaguaguuauaccagaagaucagggucucacagacucgc

SEQ ID NO: 6328 - RNA, 74 nt, Human
gucuguccagaucuuccaucuuaugcgccagcuugcagcagguuaaggacagcagcaggaugaagcuggaugac

SEQ ID NO: 6329 - RNA, 70 nt, Human
ccuacccuauguuaucucaaguuagggaaaugagagcccauuucccuaacuugagauaacauaggguagg

SEQ ID NO: 6330 - RNA, 74 nt, Human
gaaauuaaccaagguuuuauugacugccauguaugucccaugaugcaguuucugaagccaacauggcuuauuuc

SEQ ID NO: 6331 - RNA, 76 nt, Human
ucaucuguuaaucccagguguccucauguugcugaaauauuuagauagcuaaaauaucccuuaauuucacagauga

SEQ ID NO: 6332 - RNA, 81 nt, Human
uuuucauucuuacaguggucuuuucaugggagugaaugaguuacucuccacuggugauuagguaauacuguagaaugaaga

SEQ ID NO: 6333 - RNA, 98 nt, Human
cccaggcuagccagccuuuuaacaacaucuuuugggguacaauuagaaucuaaguguuugcagccauaugugucauguagaagaugccuagcccuggg

SEQ ID NO: 6334 - RNA, 61 nt, Human; identical to SEQ ID NO: 347

SEQ ID NO: 6335 - RNA, 103 nt, Human
gcggcucagccucgagcgugacuaucacagccugugcgagcggcagcccauugggcgccugcuguuccgagaguucugugccacgaggccggagcugagccgc

SEQ ID NO: 6336 - RNA, 63 nt, Human
ucgcaaaggcaaaagcaagaaauggcggcagaugcuccaguucccucacaucagccagugcga

SEQ ID NO: 6337 - RNA, 87 nt, Human
ggggcagccugcaacccccaaaggccgguguugggcuuccaaaugcuucaggccuggggccagaaagggguuacaaaagguugcccu

SEQ ID NO: 6338 - RNA, 70 nt, Human
gggguggggggucuguuuggcaacuggggugaagggauugcccucccccugcugggauccccccaacccc

SEQ ID NO: 6339 - RNA, 80 nt, Human
ugcucugcuuuuaaauuucugaacuucuucaauacaaauuaaaauaguacuggagucuuuugggaggccaauagcuagca

SEQ ID NO: 6340 - RNA, 72 nt, Human
gagcccagccaaucagcgccccggacugcaccagagccauggucggcagaagagcacugaucguacuggcuc

SEQ ID NO: 6341 - RNA, 81 nt, Human
ucucuugacucuguguacauccuacccacuuuuuggcccuccccacaagugugccugugggcaauuacacagggcguauga

SEQ ID NO: 6342 - RNA, 78 nt, Human
gaauuuagcuguucuuuauugacauggaauuugggguggcgaggguagccacacccuccaggaggaugagguagguuc

SEQ ID NO: 6343 - RNA, 84 nt, Human
cggugcuguguccuggagcuuuauuuggggaguuucacccagaauggugggagaaaccucccaggugccagguaccccgcaucg

SEQ ID NO: 6344 - RNA, 80 nt, Human
acagcacaaacccuaaaguccaugugcagucuccauguacaaguauaaaagucuguuucaggacaacccuggguugcugu

SEQ ID NO: 6345 - RNA, 65 nt, Human
agacuacucccagcuaauacuuuacugucauuauaucuuugaaauuaguacuuaugggacuggcu

SEQ ID NO: 6346 - RNA, 101 nt, Human
caucugaaguugcaccucuuauguaaccgaauccauuuacuacaccaaaaauuagcuuacaaaaggugucuggcguauacaaaaggaaguguccugagaug

SEQ ID NO: 6347 - RNA, 77 nt, Human
ccugcuaacgauguuccuuaugccuaauugucugaaucuucucauacauucuaggauuucauguuucguuacaaagg

SEQ ID NO: 6348 - RNA, 73 nt, Human
auaucuaggcugaauguaaaaucccuuauguuguaucaauggggguaaaaacuauuuuauuugccuaugauau

SEQ ID NO: 6349 - RNA, 61 nt, Human
gaaauuaaugaugcagacaacuugguguggucuuugaacagcucucugcaguauuuuuuuu

SEQ ID NO: 6350 - RNA, 66 nt, Human
ccuggucuguagccacccuccugggcccggcuccauauggcuaagggggcuggcgagcugaccagg

SEQ ID NO: 6351 - RNA, 116 nt, Human
gaggaaacugaggccucaagcguggagggguagagugaagaguagaacccaggucugaugccaaagcugcuuucuucucugccuccuccucacgcaacucacaccuccuuuucuuc

SEQ ID NO: 6352 - RNA, 74 nt, Human
acugaggccugugaaucuaagaggguugagcaugaaggacaugcgcagccuuaacaagggggcacaggccaggu

SEQ ID NO: 6353 - RNA, 71 nt, Human
cugggcaugguggcgcgcgccugcaucucagcuacucaagaggcugaggcaggagaaucacuugaacccgg

SEQ ID NO: 6354 - RNA, 62 nt, Human
gccacuggcucccugcacugugugugcugcacagaggaugguagguaggggcucagugccgc

SEQ ID NO: 6355 - RNA, 65 nt, Human
gugagaucaccuugccccauaauuuccaugcuuccuuugugugcaggggcaaaggcgauuaucac

SEQ ID NO: 6356 - RNA, 69 nt, Human
ggcucccaauguugacguuggccagggcuuugcaaacaagccaggccaaaaaggcucaacauuuacacc

SEQ ID NO: 6357 - RNA, 79 nt, Human
aauucugggagauuaggaaaaaagcuucugaaaugaagguuauuucagaaguaauuuuuaugggagagcuuccagaauu

SEQ ID NO: 6358 - RNA, 64 nt, Human
acaagaaaaagaaucuuuaccuuuacccuuucucuuggaggaauauuugacuucuuauucuugu

SEQ ID NO: 6359 - RNA, 86 nt, Human
gccaggcuuggcagugcuaagugcauugucccuuuuaauccucgcaugaacucuuuggaauagguacuauaggugcugagccuggc

SEQ ID NO: 6360 - RNA, 68 nt, Human
cuuaaugccuuauauuacuuccuuaucauagugaguagagcaugagagaauguauugugugcauugag

SEQ ID NO: 6361 - RNA, 131 nt, Human
gugcgaucucggcucacugcaaucuccgccucccagaaucaagcgagucucaugccucagcuacuugggagauugaggcagagaauugcuugaacccgggaggcggagguugcagugagccgagauggcgc

SEQ ID NO: 6362 - RNA, 67 nt, Human
accauuguccauuucuacauguuauucgcuuguuacccucaaguuggauacaaguucuggcauuggu

SEQ ID NO: 6363 - RNA, 72 nt, Human; identical to SEQ ID NO: 1696

SEQ ID NO: 6364 - RNA, 69 nt, Human
cgggcaaaggcaccgucaccuuuccaauccuucaucgacuuucaugacuagagagacgggcugacaccg

SEQ ID NO: 6365 - RNA, 104 nt, Human
agagaagggacgggguggcugggcagucagggaaggagggucgcccggauccgacauuuuggagagauuccuucacucuccuguccccccuaccucccuucucu

SEQ ID NO: 6366 - RNA, 85 nt, Human
gcuaggcugagaccuauggugguggcagggguggcuguugagccugaacuuccaguacuccugcccuuccuucuguuuaccuggc

SEQ ID NO: 6367 - RNA, 96 nt, Human; identical to SEQ ID NO: 5638

SEQ ID NO: 6368 - RNA, 63 nt, Human; identical to SEQ ID NO: 527

SEQ ID NO: 6369 - RNA, 90 nt, Human; identical to SEQ ID NO: 5735

SEQ ID NO: 6370 - RNA, 119 nt, Human
cgccccccgggggccuggcuggaaccgccgggguccgcagggccucaggccggcccuacugucgugccugggucuugcgaccccauggaaacuggaauagcagagacuccggaggggcg

SEQ ID NO: 6371 - RNA, 77 nt, Human
caggcaguguugcuccugagccaucuucuuaaccaccacaccguggggccaccauagaggaucuggagcucagccug

SEQ ID NO: 6372 - RNA, 63 nt, Human
gccgcuccgcucugggugguucaaucccaaccagggguugggauguccugccugcggaggggc

SEQ ID NO: 6373 - RNA, 69 nt, Human
gucauaagauugggugggcaaugaccacacaugaguccuguauggagcagugucucagccacuugugac

SEQ ID NO: 6374 - RNA, 84 nt, Human; identical to SEQ ID NO: 286

SEQ ID NO: 6375 - RNA, 64 nt, Human; identical to SEQ ID NO: 287

SEQ ID NO: 6376 - RNA, 89 nt, Human
ggccaauugaaacaaacaguucugagaccguucuuccaccacugauuaaaagugggguggcagguauuagggauaauauucauuuagcc

SEQ ID NO: 6377 - RNA, 78 nt, Human
gccucuaauaucuuugggacaccugaagaaaaucaagcuucuugggccaagucagcaggugccaagucuagugguggc

SEQ ID NO: 6378 - RNA, 61 nt, Human
gcuuucagaagcuugucccuggcugcccacagugaagcacgagggacagagcgacugcagc

SEQ ID NO: 6379 - RNA, 61 nt, Human
gagagucugguauuacacuggaggaucacaaacuguauuuucuuguuauaaauggcuccuc

SEQ ID NO: 6380 - RNA, 66 nt, Human
ugacuauaaaauguaauacaagggcauauuagggggagaaugccuuuguuuuuucuuuuguuguua

SEQ ID NO: 6381 - RNA, 63 nt, Human
aucuguuggaugcuugcggcggugcugcacuccaugugccacuguugcuuggcccugacugau

SEQ ID NO: 6382 - RNA, 76 nt, Human
gcagcgugugcuugacccagugucgucuugugcucugugcuggguacugcaugaugcuucugucuauccaugcugc

SEQ ID NO: 6383 - RNA, 61 nt, Human
gccgggaugcaugugggccgugggccggcggugggcugugggccugcgcugcguccugugc

SEQ ID NO: 6384 - RNA, 78 nt, Human; identical to SEQ ID NO: 99

SEQ ID NO: 6385 - RNA, 65 nt, Human; identical to SEQ ID NO: 247

SEQ ID NO: 6386 - RNA, 80 nt, Human; identical to SEQ ID NO: 100

SEQ ID NO: 6387 - RNA, 79 nt, Human
cuccuuccuccagggaggccucagcaucagugucuguggacguagucucugaagagugcuucagcugauggggaaggag

SEQ ID NO: 6388 - RNA, 67 nt, Human
gauggcgucacuuuccugccaacuuucucguugccucuccuugaaagcagaagaagugccagcccuc

SEQ ID NO: 6389 - RNA, 79 nt, Human
aaguuagaaguuuuuuuuugguggugguuauuuuaaauuuuuaacaaauauaaacaccagcagauacuauuacuugcuu

SEQ ID NO: 6390 - RNA, 73 nt, Human
uacaguuaaaaacuuuucaaaauuaauacauuguuaauuauuggaccaguuuugaaguugggguuuaacugua

SEQ ID NO: 6391 - RNA, 81 nt, Human
ccaagcugguuuggaacuccuggccucaagcaaucugcccgccccagccucccaaagugcuaggagcauaagccagcaugg

SEQ ID NO: 6392 - RNA, 74 nt, Human
cugucaaguucuguucauagcucccugcagccuugaacuucuggccucaguuucccaagugacuaggacuauag

SEQ ID NO: 6393 - RNA, 85 nt, Human
uguaccauuguuguuuuagacauaaugcuacugcacacuucauagacuacaguacaguauaguauaaauacaacuuuugugugca

SEQ ID NO: 6394 - RNA, 69 nt, Human
caggggggguugucugaagcggccucugagggaggcaaacacuucuucuucaggcugcugccuucucug

SEQ ID NO: 6395 - RNA, 67 nt, Human
gucaaagcuguccagaccuugcuugcuuuuguccaauuuggcuuucucugggucucugugcuuuggc

SEQ ID NO: 6396 - RNA, 91 nt, Human
gcuuauaucuagcaugccuguuuugggguggucccugggguugugggauuucccaggggcuacccuuuccugcucuuggcuagauaucugc

SEQ ID NO: 6397 - RNA, 71 nt, Human
gucuuguuuuuuucaguaauguccuguuugcccuucuuaucagcaucuaucuagcuacauucugacaggau

SEQ ID NO: 6398 - RNA, 79 nt, Human
gggucucuuuuuuucaucuagguaaaccggagcaaauaaaaccuauugaagaguucuccugaugauugaaugaguuccc

SEQ ID NO: 6399 - RNA, 90 nt, Human
ggugcagcagucagcagcaaagugaaagcuguucagaacuacuggauuuuccaguggaagcuuugacaucauuaacucugucucugcauc

SEQ ID NO: 6400 - RNA, 124 nt, Human
ccucaaccucccaggcucaagcaaaccucccacuucagccccccaguuauucaggugcagcagcucacaucuguaaucccaaggaggcugaggugggaggauuuuuugagcccgugaguucagg

SEQ ID NO: 6401 - RNA, 73 nt, Human
gaugggaaugagccaccucagauguggagggcccugaagaauccauauaggagggcaggcucuucacucccuc

SEQ ID NO: 6402 - RNA, 90 nt, Human
auguacaugcucaggguugucccccaguagaagugaugggcugcuuugagccguucuuacugaugucuggucugaucccuggguggucau

SEQ ID NO: 6403 - RNA, 61 nt, Human
cuagaguucuuuccccuucucuugaauuuccucauauaucaugaagccucagaaacacugg

SEQ ID NO: 6404 - RNA, 69 nt, Human
uggaaaaaccagugauauguuuagcuguauuaacuaauuacagaaucuaaugcauaacuggucuuuuua

SEQ ID NO: 6405 - RNA, 64 nt, Human
uccaucacauaugguagagauauauauuuauauauauuuauauauaauuucuuuugugguugga

SEQ ID NO: 6406 - RNA, 69 nt, Human
uggccucccacccagcucagagaccuggugaggaccacccauaagggcugugcagaggguuagaggcca

SEQ ID NO: 6407 - RNA, 92 nt, Human
uucuauuuuuuucuuacuaaugccuucucuucucccugccccuguggccuaggcccagguucuagggcagguacagugaggggugaauggaa

SEQ ID NO: 6408 - RNA, 61 nt, Human
gccccguucagccaugucguccggcauccauguagcgcuggugacuggaggcaacaagggc

SEQ ID NO: 6409 - RNA, 81 nt, Human
gcuuggcaucgugcgcgaccugugccggcuguucucgggggacguggugcucacggcgcgggacgugacgcggggccaggc

SEQ ID NO: 6410 - RNA, 85 nt, Human
augaggcucccaauguugacguuggccagggccuuugcaaacaagccaggccaaaaaggcucaacauuuacaccggcugcuuuau

SEQ ID NO: 6411 - RNA, 106 nt, Human
aaauggaaggauucagcuuucaguuaaaaaagaagaagaagaaauggcaaagagaaaguuuuuucaaauuucuuucuuuuuuaauuuagauugaguucauuuauuu

SEQ ID NO: 6412 - RNA, 90 nt, Human; identical to SEQ ID NO: 1499

SEQ ID NO: 6413 - RNA, 68 nt, Human
uuuuuuuuuugguuuucuuacaaagguugacauuuuccauaacagguguaagaguguugaaaaaaaaa

SEQ ID NO: 6414 - RNA, 65 nt, Human
auugaaagauuuuauuuuggugccucuugacaaucagagagcuucagcauguaaaauuuucuagu

SEQ ID NO: 6415 - RNA, 84 nt, Human
ugauuuugguuuucuuuauaauuuucuguauuuucuaaaaugucuaaaacaacgaaguauuaaaagugagaagaaaaugaguua

SEQ ID NO: 6416 - RNA, 60 nt, Human
ugugguauggaauaaacuucccauuuaccauggauaauuuucaaccuuuuccuuaccuca

SEQ ID NO: 6417 - RNA, 66 nt, Human
ugauagaauaggaaaauuuuaacauuuuuguuucuaaggauaguuuuaauuuucuuauuuuuuuca

SEQ ID NO: 6418 - RNA, 98 nt, Human
ugagagauguguaguuaauuuaguaauucuguuucaugagauaugaucuguuaugcuagugguuuaauaggcuugcuauguaaguagaacguggcuca

SEQ ID NO: 6419 - RNA, 65 nt, Human
uuucuguuuuucuaaaugacccgugguacuuaauagguguacuaaaauuguguugggagcaggga

SEQ ID NO: 6420 - RNA, 106 nt, Human
uaggcuacuuuuaccguggaauauauaguauagagaugcaaaacuuaaauguuuacaucaauuuauauugaaugucacauaauuucauggaaggaaagguagcuug

SEQ ID NO: 6421 - RNA, 93 nt, Human
uuuuuuugcacuuaaccacuaaaucuuuauugaauuuuuauuguaacagcaaugcaauauuagcaaauagagagaaauauagagugaagagaa

SEQ ID NO: 6422 - RNA, 63 nt, Human
gagagacacucagaauggacgaucuaaaguuccuuccagcuuccaaauucugggcugguuuuc

SEQ ID NO: 6423 - RNA, 62 nt, Human
gccuaggugagucucacucugaccuaugagagcggagaacacugagauaucuugcccauggc

SEQ ID NO: 6424 - RNA, 71 nt, Human
gcugucguuuuuuccuugacacuuguaggcuccucuucauguuuacauaaccucagugggaaaacgccagc

SEQ ID NO: 6425 - RNA, 127 nt, Human
gucuacgauggggcugccguuacagccuuccucccggggcucuggagacgcgccagcucuuugacaccucuccugcgcucggggucccgccacgaggagguucuucaaggccugcgcgcccacggac

SEQ ID NO: 6426 - RNA, 79 nt, Human
auuucauccagaauuaagcaaaguauuuguuacugcacacacagaucauaagugcucugcugcacuguacaucugaaau

SEQ ID NO: 6427 - RNA, 63 nt, Human
ugaugagcagaacaaagauuugagaagcacuuucccugcaucugguucagacucugcucauca

SEQ ID NO: 6428 - RNA, 78 nt, Human
gggcuuccccucggccuccaggugaggcugcccauugcaggcacugggcaggccugaccuugcuggggcucauggccc

SEQ ID NO: 6429 - RNA, 130 nt, Human
auucuccuauuauuauaaugcagauauuucauacuggaauaauuuacauuuacaaauuauaucauagaaaaauaauuuuaucgcuaaauguaaacagguugggguacuucauccaaaauaagaagaaaau

SEQ ID NO: 6430 - RNA, 62 nt, Human
gaaucuagcacuuucauauuuuaaagcugauauuuuagcaauauuuugauaaaacuuuauuc

SEQ ID NO: 6431 - RNA, 68 nt, Human
uuuauuaaaagaucaugauauugauaagaaugcauuuuaauuuacaagguaucauuucagagagugaa

SEQ ID NO: 6432 - RNA, 66 nt, Human
aaaggcaugagaaacagucaucucaauaaaugcaagacaugagcauaaaagagguucucugccuuu

SEQ ID NO: 6433 - RNA, 83 nt, Human
uuuggcccguguagcuucccuuugagggugugugacuugccaucugcaaaagucauggccaaaacaggaacuaacaggccaaa

SEQ ID NO: 6434 - RNA, 66 nt, Human
auucugguauagaagacauuaaggaagcauuugucacucucuuuaguaagucuaugaucuuggaau

SEQ ID NO: 6435 - RNA, 103 nt, Human
uugccgccgugcgcuuggccacacuuaacaucauccccgcuaacuacaguccuucagguuuugcaauagauagauuuaaaguuuggaauaggcauugcaguga

SEQ ID NO: 6436 - RNA, 79 nt, Human
gagaugcaguuaaaauucuagaauaauuaaaagccacaaagugaaacuguuguucuggggcccuauguuguagauucuc

SEQ ID NO: 6437 - RNA, 64 nt, Human
uuuuuuuuuacauuuugugauaacuuuuucuucucuuuagaaaaaaaaaauauguacaaaaaaa

SEQ ID NO: 6438 - RNA, 70 nt, Human
aagggggcuuggaccugugacucaguuccacauuuuggauugcauacuggaaaagaagccaagucuucuu

SEQ ID NO: 6439 - RNA, 64 nt, Human
gaagucuccuauuugaucagguuauuuccugggacuuggcaaaaaucugauugguggggaucuc

SEQ ID NO: 6440 - RNA, 77 nt, Human
uaggaccuaguggacaucugguauuaauuuaaucucaggaaaaacaagaaauuaacccagagagagucuggguucug

SEQ ID NO: 6441 - RNA, 72 nt, Human
gguuguuuuuaaaaaagcucuucuguuuaaaacauauuuguaaaacaagauuuggaugacauggaagcaauc

SEQ ID NO: 6442 - RNA, 70 nt, Human
cggagcuuggaccccgauuggcugcaaugcugaacuuuaaucuucagcaacuuuguggccccaagugccg

SEQ ID NO: 6443 - RNA, 69 nt, Human; identical to SEQ ID NO: 6356

SEQ ID NO: 6444 - RNA, 63 nt, Human
cagaccccacccugcccucacaucaggcucuuccgguacugacugugcgggguggucugucug

SEQ ID NO: 6445 - RNA, 96 nt, Human
uuuuuuuuuuuuuuuuuuuuuuuuuuuuuugcgugguugguuuuuauuaauuaucuggauaacagcaaaaaaacugaaaauaaagagagagagaga

SEQ ID NO: 6446 - RNA, 93 nt, Human
gccaugauuaugagacuuccccagccauguggaacuguuaaguccaauuaaacaucuuuuucuucuuagucccagguuguucucauucguggc

SEQ ID NO: 6447 - RNA, 75 nt, Human
guccaacacugaaaccgccugaccgcugcugucuuugugcuugcagaaaaucacggugggcacaaaauuuuggac

SEQ ID NO: 6448 - RNA, 71 nt, Human
ggcuuuuccauucaaacuuugucauuuguuucuuuaaguucaagaaagacaaaaucuacacuggaaauccc

SEQ ID NO: 6449 - RNA, 89 nt, Human
ugaggcaguauauaagagucauggaaaaagacagagaaaaaaaacagacaaaucaguugucaguauccauggccucugauucugucuca

SEQ ID NO: 6450 - RNA, 60 nt, Human
aggacagagccaaacaggaacagaggcugcccaacucccuucuguacugagcucuguuuu

SEQ ID NO: 6451 - RNA, 80 nt, Human
ggagaggcgaggaccgguaucuggagacuggggacggaagcggggagcucagaccgggauccauucucuccucgccuccc

SEQ ID NO: 6452 - RNA, 65 nt, Human; identical to SEQ ID NO: 4901

SEQ ID NO: 6453 - RNA, 119 nt, Human
ucagcagcacaaaucccuuuuauuaaccaucuucccuuucucgaguauacacaaguagaaaagaaacagugaaguaccccgauagggaggguggggagaggaugggagggggcuccuga

SEQ ID NO: 6454 - RNA, 81 nt, Human
ugcauaguuaaaaaaaugaagcgagauggcaguuugugcaguaauaucugcccuucgaaguucaugcaaccaacuaaugca

SEQ ID NO: 6455 - RNA, 75 nt, Human
uguuugccacugacgacauuccacacccuauuaucaucuguacauauggggguggggggggcggcgggggggaca

SEQ ID NO: 6456 - RNA, 60 nt, Human
cucuugcuuuccuuugaggcagcugcugucuuuuuacacagcucucgucuaagcaauggg

SEQ ID NO: 6457 - RNA, 60 nt, Human
guaggcaugacuaagggguaaggguugacuauucuugagcuaccucaccaacuugccuau

SEQ ID NO: 6458 - RNA, 60 nt, Human
ggcaguauuacaggaaccuggcagccgcacuggccgcccagaaacgucaguggugcugcc

SEQ ID NO: 6459 - RNA, 64 nt, Human
gggcggcagguaacgagucauugccucucacgccaccuggaaggcuggacuacuuccuccuccc

SEQ ID NO: 6460 - RNA, 65 nt, Human; identical to SEQ ID NO: 586

SEQ ID NO: 6461 - RNA, 95 nt, Human
uuuuuuuuuuuuuuuaaggcaacagacucuuuauuuaaugugguuuaaaauacaucaaaaucaagucccuggcuguugugaauacccaaaggaga

SEQ ID NO: 6462 - RNA, 74 nt, Human
ccaggagcuacacaccuucgaggugaccggccaggaaacggucgcccagaucaaggcucauguagccucacugg

SEQ ID NO: 6463 - RNA, 71 nt, Human
gcauugcccggaagaucaagucgugcuccuggcaggcgcgcccuggaggaugaggccacucugggcagugc

SEQ ID NO: 6464 - RNA, 84 nt, Human
cucugucuccugaguagcuggaauuacaggcaugagccacugcacacugcuuacgcuuugaucucagcacaaccaggcuaggag

SEQ ID NO: 6465 - RNA, 74 nt, Human
gcugaucuauuuuuaauuuuuuaauauuuguauuuuuaaauuuuaaauuuuauuuuuauuuugauuagaacagu

SEQ ID NO: 6466 - RNA, 69 nt, Human
gguccaacugugucacccaggcacaacugcugauuacuacagcuucgaucuccugggcugaaguggucc

SEQ ID NO: 6467 - RNA, 102 nt, Human
auacaggacuaauugucagccuagaaaaggaacuugcuccauuguuugaagaacugagacaaguuguggaaguuucuuaaucugacagugguuucagugugu

SEQ ID NO: 6468 - RNA, 81 nt, Human
gcuuugcgaccugguuucuuauccacuuuugcccuugcaacagaccaaggaagcaaacuuggacuuuccaaaaauaaaagu

SEQ ID NO: 6469 - RNA, 78 nt, Human
gacaaguuucaaaggaagaacauguaugacucauggccacaaaaggcuauuuauagauggcuucuuucugauuauguc

SEQ ID NO: 6470 - RNA, 102 nt, Human
uugggccccaacgcagcuuggaucggugcuggggcaaaccacacguggaccuucuuggcccacggaugcuccuggguuaccggccggaugcuaggggcccga

SEQ ID NO: 6471 - RNA, 97 nt, Human
gcgauguccucugcagcuuccagcuugcgcagcucgaucaggccauccccugcaguggccagugaguuggcaaucagcucagcugccuuggagucgc

SEQ ID NO: 6472 - RNA, 96 nt, Human
gugauuuuaccuuuauuuccuucacuuuaagccaaucaugaaauuucacagugauuucuggggugggagcagaaggaaggcuguguuaagaaucau

SEQ ID NO: 6473 - RNA, 66 nt, Human
gcccccugagagccuggcgcagcugggacuccccagaaauucacugccagcucuuaaauauggggu

SEQ ID NO: 6474 - RNA, 61 nt, Human
gcuggauaugcaaacccuaagggaauuaugagaauaacccuguccacgguuacaauccagc

SEQ ID NO: 6475 - RNA, 84 nt, Human
gggaugucaguggcgcugagcaguagcuuuaagucccagaaaagccuuuucuuacuaugcaaacccacucgugccuggaugccc

SEQ ID NO: 6476 - RNA, 74 nt, Human
acagaguuuugucuuuucuaauccuuguuagacuacugauuuaaaagaaggaaaaaaaaaagcccaacuccugu

SEQ ID NO: 6477 - RNA, 87 nt, Human
cuucaggcaguaaaccaacagcucacaaaggagaaagagcacuaccagguguuagagugaaguaauugggaaacuguucauuugagg

SEQ ID NO: 6478 - RNA, 66 nt, Human; identical to SEQ ID NO: 6473

SEQ ID NO: 6479 - RNA, 61 nt, Human
gcccugauuaaacacucaccccuucaggagaacccagaguuauagaagggaugucaguggc

SEQ ID NO: 6480 - RNA, 61 nt, Human; identical to SEQ ID NO: 6474

SEQ ID NO: 6481 - RNA, 64 nt, Human; identical to SEQ ID NO: 2519

SEQ ID NO: 6482 - RNA, 100 nt, Human; identical to SEQ ID NO: 2523

SEQ ID NO: 6483 - RNA, 67 nt, Human; identical to SEQ ID NO: 2521

SEQ ID NO: 6484 - RNA, 64 nt, Human
cgaguugggaggggcggaaggcugaaccuccagcuugagccggacaagccgauucccagcguug

SEQ ID NO: 6485 - RNA, 64 nt, Human
cuccccaggagcccaucauggcgacgcccccuaagcgggcgucgcgguggaggccacgggggag

SEQ ID NO: 6486 - RNA, 61 nt, Human
gaggguagagaugaacugugugugaggccaaacuggaucggucaacauggucuucccccuc

SEQ ID NO: 6487 - RNA, 64 nt, Human; identical to SEQ ID NO: 2519

SEQ ID NO: 6488 - RNA, 99 nt, Human
cuuccuauaaaguuugcucucucuuuuugaaggaaauuucugggcaaacaacauuuugagaaagaaauucagauaugggaaaguaaagaucauggggag

SEQ ID NO: 6489 - RNA, 67 nt, Human; identical to SEQ ID NO: 2521

SEQ ID NO: 6490 - RNA, 64 nt, Human; identical to SEQ ID NO: 2519

SEQ ID NO: 6491 - RNA, 100 nt, Human
cuuccuaucaaaguuugcucucucuuugugaaggaaauuucugggcaaacaacauuuugagaaagaaauucagauaugggaaaguaaagaucauggggag

SEQ ID NO: 6492 - RNA, 100 nt, Human; identical to SEQ ID NO: 2523

SEQ ID NO: 6493 - RNA, 67 nt, Human; identical to SEQ ID NO: 2521

SEQ ID NO: 6494 - RNA, 62 nt, Human
uaucagauuugaauuacagcugaguuacccacuugggagucaguuuuagauuggagcuggua

SEQ ID NO: 6495 - RNA, 69 nt, Human
uccgagggcgagcuccagaaaaguuuugcaaucuggagauaaggagcuugaugggcagcuagacuugga

SEQ ID NO: 6496 - RNA, 80 nt, Human
uauccaauauugauucuuuguuuuacagcucauaaugaucagaaaauauacauuuaaaaugaaagucaaagaaaaggaua

SEQ ID NO: 6497 - RNA, 67 nt, Human
cacaccccugaguacaguggagguuuaggagguuuggaucuccacguuuaaguacugccaaggugug

SEQ ID NO: 6498 - RNA, 68 nt, Human
uugucugccaaaucuuccuuacgugucaugaguuguuccaaggugacugugguggaagauaaugacaa

SEQ ID NO: 6499 - RNA, 81 nt, Human
ggggccagagacccaccucgcuacuuggcguacucagucaucuugaaggguguguuagaagaagaggauccggguggccuc

SEQ ID NO: 6500 - RNA, 73 nt, Human
ugaagaagguguagcucucggcggggauguuacccuuggaccaggaacacuuuguuguagcugcccuccauca

SEQ ID NO: 6501 - RNA, 86 nt, Human
gugggaggagaaggggaaguauguuuuggggggcugcuuccugucugaguaagcccucaggagccucugcuccccugugaacccac

SEQ ID NO: 6502 - RNA, 61 nt, Human
ucccuuccccagaucugcuccuccccuuucacaggugggaucggcacucagggggucugga

SEQ ID NO: 6503 - RNA, 81 nt, Human
ugccuucucaggaaagcuggugucugauuuuggccaucaggacucugacgucucuuuggucuuguugauuuccucugggca

SEQ ID NO: 6504 - RNA, 85 nt, Human
gcagucuggauucguguuuauugaagccaguaauuagagacaucuuuuuuucccaggacuagaaagcaagguuccacaugacugc

SEQ ID NO: 6505 - RNA, 94 nt, Human
guauuuuuaguagagacgggguuucaccauguuggccaggcuggucucgaacuccugaccucaggugaucuaccugccuuggcucccaaaguac

SEQ ID NO: 6506 - RNA, 69 nt, Human
aaacuuugccggauucuuuugaaauucgaucuuuuuccagauugaaauuaguaauaucuguagaaguuu

SEQ ID NO: 6507 - RNA, 72 nt, Human; identical to SEQ ID NO: 1989

SEQ ID NO: 6508 - RNA, 85 nt, Human
ggguagauguuuucuuggcagccauauuuguaggcacugcuggauacuuuaguguuagaaguggcuauuaagagacgaguuuccc

SEQ ID NO: 6509 - RNA, 65 nt, Human; identical to SEQ ID NO: 1518

SEQ ID NO: 6510 - RNA, 75 nt, Human; identical to SEQ ID NO: 74

SEQ ID NO: 6511 - RNA, 87 nt, Human; identical to SEQ ID NO: 76

SEQ ID NO: 6512 - RNA, 71 nt, Human; identical to SEQ ID NO: 77

SEQ ID NO: 6513 - RNA, 62 nt, Human
guuguuuuaccuguggugacuuucagauuuagggagagauuuagagauaucacauggacaac

SEQ ID NO: 6514 - RNA, 82 nt, Human
accacccacaggcugguauugacauccuucuugggccgggccuuuuuggccaaauguaggauggauggcccuuggggguggu

SEQ ID NO: 6515 - RNA, 84 nt, Human
uugaccccaucaacgcacugcagggcugccauggaagggccuaugagugaccacccuuggauggaggccuggcaggaggggcaa

SEQ ID NO: 6516 - RNA, 69 nt, Human
cuccuggaguggauccggcgcaccauccccuggcuggaggaccgugugccccaaaagacuauccaggag

SEQ ID NO: 6517 - RNA, 68 nt, Human
cagcuguaacuaaguauauacauguaggcuuuucuagaaaaguacagaaccaauuuagaaagcagaug

SEQ ID NO: 6518 - RNA, 69 nt, Human
cuccaguaguauugagguuaaaaugauucagcauuuagacuuuaaaaauuaccucaauguuccucggag

SEQ ID NO: 6519 - RNA, 66 nt, Human
uuauaaccuugauugaagcccuguugaagaguaacugcuuugccagcaucuauuccaucucuauaa

SEQ ID NO: 6520 - RNA, 67 nt, Human
gggagcaaccaaacuucuggggcauguguauuuuuaaaccuacgucucccgggucucuguugcucuc

SEQ ID NO: 6521 - RNA, 75 nt, Human
aguucacuauauagagcuauugaaagaguucugagcagaguuuuaucagguagguagcaguauguagagugaauu

SEQ ID NO: 6522 - RNA, 105 nt, Human
ucagaaggucacgcaacagaugcuguguuaggagcaugaggguagauauaugggccauuugugauguucaggauacggcugauuugauucuugguguccaucuga

SEQ ID NO: 6523 - RNA, 98 nt, Human
aauugaaagacuucagugaacaaggauuuacuucagcguauucagcagcuagauuucagauuacacaaagugaguaacugugccaaauucuuaaaauu

SEQ ID NO: 6524 - RNA, 63 nt, Human
gguguggguuuuuggcauguagcaguuuuuaugguaagaucuauauauaaaaagucccacacc

SEQ ID NO: 6525 - RNA, 80 nt, Human
ggugggagaugaggaaugggaucagauaucgaggguggguaauucuccauaaacugauuuagaggauucuugcuaacacc

SEQ ID NO: 6526 - RNA, 61 nt, Human
ucuuuauucauaaucacaggccacaggggugagaccugagguuuggguucuguggugaagg

SEQ ID NO: 6527 - RNA, 70 nt, Human; identical to SEQ ID NO: 3648

SEQ ID NO: 6528 - RNA, 74 nt, Human; identical to SEQ ID NO: 1525

SEQ ID NO: 6529 - RNA, 66 nt, Human; identical to SEQ ID NO: 1526

SEQ ID NO: 6530 - RNA, 61 nt, Human
auguuuuauuucacuggaaaauucuguaaagaacuaaaucugguucccuugaagaaaacau

SEQ ID NO: 6531 - RNA, 80 nt, Human
cugacucuaaggcccugugggaugaaaagcagguauccaaaagaacucugcuuggcccucugauacggccuugaggucag

SEQ ID NO: 6532 - RNA, 68 nt, Human
ggggugagcuggggaggcuucugcgguucuggagucccggcgauggcgccaguuccccagcaaacccc

SEQ ID NO: 6533 - RNA, 73 nt, Human
ccaaggagaacuucaguugcuugacucguuuggaucacaaccgagcuaaagcucaaauugcucuuaaacuugg

SEQ ID NO: 6534 - RNA, 94 nt, Human
cugcaagacugugcccuuccccuccugaaagaugucaucgcaacagauaaagaagacguugccuucaaagaccuggauguggccauucuugugg

SEQ ID NO: 6535 - RNA, 60 nt, Human
gaagucaguuaagguuauuguuguggguaauccagccaauaccaacugccugacugcuuc

SEQ ID NO: 6536 - RNA, 84 nt, Human
gaaaaucaauucuaaaaacugugugacauacaacaugacaucuuaauguaacaugacuguauguguggacuggaguugauuuuc

SEQ ID NO: 6537 - RNA, 67 nt, Human
cucucaggaagcgugguaaucucucaauggcuggccuccggaguugucacucaggcucccuuguaag

SEQ ID NO: 6538 - RNA, 80 nt, Human
ccucgaguggcuccgaauguuugaucagcaagaaauucagguauuaauuucuggugcacaaguucccauaagccuagagg

SEQ ID NO: 6539 - RNA, 61 nt, Human
accauaaggauuuuuccucgaacuugggcaagucgucgguuugcgagaucguccuuauggu

SEQ ID NO: 6540 - RNA, 82 nt, Human
gggaaacacguauucaggccggcgcggguugguacauccuagggcauaccaggggacucuggucgguuacugauacggcacc

SEQ ID NO: 6541 - RNA, 68 nt, Human
uuuugggaagaaccaugguggauagacuagagcuuaguucuuuguggcacgguggguucucgccaaaa

SEQ ID NO: 6542 - RNA, 97 nt, Human
cgcagccccagcccggccccccuggggacccuagagaggguguccuuucuguuuauccuucucuuugcuccagauggcugcgcucucuaggggcgcg

SEQ ID NO: 6543 - RNA, 84 nt, Human
ggugcgcgguguguuccagccucaguccuccuggguucuuuauccacaggcaucuggggguggaugugacggcagacuugcacc

SEQ ID NO: 6544 - RNA, 84 nt, Human
ccacuugauguucagugaagagaaccagaaaaagucuguagagcaguaccaucugggucucaucaaaaaggagaaauaacgugg

SEQ ID NO: 6545 - RNA, 66 nt, Human
cgugugaacagcuacuacucuugguaucgcaacuacgggcaccuggaguugauucagcugcagcug

SEQ ID NO: 6546 - RNA, 69 nt, Human
cagccgaggagcaggcgcggccgcggcgccauauugcggcccucagcggccgcgaccgagucauggcug

SEQ ID NO: 6547 - RNA, 112 nt, Human
cucccuucauugcaucugaggacuuguuuucuuuuucuuuauuuuuaauccucuuaguuuuaaauauauugccuagagacucaguuacuacccaguugugguuucucgggag

SEQ ID NO: 6548 - RNA, 68 nt, Human
ggaaacuggaaaaaggcuucuugaaguaaauguucugaguggagcuacuaggaugucuuccagccucc

SEQ ID NO: 6549 - RNA, 125 nt, Human
guaaagcaaugucugccuaguuuauuguccaguuaacuuuagugaccuuuuaaaaguuggcauuguaaauaaaacaacuugcaaaaaaguuuucuggaauagaauuaacaaaauauuaucuuuau

SEQ ID NO: 6550 - RNA, 92 nt, Human
ggaggucagcuaccaggaagauccaugaucugggcauuggcagaugccugccaucacagccaggaagaugccucugaccugggugcaucucc

SEQ ID NO: 6551 - RNA, 64 nt, Human
ggcagcccugggccuugguuugauuaccuccccugggggaugcuggucagacccagagguuguc

SEQ ID NO: 6552 - RNA, 65 nt, Human
uccauuaagcaguucauggacaucuucucgcuaccggagauggcucugcuguccuguguggugga

SEQ ID NO: 6553 - RNA, 79 nt, Human
gggacaugguggggaucccuggccuagguguucaaggugguggcauccugaacuuccagcaguucccuagcccgguucc

SEQ ID NO: 6554 - RNA, 61 nt, Human
cgcggcuacuacaaccagagcgaggccgggucucacacccuccaguggauguauggcugcg

SEQ ID NO: 6555 - RNA, 71 nt, Human
gggcacgugcguggaguggcuccgcagauaccuggagaacgggaaggagacgcugcagcgcgcggaaaacc

SEQ ID NO: 6556 - RNA, 78 nt, Human
gggcgccuccuccgcggguaugaccaguccgccuacgacggcaaggauuacaucgcccuugaacgaggaccugcgcuc

SEQ ID NO: 6557 - RNA, 67 nt, Human
uucagagaaauccuauuuauaauuaugaucugaacuuauucuaugauuagcaaauauaucaucugaa

SEQ ID NO: 6558 - RNA, 64 nt, Human
gcaaacagggaaaaauauauuuuuuucauaaaguacugaauguuaacuuuuuucaucuguuugu

SEQ ID NO: 6559 - RNA, 111 nt, Human
ucuuuccaaaauuuacaaauauacaauauauuuauaguauuaccuucagacaacuucagugcaaagauauacauauaguacauugugauaauuauuuguaaaaauaugaga

SEQ ID NO: 6560 - RNA, 67 nt, Human
gagaaauuuuaguuauaaauuagugaaguguuaggauuuaaauuuuacuuagaaauuaaaacuucuc

SEQ ID NO: 6561 - RNA, 88 nt, Human; identical to SEQ ID NO: 95

SEQ ID NO: 6562 - RNA, 65 nt, Human; identical to SEQ ID NO: 42

SEQ ID NO: 6563 - RNA, 60 nt, Human
ggauuaauaggucccccgcuuuguuugacaccggucugcacgggagaccaaaacgagucc

SEQ ID NO: 6564 - RNA, 70 nt, Human
cuggccccggguucccguggcuaccgggcgcggccgcccccgcgccgcaggccgggaccccgguggccag

SEQ ID NO: 6565 - RNA, 63 nt, Human
cgcucgcaagaccaccagcgcccagagccccagucugaggcuggcgccgggggucugcgggcg

SEQ ID NO: 6566 - RNA, 70 nt, Human
ggcuagcgggagccggcacaagagggucgaggagccaggaaccccaaacguccggcgccaggcgcuagcc

SEQ ID NO: 6567 - RNA, 68 nt, Human
aaaaaaaaaauggcacucugauuaaacugcauuacagccugcaggacaccuugggccagcuugguuuu

SEQ ID NO: 6568 - RNA, 69 nt, Human
cuuccuucaccaacaugcaaguucuuuccuucccugccagccagauagauagacagaugggaaaggcag

SEQ ID NO: 6569 - RNA, 73 nt, Human
gccaugucuuaagagcgggaagaaaaggcagcaaacaggcucuaucuccacaggcucuggggacagugacggc

SEQ ID NO: 6570 - RNA, 81 nt, Human
ugaaagaagaacuacuugugaagggcaaacaguuuaguucaagaaagcaaggcuaugcaauaccacagcaaacuucauuca

SEQ ID NO: 6571 - RNA, 70 nt, Human
uuccgagugaaauguguccagacagcaggagagaucuacuuaucugugagacugaagagccuccuuggaa

SEQ ID NO: 6572 - RNA, 74 nt, Human
gcaugagccacugugacuugcccagaucacauuucuacuacccuauagaauggauguaaauuaccugcuugugc

SEQ ID NO: 6573 - RNA, 72 nt, Human
gcuuuuaacuuggacuaguguaacuccuucaugcaauaaacugaaaagagccaugcugucuagucuugaagu

SEQ ID NO: 6574 - RNA, 63 nt, Human
cagaugggcucuuugggcuuugggagcuggcuucaccuggcuacucccgagucuggcccucug

SEQ ID NO: 6575 - RNA, 104 nt, Human
cggaggggcccgcuccggggacagucuugcccacccugggcuuugcgggggcccucgcggaaggcccggcggccgcgcuguguccccgugcgacacgccccccg

SEQ ID NO: 6576 - RNA, 74 nt, Human; identical to SEQ ID NO: 2058

SEQ ID NO: 6577 - RNA, 65 nt, Human
ggccuguuaucuccuuuugcgcgacacggucucagcuguuccgccugaggcgagugacgcuggcc

SEQ ID NO: 6578 - RNA, 72 nt, Human
gcggccgcauuccugcaggggaugacugugaauggcuucaucaacacagucaucaccucccuggagcgccgc

SEQ ID NO: 6579 - RNA, 61 nt, Human; identical to SEQ ID NO: 3268

SEQ ID NO: 6580 - RNA, 66 nt, Human; identical to SEQ ID NO: 12

SEQ ID NO: 6581 - RNA, 84 nt, Human
ggcaccuuugcccaagcugagugaacugcacugugacaagcugcauguggauccugagaacuucaagcuccugggaaaugugcu

SEQ ID NO: 6582 - RNA, 70 nt, Human; identical to SEQ ID NO: 194

SEQ ID NO: 6583 - RNA, 90 nt, Human; identical to SEQ ID NO: 1501

SEQ ID NO: 6584 - RNA, 81 nt, Human; identical to SEQ ID NO: 4694

SEQ ID NO: 6585 - RNA, 98 nt, Human
ugcaaagaugcuguccgugcgcguugcugcggccgugguccgcgcccuuccucggcgggccggacuggucuccagaaaugcuuuggguucaucuuuca

SEQ ID NO: 6586 - RNA, 89 nt, Human; identical to SEQ ID NO: 504

SEQ ID NO: 6587 - RNA, 79 nt, Human; identical to SEQ ID NO: 995

SEQ ID NO: 6588 - RNA, 69 nt, Human
gggcagggguggcagaagacacgagcagccacugcccguacccccucuccucucuguaagcccaugccc

SEQ ID NO: 6589 - RNA, 67 nt, Human
ccuggggcaggaacaagcuccagccuuccuccacauggcuugagguaaucagcaccccuaccccagg

SEQ ID NO: 6590 - RNA, 69 nt, Human
gccacuuagcugagccagccagcucugccucccuccccaaagagugcuuuuggcuggccagaggguggc

SEQ ID NO: 6591 - RNA, 67 nt, Human
ggucagugagaggggggcagcaggggugcuccccacggcaguccugcugcggccuucccuccuggcc

SEQ ID NO: 6592 - RNA, 74 nt, Human
ggugugagcucugaggaguccugaacccugggugcagcauccuagcauccugggaguccuuuucugcccacacu

SEQ ID NO: 6593 - RNA, 60 nt, Human
uuuuuuuuuuuuuugucaagcaugucagacaauaaaguccuuuguuaaaaaggggaaaaa

SEQ ID NO: 6594 - RNA, 65 nt, Human
cccucccgggugccccgagaugcuggccgguaacacuucuuccucuacaagcacacccaugaggg

SEQ ID NO: 6595 - RNA, 79 nt, Human
ggaugucugugucaggcauguuaacuucaaacaaaaucugagaucggcuuuuuccauugacauucuuagcacagcaccc

SEQ ID NO: 6596 - RNA, 108 nt, Human
cuuguuucggacuauagagugcugauggcagagauuggugaggauuuggauaaaucugauguguccucauuaauuuuccucaugaaggauuacaugggccgaggcaag

SEQ ID NO: 6597 - RNA, 62 nt, Human
agcaaccagccugggagccuucgacguaggcgcugugggcgaaggaaaaggccuggccugcu

SEQ ID NO: 6598 - RNA, 106 nt, Human
ccaggaacgcugcagaggcggguuggccggggggcgcugccgcccaaggcccgaggcagcggcgcgggaucggccaaagcacccgccgccaguucggcgggucugg

SEQ ID NO: 6599 - RNA, 88 nt, Human
ccugggccugccacucccacgcccuucaccaaugccguccagcugcugcugacgcugaagcuggugagccuggccagugaaguccagg

SEQ ID NO: 6600 - RNA, 61 nt, Human
gcccgcccggggucccugaccguggcuucuuccccggccugaucugcgcagcccggcgggc

SEQ ID NO: 6601 - RNA, 65 nt, Human
ggcggcaagcgggcugggacugcucggccgccuccugcccggcgagcagcucagaccaugucgcc

SEQ ID NO: 6602 - RNA, 84 nt, Human
uagugguucuucuuaucuccauccccaucggcuuccucuuuaagaaagccgguccugggcugaagagauggggagcagccgcug

SEQ ID NO: 6603 - RNA, 78 nt, Human; identical to SEQ ID NO: 99

SEQ ID NO: 6604 - RNA, 65 nt, Human
uguggcauacauaauguagaguuuucaaggguaccuuaaagaacaucuauaaauacauacacaca

SEQ ID NO: 6605 - RNA, 60 nt, Human
cguggggcuguggccacccuuucaaacuccuuucugaaugcuuguggcaucugccccaug

SEQ ID NO: 6606 - RNA, 67 nt, Human
ccuccucccgucacuccacgcagcuggcagagagcacagugaucaccagcgugagugguggaggagg

SEQ ID NO: 6607 - RNA, 61 nt, Human
cagugugcacgugggaaccuguccccaggcuggagcauaggggcaugaucccagcucacug

SEQ ID NO: 6608 - RNA, 67 nt, Human
gagugaggaauguuuggguggcgucaagguugguaagcggcgcgcgccgcucgagcucucccgcauc

SEQ ID NO: 6609 - RNA, 91 nt, Human
ugaauggccgcucgccgagugcuguuugcaaacuuaggaacccccucgcgcggggccuagcggggguacguggcgcaugcgguaacacuca

SEQ ID NO: 6610 - RNA, 74 nt, Human
ugucagauguguccuuguuaauauacucgaaguuccucuagcuugugggagauguuagagcuaacacauuugca

SEQ ID NO: 6611 - RNA, 70 nt, Human
guuucaagaguucagauauacagauaaagcaauuuaaaaaaagcuuuucuuauucuaaggcuuuugauac

SEQ ID NO: 6612 - RNA, 78 nt, Human
cugcagcggcucgucuacuccaugugcucccucugccaggaggagaaugaagacaugguacaagaugcgcugcagcag

SEQ ID NO: 6613 - RNA, 106 nt, Human
ccaguuguucaauuuccagagacagcuuauauaccuccagggccauuuucacaucccucuggguuugggagacacugcaugaguccuuuggccugugagcaccugg

SEQ ID NO: 6614 - RNA, 70 nt, Human
gaaaaaaaauuugugcuuuguguguugaaaagcaaaaacaugagccacacagaggaugauuaauaauuuc

SEQ ID NO: 6615 - RNA, 96 nt, Human
aaaugcagguuuacaaagaugagcaggugguggugauaaaggauaaauacccaaaggcccguuaccauuggcuggucuuaccguggaccuccauuu

SEQ ID NO: 6616 - RNA, 65 nt, Human
uucauuugaaaguuuucauuuccuuuuuaaaaugugaaugauuagguauguaaacuuuaugugaa

SEQ ID NO: 6617 - RNA, 126 nt, Human
gaauauucaaaauacacuuuuaccccacuccauucugucauuauuuacacauauguacaagaaaaaugaaagagucucuguguaugugugugugugcgagugugugugguuuguguuguuguuuuc

SEQ ID NO: 6618 - RNA, 68 nt, Human
ggugaccugguguugcacugcauggagggcauuggccgccagcuucucaagcgcaguggcagguuguu

SEQ ID NO: 6619 - RNA, 71 nt, Human
acaauucuauuaccauauaagguuucccaaauccuuacccagcuuaguucucuugggaagcucuuaauugu

SEQ ID NO: 6620 - RNA, 95 nt, Human
ugggacuuccagaacuuggaguaacuuggaguugauucccauuuuccuuuggaggugacuggcaaaugcaaucuuuaggaagcuccucugaccca

SEQ ID NO: 6621 - RNA, 65 nt, Human
ugccagauuccuuuuaucaucugcgaggaaaagagaagcaggaugaggaagagugagggaaggcg

SEQ ID NO: 6622 - RNA, 84 nt, Human
cagggcauuccgcagggcaucugccuccuggcugccgcucagacugaggagccaggagaccccaccgcccagcguguugcccug

SEQ ID NO: 6623 - RNA, 68 nt, Human
cgcucuuccaccgaggguggcgucaucuccccccgaagguccuuggucagcagccucgaggaagagug

SEQ ID NO: 6624 - RNA, 72 nt, Human
ugcccagcuccacaagcgccugcagcgccuccacgucaccggcgugggcagcagcacaggccaggcugggca

SEQ ID NO: 6625 - RNA, 65 nt, Human
acaggcgugcaccacugugcucggauuauuuuugaauuuucaguagagacaggguuuugccaugu

SEQ ID NO: 6626 - RNA, 76 nt, Human
gccucccaaagugauugcagauuacaggugugagccacugcgccuggccuaugguuuggaguuaauguaaugaggc

SEQ ID NO: 6627 - RNA, 69 nt, Human
ugcugcccaggcugggaugcaguggcgugaucucggcucacugcaaccucugccuccugggcucaagca

SEQ ID NO: 6628 - RNA, 65 nt, Human
accucuagaaaccccaauccuucaucuacauaaaauuuccaggcauguuuauuaaguucuagggu

SEQ ID NO: 6629 - RNA, 64 nt, Human
gcuccucagugggaagacagaagcaccagaguggcuucaaaggugaguccucaacugacagagc

SEQ ID NO: 6630 - RNA, 67 nt, Human
ggcucccaugcuucccagaauggccgcuaucuguggaguucuguggaggacaggccuaguuugagcc

SEQ ID NO: 6631 - RNA, 85 nt, Human
uggagaaggacuucauuggcuuucugcucuucaacgccacacaacguguccuuggagaagacagcacaauggggcucuaucuuca

SEQ ID NO: 6632 - RNA, 68 nt, Human
aauguguuucuucaguuaugucugugcuguauagaacugucacuaacauuaaagaaagaggacacauu

SEQ ID NO: 6633 - RNA, 68 nt, Human
guaucuuuuuuacauuuuccugaugagaauauaaauuugaaauauucucaguaagugauuaaaaguac

SEQ ID NO: 6634 - RNA, 79 nt, Human
uucugauaauuuugguguaaacaaaaaugauauuuaauuuuuauuaaaucaaguuuaccuaucaaauucccuuuuagaa

SEQ ID NO: 6635 - RNA, 80 nt, Human
uugaaaaauguaacuuuuauucugaacauguaguauuuaucuuuauuagcaauuuuuuucauaauauaagcaugccucaa

SEQ ID NO: 6636 - RNA, 70 nt, Human
cauuugcuccuauguaaccucugcugaaccaugaccccaaggucuaaggagaaaccacauaggauaaaug

SEQ ID NO: 6637 - RNA, 91 nt, Human
ggccacccagauccauuuuuguuuuugagucuggcuuuucuguggcugaagauauaccgcagucagcagguaauggcuggauuugggcgcc

SEQ ID NO: 6638 - RNA, 74 nt, Human; identical to SEQ ID NO: 1690

SEQ ID NO: 6639 - RNA, 70 nt, Human
gccaccuaugacgcagccacccaggaguuugugauacacagccccacgcugacugccaccaaaugguggc

SEQ ID NO: 6640 - RNA, 78 nt, Human; identical to SEQ ID NO: 1691

SEQ ID NO: 6641 - RNA, 73 nt, Human
gagaguggccuggcccuggagccuuuuucuagucuuuucagaauagaauaugggccuggaggcuccacuucuu

SEQ ID NO: 6642 - RNA, 91 nt, Human
aacaugugaauacuaccaaguuucuguccccaaagucaggcaucacugcuagucuuuugggacagaugggacagauguucacuuuaauguu

SEQ ID NO: 6643 - RNA, 75 nt, Human
caggugcacucuauucaagugcaaggauaucagaaguuuuugcaucaacaaauuuucgagauggaguucacucug

SEQ ID NO: 6644 - RNA, 75 nt, Human
ugacuuuuccaaccugcuuaguuuaacaaauuauauuccaguuuuaaucauuguaaaaaaagcaccuggaguuca

SEQ ID NO: 6645 - RNA, 96 nt, Human
caggaacacaaauagaccacauauuacucuuuaauuagauuuguuuuacaauauguucuugucaacgagcuaugucaaacuguuuguuuaaaccug

SEQ ID NO: 6646 - RNA, 72 nt, Human
gggggaggggaagaagcacuuuuucuagagauggaaaauaguuccaguaaaaaguucuuauuccuuucuucu

SEQ ID NO: 6647 - RNA, 72 nt, Human
uaaaauuacauggcucuuaggaaugacgccaaacaugcaacauuuuaagaguaauauuaaacaguaauuuug

SEQ ID NO: 6648 - RNA, 73 nt, Human
acugaggccugugaaucuaagaggguugagcaugaaggacaugcgcagccuuaaaagggggcacaggccaggu

SEQ ID NO: 6649 - RNA, 89 nt, Human
gagaaucacuugaacccgggagguggagguugcagugagccaagaucgugccauugcacuccagccuggugacaaagcaagacugucuc

SEQ ID NO: 6650 - RNA, 95 nt, Human
acagggucucacucugucacccaagcaggaaugccauggcgugaucuccacucacugaaugcaaucucugcuuccuggguucaaguggaucuugu

SEQ ID NO: 6651 - RNA, 81 nt, Human
gccgcuguccuguggugggugcaaauugguaugcucuguucacgcagaaacccagcaguguguaccugcuguaggcaaggc

SEQ ID NO: 6652 - RNA, 65 nt, Human
gcaccuaacugacuuccagagucucuguagaaaccuuaacucaucuggaguuaucagggagcugc

SEQ ID NO: 6653 - RNA, 74 nt, Human
uggagcuucucgcaagguguuugggagcagaggauggagcaccaacuacuaguucugcucaguaacacccucca

SEQ ID NO: 6654 - RNA, 85 nt, Human
uuucugauggcugcuaugugucugacacugugccaugaucuguaggagaaacaagugaacaggggacaaucucagccuuuaggaa

SEQ ID NO: 6655 - RNA, 95 nt, Human
gagauacauaauuacucagucauggaaaagugacuuagcaguauugugaaaaaacaggaguguuagguggcuguaacucaguaagaugugauuuc

SEQ ID NO: 6656 - RNA, 93 nt, Human
ggcguuuuuggcuccauuuaacagaagaaggaccauagugaucauuuaaucucuaugagucugucuuaucuucuggaaaaggggccuaacacc

SEQ ID NO: 6657 - RNA, 74 nt, Human
uauuccauuucaagaaaguacgacuaucagcagccacaaaaccaagcugacagugugcaacucucauuggaaug

SEQ ID NO: 6658 - RNA, 61 nt, Human
ccaccgcggggcccagguucccaagaggucccacaccagaccuucccggcccagccugugg

SEQ ID NO: 6659 - RNA, 68 nt, Human
gggacuaggccccagagggaggcgauggucugcgaggcucccguguucccggcugguuguccugucuc

SEQ ID NO: 6660 - RNA, 60 nt, Human
ccgggguggcgccggccggggcgggggagcccaaaagaccggcugccgccugcuccccgg

SEQ ID NO: 6661 - RNA, 90 nt, Human
ggguggcgaagguggcauacccccuggggcugugugugggcguguucaucuauguugccuacaucaaguggcaccgggccaccgccaccc

SEQ ID NO: 6662 - RNA, 62 nt, Human
gugaaugaaaaaagguauccguuaugaaacuuccagaaaaacgaacuacauuuuucagccgc

SEQ ID NO: 6663 - RNA, 75 nt, Human; identical to SEQ ID NO: 1860

SEQ ID NO: 6664 - RNA, 66 nt, Human
uguaaugauuggugccuguuuccucauugacuucauguuuuuugaaagcacuggcagccaggaaca

SEQ ID NO: 6665 - RNA, 77 nt, Human; identical to SEQ ID NO: 1861

SEQ ID NO: 6666 - RNA, 84 nt, Human; identical to SEQ ID NO: 286

SEQ ID NO: 6667 - RNA, 78 nt, Human
uacacagcacagaggcacgggcaccaugggagagggcagcacuccugccuucugaggggaucuuggccucacggugua

SEQ ID NO: 6668 - RNA, 64 nt, Human
accauugccauuucuacauguuauucgcuugguacccucaaguggauacaagucuggcauuggu

SEQ ID NO: 6669 - RNA, 72 nt, Human; identical to SEQ ID NO: 1696

SEQ ID NO: 6670 - RNA, 80 nt, Human; identical to SEQ ID NO: 788

SEQ ID NO: 6671 - RNA, 79 nt, Human; identical to SEQ ID NO: 3903

SEQ ID NO: 6672 - RNA, 69 nt, Human
uuuuuuuuuuuuuucccauuuuuggaaaauauuuauuaaaaaacuagugaauggggcaaaaaaacaaaa

SEQ ID NO: 6673 - RNA, 65 nt, Human
acguaggcaagcaucagcccuagggcucagcugauccuuggcuggggggcuggcagcuuccaugu

SEQ ID NO: 6674 - RNA, 79 nt, Human
uugagugugcagcucacaacagacaucaggaucacuguccaggaguguccuggguuaaccuuuguuggcugggccucag

SEQ ID NO: 6675 - RNA, 68 nt, Human
gcuuuuuaaaggauaguucucucugguuaucaagcauauuuugccaucagggaaacauauuuuaaagc

SEQ ID NO: 6676 - RNA, 67 nt, Human
ugcacaaggaugauacaaaguaucugggcuagauucacaacuauuccaauuacuaucucuuccugca

SEQ ID NO: 6677 - RNA, 61 nt, Human
uuagucauuuuaguuguucccuuuguaugccaaaaauggaagacagcuguuugugcacuaa

SEQ ID NO: 6678 - RNA, 130 nt, Human; identical to SEQ ID NO: 3794

SEQ ID NO: 6679 - RNA, 64 nt, Human
auuagauucugggguaguuuccuuugguguucucaaauuaagacuuuuccaaaacaugucugau

SEQ ID NO: 6680 - RNA, 63 nt, Human
uguaacagugacacuauuccacaacaaaauuacuuagauuucaugaggaaacauguauuugca

SEQ ID NO: 6681 - RNA, 63 nt, Human
auacaggaugauaguucgugugacaaacacagauaucauuugucagauugcuuaugcccguau

SEQ ID NO: 6682 - RNA, 90 nt, Human
aucuaugaaggccaaguggaggugacuggugaugaauacaauguagaaagcauugauggucagccaggugccuucaccugcuauauggau

SEQ ID NO: 6683 - RNA, 92 nt, Human
cuggaaauguauuccauuucaagaaaguacgacuaucagcagccacaaaaccaagcugacagugugcaacucucauuggaaugaaaccucag

SEQ ID NO: 6684 - RNA, 76 nt, Human
gcaacagaaguaauuguuucaagcuccugauucuuucuacuaaaucaugaacagcuuuaaaaacauuucugucugc

SEQ ID NO: 6685 - RNA, 76 nt, Human; identical to SEQ ID NO: 758

SEQ ID NO: 6686 - RNA, 71 nt, Human; identical to SEQ ID NO: 1764

SEQ ID NO: 6687 - RNA, 83 nt, Human
cagaguccuagaggcaggcuucuauggcugauguggugacuucauucguuaggaacugagaugccuucuuucuugcugcucug

SEQ ID NO: 6688 - RNA, 79 nt, Human
uacuuguauuuccauugcuugaauguaagagucagaugauguuuuaauugaaauaaaauucuaggcuggaugcaaugug

SEQ ID NO: 6689 - RNA, 63 nt, Human
caggacgaaaaucagguaguuggugaagucaggaaacugauugaguuguuugaguucauccug

SEQ ID NO: 6690 - RNA, 84 nt, Human
cagggggugggaagcucugauagugugccuucacguuguucuugaggaugaggccacugagagagcgcguuggcucaucuucug

SEQ ID NO: 6691 - RNA, 62 nt, Human
gacugugagucuuugagcagcugcaggaccugcugcaagcccugcucgucuggcugccaguc

SEQ ID NO: 6692 - RNA, 84 nt, Human; identical to SEQ ID NO: 286

SEQ ID NO: 6693 - RNA, 89 nt, Human; identical to SEQ ID NO: 288

SEQ ID NO: 6694 - RNA, 61 nt, Human; identical to SEQ ID NO: 776

SEQ ID NO: 6695 - RNA, 66 nt, Human; identical to SEQ ID NO: 4822

SEQ ID NO: 6696 - RNA, 83 nt, Human
gguuaacucauaaugaauuauaaaacuuugauaguuacauuguacuaucauuuaugaggcauuuauuuuucauuauuuacacc

SEQ ID NO: 6697 - RNA, 66 nt, Human; identical to SEQ ID NO: 4823

SEQ ID NO: 6698 - RNA, 97 nt, Human
aauaauuuuuagagaaaaugauguaaugaaaaauuguaccaugaauuaggagcauaguuuuuuccauuuaaacgucaccauuacuuaaaagaugauu

SEQ ID NO: 6699 - RNA, 82 nt, Human
caggagaagucuaauccacagguuacaccuauguuugauaugauauaaguucucuuugcguaggccacuggguuuucuccug

SEQ ID NO: 6700 - RNA, 86 nt, Human
augugcccacauguagccuggcaguccaaagaccaagaaucaacuugcaaaucugccauuaaacugcugugcgacuucaggcauau

SEQ ID NO: 6701 - RNA, 71 nt, Human
caugaacacgugugggccucggucaccuggcuuugagggcagucugaccaggcuagaccacacgugccgug

SEQ ID NO: 6702 - RNA, 62 nt, Human; identical to SEQ ID NO: 4127

SEQ ID NO: 6703 - RNA, 74 nt, Human; identical to SEQ ID NO: 1525

SEQ ID NO: 6704 - RNA, 99 nt, Human
ucucuuuucauauuauaagauuuuagcaauacuuccaauauugauuuccuuaccaaauggaaucuagaagcuaaauuuuuaaaaauuguuaaaggauga

SEQ ID NO: 6705 - RNA, 76 nt, Human
ggaauagagaaaugacaaauaauauaucauauagaucacaggaucauauauguguuacucauauagcucagguucc

SEQ ID NO: 6706 - RNA, 93 nt, Human
ucuaugcuuaaggaagucaaaauaauaucacuuuaggggcuaggaacaacuauuuuaaacucuaaagauuacauacuaucuuaguaucaugga

SEQ ID NO: 6707 - RNA, 72 nt, Human
cuuaccuaucuagauagcgcugcccagaggaagaggcgcucucccugccccucagcaagcugggauaauaag

SEQ ID NO: 6708 - RNA, 77 nt, Human; identical to SEQ ID NO: 2307

SEQ ID NO: 6709 - RNA, 68 nt, Human; identical to SEQ ID NO: 4262

SEQ ID NO: 6710 - RNA, 78 nt, Human; identical to SEQ ID NO: 2308

SEQ ID NO: 6711 - RNA, 78 nt, Human; identical to SEQ ID NO: 99

SEQ ID NO: 6712 - RNA, 65 nt, Human; identical to SEQ ID NO: 247

SEQ ID NO: 6713 - RNA, 80 nt, Human; identical to SEQ ID NO: 100

SEQ ID NO: 6714 - RNA, 77 nt, Human
cguggaccuucccuguggccuguacccgucccucaacagagacaggcaauuaccagcgcccaggcuguuguccgacg

SEQ ID NO: 6715 - RNA, 77 nt, Human
uaucuuaguguuauuucacagcuaacauucauuuaauacauuuuauugacaaugaugaugugucagacgcuguucua

SEQ ID NO: 6716 - RNA, 64 nt, Human
uuccugcaacuaaaggcauauuuaaaauauuguagcaauuuagauucuccagauaguguaggaa

SEQ ID NO: 6717 - RNA, 63 nt, Human
gggggaacuggagcaggcucugauaagggaauaaacuuguuaaaggaaacauccagggccccu

SEQ ID NO: 6718 - RNA, 83 nt, Human
uucagcauaacguuuauggacaaaauguauauaguauaucuuauauucuauauguauuuuaucacauaguaaggaaugcugag

SEQ ID NO: 6719 - RNA, 100 nt, Human; identical to SEQ ID NO: 698

SEQ ID NO: 6720 - RNA, 60 nt, Human; identical to SEQ ID NO: 2705

SEQ ID NO: 6721 - RNA, 72 nt, Human; identical to SEQ ID NO: 1989

SEQ ID NO: 6722 - RNA, 78 nt, Human; identical to SEQ ID NO: 99

SEQ ID NO: 6723 - RNA, 65 nt, Human; identical to SEQ ID NO: 247

SEQ ID NO: 6724 - RNA, 80 nt, Human; identical to SEQ ID NO: 100

SEQ ID NO: 6725 - RNA, 64 nt, Human; identical to SEQ ID NO: 696

SEQ ID NO: 6726 - RNA, 100 nt, Human; identical to SEQ ID NO: 698

SEQ ID NO: 6727 - RNA, 60 nt, Human; identical to SEQ ID NO: 2705

SEQ ID NO: 6728 - RNA, 72 nt, Human; identical to SEQ ID NO: 1989

SEQ ID NO: 6729 - RNA, 62 nt, Human
cucggggaggccgccgggccggccuccgagacuccggcgggcaccgagucgccucacucgag

SEQ ID NO: 6730 - RNA, 65 nt, Human
gaccaccaggcuguuguguacaauguuugaaagacuuuaauuuguaccaguuaccuuugugaguc

SEQ ID NO: 6731 - RNA, 88 nt, Human
ucuuuaguguuuuuuguuguuucugauaguaacucacuucucucucaccugaaguuaaaauucuggagaagcgacauaucauaaaaga

SEQ ID NO: 6732 - RNA, 80 nt, Human; identical to SEQ ID NO: 353

SEQ ID NO: 6733 - RNA, 62 nt, Human
gcuggggagagcccccucggggggcaucggucaagcugcugaacccccugcucaccgccagc

SEQ ID NO: 6734 - RNA, 66 nt, Human
aguugaaaaagaagaagaaauaaauggcaaagagaaaguuuuuucaaauuucuuucuuuuuuaauu

SEQ ID NO: 6735 - RNA, 63 nt, Human
auccuucuuuuucucuuuugcccacaauuuaagcaaguagaugugcagaagaaauggaaggau

SEQ ID NO: 6736 - RNA, 102 nt, Human
gaaacagacugggccaauguccacaaagaauuccuggucagcaccaccgauguccaaaggugcauuuucaaggaagggcaggcgugauggcuuauuuguuuu

SEQ ID NO: 6737 - RNA, 102 nt, Human; identical to SEQ ID NO: 3952

SEQ ID NO: 6738 - RNA, 74 nt, Human; identical to SEQ ID NO: 365

SEQ ID NO: 6739 - RNA, 102 nt, Human; identical to SEQ ID NO: 2172

SEQ ID NO: 6740 - RNA, 77 nt, Human; identical to SEQ ID NO: 3082

SEQ ID NO: 6741 - RNA, 80 nt, Human; identical to SEQ ID NO: 367

SEQ ID NO: 6742 - RNA, 72 nt, Human; identical to SEQ ID NO: 3662

SEQ ID NO: 6743 - RNA, 74 nt, Human; identical to SEQ ID NO: 365

SEQ ID NO: 6744 - RNA, 75 nt, Human
ucaguuaauaaagaagaagaagaaauggcaaagagaaaguuuuuucaaauuucuuucuuuuuuaauuuagauuga

SEQ ID NO: 6745 - RNA, 123 nt, Human
ucauuuauuugaaacagacugggccaauguccacaaagaauuccuggucagcaccaccgauguccaaaggugcaauaucaaggaagggcaggcgugauggcuuauuuguuuuguauucaauga

SEQ ID NO: 6746 - RNA, 130 nt, Human
aguccaggacuguuuuccuacagcgugccucaaaaguguuguagagggcaggauucuacauucacagccuguuccaucuacgagauuuuccagaugcuacuugugguagacauuccuaacucaugguacu

SEQ ID NO: 6747 - RNA, 77 nt, Human
cuuaaguguguuuugugugugugcccacacguagacaaauguguacggugcacacacacagugcaucauuuuuuaag

SEQ ID NO: 6748 - RNA, 68 nt, Human
ccgccgcucaggguuuuuagaacuucagccauaaaaaugggcagaauuuuccuugaucauaucggugg

SEQ ID NO: 6749 - RNA, 66 nt, Human
cugagaagcacuguuuugaaaaagugcauuagacgauucuguucauauuuaugcagugccucugag

SEQ ID NO: 6750 - RNA, 70 nt, Human
acguucaucggcaucucaucaaucugaguggaauaguacugcucgauaucucugaggaugcggaugucgu

SEQ ID NO: 6751 - RNA, 63 nt, Human
uaucgaccugaucucccaauucuguguauguacaauucucuguuauuagggagaucauagaua

SEQ ID NO: 6752 - RNA, 65 nt, Human
cuggauucggaaugugcugauuuccauuggacucaaguugaucucacuuauauucugagugccgg

SEQ ID NO: 6753 - RNA, 76 nt, Human
auuacagguguaggccgcugugccagcugaguucacuuuuuaacaucugucugaggcggucaugagacacuguagu

SEQ ID NO: 6754 - RNA, 89 nt, Human
ggcccuucuguaauccaucccuugaguuuuuuuuuuuuuaaaugaauuuuuaauuuaaaaaauguauguauuggaauagagacaggguc

SEQ ID NO: 6755 - RNA, 61 nt, Human; identical to SEQ ID NO: 200

SEQ ID NO: 6756 - RNA, 63 nt, Human
cgucuccgaguuugcgacucgcggaccggcguccccggcgcgaagaggcuggacucggauucg

SEQ ID NO: 6757 - RNA, 76 nt, Human
ugugcccacagguugagaacuauguggcagauaucgagguggauggaaagcagguagaguuggcuugugggacaca

SEQ ID NO: 6758 - RNA, 66 nt, Human
ucuauaaaugcagauaugugugugcgcuucuauguauggaugcuuacauguacaugcauagguaga

SEQ ID NO: 6759 - RNA, 78 nt, Human
guaacucuucucuuguaccaggaagcagcuguaggugggguaaugggaucugucuccuggugcagaggggcagcuuau

SEQ ID NO: 6760 - RNA, 130 nt, Human
uggcccugacccagcucuucucccugguggcccucaacugccuucagccucagcuccagcuggggaggagggugaagagcagcuugagucagacugaggaaugcaagagaggugcuggccguccuuguca

SEQ ID NO: 6761 - RNA, 84 nt, Human; identical to SEQ ID NO: 286

SEQ ID NO: 6762 - RNA, 64 nt, Human; identical to SEQ ID NO: 287

SEQ ID NO: 6763 - RNA, 89 nt, Human; identical to SEQ ID NO: 288

SEQ ID NO: 6764 - RNA, 85 nt, Human
uggcggugggucaguggcagagggccaugguuuccauguuaaggaagcggacgugcaucuuggucucaaugucgauccccugcca

SEQ ID NO: 6765 - RNA, 85 nt, Human
uugggauuuaacuuuuuuaaugggucugaaaauucugugacaaauuuuuggucaaguuguuuccauuaaaaaguacugauuuuaa

SEQ ID NO: 6766 - RNA, 61 nt, Human
cuucaucuuggucaccacgccagagaggauccgcccucgaauggacacauuaccagugaag

SEQ ID NO: 6767 - RNA, 76 nt, Human; identical to SEQ ID NO: 758

SEQ ID NO: 6768 - RNA, 94 nt, Human; identical to SEQ ID NO: 1365

SEQ ID NO: 6769 - RNA, 63 nt, Human; identical to SEQ ID NO: 1366

SEQ ID NO: 6770 - RNA, 64 nt, Human
guagaggugagaacaaagcugcgugugugcaaaugugugugcugggcucagggacucacucugc

SEQ ID NO: 6771 - RNA, 63 nt, Human
ugucaaaaccucaaauucuugcuggggcaguuugugacaagaggcagggaugcuggaaugaca

SEQ ID NO: 6772 - RNA, 80 nt, Human
gacuccaccuucucccuggaccagcccgguggcacccuggaucugacccugauccgugcccgccuccaggagaaguuguc

SEQ ID NO: 6773 - RNA, 98 nt, Human
gagccugccuggugcuggccugaguucccaggagcugucugguggcccuggugauggccccugaggcuggagcccccauggccagcccagccuggcuc

SEQ ID NO: 6774 - RNA, 65 nt, Human
cuugccaguuucucccagcaggacccucuucuuguuuugaaagauggucggcugcuuuugguagg

SEQ ID NO: 6775 - RNA, 76 nt, Human; identical to SEQ ID NO: 758

SEQ ID NO: 6776 - RNA, 72 nt, Human; identical to SEQ ID NO: 2728

SEQ ID NO: 6777 - RNA, 65 nt, Human
ggggcugugguuaccucucucuucaugacaccccugugacguggugaagguucgccugcagucuc

SEQ ID NO: 6778 - RNA, 97 nt, Human
aagaaggcaaagacuggggccagcagggaaguuuaaaaggggaaaauaaauguguuuccccauuauaccuccuucaccccagaauauuugccgucuu

SEQ ID NO: 6779 - RNA, 76 nt, Human; identical to SEQ ID NO: 2936

SEQ ID NO: 6780 - RNA, 64 nt, Human
guucaguuccaaggagucccagcggggcaugggcuacaugccccaacguggccuggaggugaac

SEQ ID NO: 6781 - RNA, 72 nt, Human
acucugcuagcucaagauucacaauguugaaagcccuuuuccuaacuaugcugacucuggcgcuggucaagu

SEQ ID NO: 6782 - RNA, 66 nt, Human
gaagcucugagacaugugagaaggucuaguauucuacuagaacuggaagauugcucuccgaguuuc

SEQ ID NO: 6783 - RNA, 65 nt, Human
auggauuaauagaguuggaguuuuauuuuuaagaaaaauucacaagcuaacuuccacuaauccau

SEQ ID NO: 6784 - RNA, 62 nt, Human
acuauuaugaucaaggauauggaaauuacaauagugccuaugguggugaucaaaacuauagu

SEQ ID NO: 6785 - RNA, 92 nt, Human
aggaggagauguuaaaguaacccaucuugcaggacgacauugaagauuggucuucuguugaucuaagaugauuauuuuguaaaagacuuucu

SEQ ID NO: 6786 - RNA, 92 nt, Human
aggugcaaggacguguugaacuagcucucugcagccuccuuggaggaugugauccuaugggagggguaggaguauucagguccuugacaucu

SEQ ID NO: 6787 - RNA, 82 nt, Human
gcaucgcaggcuuaucuugcauuuugauuuuaugauucugauauucauguugaugucaugcuguaugauucuauugcuuugc

SEQ ID NO: 6788 - RNA, 94 nt, Human
gggcucggcgcuggcggcaguggcgagcggcggagaccucuucccggggcagccgguguccgaacugaucgcgcagcugcugcgcgcugagccc

SEQ ID NO: 6789 - RNA, 66 nt, Human; identical to SEQ ID NO: 1983

SEQ ID NO: 6790 - RNA, 64 nt, Human
cccuagccuugcuuguuaaauuuuuuuuuuuuuuuuuuuuaagaauuucugggaaggguacugg

SEQ ID NO: 6791 - RNA, 70 nt, Human
ggaaguagcucuuuuuuuguuuuuuguuuuuuuuauugggagagaagcgggguuauaaagagagucuucc

SEQ ID NO: 6792 - RNA, 107 nt, Human
uggugcugacuauccaguugaugggcugccagaucuggggcaugcccaggaccucauggaugggcugccuccaggugacagcaaucagcuggccugguuugauacug

SEQ ID NO: 6793 - RNA, 67 nt, Human
agaauuucuacagacauacgcaguaggucuaugccaguccuuuugugaacuuuuaacggaaauuacu

SEQ ID NO: 6794 - RNA, 92 nt, Human
ggccgucgcgacucuggccucugaaacacuaccacugcuggcgcugaccuucaucacagacaacagccugguggcagcgggccacgacugcu

SEQ ID NO: 6795 - RNA, 105 nt, Human
gguggcacggcugcgggcgcgggccuagacucgcugcacaaagaacagcgucagccagaucucggugcucagcggcggcaggccaagugcucgcaguucugcacc

SEQ ID NO: 6796 - RNA, 74 nt, Human
uaagguuagaaaucauauaucuguauaaucuacaaugaagcuguagauagucuacauuaugauauucuaucuua

SEQ ID NO: 6797 - RNA, 69 nt, Human
caggggacagucaaggauguuuugaguguacuguuucuaccaacaaaaacuaaaaacaaaugucaacug

SEQ ID NO: 6798 - RNA, 63 nt, Human
ggaaaaugaacacuuaaauugugguauacucacacagaauacuauagagcaaguaaaccaucc

SEQ ID NO: 6799 - RNA, 65 nt, Human
ucagacacuguauguagaaagcuucaaaaaaugaaacaguauguuuggagaacauacauguguga

SEQ ID NO: 6800 - RNA, 71 nt, Human
caguaauuaauauuaggaaacauuacagcccuuaaccuagauuaauauguauaccugguauuaauaaaaug

SEQ ID NO: 6801 - RNA, 82 nt, Human
caucugggacuugaccaaaguuguucuguuuuguuuuuuuaacugaaaguaacagaaggaccuuucuuaaaugugacagaug

SEQ ID NO: 6802 - RNA, 80 nt, Human; identical to SEQ ID NO: 509

SEQ ID NO: 6803 - RNA, 119 nt, Human
gggagcucuuugcucaggcaccaguagaacaauauccugguauugcuguggagacggugacagauucuagccgcuacuauguaauccggauccaggaugguacugggcgcagugcuuuc

SEQ ID NO: 6804 - RNA, 71 nt, Human; identical to SEQ ID NO: 510

SEQ ID NO: 6805 - RNA, 83 nt, Human
agggcaggggagagcaaggggcuuuggggucgaccuccugggggaggguagcccuggggccccgcugugcccucacucgcccu

SEQ ID NO: 6806 - RNA, 87 nt, Human
gggccgucggggccaucucccucccggagucgcuggccagucagcucccucuugaacuccagggggaaggcccucgccgacucgucc

SEQ ID NO: 6807 - RNA, 68 nt, Human
ccaaaaaacagcauaagaauuaaaaacaguuauauuccaauguuuuuaauacuugguucacauuuugg

SEQ ID NO: 6808 - RNA, 62 nt, Human
ccugcccagaaauaaaagcuuuguucugagagaaauugaaaagcuggaaaauauggaguagg

SEQ ID NO: 6809 - RNA, 70 nt, Human
gaugcucuccccagggauccgacggcgcugcggaggcggcagcgauguaugggauccuaaagaaagcauc

SEQ ID NO: 6810 - RNA, 63 nt, Human
gcugcagguugccccaccgagggcauuuuuccgcaccgagggggcggggggcagaaugcacgc

SEQ ID NO: 6811 - RNA, 73 nt, Human
aggggguggggggucuguugggcaacuggggugaagggauugcccucccccugcugggauccccccagccccu

SEQ ID NO: 6812 - RNA, 60 nt, Human
ggccagccggagggccuccaggucccgccgcagcgccuggcgcucagccuccagcucgcc

SEQ ID NO: 6813 - RNA, 68 nt, Human
ggucuggcaggaagggggcagccugcaacccccaagggcagguguggggcugccacagccgcuuggcc

SEQ ID NO: 6814 - RNA, 101 nt, Human
aggcuguggacggggaggagcugcacgauggaacccgugugaggugucuucugggaccuugccggccucccgggccagcugccccagccuuguccaugccu

SEQ ID NO: 6815 - RNA, 111 nt, Human
gccagcgccccuacgcaacguggaguacuaccagagcaacuauguguucguguuccugggccucauccuguacuguguggugacguccccuauguugcugguggcucuggc

SEQ ID NO: 6816 - RNA, 74 nt, Human
agcaaaaggaugggguuccuaacuuugauuucuaaggacuuuuaggcuucucauauaaggccccguuuuaggcu

SEQ ID NO: 6817 - RNA, 106 nt, Human
ggagaaacagacaggaggggggaaggaaccaaacuguuuucuaaggaucgguugucugcaugaagaaauuucgguuucccuccaaccgcccccuccucgauucucc

SEQ ID NO: 6818 - RNA, 69 nt, Human; identical to SEQ ID NO: 528

SEQ ID NO: 6819 - RNA, 65 nt, Human
ggacgugugaaggagcacggggagcacgacucgaauaccacucccgaaggauccgcacgcagucc

SEQ ID NO: 6820 - RNA, 72 nt, Human
gggaagggguggcgcgauaagugaggcgggacgacuuagccguuucagcgugauccgugcgcaucccucucc

SEQ ID NO: 6821 - RNA, 65 nt, Human
cccuugguuccagcgucauggaucaugucugcuugguccgagugagccgcguguggaaccaaggg

SEQ ID NO: 6822 - RNA, 71 nt, Human
cuuuauaaaaugaucuaacuacuuauauuugugcugcaucgcguuacaucuguuuuuauuucacuaugaag

SEQ ID NO: 6823 - RNA, 87 nt, Human
ucuuugaguaaaugaagauucagacuuuguaauauuauugcccuuaagugcaaugcuaaaaaaaacguugauuuucaagcuuagaga

SEQ ID NO: 6824 - RNA, 76 nt, Human
ugcaguuagugggugauuugcuauuuuucuuaguaguuaaaaaauggaacuaaauagugaauauacauacacugca

SEQ ID NO: 6825 - RNA, 83 nt, Human
cagccaguaagugguggagaauuguacaaugaggugccgggcacggugguucaugccuguagucccagcacuuugggaggcug

SEQ ID NO: 6826 - RNA, 98 nt, Human
ccacggcggcggcccugggagcagagguggagcgaccccauuacgcuaaagaugaaaggcugggguuggcuggcccugcuucugggggcccugcuggg

SEQ ID NO: 6827 - RNA, 85 nt, Human
ccgggacaccccguguguggcaggcggcgaagcgcucuggagaaucccggacagcccugcucccugcagccagguguaguuucgg

SEQ ID NO: 6828 - RNA, 103 nt, Human
ugaggcaggagaaucacuugaacccgggagguggagcuugcggugagccgagaucgcgccauugcacuccaggccugggcaacaagagugaaacuccaucuca

SEQ ID NO: 6829 - RNA, 76 nt, Human
cccgcggggcccgugacuggugcugggcuucagccaugaagacccucauagccgccuacuccgggguccugcgcgg

SEQ ID NO: 6830 - RNA, 104 nt, Human
ggaccugcagcugucgcgcgaggggucugggagauggggccacuggauccagcauccucuccguacuccaggaccucuucucugucaccuggcucaauaggucc

SEQ ID NO: 6831 - RNA, 87 nt, Human
gguggaaaagcauguacaggucaucucagugcuccaguuggguacuaguccuuccuuguacugggaguggccugcagugccauccuc

SEQ ID NO: 6832 - RNA, 61 nt, Human
gagguacuagguuuugacaagcuugcaucaugcgugaguauaagcuagucguucuuggcuc

SEQ ID NO: 6833 - RNA, 79 nt, Human
gccuuuugcuuuugauuuuaauauaaauacuuauuuuagcuuuauaaguuauugaauguuugauacaaaggauggaggc

SEQ ID NO: 6834 - RNA, 75 nt, Human
gcgaggcugaacgccugacgucaaggcgacaucgccaaaccucgcccagauucaggcguguaaaccagccggagc

SEQ ID NO: 6835 - RNA, 76 nt, Human
cggagaugccuacauagaagagugacagcagcuagacuaaauguuuaacugcugaacuaguuccucagguauccug

SEQ ID NO: 6836 - RNA, 74 nt, Human
ggagcccgcagcggaggaggggccgcgggcgggaggcgcugcgaggcgcugcuggcccucgggcugcgggagcc

SEQ ID NO: 6837 - RNA, 65 nt, Human
ggcccucgggcugcgggagccgggcuaggacgccgagcggugacuccccgccgcucccgggggcc

SEQ ID NO: 6838 - RNA, 62 nt, Human
ugggagauuggaugacuguuacagauccaggucugucuucaggaaagcaaaacuaucucuca

SEQ ID NO: 6839 - RNA, 81 nt, Human
gccuuuguacccaaugacgguugcuugaacuuuauugaggaaaaugaugaaguucugguugcuggauuuggucgcaaaggu

SEQ ID NO: 6840 - RNA, 78 nt, Human
ggaguugaagccaaacagccaaauucugccauuaggaaguguguaaggguccagcugaucaagaauggcuuuaaaauc

SEQ ID NO: 6841 - RNA, 101 nt, Human
uacuuuguuugacuuggugaacuuaauuugcauuuaugccauuauaccuccuaauuuuuagugaaauucaaaaagaccucaccaaucauacuaacaaggua

SEQ ID NO: 6842 - RNA, 64 nt, Human
cuucuucagcagcccaagcugucaggaucucuuaaguuuuugggacauuuauaugcugcagaag

SEQ ID NO: 6843 - RNA, 61 nt, Human
ucacugaugucuccuuagggaucucuucaaaugagcaggaccaaggaucagacaaagguga

SEQ ID NO: 6844 - RNA, 73 nt, Human
gcucacaaucucugucaucggcugauccaaccguuccuugagcuuggcagcuggcaugaagaaggaauagagc

SEQ ID NO: 6845 - RNA, 65 nt, Human
gcuugcucuaguagccggucugcagaaggaacugucauaguuucacugcccggagguuggagugc

SEQ ID NO: 6846 - RNA, 91 nt, Human
cugcaucugccuccugcggggccuggacagggagggggccagaccacagcggacccuccuccggucauugugcgggccucugaggcugugg

SEQ ID NO: 6847 - RNA, 97 nt, Human
gauggguuggggcgguucuuagagcugagucuuggggccaagggucccugggucugggcugggagacucagucagaaauagguauugcuuauccauc

SEQ ID NO: 6848 - RNA, 67 nt, Human
gggaacucccucggagugccaggaaaggucugucaggcuccucuccgaaguggccauccgagguccc

SEQ ID NO: 6849 - RNA, 69 nt, Human
acuagagaccauccgcucagugggcuacuacagaaacaucuaucagcccccugagggcaaugccucagu

SEQ ID NO: 6850 - RNA, 85 nt, Human
ccuaugacgagacggcaggcaugcugaagaccaucaaccuacagaaugagggcuucaccugcaccauccgcuaccgucagauugg

SEQ ID NO: 6851 - RNA, 76 nt, Human
cuggccgcagggugauauacaaguauggcaaacugucaaagcuggcagagacgcucuaugacaccaccaaggucag

SEQ ID NO: 6852 - RNA, 76 nt, Human
gcagacaaaaugaaagaaaaugagagcagaaaguaagcauuuccagccuaucuaauuucuuuaguuuucuauuugc

SEQ ID NO: 6853 - RNA, 62 nt, Human
gucauuuuggguugccgugcucccaaaacauuuuaaaugaaaguauuggcauucaaaaagac

SEQ ID NO: 6854 - RNA, 63 nt, Human
uaauccuguauauaaaauaaaaaguccacaaugaguuuggggcauauuuuaauggauggauua

SEQ ID NO: 6855 - RNA, 69 nt, Human
gcgcuuccgcaaguuccugguguuuguggcaaacuucgaugagaaugaccccaagaccuuugagggcgu

SEQ ID NO: 6856 - RNA, 63 nt, Human; identical to SEQ ID NO: 722

SEQ ID NO: 6857 - RNA, 60 nt, Human; identical to SEQ ID NO: 723

SEQ ID NO: 6858 - RNA, 86 nt, Human
cgggggaguuguggugcuucugggucucugggccccgccugcuggccugggaugcccucauguugggaagcauuccgugccccccg

SEQ ID NO: 6859 - RNA, 67 nt, Human
gauugaccucccugaagcccaagccaaucugucccagcuccgggaucacuugggacaggaggucauc

SEQ ID NO: 6860 - RNA, 61 nt, Human
ggcguugaccggcgagaaccuggagcagcugcuguugcaccugaaggugcuguaugacgcc

SEQ ID NO: 6861 - RNA, 79 nt, Human
cucgagcggcucgagguggugcuggcugaaggcauccgugcgaaggugcuuucgggguccgcugcugcugcucugugag

SEQ ID NO: 6862 - RNA, 76 nt, Human
guccgggacucagggacuugguggccacgcagcuguccauagggagguugaaugguugcugcacuuugguccggau

SEQ ID NO: 6863 - RNA, 66 nt, Human
cggcaggcagccagcgaggccugcuucuacaacuccgacuacguggcagcccgugggcgccuggcg

SEQ ID NO: 6864 - RNA, 63 nt, Human
uacuuagaguaguaugagcaagcaugggcgccccaaacuuccauacuucacgcuaucuaagug

SEQ ID NO: 6865 - RNA, 79 nt, Human
ucgaugagcacgaugcaauucuucaccagggucuugguacgaaccagcucguuauuagaugcauuguagacaacaucga

SEQ ID NO: 6866 - RNA, 80 nt, Human
aggccuccccucuauccuuaucugucuggucgagucauuccgggccgagugggcaccaucaugggacgggcaggaggucu

SEQ ID NO: 6867 - RNA, 105 nt, Human
gugguuacguuuuccacaggguaaugcauuugcaaggacaucaauccucuuccucuggguggcucucuuugauggaugcauuuccaugaugaaaugacaaggcac

SEQ ID NO: 6868 - RNA, 88 nt, Human
gcaggguucucagcagugaugggagggcaggggaagagauguaaaggcuuugagacuggguucccaucgcuggaaaagaaggcucugu

SEQ ID NO: 6869 - RNA, 67 nt, Human
uugauagaaaauuuguccucaguuguagguuacucuuaaagcagcuuagauugcauguuuucuucag

SEQ ID NO: 6870 - RNA, 66 nt, Human
guggaagugggcuacaacguaguacgugucguggaguacgaugucgagugaugaguuugcuaauac

SEQ ID NO: 6871 - RNA, 85 nt, Human
auuaaucucuuuauccauugcugaacgacugugacuauucaguaacgaaguaauaguaauuaauuaguaugguauaaucuuuaau

SEQ ID NO: 6872 - RNA, 63 nt, Human
gaaucgucucacccgcaguaaccacugaacgucaaucagcccuccaugggguucuuucgauuu

SEQ ID NO: 6873 - RNA, 82 nt, Human
uggugaaguauuuuguuaccucagucuuguaucaaguugcuguauuuuucagcuuguuacauugauaauaauuauuucacua

SEQ ID NO: 6874 - RNA, 69 nt, Human
gcaggcgcagugagucagugccggucggucuugugggcugaggggcagcggcuuagcuccggcgucugc

SEQ ID NO: 6875 - RNA, 79 nt, Human; identical to SEQ ID NO: 5273

SEQ ID NO: 6876 - RNA, 66 nt, Human; identical to SEQ ID NO: 5275

SEQ ID NO: 6877 - RNA, 66 nt, Human
cccugaagccgagaaauguggaaaagcgagauugucuuugaccauuugcuauggacauugucaggg

SEQ ID NO: 6878 - RNA, 73 nt, Human
ccugaaugagaaugucugcgguauuucccgaaauaaguaucccucaaggaugauacuguggaccucacucagg

SEQ ID NO: 6879 - RNA, 90 nt, Human
gaaaggaucaggcuucccuaugaacugcagaaaaugccuaauggaagugcaggaguucaggugcgguacuuagaggaagagagaccuuuu

SEQ ID NO: 6880 - RNA, 71 nt, Human
ucgagaccaucgccaaugaguacagcgacagguguaccccggccuguauaucauugggaucaagaacucga

SEQ ID NO: 6881 - RNA, 70 nt, Human; identical to SEQ ID NO: 4167

SEQ ID NO: 6882 - RNA, 64 nt, Human
aacuuaaacgaaaauugaacauucugacucgaccgaguggaauauuggugaacgauacuaaguu

SEQ ID NO: 6883 - RNA, 75 nt, Human
cccagaggagucgauuccgaagcccgucacacucgcuucaaggacgacgacggcgacgaggaggacgaaaauggg

SEQ ID NO: 6884 - RNA, 64 nt, Human
uacagauucuauucaugaacaaugcuauuucaaagcaauaucaucaagaaauagaggaauugua

SEQ ID NO: 6885 - RNA, 75 nt, Human; identical to SEQ ID NO: 74

SEQ ID NO: 6886 - RNA, 93 nt, Human
gcuguugggucguguaguugaugcccuugguaaugcuauugauggaaaggguccaauugguuccaagacgcguaggcgaguuggucugaaagc

SEQ ID NO: 6887 - RNA, 71 nt, Human; identical to SEQ ID NO: 77

SEQ ID NO: 6888 - RNA, 89 nt, Human; identical to SEQ ID NO: 504

SEQ ID NO: 6889 - RNA, 70 nt, Human
cagcaugcacacagcucucuguaccuuggccaggucuccaccaggcaccacagugggaggcugguaguug

SEQ ID NO: 6890 - RNA, 63 nt, Human
gcauuggugaucucugcuacagaaagcuguucaugguaggcuuucucagcagagaugacaggc

SEQ ID NO: 6891 - RNA, 68 nt, Human
ugccaaccuugaagccaguggggcaccaauccacaaacuggaugcugcgcuugguuuugaugguggca

SEQ ID NO: 6892 - RNA, 85 nt, Human; identical to SEQ ID NO: 3621

SEQ ID NO: 6893 - RNA, 130 nt, Human
augcuugucugauguuguacugagcagauacgaaggaguaggaaggagaaagaaugauucucgcacugucuuaaaauuccuaaugugucucugaccucagcaccuuaauuuuaaauaaucagaguugcau

SEQ ID NO: 6894 - RNA, 66 nt, Human
ggcucuauuacucaggauuggaauucugcugcccuugacuaaggcugccugccgcugagaugagcc

SEQ ID NO: 6895 - RNA, 70 nt, Human
acugugauucaugguaucaagacagugucuacuauauugauacccuuggaagaauuaugaauuuaacagu

SEQ ID NO: 6896 - RNA, 70 nt, Human
uuauuauuucgagaacaauuguagagcuaauacaccuguugcaauuggguuguuuuugauucaaugauaa

SEQ ID NO: 6897 - RNA, 85 nt, Human
uuuaacuaucaaguaagcuuagugaaaaucuccuuaauaugcaaaauaaucauguaagcaugggggauaagccuugguaguugaa

SEQ ID NO: 6898 - RNA, 70 nt, Human; identical to SEQ ID NO: 6185

SEQ ID NO: 6899 - RNA, 75 nt, Human
agggaguaaagauaaucugggcugcuccauaagacagaacaggguagcgggguacuaggcagauuuuagcaaccu

SEQ ID NO: 6900 - RNA, 95 nt, Human
uucagauucuuuucuacauguaugaugaugaagacaguuccuuaaugugaagaauucugucuguuaacauucagucagguuggaauggaucugaa

SEQ ID NO: 6901 - RNA, 95 nt, Human
ucaucaggcauggaacuaucaaaacgacuggcuucaaaaaacaaguuacucuuuacuugacauuugaaggggcgaugaccacuccugccugucga

SEQ ID NO: 6902 - RNA, 61 nt, Human
uccuuuucccauacucaauauaaaagacagcaguucuaagggaagaguagacagggaagga

SEQ ID NO: 6903 - RNA, 79 nt, Human
cacuggauggucuggauucgguucuuggcugggacaaacucgggcugaagcuucaauguggauucauaccacaccagug

SEQ ID NO: 6904 - RNA, 85 nt, Human
ccagagcuuggcauugugcaagauguuggccaggcuaaucaggggcacauccuucaucugguguggcgcauagugcagagccugg

SEQ ID NO: 6905 - RNA, 64 nt, Human
cccgccggccgcuuccgcucccggcgcaggcgcugcagcuuggccagagcggagggggcucggg

SEQ ID NO: 6906 - RNA, 65 nt, Human
cccguggaugugcaaguuguggagagaaggagcaccggguuccugcccagcacugugcuugcggg

SEQ ID NO: 6907 - RNA, 61 nt, Human
gaaggaggcacagaccggggaaauaugacagccgucauuuccaguucucuguguugucuuu

SEQ ID NO: 6908 - RNA, 98 nt, Human
gauguuaaggugaacuugucacuugguauguagguccgacucccaucccagagguggcagugggccuuggcucaagaucaaguuugaacuaaaauauu

SEQ ID NO: 6909 - RNA, 78 nt, Human
ggaggagaggcugguggucuugagcuuuuggccuggaauuccagucugaauuuucaaauauucccugccuccaacccc

SEQ ID NO: 6910 - RNA, 67 nt, Human
cucaacacuuaaauucauaaaauuaagaccauguaaggguauguuuuuagagaaauggaaguuugag

SEQ ID NO: 6911 - RNA, 71 nt, Human
gagagaaagauggucgucuccagcagagaaagugaacagcauuuguuggaaggugauggcucucccuccuc

SEQ ID NO: 6912 - RNA, 60 nt, Human
guaacguaaaguguauucuguacauaauuuacaaauaaaacauuuuauuuuaauuguuac

SEQ ID NO: 6913 - RNA, 79 nt, Human; identical to SEQ ID NO: 728

SEQ ID NO: 6914 - RNA, 73 nt, Human
uucagacccucgaggauucggucauaucggaauugcuguuccugauguauacagugcuuguaaaagguuugaa

SEQ ID NO: 6915 - RNA, 81 nt, Human
cgggcgcaggguguccgagccgcugccugugcuuccgcaccaccgugcgcugcaugcaucugcugcuggaggccgugcccg

SEQ ID NO: 6916 - RNA, 83 nt, Human
gagcgggcgugcauaugcgguggcgggugggguggaagggggagauccugcugcacuggccgccaaguaugaggggcgagcuc

SEQ ID NO: 6917 - RNA, 101 nt, Human
gggcgagcucgguggugacgcgcggcccucacgugacccagagcugcagagcgacgcagccuucggugcagucgucacucgcgucuggcuaccagcucccc

SEQ ID NO: 6918 - RNA, 61 nt, Human
aacucaguuucuaagguucucuggaguccccuuggucagcagagagucuguucacuugguu

SEQ ID NO: 6919 - RNA, 85 nt, Human
caugcuguuggauuggcaccugcugcacacgcuacagauccggggcuucaugcugcugacucuuugcuuguggccaguccccaug

SEQ ID NO: 6920 - RNA, 67 nt, Human
ggcugacauggcuuuagauccuguuuaugauuugguaucuuauugucacaaaguuguuccgucaguc

SEQ ID NO: 6921 - RNA, 62 nt, Human
cucaacacacuagcgcgcaguccgagagggccggagaucgggacucgcgccacugugauggg

SEQ ID NO: 6922 - RNA, 69 nt, Human
gggcggguggcguuccggcacuauugugaugaggcgccccucuaccuacaauaaccucgucgcccgccc

SEQ ID NO: 6923 - RNA, 74 nt, Human
ggugauagcgugcuuccgcacggcgagcccgcauaaaugauccgccgggcgauauacgagcgauguuuaucacc

SEQ ID NO: 6924 - RNA, 76 nt, Human
cagaucccggaaugccugaaccaacuguuuugagccuacuuuggggauaacaggauuauuuggucuucuggauuug

SEQ ID NO: 6925 - RNA, 64 nt, Human
cuauaugagggaggaccggauuuauacauuuccagaaugaagcccgggguuuaaccugguuuag

SEQ ID NO: 6926 - RNA, 87 nt, Human
gcugugguugcuguaagggguccucccugcgccacacggccgucgccauggugaagcugagcaaagaggccaagcagagacuacagc

SEQ ID NO: 6927 - RNA, 100 nt, Human
ugggacaucauucagucacuagguuggauggcacaaggcucuucacagacgcaucuguagcagaguggaucuuguacuaacuuaugauagaaguguauca

SEQ ID NO: 6928 - RNA, 81 nt, Human
aaaguccuacgugacugauuuuaaacauugugauaaaauuaauuuucaguauaauaguugaauguguuaagauaggauuuu

SEQ ID NO: 6929 - RNA, 71 nt, Human
aguaccguuuuugagguucaguccuuaaacauuugcuuuaagaaaacaggcuugaauuucacaaugcugcu

SEQ ID NO: 6930 - RNA, 72 nt, Human
gaaaauuuucucccuuuuccuuuuucuuaagaaugaacuuucuuggcccuggagaacaaaaaaaaaauuuuc

SEQ ID NO: 6931 - RNA, 68 nt, Human
gagaugggguuucaccauguuggccaggcucgucucgaacuccugacuucaggugauccacccaucuc

SEQ ID NO: 6932 - RNA, 95 nt, Human
aggggacaacugugcuggugcugucuuuugcaggauguguuuaccacaucuaaugcaacuauuuucagacuuuacaguuuguaguguuaaccucu

SEQ ID NO: 6933 - RNA, 89 nt, Human
auuuggaucaucuguugagacgggugcgugaaaaguacuugugggguggaggucacgcgcuugucgcucguaauuauagauguacggau

SEQ ID NO: 6934 - RNA, 70 nt, Human
gcccgcucauaaggggauggccauggcuagguuuauagauaguugggugguugguguaaaugagugaggc

SEQ ID NO: 6935 - RNA, 63 nt, Human
guugucgugcagguagaggcuuacuagaagugugaaaacguaggcuuggauuaaggcgacagc

SEQ ID NO: 6936 - RNA, 71 nt, Human
gucuggaccugggacccacugcagauuauguuuuuccugacuuaacugagaaggcagguuccauugaagac

SEQ ID NO: 6937 - RNA, 71 nt, Human
caucuccuacaauaggaaguaagguagaagagauagugauuaauaauacacguuuccuaaugugggauaug

SEQ ID NO: 6938 - RNA, 89 nt, Human
uuagaaaggcuaguuuuagcuuccuuuguggcucccuggugcaaaacaauuagcaguuaugcaauggaccugauucuaguuuauucuaa

SEQ ID NO: 6939 - RNA, 76 nt, Human
caaagcgggccgcccgagcguccacuccaagccugagcauccacacaauuccagugggcccucggugccugcugug

SEQ ID NO: 6940 - RNA, 84 nt, Human; identical to SEQ ID NO: 286

SEQ ID NO: 6941 - RNA, 103 nt, Human; identical to SEQ ID NO: 294

SEQ ID NO: 6942 - RNA, 65 nt, Human
gaggugauugggggagcagacaaguaccacuccgugugucggcucugcuacuucaagaaggccuc

SEQ ID NO: 6943 - RNA, 64 nt, Human
gauaugcuauaguuuagagucucauuaggaagcgcuaccguucaugcuuuacucugugcaucuc

SEQ ID NO: 6944 - RNA, 120 nt, Human
gguggggaccccgggccgcauccuggcgcucgugcggaauaggagcuucagccuaaagaaugugaagcacuuugugcuggacgagugugacaagaugcuggagcagcugggcuccccucc

SEQ ID NO: 6945 - RNA, 65 nt, Human
aaacuauguacaagcuacaaaauagcaucucuuucaugguauguuugaguguguaauuuuaguuu

SEQ ID NO: 6946 - RNA, 82 nt, Human; identical to SEQ ID NO: 5380

SEQ ID NO: 6947 - RNA, 60 nt, Human; identical to SEQ ID NO: 723

SEQ ID NO: 6948 - RNA, 93 nt, Human
ggccaugugagccaccgcugccagcacagagcguccuucccccuguagacuagugcccguaggacguaccuguugccccagcugacuguggcc

SEQ ID NO: 6949 - RNA, 75 nt, Human
uggaaagcggaguuccuaacaggauaaaaguucccccaucaguucccccaguaccuccaagcaaguagcuuucca

SEQ ID NO: 6950 - RNA, 63 nt, Human
ccgggucacccugguuugugaguugccccgggaccauucaccauggaccuuauggagaucugg

SEQ ID NO: 6951 - RNA, 60 nt, Human; identical to SEQ ID NO: 5112

SEQ ID NO: 6952 - RNA, 63 nt, Human
caucacgccagucauuuuauuuccaucaucauccuugugaagaaauggaagucuggagaggug

SEQ ID NO: 6953 - RNA, 66 nt, Human
gcauuuuccaaagcaaacccaacccucgugauuauuucuagccagggugaagcuaaggaagguagc

SEQ ID NO: 6954 - RNA, 73 nt, Human
aaaugagaguggccacaagucuucuacagucuccuuagagagcucuagagggguuggaugguccuauuuauuu

SEQ ID NO: 6955 - RNA, 92 nt, Human
cuuguacccugaaaucuucugcugucccaccuugacugccccaaacuuggacugucucagccuugccaggguuauaguaggcaggucacagg

SEQ ID NO: 6956 - RNA, 68 nt, Human
cuguaaucccagcuacucgggaggcugaggcagaagaauugcuugaaccugagaggcggagguuacag

SEQ ID NO: 6957 - RNA, 62 nt, Human
guggguccagggggccaaugcuaguauagaggcugugaaggcccugaacucugggagcccac

SEQ ID NO: 6958 - RNA, 68 nt, Human
uaaacaaagaagcagguggugaggacgugcuggucaaaaggaagcagucacaucaaguguuuaguuua

SEQ ID NO: 6959 - RNA, 111 nt, Human
gccugacccuuaacgcccucggagcggccuucuuauuuuucuugaugauguugaugccccacgggguuuugggggcugcagcacugucauccuugcucccugcgggcaggu

SEQ ID NO: 6960 - RNA, 89 nt, Human
gcuucuugcugaucagagcuugguuggcacagccgggguccucgcccucggcccugcuguucucccggaucgcucugauccagcccagc

SEQ ID NO: 6961 - RNA, 80 nt, Human; identical to SEQ ID NO: 4151

SEQ ID NO: 6962 - RNA, 61 nt, Human
gcuagagcugagcgaagcgaugccuaaaucaaaggaacuuguuucuucaagcucuucuggc

SEQ ID NO: 6963 - RNA, 79 nt, Human; identical to SEQ ID NO: 4153

SEQ ID NO: 6964 - RNA, 92 nt, Human
ggcuguuucacaggccuggccacgcucucacggaaccacuggcaucagauggugaagugacugcuacccgguugccaucuguugaacagacu

SEQ ID NO: 6965 - RNA, 84 nt, Human
ugcuggcuuuuauguaugauaccuaaucagagcauugaccagaaaaauugaaaguguucugaggcacauagcagaggagcugca

SEQ ID NO: 6966 - RNA, 61 nt, Human
uuuccugcuuguauuggcguauaucguuccuccugagcagcaacccacaguagguaggaaa

SEQ ID NO: 6967 - RNA, 112 nt, Human
aggcucugagcagucaggguggaugggaaguggggggccauugccuucucggaguucaggacagaagguucuggccuccugucuuagccuuccugggcugugucuggagccu

SEQ ID NO: 6968 - RNA, 91 nt, Human
guuagaguugaggguacugaggcccaaggcuguccugcuccaugucacccaguuggucagggggcugcuggcugagccccaaugcucugac

SEQ ID NO: 6969 - RNA, 65 nt, Human
cguggagcugggccgaaccacguguaccaagacccagcccaacuuggacaacugccccuuccaug

SEQ ID NO: 6970 - RNA, 123 nt, Human
caguucacccaggcccuggaccgccaaacagcuacucagcugcuuaagcuggcccacaaguacagaccagagacaaagcaagagaagaagcagagacuguuggcccgggccgagaagaagcug

SEQ ID NO: 6971 - RNA, 60 nt, Human; identical to SEQ ID NO: 2705

SEQ ID NO: 6972 - RNA, 72 nt, Human; identical to SEQ ID NO: 1989

SEQ ID NO: 6973 - RNA, 95 nt, Human
cgcgggcuagggagcgugggauuccggacugugagcggcuguuagugcgucgcagcugcuggcgauccggcgacccucggccggcaggacccgcg

SEQ ID NO: 6974 - RNA, 71 nt, Human
gagcuggaggagcucacggugcagguggcccgggucuauaaugggcggcucaaggugcagcgccucugcuc

SEQ ID NO: 6975 - RNA, 61 nt, Human
gcccgccaagggaacugaaaaaaaaccgaaagaaagcuuuucaaaaauuaccguggggggc

SEQ ID NO: 6976 - RNA, 69 nt, Human
caaauugcgcuuaagaaaaauacuacgagaauugagaauuuuuuaacguaacuuccuaaguguaagaug

SEQ ID NO: 6977 - RNA, 70 nt, Human
gggagaagggggcgagccugcgggcggaagaggaagcaaggcccucuuccuccacgucucaccccagccc

SEQ ID NO: 6978 - RNA, 63 nt, Human
gggccaucggcuggccugccagauccccaacacaaaggacacgaggauacgcagcaagagccc

SEQ ID NO: 6979 - RNA, 110 nt, Human
guguugaccguuccucuccccuguacauagcccgagccaguccugagugggugacuccugagugggugacgcgcagacgggauuucucaggucauuuguauggucgacau

SEQ ID NO: 6980 - RNA, 76 nt, Human
accaaggacacugaccccaagcuguccugccuagcguccagcgucuucuaggaggguggggucugccuguccuggu

SEQ ID NO: 6981 - RNA, 66 nt, Human
ggcugguugccucaagcucuucucugccucauaaacggauccagagaaggcugguugccuuaagcu

SEQ ID NO: 6982 - RNA, 82 nt, Human; identical to SEQ ID NO: 6291

SEQ ID NO: 6983 - RNA, 87 nt, Human
ccucuggcccuuccugggcaucguggcugaggugcuggugcugggucaccaucaucuucaucuacgagaagcgccggaagcccgagg

SEQ ID NO: 6984 - RNA, 121 nt, Human
gcuggaggacugcuucaccuuccugggcaaucuuccuggccaucauccucuuccccuuuggguucauuugcuguuuugccuugaggaagcgacgaugccccaacuguggagccaccuucgc

SEQ ID NO: 6985 - RNA, 64 nt, Human; identical to SEQ ID NO: 6321

SEQ ID NO: 6986 - RNA, 60 nt, Human
ugucucuucugguggagcugugccuggcccuguaggcccagguuuggcuggaaggugaca

SEQ ID NO: 6987 - RNA, 66 nt, Human
uuggagacgggaguggcccuucggcucccgagcucccucuggggacggcuggcucacugucuccag

SEQ ID NO: 6988 - RNA, 103 nt, Human
acgucuaacuaacuuaaaugaaguauaauaaaugaguucauaugaaaaggcuuccucuauggacacuuagauauauuguaacuauugaaguuaccugggaugu

SEQ ID NO: 6989 - RNA, 95 nt, Human
uccaguauugagaccaguucacuagaagaaacaaacauuucugccaugcagacccaaaaaguuauuaguuggugaauauguauuuucucuuugga

SEQ ID NO: 6990 - RNA, 76 nt, Human
uuaguuucaacaccagauugaaaugguuugccaucugcuucguauguggcguuuucuuuucuauucuuggaacugg

SEQ ID NO: 6991 - RNA, 71 nt, Human
ggucacgaccacggugcuggugaggagagaucaccauggagccaauuucucgugccgcacugaacuggacc

SEQ ID NO: 6992 - RNA, 61 nt, Human
cacucaccaccaacuaugcccccgggugaaugugccggaggcccuagaacaaggugaagug

SEQ ID NO: 6993 - RNA, 101 nt, Human
cuggugacggggccauggacugaagggugaccaaagugcauaguguguccucccacggagaacgcgccaaaggguagccccgggcguguccuguacggcag

SEQ ID NO: 6994 - RNA, 79 nt, Human
gggaggggugcgcagcaaugugcgugacaaaugacggacucugucuugaguguugcgccucggcuccggacccgcuccc

SEQ ID NO: 6995 - RNA, 87 nt, Human
cccagagccagagcugcuugugcgcugguaccagaugggugcuuaccagccauuacuuccgggcacaugcccacuugggacacuggg

SEQ ID NO: 6996 - RNA, 101 nt, Human
gccguguggacaggggacaacacugccgagugggaccauuugaagaucucuauuccuaugugucucagcuuggggcuggugggacuuuccuucuguggggc

SEQ ID NO: 6997 - RNA, 70 nt, Human
gccuugggccagcgauauucuuagguugccuucugguaaacccucuuauaucaggggccaucggaaaggc

SEQ ID NO: 6998 - RNA, 70 nt, Human
uccuggucaugaaggcccugugggugcagaacccucaggaugugaauaccuucaauauagaugaucagga

SEQ ID NO: 6999 - RNA, 71 nt, Human
caugaccacaguccaugccaucacugccacccagaagacuguggauggccccuccgggaaacuguggcgug

SEQ ID NO: 7000 - RNA, 78 nt, Human
ggucguaugggcgcuggucacaggcugcuuuaacucugguaaaguggauauugugccaucaaugaccccuucaugacc

SEQ ID NO: 7001 - RNA, 65 nt, Human
uggggcucauuugcaggggggagccaaaagggucaucaucucugcccccucugcugaugccccca

SEQ ID NO: 7002 - RNA, 130 nt, Human; identical to SEQ ID NO: 2385

SEQ ID NO: 7003 - RNA, 71 nt, Human
agcccaggugaccuucucugaggagucugcaguuccugagaggagcuggcgccucaggccauaccugggcu

SEQ ID NO: 7004 - RNA, 86 nt, Human
guaucugcagccauccugaaccccaguugccaggccugcgugagagcaguggcagcggcguggaggaagaccaugaaugcguguac

SEQ ID NO: 7005 - RNA, 61 nt, Human
cacagcaacucccuguuuccugcauauuucuugcaggucucugaagaugucgaugucugug

SEQ ID NO: 7006 - RNA, 69 nt, Human
aagguauaguaguugguggguaaauagaaacccuguuguacucuguugcugacuaauugugguuaccuu

SEQ ID NO: 7007 - RNA, 106 nt, Human
guggguacaaggaagccugguugaagucuuuuccuugagaggccuggauuuguucacauauucagauuucaacuggcuuuauaacagguuuccuuaugugccucau

SEQ ID NO: 7008 - RNA, 81 nt, Human
aggaagacacauagguggguuuauguuucaccucauuuggaacaaaagaggacagaagcagaccacucugugcaccaaccu

SEQ ID NO: 7009 - RNA, 83 nt, Human
cugaaguaugggugccuugaggaaaagcaguuacacaguugaguugcaagcugaauuggcuguguucaaggcaugcccuuuag

SEQ ID NO: 7010 - RNA, 68 nt, Human
cuguaauuccagcuacucgggaggcugaggcaagagaaucgcuugaauccgguagguggagguugcag

SEQ ID NO: 7011 - RNA, 70 nt, Human
agaccaaaacagacagacaaguccagcagaagcagaugcaccugacaaaaauggauguauuaauuggucu

SEQ ID NO: 7012 - RNA, 63 nt, Human
gagaauguuaucuagacagcagugcacuccccuaagucucugcucaaaaaaaaaacaauucuc

SEQ ID NO: 7013 - RNA, 65 nt, Human
aucagucuuaucaccuuucucuugguuuccauucauuugucucuccagagagugggaaggcugau

SEQ ID NO: 7014 - RNA, 64 nt, Human
cacuuguaauccccccuguacuuaccuacucacauuggagaguucugaggccggaguaacugug

SEQ ID NO: 7015 - RNA, 86 nt, Human
gaaauagaacaaaauaguaugugccguagguagcuuaagaaagucucagauauuuuguugcugaucaaauacuguuuuuuuguggc

SEQ ID NO: 7016 - RNA, 66 nt, Human
gcaaugccagguucaguagccguccccccggaaaggggugaccuuuaugcucgugcuugauguugc

SEQ ID NO: 7017 - RNA, 70 nt, Human
ccccaggaguccacugauuucucaucuuccucccaagaggcauuugcagcuucugcagugggcagugggg

SEQ ID NO: 7018 - RNA, 61 nt, Human
ucgaggagguggcccuguauucccagccccugucguuggcaguggaggggccacaucugga

SEQ ID NO: 7019 - RNA, 70 nt, Human
ugcucagaacacaugaagugcagcaccacagaacaaacgggagcccgaagcaggcacaaaugcaugagca

SEQ ID NO: 7020 - RNA, 65 nt, Human
ggguagguuuccuauuugaaacaguggaaucauguuuccagugauaaaguuuaaugaccucaucc

SEQ ID NO: 7021 - RNA, 66 nt, Human
gacuuguucaucuuguuuuuccuuggcuucaacagccuccaauucuucaauaaauguagccaaguc

SEQ ID NO: 7022 - RNA, 68 nt, Human
gauggacucuuucuuuuuaauguguccagcucuuguucuuuuucauuucuuagccugcagaguucauc

SEQ ID NO: 7023 - RNA, 75 nt, Human
uuuuucuuuucugccucugcuuucauuucuaugguuauucguggaaugacucuuugaccacgcggagaaggcaaa

SEQ ID NO: 7024 - RNA, 97 nt, Human
uuccggagcauaugauuagaguuggauuaguuaccacuggauggaacuaucgucuucucagguagcaaauuccucccuguaaaaaucuguuuaggaa

SEQ ID NO: 7025 - RNA, 75 nt, Human
ccaaucccagccaaagaaugcuccuguuaccuucauuguggauggagcaguagucaaguuuggccaggguuuugg

SEQ ID NO: 7026 - RNA, 65 nt, Human
ggagaccugaaggcauugaacgacaguacaggaagaaaugugcaaaguguggacugccgcucuuc

SEQ ID NO: 7027 - RNA, 101 nt, Human
uuuuucccgacccccuuuuuuuuuaaaaaaggggcccccaaaggggggccuuuuaaaaauuaggcccgggcccccuuuuuaaaacccgggggggggaaaaa

SEQ ID NO: 7028 - RNA, 62 nt, Human
gaaggaguuucuuccaaacuucaccaucuggauacugguguuucuuuacagauuccuccuuc

SEQ ID NO: 7029 - RNA, 69 nt, Human
gccuagacuuaggggcacuaguuucagaaaaaaaugaaacuauauauauuuccauguuuuuuccaaggc

SEQ ID NO: 7030 - RNA, 79 nt, Human
auucugaguuguuggugccugcccuuccccugaaucuaagaacugauuaguggguuagacugcaacagcagcucaggau

SEQ ID NO: 7031 - RNA, 74 nt, Human
gagcaaucaaagcguuaucugcaaagcaauucgcuucuuauugauuuugccauaaccacgcuuggagauaguuc

SEQ ID NO: 7032 - RNA, 73 nt, Human
ggacggaggcaauaaauacugauggccaagcggggcuccuggcugggcccaaguggggugggugaggcugucc

SEQ ID NO: 7033 - RNA, 80 nt, Human; identical to SEQ ID NO: 788

SEQ ID NO: 7034 - RNA, 62 nt, Human; identical to SEQ ID NO: 1277

SEQ ID NO: 7035 - RNA, 62 nt, Human; identical to SEQ ID NO: 4194

SEQ ID NO: 7036 - RNA, 67 nt, Human; identical to SEQ ID NO: 4195

SEQ ID NO: 7037 - RNA, 71 nt, Human
ggcaacgacguguuacccguggggaauuagcaggcgcucugaacgcaugcacggaggacacgcccauugcc

SEQ ID NO: 7038 - RNA, 74 nt, Human
gggggcgcgcuuuuuuacguuuccgcaaaagaccacccuuuucauccgcgggcaaacuauaggcguaugcuccc

SEQ ID NO: 7039 - RNA, 131 nt, Human
ugggggggcuuuccaaauuggagaaccaaucuuuccuuuccgcguuuggacucacuuuggcggcaccgcuaaccacaacgaggcggcgggaaugaggcgggugaggcaaccaauuuggggccccgaaccca

SEQ ID NO: 7040 - RNA, 88 nt, Human
ggagaaucacuugaacccgggaggcaaagguugcagugagcugagaucgugccacuguacugcagccugggagacagagugagacucc

SEQ ID NO: 7041 - RNA, 99 nt, Human
ggcaccucuagaaguauacgugugugucuccaaccaggugucagaagccagauauguuugacaaccacucugucuggaggccugcacacuuaugguguc

SEQ ID NO: 7042 - RNA, 61 nt, Human
ggccaucaccaugcaguucacuuuugcagugcccacuuuaaaggagugcugguggaugguc

SEQ ID NO: 7043 - RNA, 61 nt, Human
guccugcacaaucaaauccgugacacuggagcagugggcugugagcugcuuguugcaggac

SEQ ID NO: 7044 - RNA, 72 nt, Human; identical to SEQ ID NO: 3662

SEQ ID NO: 7045 - RNA, 68 nt, Human
gauggcuuauuuguuuuguauucaaugauugucucuccccauucauuugucuuuuuagagcagccauc

SEQ ID NO: 7046 - RNA, 90 nt, Human; identical to SEQ ID NO: 1501

SEQ ID NO: 7047 - RNA, 77 nt, Human; identical to SEQ ID NO: 2332

SEQ ID NO: 7048 - RNA, 64 nt, Human; identical to SEQ ID NO: 287

SEQ ID NO: 7049 - RNA, 89 nt, Human; identical to SEQ ID NO: 288

SEQ ID NO: 7050 - RNA, 85 nt, Human; identical to SEQ ID NO: 866

SEQ ID NO: 7051 - RNA, 62 nt, Human
gaggcgggcagaucacgaggucaggagaucgagaccauccugacacggugaaacccugucuc

SEQ ID NO: 7052 - RNA, 72 nt, Human
gucuucuaugaaaaggcugauaaugggcugggcgcgguggcucacgccuguaaucccagcacuuugggaggc

SEQ ID NO: 7053 - RNA, 72 nt, Human; identical to SEQ ID NO: 3662

SEQ ID NO: 7054 - RNA, 74 nt, Human; identical to SEQ ID NO: 365

SEQ ID NO: 7055 - RNA, 102 nt, Human; identical to SEQ ID NO: 2172

SEQ ID NO: 7056 - RNA, 77 nt, Human
uucaguuaaaaaagaggaagaagaaauggcaaagagaaaguuuuuucaaauuucuuucuuuuuuaauuuagauugag

SEQ ID NO: 7057 - RNA, 92 nt, Human
gcccauuuaauugaaaguauauaguaaugaaaagccuuauaacgucgggccucuagcaaugcgauuauauagcaaugauuauaaagcugggc

SEQ ID NO: 7058 - RNA, 93 nt, Human
ucccugacccuccuuuuuguuugccaaucuggauauuaucuaaacaacacaauuagacuaauaugcccuauggcuggaaauugagacuaggga

SEQ ID NO: 7059 - RNA, 63 nt, Human
cccuggagcuggggggcaagaaccccuauaacguggacgaacauugcgacccccagaacgggg

SEQ ID NO: 7060 - RNA, 89 nt, Human
gcgguggcugguucugcuacuuaauggcggcaagacugguuggcccugacuacgucugugaagcccgagaugcaggaagguguggccgc

SEQ ID NO: 7061 - RNA, 91 nt, Human
aggaaaaacuuauggcauguauagugagguuaaggacuugcaugucccucgcgaugguuuccuuccccuuauucuuacugcucaguguccu

SEQ ID NO: 7062 - RNA, 62 nt, Human
gaucucguuggcgcccguaauccgcuaccaggaagccuagggagguauacgagggacgaguc

SEQ ID NO: 7063 - RNA, 96 nt, Human
agccauccuaggggucuggugugagggaaucaagaagaaccaaacaagggcugggcuugguggcucacgccuguaaucccaucacuuugggaggcu

SEQ ID NO: 7064 - RNA, 66 nt, Human
agguggguggaucgccugaggucaggaguucaagaccagccuggccaacauggugaaacuccaucu

SEQ ID NO: 7065 - RNA, 72 nt, Human
ccgggcauaguggugcaugccuguaaucccagcuauuugggaggcugaggcacaagaaucacuugaacuugg

SEQ ID NO: 7066 - RNA, 88 nt, Human
agguauaauucagagacuguccuuugcaaaggaaaugaccagcauuucaacuguaugucuuccuggaaggguagauucugcuauaucu

SEQ ID NO: 7067 - RNA, 65 nt, Human
aucuucugguucaaagaacacaucagaugcaaggauaauaucuuguggugguagagccagaagau

SEQ ID NO: 7068 - RNA, 67 nt, Human
ccauuuguagaguaaagcuucaagugaccagucagcacuccuaacuugauaaguagaccacaauugg

SEQ ID NO: 7069 - RNA, 73 nt, Human
ggcaaacagacuugaccaucuucagacccacugcauucucaagcugaaguggucugcucauaguuugugugcc

SEQ ID NO: 7070 - RNA, 84 nt, Human
ggcgccuaugggcaggcggugcgcuaccagggccgcgcgcaggccgugcugcagcaguaccaacaccugcccucguuccgcgcc

SEQ ID NO: 7071 - RNA, 70 nt, Human
guucaucucagcaacagacaccauccggaagaugaagaacgauuuccggaagauggaggaugagauggac

SEQ ID NO: 7072 - RNA, 75 nt, Human; identical to SEQ ID NO: 74

SEQ ID NO: 7073 - RNA, 71 nt, Human; identical to SEQ ID NO: 77

SEQ ID NO: 7074 - RNA, 67 nt, Human
gcaguuauuuuuaaaacuuuauuuuaaaaauaugagcaucuauuuuaaaaguuuugauaauuauugc

SEQ ID NO: 7075 - RNA, 62 nt, Human
gcaguuuuaauucugaagacaaauaucuucauggaaaucuauuuguaagcuucugagauugc

SEQ ID NO: 7076 - RNA, 80 nt, Human
uauaccaauuccccuuuacaacugaugcagaucauuaugaaauacuggaaggcauacccuacaauuuaggaauuggugug

SEQ ID NO: 7077 - RNA, 66 nt, Human; identical to SEQ ID NO: 6981

SEQ ID NO: 7078 - RNA, 86 nt, Human
agaacuauugagaaauugauuaaugacaugagggcacaacacuaauuacuggcccgcuguuggcauugggguucuuaacuaguucu

SEQ ID NO: 7079 - RNA, 78 nt, Human
gcauuauuuuauccuauaucucacugaauuuuaagaaauaacauuaguauuagaaaaacuaggaaaaaagauaaaugc

SEQ ID NO: 7080 - RNA, 84 nt, Human; identical to SEQ ID NO: 286

SEQ ID NO: 7081 - RNA, 61 nt, Human
gucucaugagcuaugcacaaaugucuuuaucaauuuacauuucaaauauaguuuuaaugac

SEQ ID NO: 7082 - RNA, 61 nt, Human
guaaaccuuaguagagaugcgacucacggagaccaaaaguaaaaaucucuuuaccguuuac

SEQ ID NO: 7083 - RNA, 72 nt, Human; identical to SEQ ID NO: 5020

SEQ ID NO: 7084 - RNA, 60 nt, Human; identical to SEQ ID NO: 5021

SEQ ID NO: 7085 - RNA, 82 nt, Human
caggagcccguggccacagccaugccaucgucggugaccccgaggcagcucacgcgguugucguggccagcgaggacuccug

SEQ ID NO: 7086 - RNA, 77 nt, Human
cccaaggccccguggcccggggaagggggcugggauugcgccagccccgcagcccuggccuguagugugggcauggg

SEQ ID NO: 7087 - RNA, 94 nt, Human
gugaggggagcugugccuggauccugccuccaagucacaugagcacuagcucauaguggcagggugggggugggaggggcaggucuaaacucac

SEQ ID NO: 7088 - RNA, 72 nt, Human
gucugggccagaugcccugccaggaaagggacauggacccacgugcuugaggccuggcagcugggccaagac

SEQ ID NO: 7089 - RNA, 66 nt, Human
gggugagaggcuggugguugccucccguccugggcaggcugcagccucaugccaugucucucuccc

SEQ ID NO: 7090 - RNA, 99 nt, Human
ugaugggcacauggacaggcugcagagggcuccagguucugggccccuggcugagaaggggaggauccuguccuggcuguagccuuccugccccaauca

SEQ ID NO: 7091 - RNA, 77 nt, Human
cccgaggaaagcacuguugagaugaugguagagcaaaucaaucuaccagcguucuuuugaguucuguggacuuuggg

SEQ ID NO: 7092 - RNA, 61 nt, Human
cgcccacguccaccucugguuuggggacaaaagcuuguccuggaauuguaaagaugugucg

SEQ ID NO: 7093 - RNA, 72 nt, Human
gcagagguacugagccauaacagagaggcgacuacgcuguuugcuuccuguauuggcugcaagucucucugc

SEQ ID NO: 7094 - RNA, 98 nt, Human
ucuucgcuugaguucuucucugaaauuauaugcaaagaguugugggucuucaucacacauuuuucuguauacaucacagaggcucuuaaagugugaga

SEQ ID NO: 7095 - RNA, 68 nt, Human
uggagagcuggcggggcgaagaguagggucuaugucugccaacucuaacagccugcccgugcuuucca

SEQ ID NO: 7096 - RNA, 83 nt, Human
gcguuggcagcggaugcgggaagccggacucugggcgucauguacuacaaguuuaguggcuucacgcagaaguuggcaggagc

SEQ ID NO: 7097 - RNA, 72 nt, Human
gucagagcucauucgacaguuaaagccauuguuuaaagaaauggugcuuugcucuguguuugugcuccugau

SEQ ID NO: 7098 - RNA, 79 nt, Human
ucauuguuaaauuaaaauuuuuuuuuuuacuuggauggcuuaacauuuuugcaagaaaaauaggaagauaugaagauga

SEQ ID NO: 7099 - RNA, 70 nt, Human
ucccuggagguucuggaugaaggcugaacacaggcuuguuaaugucagucugugcugaggaccucaggga

SEQ ID NO: 7100 - RNA, 63 nt, Human
uggcgcugacugugggagggaccaucuacugccugaucgcccucuacauggcuucgcagccca

SEQ ID NO: 7101 - RNA, 102 nt, Human
caggcgagcaagacaguauacuuaagggguugcaaagcuugggacuggaaauuguuuaguucuugaaacaaaauacuucuuuaagguugcuuuugcuguuug

SEQ ID NO: 7102 - RNA, 63 nt, Human; identical to SEQ ID NO: 527

SEQ ID NO: 7103 - RNA, 69 nt, Human; identical to SEQ ID NO: 528

SEQ ID NO: 7104 - RNA, 91 nt, Human
uucccaaugcuacacaaccagaaaguaagguguucuacuugaaaaugaaaggacgauuauuuuagguaucuuucugaaguggcaucuggag

SEQ ID NO: 7105 - RNA, 65 nt, Human
ccggugcugcgcgcugggcugagguuauggcucgcuucgcggccaggcugggcgcgcagggccgg

SEQ ID NO: 7106 - RNA, 81 nt, Human
gcgggcggcgcggugcaaccucggccgaggccuuccuagccgccggcuacggguccuguucuuguaucgcgcucgcucugc

SEQ ID NO: 7107 - RNA, 78 nt, Human
ucuguugcaggcugcggcccaggcacucaauccgcuaggcccuucugcgauguuuuaccuggcugcggcugugucaga

SEQ ID NO: 7108 - RNA, 67 nt, Human; identical to SEQ ID NO: 1261

SEQ ID NO: 7109 - RNA, 76 nt, Human
uggccaagggccgcggccgcggaggccugcagcagcagaagcagcagaaaggccgcggcaugggcggcgcuggccg

SEQ ID NO: 7110 - RNA, 75 nt, Human
ggccaccaacacauggcccagccagugcugcugggcucugguuucuguguucuggugaggccaugggguggggcc

SEQ ID NO: 7111 - RNA, 86 nt, Human
uuguccuucauauacugcuccugaaaaaugcucaagucuuccaaaaccauucaucuugucaucuuuccagcuuccuguguagacaa

SEQ ID NO: 7112 - RNA, 101 nt, Human
uauguuucuaaaaaaguuuaguucuaaagaucagagaaaaagcaugacacaaagcguuuugacuauuuuaugaauaugugaauugaaagagaauguacaua

SEQ ID NO: 7113 - RNA, 91 nt, Human
guguuucuaaaccuaaaaccuaucuucuuucauaucucucauugcuaggugugaauauaagaagaacuuaaagguagaggcauaggaagac

SEQ ID NO: 7114 - RNA, 70 nt, Human
cacauccugggcuauuggacucucuguagcagauuuggcagagaguauaaugaagaaucuuaggcgggug

SEQ ID NO: 7115 - RNA, 69 nt, Human
cguuugaagaagagugcagauacacuuugggggauccaaaaggagcugcaauuuuaaagucuucugaug

SEQ ID NO: 7116 - RNA, 99 nt, Human
ggcacugucuuugcccgcauggccccugagcagaagacagagcuggugugcgagcuacagaagcuucaguacugcgugggcaugugcggagacggugcc

SEQ ID NO: 7117 - RNA, 61 nt, Human
gggcccaccuuugguaucauugugaagcacuuccccaagcugcugcccaagguccuggucc

SEQ ID NO: 7118 - RNA, 61 nt, Human
ucauucuuuggaacacuacaucuuggaaacaggugcagaacucuaguuuuccacaguuuga

SEQ ID NO: 7119 - RNA, 64 nt, Human
cauccuggagcaucucccgccaagucuccuguccagaccuaagcugagagaacacuccacgaug

SEQ ID NO: 7120 - RNA, 77 nt, Human; identical to SEQ ID NO: 3323

SEQ ID NO: 7121 - RNA, 79 nt, Human
cucugugaccgacggccggggccuucugacggucugaggucuugcuugggccagucaccuccugucacgguccgcggag

SEQ ID NO: 7122 - RNA, 71 nt, Human
gaggagcgguagcuuuugggaagcaggacguucucaccaggagagcguccucucgagauuucugcucccuc

SEQ ID NO: 7123 - RNA, 79 nt, Human
gggcuucuugggcgcaggucggagcugggugggccggcuccccggccccuggcuugggcgaccauguccgcauccgccc

SEQ ID NO: 7124 - RNA, 75 nt, Human
gcgcagaguuacuuccaguagcuggguccucauuccacgaggagcccaaauauaggaagauaggcgacucugggc

SEQ ID NO: 7125 - RNA, 76 nt, Human
ggcaggcauucacccucaggaccaggcaagugcagagucagcaguccuguuccuggguauggaguccuguccugcc

SEQ ID NO: 7126 - RNA, 86 nt, Human
uuggacagggacgacauucaggagccaaacaggccgcaagagcaacuggcagauccaaggucccguggaugacugucuuugaacaa

SEQ ID NO: 7127 - RNA, 62 nt, Human; identical to SEQ ID NO: 1277

SEQ ID NO: 7128 - RNA, 62 nt, Human; identical to SEQ ID NO: 4194

SEQ ID NO: 7129 - RNA, 67 nt, Human; identical to SEQ ID NO: 4195

SEQ ID NO: 7130 - RNA, 72 nt, Human
aacagaucucaaagaucucaucauuuuugacaaacagucaucacaaaggaugagacagaauuugaaauuguu

SEQ ID NO: 7131 - RNA, 85 nt, Human
cugcuacgcuccagccagccccuaacugguccccagaagcggcgcugcuacagggaccaggagcugcugcgaacugcgcuggcgg

SEQ ID NO: 7132 - RNA, 64 nt, Human
ggcucguccuugggcgcggggcuucaucauggacacgcucucggcccaggccgcgaaacaagcc

SEQ ID NO: 7133 - RNA, 65 nt, Human
ugcagaccuggcuuagaggaccccuaaggcugaggggucacuuccagaacugaguccgguccgca

SEQ ID NO: 7134 - RNA, 81 nt, Human
uugcacuggucccuggagagagggcguccccugcaggagagcuucaugcgccugguggaggccuguggggacucggagcaa

SEQ ID NO: 7135 - RNA, 67 nt, Human
uccaccguaaccuuuguacuuguuuuccuccuggggaaagugucaaaacagugcaaggacugguggg

SEQ ID NO: 7136 - RNA, 71 nt, Human
uuauuggucugaauucauuuuagguuacuuuaacauuuuaauuuccuguaacuguccaugagagaauauaa

SEQ ID NO: 7137 - RNA, 63 nt, Human; identical to SEQ ID NO: 1366

SEQ ID NO: 7138 - RNA, 86 nt, Human; identical to SEQ ID NO: 1381

SEQ ID NO: 7139 - RNA, 79 nt, Human
ggacuuuuccuuuccugcuuuucacuugaagguucccugugcaaccgacggaaagaucggggaaacuccggaaguauuc

SEQ ID NO: 7140 - RNA, 66 nt, Human
gucgcgcgcaaauuucuggugagcgccacaugacaauuuggcacacucuauccgaaauuugccgac

SEQ ID NO: 7141 - RNA, 92 nt, Human; identical to SEQ ID NO: 6794

SEQ ID NO: 7142 - RNA, 108 nt, Human
gguggcacggcugcgggcgcgggccuagacucgcugcacaagaacagcgucagccagaucucggugcucagcggcggcaagggccaagugcucgcaguucugaccacu

SEQ ID NO: 7143 - RNA, 60 nt, Human
aggcuugccagcccccucccucuuaauuuaauuccugaaguuuuugggggggccaagccu

SEQ ID NO: 7144 - RNA, 85 nt, Human
gcguuaugucaccaugcaguugccagugugauuagugccuaggggucuccauuuagcagaaaugguaaugacagugauauaaugc

SEQ ID NO: 7145 - RNA, 65 nt, Human
auaagaucuaaagaguuaccuggcuacagaaagaagaugccagaugacacuuaagaccuacuugu

SEQ ID NO: 7146 - RNA, 73 nt, Human
gcaucguggccucagcuggcucuguagaggagcugcccgaagaagcggcuggugcagagccgcgagggugugc

SEQ ID NO: 7147 - RNA, 90 nt, Human
ggaaaauggccuuccugaagcugaguccacuuuugaguaguggccauaggaccaguugagucaagagucauggauccaggggggccaucc

SEQ ID NO: 7148 - RNA, 70 nt, Human
guuuagccagcucucccggcaguagcaaggccaccugugguuugaaucuuucuggaagaaaugguggagc

SEQ ID NO: 7149 - RNA, 80 nt, Human; identical to SEQ ID NO: 174

SEQ ID NO: 7150 - RNA, 64 nt, Human; identical to SEQ ID NO: 175

SEQ ID NO: 7151 - RNA, 66 nt, Human
uuucggcgcugggucgcccaaagcagaauggagacggauagagugguggaucccagaaucccgaag

SEQ ID NO: 7152 - RNA, 101 nt, Human
cggaacgcguguuguugggacucugggacugcucgugcgagcaaucuguuccguaaacggaugcaagcacgguggguugaguguucaacccaugcguuuug

SEQ ID NO: 7153 - RNA, 105 nt, Human
gaacaucuaagagguuggaacgccugggccuuacgccauugggaagccuacggagcggaaaggcacauucacaccguguggggccccggguagccccucuuguuc

SEQ ID NO: 7154 - RNA, 60 nt, Human
gccguaaguugccauuggccuuugggagauuggaaccagggcuccacggcaauuuguagc

SEQ ID NO: 7155 - RNA, 91 nt, Human
uugacaaacaccgucauguacccagucgauacucggacgccgagagcacggugccccaguagcaagcccggcccgugaugcucgauuucaa

SEQ ID NO: 7156 - RNA, 77 nt, Human
cauguacccaggggagauuccagccagacacccgccccccgggccuggcuaagaaguugcuuccuguugccagcaug

SEQ ID NO: 7157 - RNA, 60 nt, Human; identical to SEQ ID NO: 231

SEQ ID NO: 7158 - RNA, 64 nt, Human
gggaaguaugagaaggugcuuguggaagggggcccggcucccuaggcgucccaucucgcuuccu

SEQ ID NO: 7159 - RNA, 69 nt, Human
gccaacaaauguuuuugcauucacaccaauugcugguuuugaaaucguacucuucaaagguauuugugc

SEQ ID NO: 7160 - RNA, 77 nt, Human
uagccgugauguccgggggccguguacaucauguuaccgugggguggggucugcauuggcugcugggcauauggcug

SEQ ID NO: 7161 - RNA, 65 nt, Human
uugacauuguaggcuggcgcuggcaucagguucacacucauguucaugcccucuugcaucguuaa

SEQ ID NO: 7162 - RNA, 63 nt, Human
ccggguccccuucagcaaggagggcggcccacugcucugcuggugcuggaaggaggaccccgg

SEQ ID NO: 7163 - RNA, 129 nt, Human
ucugccuuuucaccuacgcagccccagcccggccccccuggggacccuagagaggguguccuuucuguuuauccuucucuuugcuccagauggcugcgcucucuaggggcgcgauguguguguggugga

SEQ ID NO: 7164 - RNA, 84 nt, Human; identical to SEQ ID NO: 286

SEQ ID NO: 7165 - RNA, 89 nt, Human; identical to SEQ ID NO: 288

SEQ ID NO: 7166 - RNA, 61 nt, Human; identical to SEQ ID NO: 776

SEQ ID NO: 7167 - RNA, 105 nt, Human
gcuuggagccucccccagagguguggcaggugcugaagacccaccccggagacccccgcuuccagugcagucucuggcaucucuauccccuaugaggcaccacgu

SEQ ID NO: 7168 - RNA, 75 nt, Human
guuugaccuggccuggcaguacgggcccugcaccgggaucacacggcugcagcgcuggugucgggccaagcagau

SEQ ID NO: 7169 - RNA, 75 nt, Human
agccacauuuugggguuguggugcguauaccauuugcgcgcaagagcgcaugguggcccggcccccuauauggcu

SEQ ID NO: 7170 - RNA, 65 nt, Human
gcuaauuauugccccuaaguugcgaccuaaauuugauuuuggaaccgaucuuguaauaagaaagu

SEQ ID NO: 7171 - RNA, 65 nt, Human
uccuugugggagcagcuauggcaaguccaccuccuugcauugucauaggucacauuccacaagga

SEQ ID NO: 7172 - RNA, 71 nt, Human
cucagcgguauucuggugcuuauggugccucaguuucugaugaagaauugcaccacgacagaguagcugag

SEQ ID NO: 7173 - RNA, 60 nt, Human
gccgggucaccuucgaggcggacgagaaugagaacaucaccguggugaagggcauccggc

SEQ ID NO: 7174 - RNA, 81 nt, Human
acugcuucaaggacaucgugaacaugcugaugcaccaugacagguucaagguguuugcagacuaugaagccuacaugcagu

SEQ ID NO: 7175 - RNA, 60 nt, Human
cucaacggggcccucaccaucggcaccauggacggcgccaacguggagauggccgaggag

SEQ ID NO: 7176 - RNA, 66 nt, Human
gaguggaccaagaaggucaucaggaacaucgccugcucgggcaaguucuccagugaccggaccauc

SEQ ID NO: 7177 - RNA, 62 nt, Human
ugucagugccugauggaguggccggggcgggugccuucacgucagcuccagaaucacuguca

SEQ ID NO: 7178 - RNA, 105 nt, Human
cuggugcuucagugcugaacaaauggcagaugaacccauaugacagaggaucugcuuuugcaauugggucagauggucuuuguugucaaagcagagaaguaaagg

SEQ ID NO: 7179 - RNA, 82 nt, Human
gauggguguaaugccugagauugcacaagcuguggaagagauggauuggcuccucccaacugauauccaggcugaaucuauc

SEQ ID NO: 7180 - RNA, 60 nt, Human
ucuaccaugcaggccuuuuuggaccuagguacugacaaguuuggauuuggcuuuggugga

SEQ ID NO: 7181 - RNA, 77 nt, Human
ccuugcuguccucugggcuucuccucugacccaggucacccuguggcaggccaugggcccucaggauguuucaaagg

SEQ ID NO: 7182 - RNA, 112 nt, Human
aauauuccugggaguggugggcaauuagccugucuauggcuuaggaucuguuuccaugcuugcuuccugagcuucuucuaccucugagaguuuuucaucauuuuccaauguu

SEQ ID NO: 7183 - RNA, 60 nt, Human
gggugcuggaaucacuuuugccaaaggcaucauauccuugggcgaauuuuuccggaaucc

SEQ ID NO: 7184 - RNA, 78 nt, Human
uuccuaccacuuaagaauaaaaaaugcauuuuaauaaaaacaaaucuauacugaagucauuuuccuuugugagaggaa

SEQ ID NO: 7185 - RNA, 74 nt, Human; identical to SEQ ID NO: 365

SEQ ID NO: 7186 - RNA, 72 nt, Human
gccaauguccacaaagaauuccuggucagcaccaccgauguccaaagguggcaauaucaaggaagggcaggc

SEQ ID NO: 7187 - RNA, 75 nt, Human; identical to SEQ ID NO: 1111

SEQ ID NO: 7188 - RNA, 80 nt, Human; identical to SEQ ID NO: 367

SEQ ID NO: 7189 - RNA, 88 nt, Human
gauggggcucauggcugucugccaagguucauccaugaaucuuuuauugauaucuuuuggcuuaauuuagaauacuauuagcacuauc

SEQ ID NO: 7190 - RNA, 83 nt, Human; identical to SEQ ID NO: 3404

SEQ ID NO: 7191 - RNA, 60 nt, Human
cuuuuuuugcuggguauuauuucaagaaccaagguuccuagauaacaucuagucuuagag

SEQ ID NO: 7192 - RNA, 72 nt, Human
ggggaaagauguccucaucugcucaggcacucauccaugccccgccuccaagcagugugaugucgacucccu

SEQ ID NO: 7193 - RNA, 81 nt, Human
uccggggucuuaucuuacauggagagccuccaguuucucuuuaugggugcucucuucuuccaugaucuuucuuaucccgga

SEQ ID NO: 7194 - RNA, 81 nt, Human
agcuccccaaccccgaaucagugacucggaaagugaggaucccccaaggaacccggccagugauucggaaaaugaggagcu

SEQ ID NO: 7195 - RNA, 66 nt, Human
cagaacugcagaaugacuccuuccauucagacagccauauggacagaaaaaaguuucacaguucug

SEQ ID NO: 7196 - RNA, 75 nt, Human
gauacauuuggauucuucucaacuuugaaacuguuuagcacaguuccauuguauuauauaagaagacacuguauc

SEQ ID NO: 7197 - RNA, 72 nt, Human
ugugaugauuugauucagguauagcccaaauuaguaaggggcuuuagcuguaaacugaaaacaauauucaca

SEQ ID NO: 7198 - RNA, 93 nt, Human
uaugauuugauuuuauauacacauauguauacauauuauauauaaauauauauguguauacauauauguguguauaucuaugaaucaaacaua

SEQ ID NO: 7199 - RNA, 73 nt, Human; identical to SEQ ID NO: 4293

SEQ ID NO: 7200 - RNA, 70 nt, Human
ggcucccaauguugacguuggccagggccuuugcaaacaagccaggccaaaaaagcucaacauuuacacc

SEQ ID NO: 7201 - RNA, 60 nt, Human
gcagcuccugcaucucaucaaacucggaauggaaaacgaugacaccgcaguucaguaugc

SEQ ID NO: 7202 - RNA, 67 nt, Human; identical to SEQ ID NO: 1379

SEQ ID NO: 7203 - RNA, 86 nt, Human
gcgcggccggggcgggagagacucagcaacgacccauaccucagacccgacgggccggagcggagcgcgcccugcccuggcgcagc

SEQ ID NO: 7204 - RNA, 69 nt, Human
ggcaagaaggugcugacuuccuugggagaugccauaaagcaccuggaugaucucaagggcaccuuugcc

SEQ ID NO: 7205 - RNA, 97 nt, Human
aguucugugcuggugggucauauguuggugaagauuguccccaguggauggucccuaucacaaucucuacuagugaagaccccaaccaggccaaacu

SEQ ID NO: 7206 - RNA, 99 nt, Human
cucagugugggccauccaucugagguugaugagauauuugaugcuauaucauauagcaaaggugcaucugucauccgaaugcugcaugacuacauuggg

SEQ ID NO: 7207 - RNA, 76 nt, Human
cugugaugaauaccuggaccaaacaaaugggauuuccccucauuuauguggaagcugaacagguagaagaugacag

SEQ ID NO: 7208 - RNA, 79 nt, Human
cucuuacucccuuuuccccucaaaggagaacuguguuuaugaaacuguaguuuugccuuuggaugaaagggcauuugag

SEQ ID NO: 7209 - RNA, 87 nt, Human
gaacuccaggccucaagugaaccucccgccuuugccucccaaaguguugggauuauagguaugagucuccuugccuggccuagauuc

SEQ ID NO: 7210 - RNA, 71 nt, Human
ccgccguaauauagaacgucccggcccauacuuaugcucgcgccguaauggccgguacuaugcuccggcgg

SEQ ID NO: 7211 - RNA, 82 nt, Human
gccagguggguuucagggcgcugagaaagccgcuggucggucggcgaccgucaggguuuuccagggugggaauccgcggggu

SEQ ID NO: 7212 - RNA, 66 nt, Human
gccucacugccggcgucuacgagucagccaaagucuugaacguguaaguguagacgcggcccaggc

SEQ ID NO: 7213 - RNA, 75 nt, Human; identical to SEQ ID NO: 74

SEQ ID NO: 7214 - RNA, 67 nt, Human; identical to SEQ ID NO: 836

SEQ ID NO: 7215 - RNA, 77 nt, Human
ggaauuuggcugaggagcagcuuuagguauggauugaugacuaagucaagcuacuuccugagcuucucucagauucc

SEQ ID NO: 7216 - RNA, 81 nt, Human
aaguggaaauggcuguauuugcuuuacaauguuuucagcuggaaagcugagggcuggaaucaucugaagccuuguucacuu

SEQ ID NO: 7217 - RNA, 65 nt, Human
ccaggaaaugaaugagcuuggguaauggagcucucugaagcugaggccauuuuuacaagaacugg

SEQ ID NO: 7218 - RNA, 88 nt, Human
ccucucuuuucuaggggggaugugacccuuugaaaaaaauuuuuuuaagaagggggggggguguauauuucgccccaggagagagagg

SEQ ID NO: 7219 - RNA, 71 nt, Human
uuuggucccugcgccuuugaaggggggggggggucauaagguuucccccuuuuuuaaggguuuuaaccaaa

SEQ ID NO: 7220 - RNA, 92 nt, Human
gggggggcgggaaaaaaaaaaaaccggggccccuucucuuguuccaggaaaaaagggcccccuggggagagggguccuuuuucccccccccu

SEQ ID NO: 7221 - RNA, 65 nt, Human
uuuuuuugggaaaaaaacaaaauuuuuugggggcccccaaaaaaauuuuuuuuuucccggaaaaa

SEQ ID NO: 7222 - RNA, 79 nt, Human
cgccaggugcuuauuaggccgugcuccaaagucaucguccgguuucucacugugaugaugaagcaugguuacauuggcg

SEQ ID NO: 7223 - RNA, 67 nt, Human
gcccggcaaccaauggugagaaguuucucgaaggcacgucccgccgggaagcugguuuuacccgggc

SEQ ID NO: 7224 - RNA, 77 nt, Human
gcccucaaccggcggccgcgccaugcugcgggguaacacccgcggggcgguauggagagcggcacacgccggggggc

SEQ ID NO: 7225 - RNA, 63 nt, Human
gguaagcaggaaauuagaugaucuucauuaagacuccauggguguaucugagcuccugcugcc

SEQ ID NO: 7226 - RNA, 60 nt, Human
ccuuaaaaaaaaaaaaggcaaccaccccccaggggaaacucgugccaaggaaauuugggg

SEQ ID NO: 7227 - RNA, 63 nt, Human
uggggguccugccccuggagggccuuggaccaccagcugguggagggcccuauggacacccca

SEQ ID NO: 7228 - RNA, 73 nt, Human; identical to SEQ ID NO: 721

SEQ ID NO: 7229 - RNA, 63 nt, Human; identical to SEQ ID NO: 722

SEQ ID NO: 7230 - RNA, 60 nt, Human; identical to SEQ ID NO: 723

SEQ ID NO: 7231 - RNA, 60 nt, Human
auuggugugcccguguaacguuuaggaacaaguguguuuauacaacguuuggggaccaau

SEQ ID NO: 7232 - RNA, 72 nt, Human
ggcuaaccuuacccauguuggccacgaauuacuguuggaauucgaugguuaagaaaggggcgugagggggcc

SEQ ID NO: 7233 - RNA, 94 nt, Human; identical to SEQ ID NO: 4360

SEQ ID NO: 7234 - RNA, 128 nt, Human
ugagucaccgaagagugauaaucccaggcaguacagaaugagcucagcugagguugugcaauggguugugaaugacgaugaaguuguggaucaccucugguucugagacacucuguucuugguguuca

SEQ ID NO: 7235 - RNA, 67 nt, Human
ccaugcgcuacaagucccaggacccccggaauccugcacaaugaccugcuuuguagcucuccaaugg

SEQ ID NO: 7236 - RNA, 66 nt, Human
ccgaaacaagcuuucaccgacguggccacuggcucccugggccaguguccucggggccgcuugugg

SEQ ID NO: 7237 - RNA, 72 nt, Human
gcugguuuccuggccgaggcggagcugcugaaccugaggaagaucagcuccgacuuuggacgggcacccggu

SEQ ID NO: 7238 - RNA, 60 nt, Human
ccuggcuccucucaguuaugucaaaugauuauagaacuuggcauuuuacuagggagcagg

SEQ ID NO: 7239 - RNA, 75 nt, Human
gaggcccagaggguuggacauacuaggaauucugucauccccaguggcugauccuuuaaccccuucucaggucuc

SEQ ID NO: 7240 - RNA, 63 nt, Human
uucuuuuugguuuugacaucauucauuuccaccugggaauuucuggugccaugccagaaagaa

SEQ ID NO: 7241 - RNA, 87 nt, Human
cuagccaaaauguacaagaccacaccggaugucaucuuuguauuuggauucagaacucauuuggugguggcaagacaacuggcuuag

SEQ ID NO: 7242 - RNA, 88 nt, Human
uguuggugcuggcaaaaagccgaaggaguaaaggugcugcaaugauguuagcuguggccacuguggauuuuucgcaagaacauuaaua

SEQ ID NO: 7243 - RNA, 79 nt, Human
cacaaaagaaauauuauuacaagguuucagagguagccaauugcauucuuuuggaaaucuacuguacuguuucaaugug

SEQ ID NO: 7244 - RNA, 72 nt, Human
caccuuauaaguucugauuuauuuucuuacucauuaugcuguguucuaaauaaaucaugaaugagaagagug

SEQ ID NO: 7245 - RNA, 63 nt, Human
gaggaaacgaugaacaaaaacuaaucuaauugccagguuagaauucauuauuuaauuuaccuc

SEQ ID NO: 7246 - RNA, 62 nt, Human
gaguuacuagcgacuaguggucagcggccgccuugguggcccgcuauagucguuagccgcuc

SEQ ID NO: 7247 - RNA, 60 nt, Human
ggucguuacaacgcaauuccuuugucgcgaugccacacaggacuaugcguaaccacgcuc

SEQ ID NO: 7248 - RNA, 71 nt, Human
gcgugggcggaaucacuugagcccaggaguuugagaucagccugggcaauauagugagaccucgucuaugu

SEQ ID NO: 7249 - RNA, 66 nt, Human
gguaagauuaccaguguaggcugggagugguggcucaccccuguaaucccaacgcuuugagaggcc

SEQ ID NO: 7250 - RNA, 66 nt, Human
gcugucaaagaaccucuggguccauggguagacaaccaggagccuucccaggguuucuccuccagc

SEQ ID NO: 7251 - RNA, 82 nt, Human
ggauugccaaaacggucaccagcacauuucccaggagcuugaaguucucaggauccacaugcagcuugucacagugcaguuc

SEQ ID NO: 7252 - RNA, 69 nt, Human
ggcaaaggugcccuugagaucauccaggugcuuuauggcaucucccaaggaagucagcaccuucuugcc

SEQ ID NO: 7253 - RNA, 66 nt, Human
gcggccgcagacaguccgggagcaccagcucgcuaucaagcagcuggacgccccgcgugaggccgu

SEQ ID NO: 7254 - RNA, 60 nt, Human
auaacaaauacuccguccuuuugccauugguggcuaaagaaggaaaacuccauuuguugu

SEQ ID NO: 7255 - RNA, 82 nt, Human
caccguccggucagagaagcuaagaagggccccuggagaaguuugcuucccuggagguaagcggcccucagacuggaugaug

SEQ ID NO: 7256 - RNA, 61 nt, Human
ugggggucucgcuauguugaugaggcuggucucgagcuccuggccucaagugauccuccca

SEQ ID NO: 7257 - RNA, 83 nt, Human
gagcuuuuuagagaaguggaacguugguacccuuggauuugccugguuucugauuuucuauuguagucuuuaaguggagguuc

SEQ ID NO: 7258 - RNA, 79 nt, Human
ugauaccuuacagugcuacauuaucuccuuucaggauuucauaucugccgaugauuuuuguagucuugucagggcauca

SEQ ID NO: 7259 - RNA, 83 nt, Human
gagcuuuuuagagaagugugaacguuggacccuuggauuugccugguuucugauuuucuuuuguugucuuuaaguggagguuc

SEQ ID NO: 7260 - RNA, 88 nt, Human
guugguguggacagacgauaagcuccaccauuaccccugaagcuuguggacuggggccauuugggugaggggcuuguuacacaccgac

SEQ ID NO: 7261 - RNA, 73 nt, Human
cucgaauuucagugcgggaaccaaugcagacuggcauuaaagcuguggauagcuuggugcccaauuggucggg

SEQ ID NO: 7262 - RNA, 75 nt, Human; identical to SEQ ID NO: 74

SEQ ID NO: 7263 - RNA, 96 nt, Human; identical to SEQ ID NO: 2594

SEQ ID NO: 7264 - RNA, 71 nt, Human; identical to SEQ ID NO: 77

SEQ ID NO: 7265 - RNA, 78 nt, Human; identical to SEQ ID NO: 99

SEQ ID NO: 7266 - RNA, 80 nt, Human; identical to SEQ ID NO: 100

SEQ ID NO: 7267 - RNA, 99 nt, Human
aacuuggauuuuucuuuuuauuaaugcaguauguucuuuuuauucaaguaugaacuuguugagaaacuauaguaauaugauuuuuaagagauuuauguu

SEQ ID NO: 7268 - RNA, 63 nt, Human
auaauuauacaaaaugaugccaugacaaaauuccacagcaucagucuuaguuuguauaguugu

SEQ ID NO: 7269 - RNA, 78 nt, Human; identical to SEQ ID NO: 99

SEQ ID NO: 7270 - RNA, 65 nt, Human; identical to SEQ ID NO: 247

SEQ ID NO: 7271 - RNA, 80 nt, Human; identical to SEQ ID NO: 100

SEQ ID NO: 7272 - RNA, 87 nt, Human; identical to SEQ ID NO: 76

SEQ ID NO: 7273 - RNA, 71 nt, Human
ugcccgcguacaugggcugaggaauguucaagcagaagaaaugguagaguuuucuuuaggcuuaaagggua

SEQ ID NO: 7274 - RNA, 73 nt, Human
aauggaauggaaucuccaggagugaggguuuccauggaagccagcacuauccuuggggacaccacugaccauu

SEQ ID NO: 7275 - RNA, 72 nt, Human
gcuguuaauuuuuaugauuuuccuacuacaaagauacucaucuauauuuugaggguggaaaauuaaaauagc

SEQ ID NO: 7276 - RNA, 130 nt, Human
guacagauaaggaauugagcgcagaaaaguugugacuugcucaaguuuucaggguuagaaaguggcaaagaccuaauucuaaaaaggcuuuauaauuacagauuuugugcucuuaucuuuuauucuauac

SEQ ID NO: 7277 - RNA, 87 nt, Human; identical to SEQ ID NO: 4680

SEQ ID NO: 7278 - RNA, 72 nt, Human
cuggaucuaugaaugacaggagggcagaccacauuguuuucacauccauuuccccuccuucccaugggccag

SEQ ID NO: 7279 - RNA, 80 nt, Human
agggggggggggacaucaacuuggaggccaggguuggaaaaucaggccugaccaacaguugugugaaccccuuauucucu

SEQ ID NO: 7280 - RNA, 61 nt, Human
uaagucuuuuauuuauuuuuuuuuugggucuauccuaagggaccaguaaauaaugaucuua

SEQ ID NO: 7281 - RNA, 65 nt, Human
cuugcugcuguggugacucaaaaacaaacacagaaguguugugcauacuuaaagcucaguacaag

SEQ ID NO: 7282 - RNA, 70 nt, Human
gaggaacccaaucugcuucuguuguggcaccagagguuugcuuuguugcugaaucuauaguugcuuccuc

SEQ ID NO: 7283 - RNA, 67 nt, Human
ggacuugcagagagaguuuucuacuggaauguaagagguuuugaaggcucucuuuucugcaaaggcc

SEQ ID NO: 7284 - RNA, 67 nt, Human
ugugcagcaauuuuccuacaaacuuuccgguuuaauucggaacugaacaguggaauuccaaagcaca

SEQ ID NO: 7285 - RNA, 74 nt, Human
auggucaacggcgcuacagaacaaagggcgagcucuaaagaguccagcucauccucuucccgaccucugaucgu

SEQ ID NO: 7286 - RNA, 70 nt, Human
ccagacugccucccagccagagugcgcacuuacagcagaccggagcacuggccaguggagguucucaugg

SEQ ID NO: 7287 - RNA, 86 nt, Human
cugugagacaaccauuggcugcaaggacccggcccagggacaacuccugaaagagcugaugcagacaccaaacuuccguaucacag

SEQ ID NO: 7288 - RNA, 91 nt, Human
ggcugaggccuuugcgcguacaggaaaguccauugagcagcuggagaaagaguugcuggaugggcagaaacugcaggggccccagacagcc

SEQ ID NO: 7289 - RNA, 80 nt, Human
gauugaguucacaccucagcagauugaagaguucaaggagccuucaugcuguucgacgacaccaagugugagaugagauc

SEQ ID NO: 7290 - RNA, 73 nt, Human
uacaagaugauggacuugaacuuccugccaugcucagacauuccagacaggacaaggaccauuaggacuugug

SEQ ID NO: 7291 - RNA, 70 nt, Human
gaagaacgaguaaccugaaaugaaggagcgagaaucccacccucagccccccaacagcuuccucagcuuc

SEQ ID NO: 7292 - RNA, 73 nt, Human
gcaggugcgcuccgggaugaagugcagggaggcaaacucuggcuggguuccuguaaacauccaucgcagcugc

SEQ ID NO: 7293 - RNA, 105 nt, Human
cugagaugccuuuaguggaacucuucuccucagaaccauguagagucuaccugacuccaggugguacuuuuaagguauccaggagaccuuuagauuugcucucag

SEQ ID NO: 7294 - RNA, 73 nt, Human
ucucuccaaguugucaggaaaccucugguuccccauucuccuggcgguacagcaagcacugacagugaguaga

SEQ ID NO: 7295 - RNA, 78 nt, Human; identical to SEQ ID NO: 99

SEQ ID NO: 7296 - RNA, 80 nt, Human; identical to SEQ ID NO: 100

SEQ ID NO: 7297 - RNA, 74 nt, Human
acaaugucuuuaauuccucauaugcugacuuggcaauccauaugcagccuaaaaggugguugaaagaugucugu

SEQ ID NO: 7298 - RNA, 78 nt, Human
ccacacacacuuuugccaguucccccuggugaaccauaauacacacgugggagacagcuggcaucaucugagucuugg

SEQ ID NO: 7299 - RNA, 61 nt, Human
guccagcaaaagguugccaaagaguuuauggacagaccuggaauccaaccgcacaauggac

SEQ ID NO: 7300 - RNA, 83 nt, Human
guuguuggaccagaagcaccucuggcugcugggaucguugggaaccugaggucugcaggagugcaaugcuauggcccaacagc

SEQ ID NO: 7301 - RNA, 82 nt, Human
ggguccacucuccugccugcugggaccuauggaaggggcuuccuggccaaggcccccucuuccagaggaggagcagggaucu

SEQ ID NO: 7302 - RNA, 75 nt, Human
gacgugcuggaacagggagugcuucagcagguggacaaugccauccaugaggccagccgugccucccagcucguu

SEQ ID NO: 7303 - RNA, 62 nt, Human
ggcaguagagccuagcgcccaggcccuugagcugcagggucuggguguggacgucuaugacc

SEQ ID NO: 7304 - RNA, 61 nt, Human
uaguucaaucaaccuucuagaauuuuuguaauauaacuucaaguauguaaugauuuaauua

SEQ ID NO: 7305 - RNA, 80 nt, Human
uuaccacauggagcauuucacaguuucaaagaaguuuuccuuauuuuaaaacugcaagaaaaugcuacacuugaugguag

SEQ ID NO: 7306 - RNA, 91 nt, Human
ccggaucccugccuagcgcggcccaaccuuuacuccagagaucauggcugccgaggaugugguggcgacuggcgcgacccaagcgaucugg

SEQ ID NO: 7307 - RNA, 65 nt, Human
ugcugcugcuuggccucugcaucuuccugcucuacaagaucgugcgcggggaccagccggcggca

SEQ ID NO: 7308 - RNA, 68 nt, Human
caggccuggaugugaguugaccuuugauuuugaaugaccacagucacgguugaaagcauucaggucug

SEQ ID NO: 7309 - RNA, 76 nt, Human
gccugggccagcugcuuggagagaccccgcagagccugcaggauccggcggugucugcccagcgucuccuccaggu

SEQ ID NO: 7310 - RNA, 83 nt, Human
ggaaucuggcaggaagcauccagggcccagccucugucaggccuggcuuggccugggggccccagcugcuucuuccauugucu

SEQ ID NO: 7311 - RNA, 62 nt, Human
guagagacaggguuucaccauguuggccaggauggucucgaucuuuugaccuugugaucugc

SEQ ID NO: 7312 - RNA, 104 nt, Human
uggugcccaagcccagccuugcccacagcccuuccagcugccucgccaggcggagcugcugcaucuccaggaagggcugagggggaaccucugggcugggcuca

SEQ ID NO: 7313 - RNA, 69 nt, Human
uuauuuuguauaacuuuuauucuuagauuauauuacaaugugucagucucaaguauaacuacaauauaa

SEQ ID NO: 7314 - RNA, 62 nt, Human
acauacuugaacuuacacugggcaaauguuguuuacuacaguccaaaugaaguuaaaguggu

SEQ ID NO: 7315 - RNA, 80 nt, Human
ggagcgaggcagcgcgcccggcucccgcgccauggggcggcugguggcugugggcuugcuggggaucgcgcuggcgcucc

SEQ ID NO: 7316 - RNA, 66 nt, Human
uuguuuuuucgguugggcaugcugcuuaccgcaggaugauggaagcgacggcccguacaaagacag

SEQ ID NO: 7317 - RNA, 86 nt, Human
aggaacgauucacaggacaaacaaacccaauuuuuaagaaguuuauuugaaacucuuccuggucggguccagugugaaauguuacu

SEQ ID NO: 7318 - RNA, 63 nt, Human
cuauuagaggcugaaacuauugaagaacaagaaucuccagugaacuguuuuagaaaauuaugg

SEQ ID NO: 7319 - RNA, 70 nt, Human
ucacggaacaaugcuucaacacguuagaacgaucagaaauguugcuucuacuuuugaggcgcuucccuga

SEQ ID NO: 7320 - RNA, 72 nt, Human
gcaucaauagcaacagaaaugggccccacaguugcaacugccuucaucaaggccuucuccugcuuaagaugu

SEQ ID NO: 7321 - RNA, 66 nt, Human
ggcaugcuggccaaccuaguggagcagaacaucuccgugcggcggcgcaaggggucagcaucggcc

SEQ ID NO: 7322 - RNA, 84 nt, Human; identical to SEQ ID NO: 286

SEQ ID NO: 7323 - RNA, 61 nt, Human; identical to SEQ ID NO: 776

SEQ ID NO: 7324 - RNA, 91 nt, Human
cgucgagauguuuuuaaccagcgcguuucucaccggcuucucauuucacuguuuguacuccgggaucgggcacggagaagacauccuggcg

SEQ ID NO: 7325 - RNA, 60 nt, Human
gcgccgccuccuugaaacuuagcgcucugacccagagucugaccaggguacggcaggcgc

SEQ ID NO: 7326 - RNA, 61 nt, Human
gucguccccacagcuccggaagugcuuggcgccguugcgucacuuccggaucggggucgac

SEQ ID NO: 7327 - RNA, 64 nt, Human
uuggggcgaagcggcagcggaggcggcgggccgacgccggucaagcccgcgcugcuuccuccag

SEQ ID NO: 7328 - RNA, 75 nt, Human
aagcugagggugauuagacaaguugacaaguuguuuugaaagaggcaacuggcuuaguacaaaaauccauaguuu

SEQ ID NO: 7329 - RNA, 91 nt, Human
uuuuuuagcaagacaagguguuuuuauugaggucucaggaauugcaauuugggagacagauucagcuagaagccacuuguguucugaagag

SEQ ID NO: 7330 - RNA, 75 nt, Human
uuuguacaguuuaaacaacagcugaaagaacuaaagaagcaauguggucuucaagcugacagagaagcugacgga

SEQ ID NO: 7331 - RNA, 61 nt, Human; identical to SEQ ID NO: 3139

SEQ ID NO: 7332 - RNA, 110 nt, Human
gguuccgucacccccucccagggaagcaggucugagcagcuuguccuggcuguguccaugucagagcaacggcccaagucugggucugggggggaaggugucauggagcc

SEQ ID NO: 7333 - RNA, 61 nt, Human
guaccucagugugcaaaagugcuuugaagguuguccaggugagccaggcauacuaaggcac

SEQ ID NO: 7334 - RNA, 106 nt, Human
gaagcacguaauguuuaaaauguguuguuuuucacaaguaauuuaaguauagcauuauuauuauuugguacuugagucaaagacgacauuuagauucuucagcuuu

SEQ ID NO: 7335 - RNA, 65 nt, Human
ggaacaccauaggaguugccaucagagauaacacccauggacacaaacucucccucugggguucc

SEQ ID NO: 7336 - RNA, 80 nt, Human
gucccugcuucccgacaccagccucauggaauaugcaacaacuccuguaccccaguccacgguguucuggcagcagggac

SEQ ID NO: 7337 - RNA, 110 nt, Human
cugugcaccucgugguagaaacucuuugggguucgccagcuguagcucauauuucauguuggggucaugccgaacacccaugaaguuguaguuccacgaggacugggcag

SEQ ID NO: 7338 - RNA, 118 nt, Human; identical to SEQ ID NO: 3011

SEQ ID NO: 7339 - RNA, 75 nt, Human; identical to SEQ ID NO: 74

SEQ ID NO: 7340 - RNA, 87 nt, Human; identical to SEQ ID NO: 76

SEQ ID NO: 7341 - RNA, 79 nt, Human
ucagugcgggaaccaaugcagacuggcauuaaggcuguggauagcuuggugccaauuggucguggucagcgugaacuga

SEQ ID NO: 7342 - RNA, 71 nt, Human; identical to SEQ ID NO: 77

SEQ ID NO: 7343 - RNA, 74 nt, Human
ccaugcaggcuacuccauguuuggggcuggcaucaccguaggccugucuaaccucuucuguggagucugcgugg

SEQ ID NO: 7344 - RNA, 66 nt, Human; identical to SEQ ID NO: 4945

SEQ ID NO: 7345 - RNA, 69 nt, Human
gcccuuaugugguccaaccugggcauuggccuagcuaucucccugucugugguuggggcagccuggggc

SEQ ID NO: 7346 - RNA, 80 nt, Human
gcgggggcggacagacugcgggacggacgguggacgcugggacgcguuuguagcuccggccccgccguuccgacccccgc

SEQ ID NO: 7347 - RNA, 104 nt, Human
uucugugaggcuguggccaucuacggcaucaucauggcaauugucauuagcaacauggcugagccuuucagugccacagaccccaaggccaucggccaucggaa

SEQ ID NO: 7348 - RNA, 68 nt, Human
cagccggcagccagcggcaguggaucgaccccguucugcggccguugaguaguuuucaauuccgguug

SEQ ID NO: 7349 - RNA, 62 nt, Human
cggccccgcagcagcuccaagaaggaaccaagagaccgaggccuucccgcugcccggacccg

SEQ ID NO: 7350 - RNA, 67 nt, Human
ugucccucugcgcuugcuccccgcauccaugcccaggaaucgggacacauuacggcaggcaaggaca

SEQ ID NO: 7351 - RNA, 88 nt, Human
ggcaugcaguaacuguucaaauaauguuuguuuaauugacggguuuuaagcucgauaacuuagcuaagcccuuugcacagucuaagcc

SEQ ID NO: 7352 - RNA, 98 nt, Human
uuuuuuuuuugucuuuauucauuuauuuauuuauucauucauuuugugcccuucugggaaugaaccaggacuauuugaauggaaagagaaaaaaaaaa

SEQ ID NO: 7353 - RNA, 105 nt, Human
guuggauuugcaaaccuccccaaucaaguucaccgaaaaucagugaaaaaagguuuugaguucacacugaugguggucggugaaucaggucuaggaaaauccgac

SEQ ID NO: 7354 - RNA, 63 nt, Human
guuucugauagacacuagaaaggacaaguuugaucuugugauaaauugauuaauguuagaagc

SEQ ID NO: 7355 - RNA, 75 nt, Human
gcuccugaaaaguacaucaagucuaaagugaaccagcuaacucauuaagacuggaaucaugagcaacaauggagc

SEQ ID NO: 7356 - RNA, 68 nt, Human
ggcuccggcuccacacuggcacguagugggcggaucgcgccggcgcugaguaggaaggagcuucagcc

SEQ ID NO: 7357 - RNA, 73 nt, Human
acacagaccacuaagaacaauaacuuuaacaaaauaagcauuugcuucaaaguuauuuuuuagucgcuggugu

SEQ ID NO: 7358 - RNA, 61 nt, Human
cugauauaagguccagguugauucacuccaaaggguguuaucuuacgaggacagucauuag

SEQ ID NO: 7359 - RNA, 65 nt, Human
cugucuguucauauguugguuaugacuuuuacauuaaaauaucauuuaaacgaaugagcaaucag

SEQ ID NO: 7360 - RNA, 64 nt, Human
guauaaacagaguuacaacuaaauuuggauaaaaauguucaauaauuaacucuagcacguauac

SEQ ID NO: 7361 - RNA, 64 nt, Human
agcuuuuauuuauuuuuuagcaaugacauuaacaagauuuugccagguuauaaaaaugagggcu

SEQ ID NO: 7362 - RNA, 72 nt, Human
caucccuaacacaaauccagggacuuuguuucuuaaccuuaaaauuggaaacacuucuugcuaccagggaug

SEQ ID NO: 7363 - RNA, 75 nt, Human
ccuggagagggcggcaugauccuagugggccgaggucaaccgccagggucaaacggaacacaacccacucucagg

SEQ ID NO: 7364 - RNA, 87 nt, Human
acaaccacaauaaauauaaagauauauguguaagguuucaaaacagcauauacuacauaauaccauuuuuguaaauaacauguuugu

SEQ ID NO: 7365 - RNA, 67 nt, Human
uaugauuacacauagaaggcuaaaagauaugucaaaauauuaacaaaauuucuguagucaaaucaua

SEQ ID NO: 7366 - RNA, 77 nt, Human
ggaaaauugcaaugaucaaguuucuuuuuuauuuuuuuuuuacuuagaaaagcaaauauguguuuuguaauaaaucc

SEQ ID NO: 7367 - RNA, 120 nt, Human
ggccccaccugaggcacagcgcugacucaucacggugguaccaguaggucagccaucuggaaacagaaguggcccuaaugggccaaaaugugguaagacucgcuggccucaggcagggcc

SEQ ID NO: 7368 - RNA, 66 nt, Human
uccaguaaauuggaaugacucaucaucaggacagcaauuagggauuggucauauagguggacagga

SEQ ID NO: 7369 - RNA, 63 nt, Human
agaaauuccuucacaaaauuugggguaaaaacccuuacaaggcaauuuugugggcgaguuucu

SEQ ID NO: 7370 - RNA, 84 nt, Human; identical to SEQ ID NO: 286

SEQ ID NO: 7371 - RNA, 64 nt, Human; identical to SEQ ID NO: 287

SEQ ID NO: 7372 - RNA, 89 nt, Human; identical to SEQ ID NO: 288

SEQ ID NO: 7373 - RNA, 70 nt, Human; identical to SEQ ID NO: 7282

SEQ ID NO: 7374 - RNA, 67 nt, Human; identical to SEQ ID NO: 7283

SEQ ID NO: 7375 - RNA, 67 nt, Human; identical to SEQ ID NO: 7284

SEQ ID NO: 7376 - RNA, 73 nt, Human
aaauugauguuuggcuuuuuuuuccuccacgauuaaaaaaguaggggaaaaaaacccaccucaacuucgauuu

SEQ ID NO: 7377 - RNA, 73 nt, Human
aggagaaauaaauuugguauaaaauauguagaguauaaucuuacuauuuuuguauaauauuagaauuuauccu

SEQ ID NO: 7378 - RNA, 79 nt, Human
ugccugauguauuuacucgugaucuucauucaugcuuggggacagagugagugggauuuaugaguuacuguacucagca

SEQ ID NO: 7379 - RNA, 63 nt, Human
auuuaccaaaccagucuguacaaaccuuacagccagaagggaaaaaaauagcuugugguaaau

SEQ ID NO: 7380 - RNA, 67 nt, Human
cauauauuuauugcaaauacuuaaaauucuuauguaaaaugauuuucuauauuugugaaaaaauaug

SEQ ID NO: 7381 - RNA, 73 nt, Human
cuuuuuaaaugguguugacaccaacuucucuguacauacccucaauuccaauguuaacaauuccuuuaaaaag

SEQ ID NO: 7382 - RNA, 76 nt, Human; identical to SEQ ID NO: 4817

SEQ ID NO: 7383 - RNA, 80 nt, Human
gauuucucaagacaagaagauaggcacuuaauggcagcugaaauuccuaauauuaagccugauauucuuaucauugaauc

SEQ ID NO: 7384 - RNA, 75 nt, Human
uacaugacauuccaauauacuaugcaucaucuuuuggcccaagaauuggaugggcaguguaccagaacauaugua

SEQ ID NO: 7385 - RNA, 62 nt, Human
aaauagaaaauuauauaaucugaagaguauuuuuucucguucaauuucuauaacauuuauuu

SEQ ID NO: 7386 - RNA, 87 nt, Human
cagaagauggcaaagaaugaauuucaauuauuaugaucaccacuauugauuuaauaugacuucuucaauuggaugugcuaucuucug

SEQ ID NO: 7387 - RNA, 79 nt, Human
auauacuuaaaauguuauuugauaaauuugcccuucuauuauuugauccccagucacauaauauauuuaugccugauau

SEQ ID NO: 7388 - RNA, 76 nt, Human
gcuaauuucacauuaguggauuuggcuguuacuauuugaacccuagcugcugccuuccuccuacuucuguguuagc

SEQ ID NO: 7389 - RNA, 62 nt, Human
guugagcaucuguugcacuaagugcuuucuauauucaguaaucuuuuguaacaagccucaac

SEQ ID NO: 7390 - RNA, 91 nt, Human
caguguggucaguguuaccauccauacugugucaguauuaagaucacuaaagugguucuuagcaaagguuggaggugucuugagugcacug

SEQ ID NO: 7391 - RNA, 69 nt, Human
cugccuagacccuccauugcagacaguucccaaaggaggcuggaagugcaaaugguguguuuggugcag

SEQ ID NO: 7392 - RNA, 96 nt, Human
gauauguguguaguuuguggcaguuuuggccaaggagcagaaggaagauuacuugccuguucucaguguggucaguguuaccauccauacuguguc

SEQ ID NO: 7393 - RNA, 72 nt, Human
ggaagguaucuguaauccucuauucguggcgauucuuccacguacuuaguagaguuaaggcaaaaacuuacc

SEQ ID NO: 7394 - RNA, 61 nt, Human
gaggaccaagauguggaaaggagccagugaacuugcugacugagaaggcaccuuggaacuc

SEQ ID NO: 7395 - RNA, 120 nt, Human
gcaccuuccuguggauccgggugcagcaguucacgucucggcggguggagcugcucaucuucucccaccugcacgagcucucacugcgcuggcaccuggggcgccgcacaggggaggugc

SEQ ID NO: 7396 - RNA, 68 nt, Human
ggccuggacuguuaccaguuacgucuuccucaaguuccuccagggggguggcacuggcaguacaggcu

SEQ ID NO: 7397 - RNA, 87 nt, Human
cagcuuucuggaaguauuauagaaaaagaagguuuaucuaacauuaaguuaaagguagaagacuuuuugaaucucuccacacagcug

SEQ ID NO: 7398 - RNA, 94 nt, Human; identical to SEQ ID NO: 1365

SEQ ID NO: 7399 - RNA, 61 nt, Human
guccagccugggccauagagugagacucugucucaaaaaaggaaagaaaaauaggcugggc

SEQ ID NO: 7400 - RNA, 60 nt, Human
acacaaacaugcaauucccucucugcagaauaaucugcaauuugguauaaauguuagugu

SEQ ID NO: 7401 - RNA, 64 nt, Human
cgucucaguggcugcccgcaugcucaagguggcccggcugcuugaggugccagucaugcugacg

SEQ ID NO: 7402 - RNA, 81 nt, Human
ucuuguguugagacuucgugguggugcuaagaaaaggaacgaagaagucuuacaccacucccaagaagaauaagcacaaga

SEQ ID NO: 7403 - RNA, 78 nt, Human; identical to SEQ ID NO: 99

SEQ ID NO: 7404 - RNA, 65 nt, Human; identical to SEQ ID NO: 247

SEQ ID NO: 7405 - RNA, 80 nt, Human; identical to SEQ ID NO: 100

SEQ ID NO: 7406 - RNA, 73 nt, Human
ggccaggcggacgaaccccuccucagugcuuggucaucuuggccgggcucgggggguauccgaccuucaggcc

SEQ ID NO: 7407 - RNA, 126 nt, Human
uguucaccacgcccccgaagcgagagaguucaaguugauguugacgaugacaucguuggccgccacccgacacucgaugucgcugcaaucaucuucuucaacgccuuugucguugcugguagaaca

SEQ ID NO: 7408 - RNA, 73 nt, Human
cgucgggcccgguucgagguggcugacgaggacaagcagucccggcugcgcuaccagaaccuggagaacgaug

SEQ ID NO: 7409 - RNA, 99 nt, Human
gauggagcccaggccucuccggagccggaugggggagucggcaccagggauuccagccgaacuuccauccgcagcucccagugguccuucagcaccauc

SEQ ID NO: 7410 - RNA, 69 nt, Human
agcacaggcccaauucuucccugccuuuuaucacccugucagcugggaguaucuuuucuaccuguggcu

SEQ ID NO: 7411 - RNA, 82 nt, Human; identical to SEQ ID NO: 1077

SEQ ID NO: 7412 - RNA, 77 nt, Human
gguaucuugguuaugacaaagucauuacaaaugugacuaagucauuacaaaugugacugagucauuaccaguggacc

SEQ ID NO: 7413 - RNA, 69 nt, Human
cacgucuccggccacgcccuguucacagagacaccccaugacaugacagcacggacgggcgaggacgug

SEQ ID NO: 7414 - RNA, 93 nt, Human
ccugcuccuuccgcggcagcggcucccccuccuacucgcuggagauccaguggugguauguacggagccaccgggacuggaccgacaagcagg

SEQ ID NO: 7415 - RNA, 80 nt, Human
ggggcccagaugugaggcggcggcgcccccggcccgagagcgcacgaugggggccccgcucgccguagcgcugggcgccc

SEQ ID NO: 7416 - RNA, 61 nt, Human; identical to SEQ ID NO: 1238

SEQ ID NO: 7417 - RNA, 82 nt, Human
ggcccaggaucggcagggcugcuggcagaggaaucccagcugggguucccaugccccaggcuccugcaggacuugcugggcc

SEQ ID NO: 7418 - RNA, 86 nt, Human
gcugccccuucagagcagggaaacacgggcuggugccuuucuucaccugcauggcagcuugcuucccuggcaguggagagggcagc

SEQ ID NO: 7419 - RNA, 67 nt, Human
guggccagaagccucguuccuccugacucuuccugcagguggcucaggaaggauucagccuggccac

SEQ ID NO: 7420 - RNA, 94 nt, Human
ucagccuuggucaucugcgauggagcgcuuucucagaacuguaggacauagaacugugcacaggaacagcuuccagagccgaaaaccagguuga

SEQ ID NO: 7421 - RNA, 72 nt, Human
acccuagcuaacauccuacagaauggugaaagacugaguguuuuuccccuauaauaggaaacaagcaagggu

SEQ ID NO: 7422 - RNA, 62 nt, Human
caguuuauucuauaucacuuuauaacuuaauaaagcuguuuaagaaaaauguuaguaagcug

SEQ ID NO: 7423 - RNA, 72 nt, Human
ugcacuggauguucuagccgguucuguuccacguugcacuggauguucuagccgguucugauccacguugca

SEQ ID NO: 7424 - RNA, 85 nt, Human; identical to SEQ ID NO: 3621

SEQ ID NO: 7425 - RNA, 125 nt, Human
gcugaacugcgaaugauacuuuaugaagaugauucaguacaaguacaauauguugaugguuccacauugcaacuuucucccuguggcucugaauuuuuauuugaaaagucaccaccuguuucagc

SEQ ID NO: 7426 - RNA, 75 nt, Human
uaccuucugaaagaaaaaagcauaucuucauugacauaacagaagugagauggcccagucuugauacagauggua

SEQ ID NO: 7427 - RNA, 84 nt, Human; identical to SEQ ID NO: 286

SEQ ID NO: 7428 - RNA, 89 nt, Human; identical to SEQ ID NO: 6376

SEQ ID NO: 7429 - RNA, 94 nt, Human; identical to SEQ ID NO: 5398

SEQ ID NO: 7430 - RNA, 61 nt, Human; identical to SEQ ID NO: 544

SEQ ID NO: 7431 - RNA, 60 nt, Human
gcggccuccuucccaggcucuggggcagcgcaagagggguaggcugggaggggcugccgc

SEQ ID NO: 7432 - RNA, 92 nt, Human
ggcaugggcaagggggguccccagguaguaaacuccccaggugggcugagggcuagggcugaaccucaggugggucuccuguucccagugcu

SEQ ID NO: 7433 - RNA, 85 nt, Human
accguggguaggcucccagcauggcgcgaguuuacugcagacgugguggugacccgugagugugcugcuggagccuccacgcggu

SEQ ID NO: 7434 - RNA, 95 nt, Human
gucgacgaucagacaagguuggcuugugcgcagucuggcccaugagcucagucagccagagugaagcagcaucgcaggaccuugugcugacagac

SEQ ID NO: 7435 - RNA, 70 nt, Human
gauguauauauuauucugcaagcuuucauacugacuacuacaguauuuuuugguuugacuguguauacuc

SEQ ID NO: 7436 - RNA, 75 nt, Human
gcgccguccuggucacggccccgcggggcagccaugccuggccgucugcugcggggccuguggcagcgauggcgc

SEQ ID NO: 7437 - RNA, 69 nt, Human
ggaaggcggccgagcgcggcccccucuccucccgggccggggcgggcccgaggccucgauccgccuucc

SEQ ID NO: 7438 - RNA, 73 nt, Human
ggggaccuccuuccagcucuacgcgccucucauucagagaggugaggucaggaaaggggaaggacgaagcccc

SEQ ID NO: 7439 - RNA, 73 nt, Human; identical to SEQ ID NO: 2359

SEQ ID NO: 7440 - RNA, 76 nt, Human
cugggccugagggagggcuggagucgcacgcgcuuuguccuuagcgccugucugcucuccucuaacuaggacccag

SEQ ID NO: 7441 - RNA, 63 nt, Human
ucuccgugcucuggggccgggccucgcugcuuagcagcggccucuagcuccgucucccgggga

SEQ ID NO: 7442 - RNA, 86 nt, Human
aagaugauucugacagugaaaagcagcaacaaauucaucacaucaagaacuuguaugccuucaaccucuucugccagaagcguuuu

SEQ ID NO: 7443 - RNA, 60 nt, Human
gcccacagacuacagaaagcaguugcaguaucccaacccauugccugugcucuccggggc

SEQ ID NO: 7444 - RNA, 66 nt, Human
aaauguaagacguuaaaguguugcuuacaggaggguaaaugcaaacaucaccaaugccuuacauuu

SEQ ID NO: 7445 - RNA, 102 nt, Human
cugcucuggcauaggaauacuugaauagcuugguuaaaugaagggauggccaggagauguuacuuuuccaagcuauucaggcacuccuuaugucagagacag

SEQ ID NO: 7446 - RNA, 76 nt, Human
guggcucauugcuuaggugcccagguuuuucaggugcaauuaaaauuuagaacuaccacacaaaggcauuggcugc

SEQ ID NO: 7447 - RNA, 63 nt, Human; identical to SEQ ID NO: 3037

SEQ ID NO: 7448 - RNA, 63 nt, Human; identical to SEQ ID NO: 3039

SEQ ID NO: 7449 - RNA, 67 nt, Human
uucuaguuacauuacaaaaauuaaucuuaggucucuaccucacauauauauaaaaaugaacucagaa

SEQ ID NO: 7450 - RNA, 86 nt, Human
uuuggaaggcugaagcggguagaucaccugaggccaggaguucgaaaccagccuggccaacauggugaaaccccgucccuacuaaa

SEQ ID NO: 7451 - RNA, 96 nt, Human
gagcugcggcgcgggccauuucugagcaguggagguuucaaguaauccacuaacaaccaguuccaaauucugucaucaaauccugugcugcuguuc

SEQ ID NO: 7452 - RNA, 60 nt, Human
ggauguaggcaucuugguggugcuuggcaaaguacagcauguuguccagagccaacaucc

SEQ ID NO: 7453 - RNA, 68 nt, Human
cuugcacgccugaagagacucggucacggagccaaucugguugacuuugagcaggaggcaguugcagg

SEQ ID NO: 7454 - RNA, 60 nt, Human
ggugggggacacaggugcgcagcugcacagagucagcagcagcagccugcuccccgcacu

SEQ ID NO: 7455 - RNA, 84 nt, Human; identical to SEQ ID NO: 286

SEQ ID NO: 7456 - RNA, 89 nt, Human; identical to SEQ ID NO: 288

SEQ ID NO: 7457 - RNA, 67 nt, Human
cccagcuuacaacacccgugguccuuucacaucaggcuccgggcuguuccacuuucuguaggguggg

SEQ ID NO: 7458 - RNA, 74 nt, Human; identical to SEQ ID NO: 365

SEQ ID NO: 7459 - RNA, 102 nt, Human; identical to SEQ ID NO: 2172

SEQ ID NO: 7460 - RNA, 77 nt, Human; identical to SEQ ID NO: 3082

SEQ ID NO: 7461 - RNA, 80 nt, Human; identical to SEQ ID NO: 367

SEQ ID NO: 7462 - RNA, 80 nt, Human
gacauuauuauauuaccaauagcugauuuuuuuuuccauucugggaccuaaaaugcuuacagguacuagcaguacauguc

SEQ ID NO: 7463 - RNA, 71 nt, Human
agaaaaaugauacuucucuuuuuuugcuguuccaccaaauacaauucaaaugcuuuuuguuuuauuuuuuu

SEQ ID NO: 7464 - RNA, 76 nt, Human
auggugcuauaauaaauaaacuucaacacucuuuaugauaacaacacuguguuauauucuuugaauccuagcccau

SEQ ID NO: 7465 - RNA, 75 nt, Human
guuuugcuccuugagagcagauuggcugaugccccugcaaccccagcccaagcucugccucaaagaccgagugac

SEQ ID NO: 7466 - RNA, 60 nt, Human; identical to SEQ ID NO: 5112

SEQ ID NO: 7467 - RNA, 77 nt, Human
cuacaggacacaauguggcugaccugguggugauacucaagauucugccaacguuggaagcuguugcugcccugggg

SEQ ID NO: 7468 - RNA, 71 nt, Human; identical to SEQ ID NO: 3414

SEQ ID NO: 7469 - RNA, 60 nt, Human
uugauagucaacuguggagcauugucauuuacauccacaacuuccacaagaacuguacaa

SEQ ID NO: 7470 - RNA, 98 nt, Human
ccaccagucaagggugggaauagggugggaggggguuggcuuuaaaaguuauauguacaagccaucccguaccagacccuuggccuccugacaggugg

SEQ ID NO: 7471 - RNA, 63 nt, Human
gacaaggucauugugcccugccacgggacaacguaaaucuggaaagagcagaauggcuuccuc

SEQ ID NO: 7472 - RNA, 60 nt, Human
gcuacuauuuuauugcaggagguggggguguaugcaccgcacaccggggcuaugagaagc

SEQ ID NO: 7473 - RNA, 88 nt, Human
aagauccaggagcagcucugccugguccaggacuccaaucguccaugauguuccugcuaugacuaggcagacuguaucccugagucuu

SEQ ID NO: 7474 - RNA, 71 nt, Human
aaguugcccgcuguguaagaaaaagccaagagacugcuuuugagugacauuuauuuagcagcuaguaacuu

SEQ ID NO: 7475 - RNA, 80 nt, Human; identical to SEQ ID NO: 174

SEQ ID NO: 7476 - RNA, 64 nt, Human; identical to SEQ ID NO: 175

SEQ ID NO: 7477 - RNA, 92 nt, Human
gagccauuguggacguuccauuggugagagcuguugggucguguaguugaugcccuugguaaugcuauugauggaaaggguccaauugguuc

SEQ ID NO: 7478 - RNA, 70 nt, Human
gagacucuuccaggucaaagggcggcgugugguccgugccagcgagguaccuguguccugggagagcuuc

SEQ ID NO: 7479 - RNA, 129 nt, Human
gcagcaccgugagguccagugcuucgagugcggccaccuuccuaggcuacuucaagucuggccugaaguacaagaaaggagguguggcaucaggauucaagcacgugguacccaacgaggugguggugc

SEQ ID NO: 7480 - RNA, 109 nt, Human
ggacaacgagcggaguggccgggcccgagugcacgugucugaggagggcacugagcccgaggcgaugcuccaggugcugggccccaagccggcucugccugcagguacc

SEQ ID NO: 7481 - RNA, 70 nt, Human
ggucuccaauggugcagggaccauguccgucucccucguggcugaugagaaccccuucgcccagggggcc

SEQ ID NO: 7482 - RNA, 72 nt, Human
gcagagccagaggcgguguugucacggacuaaugugaaaucucuucccguggcgcgcauccucugacucugc

SEQ ID NO: 7483 - RNA, 70 nt, Human
gcucagccagcccuuggaggcucagagcagcuggcccaggcuccagcucgccuccaguggaagcccgagc

SEQ ID NO: 7484 - RNA, 87 nt, Human
gcucugcucuaggacugccucccacugcggccccucaccugacuucaggguauggggagggagggagccagugcuccaagggcaggc

SEQ ID NO: 7485 - RNA, 66 nt, Human
gggaccaggugucgcgcagagaugugccucauucugugccuccuucugugccucuaccauguuccc

SEQ ID NO: 7486 - RNA, 88 nt, Human
uccuuuuccucuuuuccuuccuccucuuuggaauuuuccugggaccuacagaauaaagggggggauggacaggggguuuucaaaagga

SEQ ID NO: 7487 - RNA, 74 nt, Human
gccccgccccugccgccggaauccugaagcccaaggucugcccgggggcgguccggcggcgccggcgauggggc

SEQ ID NO: 7488 - RNA, 78 nt, Human
agacccagugccugugacuuugaguaguuuguucuaaauguggugacaaacaagucauuucuguaagacauugggucu

SEQ ID NO: 7489 - RNA, 65 nt, Human
ccggcaaguugcuaacugugcguuucucccuucuuagaaugaaugucucccccaaaacuggcugg

SEQ ID NO: 7490 - RNA, 65 nt, Human
gaggaugaaagaggaccugggagcggcaacuuuguucugguuuguuguuuucucuucccuaccuc

SEQ ID NO: 7491 - RNA, 65 nt, Human
gccugcccauuuuguagugcaguugaggagagcucaggggcugucagaaugcugugugggaaggu

SEQ ID NO: 7492 - RNA, 78 nt, Human
ugaaaagugcuccccaucaucugaagaagcagcaccugguaacaggcauggccauucagaggguacuuagcauuuuca

SEQ ID NO: 7493 - RNA, 63 nt, Human
ugcuuuguccaucagguccuaaaagugucucucacuuguaauuccacagaagugaauaaagca

SEQ ID NO: 7494 - RNA, 73 nt, Human
cuggggcuaccucucuacagcuguuuccucagaggggaaaaaucuuggaggaccagaugggugggagcucugg

SEQ ID NO: 7495 - RNA, 83 nt, Human
guggacuuaaccauugcaaagcacacugucuuucucagcguucucugcaagucaguagguguuaguaugguugcaaaguucac

SEQ ID NO: 7496 - RNA, 72 nt, Human
uguugaggguggggagaaaagacuuuaagggaggagagccaucuauuuuguuccuaaagccaccucucagca

SEQ ID NO: 7497 - RNA, 71 nt, Human
ugaaauuuuauuguguaaaguuuauagaaguaugacuaguauuccuuuguacaaaguacacaacgguuuua

SEQ ID NO: 7498 - RNA, 66 nt, Human
ugucuccaaaaguccuugaaggauuuuaggaaguuguuaaaagucuugaaacgauguuugggggca

SEQ ID NO: 7499 - RNA, 70 nt, Human
cugagugccaaguggaagacaacauuugaucccaagaaaacagaauggaacccuuucacuucaaacucag

SEQ ID NO: 7500 - RNA, 65 nt, Human
uaaaagugcccaugaugaauagcaagaaaguacccuguggcccauuucaugugaccaaacuuuug

SEQ ID NO: 7501 - RNA, 80 nt, Human
agcuuacugccagcaccaacugccucucacaggcuggggugaucaugggacugggaaggaggggugugggcgguagagcu

SEQ ID NO: 7502 - RNA, 83 nt, Human
caggggggugcgagcugguauggaugcccuccuggguuuccugggggcucugcacuuccagacuccaguuuguccacccccug

SEQ ID NO: 7503 - RNA, 76 nt, Human
ggacccgggggacuggggaggcucuggccggcguaguccuugccgccagccuucacagcggguucucugagggucu

SEQ ID NO: 7504 - RNA, 78 nt, Human
ucggccucccaaagugcuggaauuacaggugugagccacugugcccggccaccugccuccuuuauuuugggaggccga

SEQ ID NO: 7505 - RNA, 76 nt, Human
uucagcauuuaggggguuccuggugagggcucaggagagaucugggcccagagccagccacacuccuuguguugag

SEQ ID NO: 7506 - RNA, 97 nt, Human
ccgcccagccccagguggguaguggggaggagagcuggcauuccuccagguggcaaauggcgacucuauacucuccgcccgccccagggcuggaugg

SEQ ID NO: 7507 - RNA, 89 nt, Human
ccguacugcagagcuuacacaaaauugaagaauguuaauguucgaguuuucuuaucuuguguuuagagguuguuuuuugcagaucuugg

SEQ ID NO: 7508 - RNA, 74 nt, Human
cuccuccaggagaccauaagauagaucccccauccucucagcccuauucccaugccucccucucauuggaggag

SEQ ID NO: 7509 - RNA, 89 nt, Human
aaaacugcuuugcacgugacacaagcugaccucaagagcuccacguuuuggcuucgagcaaguuuuggugcuacuguuuuugcaguuuu

SEQ ID NO: 7510 - RNA, 96 nt, Human
aguucugcuagaauuauugagauauuuauacaugcagaguuacuuuauuaauauuuguaauucaugcauaagaguauuuuaaugauaguuauaacu

SEQ ID NO: 7511 - RNA, 81 nt, Human
agccugcagugugugcguggcaguuugguuuauugguagugucgucucagcagcgugccacauggccaccaucugcgggcu

SEQ ID NO: 7512 - RNA, 85 nt, Human
cucucccugcccaggggcugggccacucugcccgcucuuccugggaggaaacaugggcagaggggcccauggugggaggggagag

SEQ ID NO: 7513 - RNA, 76 nt, Human
acagucuacuuauuuuuugucccuuuuauauccuauuuuaggcaaaaugauaaaacccagaaaauaacaggaaugu

SEQ ID NO: 7514 - RNA, 86 nt, Human
ccuagaccuuuacaucacauagaacuauaaaacagguuuccauaaaauucauuccacauuguagucaacggauguaugauccuagg

SEQ ID NO: 7515 - RNA, 62 nt, Human
ccccaucagggauggucacaguccagccacaggggcgacucugcccaucagucccccugggg

SEQ ID NO: 7516 - RNA, 68 nt, Human
ccucaggaaaacgugguccccaccuggagcuucccucgguugcccuggcccuugaccccguccugagg

SEQ ID NO: 7517 - RNA, 97 nt, Human
cugacagggagcagcaggaagcugccagcccacugccuccaugcggguccuuggagggcaaacgggggagcggcgcuuccucagcucccgcggucag

SEQ ID NO: 7518 - RNA, 84 nt, Human
ucuuguucaacauaggguagguggcagccacggguccaacucgcuugaggcugggcccugggcgcuccauuuuguguuccagga

SEQ ID NO: 7519 - RNA, 65 nt, Human
cccucacagcugcucucuggcagagguuggcauagccuaggagcagcugcaauugcaccugaggg

SEQ ID NO: 7520 - RNA, 74 nt, Human
gagucaagcccaagagcucccuuggcccuguuccccacucccuccacuggccucugcuguuccugucuuugcuc

SEQ ID NO: 7521 - RNA, 91 nt, Human
gggguggguggggugcuuuguuagggcugucuggcuuucacuucuuguuuuugagcugauuggccagccaguccaggccuucguacagccc

SEQ ID NO: 7522 - RNA, 103 nt, Human
ggaauuuuggguuauacuacgauucuggacugaaaugguaugcagguaugacuuaaaagccauagguauacugggcaccauuugagcacguauagccacuucc

SEQ ID NO: 7523 - RNA, 67 nt, Human
uuugccuuagagauuauaguaguagaacucagauuuauagugugacaugcuguucuggaagagcaaa

SEQ ID NO: 7524 - RNA, 61 nt, Human
cuauaacaggaacaaggauuccgugcuauuaucaucucuggaggaccuaauucuguguaug

SEQ ID NO: 7525 - RNA, 95 nt, Human
ggaugcuggugcucaguacgggaaagucauagaccgaagagugagggaacuguucgugcagucugcaaauuuuccccuuggaaacaccagcauuu

SEQ ID NO: 7526 - RNA, 76 nt, Human
ugugaaaguagauuuuuauuacagagcaaauuuuucuaucaauucaaugcuuuaaauaaaacaacauaauaccaua

SEQ ID NO: 7527 - RNA, 112 nt, Human
cccauugggcgccaacuacuguguggaacugccauaagcgaccgugcagccagagagggguucguauuauugucuuuauuucguucacacaguacagcugauuucgaauggg

SEQ ID NO: 7528 - RNA, 64 nt, Human
gggaaauuuucuucauuuuuaauuuacagcagaaagaauauaaagcauucagaaaacauuuucc

SEQ ID NO: 7529 - RNA, 64 nt, Human
ugcaugguuuccagcagcugaguucuucaacagauccauugauucaaucgaugcuuuacaugca

SEQ ID NO: 7530 - RNA, 62 nt, Human
aggccuaacuuugggugguguagauacagaucaaaaugaauucucaaaccagagaugggcuu

SEQ ID NO: 7531 - RNA, 95 nt, Human
guggaaugggccuaaaguagugacaagguagucacagacuucuggaggaggguacuugggcuggugucuaccuggcauauuuaggaacauuccau

SEQ ID NO: 7532 - RNA, 67 nt, Human
gggcugccggggcuggcgcagcucaagagccgcgagucguacgugcugugcuacgacccgcgcaccc

SEQ ID NO: 7533 - RNA, 76 nt, Human; identical to SEQ ID NO: 273

SEQ ID NO: 7534 - RNA, 88 nt, Human
aggcuaagucagagucuccuaaagagcccgaacagcugaggaagcucuucauuggaggguugagcuuugaaacaacugaugagagccu

SEQ ID NO: 7535 - RNA, 76 nt, Human
ccuccggacuuucaaaugcuugcugaaccuuccaaaauacuuccucuagguggcagcgcaggaauaucucuggaag

SEQ ID NO: 7536 - RNA, 80 nt, Human; identical to SEQ ID NO: 788

SEQ ID NO: 7537 - RNA, 129 nt, Human
agcaugcucaguuaaauuugaauuucagacaaauaaugaaugcuuuuacuguaaauauaugccaaauauugcaugaaacauucuuaacgugaaauuguuucucugaaauucaaacuuaacugggcaucu

SEQ ID NO: 7538 - RNA, 84 nt, Human
caccaggcaggcagguuaaguuccuugaugcccuccuuuggaaagaaguggagggugagggaaaaaggacuuccauuucaggug

SEQ ID NO: 7539 - RNA, 73 nt, Human
agugccucuucccucccccugcgaacgcuagaauccgaaccaagugagcccagaacgaaggaacacgggcgcu

SEQ ID NO: 7540 - RNA, 68 nt, Human
cucugcgcaggcuccgcacgcagcuaggucaucaggaugggcuagcugcgugcggagccugcgcagag

SEQ ID NO: 7541 - RNA, 70 nt, Human
gccaccggggucugcgauggcacgccagugcuggagccgcagccaggcgaggccacucgacucccggggc

SEQ ID NO: 7542 - RNA, 96 nt, Human
gcaggcccaaccgccgccagcaccauggccagcaccauuuccgccuacaaggagaagaugaaggagcugucggugcugucgcucaucugcuccugc

SEQ ID NO: 7543 - RNA, 103 nt, Human
gcucaucugcuccugcuucuacacacagccgcaccccaauaccgucuaccaguacggggacauggaggugaagcagcuggacaagcgggccucaggccagagc

SEQ ID NO: 7544 - RNA, 61 nt, Human
guccccuucugaccuguccccagagagcccuaugcucuccuccccacccaagaagaaggac

SEQ ID NO: 7545 - RNA, 78 nt, Human
ccggggagauaguguacuuuguggccuccguagccgugcuauacagcguggaggagcagaggcagcgacacuaccugg

SEQ ID NO: 7546 - RNA, 60 nt, Human
gccacgggacagguggcgggaaccacuaaggaagggaagccgcugccgccccacgugcgc

SEQ ID NO: 7547 - RNA, 117 nt, Human
cccaccagcuucuggcaggagcagcuccccuccuggccuccccucccuucgggggugugaaaugaaaugauggaguggaaggcgcuggcuggggucgggcuccaugcucuggauggg

SEQ ID NO: 7548 - RNA, 65 nt, Human; identical to SEQ ID NO: 5414

SEQ ID NO: 7549 - RNA, 85 nt, Human
uauucaucacauuggguugaaaaguuggaagauuuugcaucuuauugaaaagaauuuuucaaaaauguuucuguacaaaugaaug

SEQ ID NO: 7550 - RNA, 85 nt, Human
uuuuuuuuuuugcagggagaauaauguuuauugagaauggcucauuacaaacaaaauauauauaaaaucucugcaaugcaaaaga

SEQ ID NO: 7551 - RNA, 61 nt, Human
gaaggcugaguacugggcacucucaucucucacuggugagaauguccgagaauucuucuuc

SEQ ID NO: 7552 - RNA, 90 nt, Human; identical to SEQ ID NO: 5706

SEQ ID NO: 7553 - RNA, 80 nt, Human; identical to SEQ ID NO: 5707

SEQ ID NO: 7554 - RNA, 65 nt, Human
ucugcgggcgccagcagcuccuccugcucccgggcgcgaggcagcagcugccggcguucugcggg

SEQ ID NO: 7555 - RNA, 75 nt, Human
ccccuaaugauucuagaugaccaaaacuaacaaacugaaaucgggguguugaaccaaaugggauuuguuuggggg

SEQ ID NO: 7556 - RNA, 61 nt, Human
uuucuuucauugcccgugaugugacagacaaccgggcauuugguuacguguguggaggaga

SEQ ID NO: 7557 - RNA, 78 nt, Human; identical to SEQ ID NO: 99

SEQ ID NO: 7558 - RNA, 65 nt, Human; identical to SEQ ID NO: 247

SEQ ID NO: 7559 - RNA, 80 nt, Human; identical to SEQ ID NO: 100

SEQ ID NO: 7560 - RNA, 83 nt, Human
ccugaagcugcagaguguggaauacgugguguucgaugaagcugaccggcuuuuugaaauggguuucgcagagcagcugcggg

SEQ ID NO: 7561 - RNA, 102 nt, Human
gagcuggcccugcagacccugaaguucacuaaggagcuaggcaaguucacuggccucaagacugcccugauccuggguggagacaggauggaagaccaguuu

SEQ ID NO: 7562 - RNA, 65 nt, Human
gggcaguggcaagacagccugcuuccuccucccaauguucgagcggcucaagacccacagugccc

SEQ ID NO: 7563 - RNA, 71 nt, Human
uuugcagcccugcacgaaaaucccgacauaauuauugccacgcccggacgguuggugcauguggcugugga

SEQ ID NO: 7564 - RNA, 74 nt, Human
gagaagcuguuccagaaccucaggacccucaugacuccuuauagggucaccuucgagucaccccuggagcucuc

SEQ ID NO: 7565 - RNA, 92 nt, Human
gcagaugaucgagacguacuuugacuuccgguuguaucgccuguggaagagccgccagcacucgaagcugcuggacuuugacgacguccugu

SEQ ID NO: 7566 - RNA, 129 nt, Human
ggcgagaacgaccguggcgucucuuuuaccuuuggagccgaggugguggccaaguuccuccacaagcacgacuuggaccucaucugccgagcacaccaggugguagaagacggcuacgaguucuuugcc

SEQ ID NO: 7567 - RNA, 68 nt, Human
guggaaaguacgggcaguucaguggccugaacccuggaggccgacccaauaacccacccgcauuccgc

SEQ ID NO: 7568 - RNA, 88 nt, Human
uguggcgaguuugacaaugcuggcgccaaugaugaguguggaccgagacccucauugugcucuuuccagauccucaagcccgccgaca

SEQ ID NO: 7569 - RNA, 61 nt, Human; identical to SEQ ID NO: 1363

SEQ ID NO: 7570 - RNA, 63 nt, Human; identical to SEQ ID NO: 1364

SEQ ID NO: 7571 - RNA, 69 nt, Human
ccaccuguuuuuguccacggggaguuuguuguaaaggaaaaaggacccgucggauuccaacacgggagg

SEQ ID NO: 7572 - RNA, 85 nt, Human
ggaaacagggaaagguuuuuuugcguguagggguugugcaaacccuaaugcauaacggagcaugaaaagacuuuccccuguugcc

SEQ ID NO: 7573 - RNA, 112 nt, Human
ggcaggguguacaccugggguuuucggggcugcccuuuuguuuuggaaaugguuuuuucgaugggggcugggagggcuuuguuggaaaccuuugaucuuguacuucuuugcc

SEQ ID NO: 7574 - RNA, 66 nt, Human
ggguaccugccaagcuuuuuuuugcaaccggaaaagcccggggagcggggguuugccggccguccc

SEQ ID NO: 7575 - RNA, 62 nt, Human
gggggaggggccggacgcuugcccgccuucguggagaaggguguuuggaugggcccuccucc

SEQ ID NO: 7576 - RNA, 73 nt, Human; identical to SEQ ID NO: 721

SEQ ID NO: 7577 - RNA, 76 nt, Human
cagggaaagagggaaauguuguauuaugugggucuuggggccucuaaccaucaguauaggguuuuuucuuuccuug

SEQ ID NO: 7578 - RNA, 77 nt, Human
ucuuaagucacauggcuucugucuuggaaauuuuaccuuuaaaagauuauuuaagacaggaaccaggaggcuuggga

SEQ ID NO: 7579 - RNA, 61 nt, Human
cacagagggcuugcugagggcagggcugcugcuccgcagagaacagacuuggcccucugug

SEQ ID NO: 7580 - RNA, 99 nt, Human
gccaccguguaaggugugggcacggugcucuucaggaguucacaacgggacagcgguuguauuguucuuuuugcaucgugguuuuuccuauaggugggc

SEQ ID NO: 7581 - RNA, 62 nt, Human
accucgaagagcuuuccugagcaaguggcagaagaugcgauugacuggggcgacuuuggggu

SEQ ID NO: 7582 - RNA, 70 nt, Human
auuggcugguggacagaaggcacugcagccugaaauggcagagucuggugcugacgauccgcgagaagau

SEQ ID NO: 7583 - RNA, 79 nt, Human
cagagccugcacccuugcccccucagagcucugcugcagggccugcgugagcuuuuaccacugggcgaugguggcugug

SEQ ID NO: 7584 - RNA, 70 nt, Human
ggcggcgugggcguggccgcugcccugugucucuguagccuccugcuguggccgacccgccugcgacgcu

SEQ ID NO: 7585 - RNA, 103 nt, Human
gggacuggguguggccguguaugcagcggcugugcugcugggugcuggcugugccaccauccucgucaccucgcuggccaugacggccgaccucaucgguccc

SEQ ID NO: 7586 - RNA, 63 nt, Human
auagauauugguuuuucuuucucugacuugaacuaaguaggagaaaccaaaccauaaaccuau

SEQ ID NO: 7587 - RNA, 84 nt, Human
uuaaaacccugaaaacacaugauccuuguugacucugcuugguugaagcaggaaagaauggucuugauggucagaaaguuuuaa

SEQ ID NO: 7588 - RNA, 71 nt, Human; identical to SEQ ID NO: 1145

SEQ ID NO: 7589 - RNA, 70 nt, Human
cuucauucaguuuuuuguccacagcaguggcauuuaaauuacuguacuuuaagacauggaauugcuggag

SEQ ID NO: 7590 - RNA, 70 nt, Human
gaaaauaucuaauucuaagucuugaguucuucucaucagaccauagcaggauuuaacauuuaacauuuuu

SEQ ID NO: 7591 - RNA, 64 nt, Human
ccaaucacguuguauuagguagcccuugggaagagagccaucauauuuuauacacauguuuugg

SEQ ID NO: 7592 - RNA, 63 nt, Human
uccuacuugggcgugcgggagaaagaaaaaggcgccugcgauucuacccgcgcuugagcgggg

SEQ ID NO: 7593 - RNA, 62 nt, Human
uguagccuuccgcccugguauuuggggggaugaccagcccaggcguuggguguuagucugca

SEQ ID NO: 7594 - RNA, 91 nt, Human; identical to SEQ ID NO: 4623

SEQ ID NO: 7595 - RNA, 62 nt, Human; identical to SEQ ID NO: 6729

SEQ ID NO: 7596 - RNA, 60 nt, Human
gcagcaggccgcggcccaccugcugggcccgccccaccacccgggccugccgccugaggc

SEQ ID NO: 7597 - RNA, 69 nt, Human
gccugggagagcugaaggggacgccggcugcggcgcugagccccccagagccggcgcccucucccgggc

SEQ ID NO: 7598 - RNA, 77 nt, Human
gcugagaugugccgagaccuggccccagagguggagaaacugcuccugcagcccagucccuacgugcgcaagaaggc

SEQ ID NO: 7599 - RNA, 76 nt, Human
ugacugcagugcacaugauccggaaggucccugaacucuccagugucuuccucccacccugugcccaacugcuuca

SEQ ID NO: 7600 - RNA, 65 nt, Human
uggggccccccauccuuugcuucaggucuauggacagaagaauugaaaaucggaugggaacccca

SEQ ID NO: 7601 - RNA, 77 nt, Human
cagcugcugagccguccgcuaucugcaguggugcugaaacgaccggagauacugacagaugagagccucagcagcug

SEQ ID NO: 7602 - RNA, 63 nt, Human; identical to SEQ ID NO: 527

SEQ ID NO: 7603 - RNA, 90 nt, Human; identical to SEQ ID NO: 5735

SEQ ID NO: 7604 - RNA, 84 nt, Human
cgccgggcaggcgcugggcaggggguagcggccgcggugcagcugcuggucacccugagcuuccugcggcgcgucgucgaggcg

SEQ ID NO: 7605 - RNA, 64 nt, Human
cuuucugggcagaagauggccacuguucaauaaaagacugucauguggagcccuguccagagag

SEQ ID NO: 7606 - RNA, 98 nt, Human
gcggggucgcagcugccggguguuggggaaagagucgccugccuccggaccggagugcagaccucugacccuggagucgcucggccgcugggaaccgu

SEQ ID NO: 7607 - RNA, 66 nt, Human
cucgggcuaagcagauuguguggaaugguccuguggggguauuugaaugggaagcuuuugcccggg

SEQ ID NO: 7608 - RNA, 73 nt, Human
ggcuucuggcauaccugcuggcuggaugggcuuggacugugguccugaaagcagcaagaaguaugcugaggcu

SEQ ID NO: 7609 - RNA, 77 nt, Human; identical to SEQ ID NO: 2642

SEQ ID NO: 7610 - RNA, 83 nt, Human
cuugaaacgcuuugucaugcuucuucaguaccauggauuugaaaugaacucauccuugcugugagcauccaggagcccuugag

SEQ ID NO: 7611 - RNA, 70 nt, Human
gggcuacuuccugaccaagaucuuccacccgaacgugggcgccaauggcgagaucugcgucaacgugcuc

SEQ ID NO: 7612 - RNA, 80 nt, Human; identical to SEQ ID NO: 100

SEQ ID NO: 7613 - RNA, 67 nt, Human
cucagugggcuccccaggccccacagguggguccaagagagacggggccggaggggugcaagcuggg

SEQ ID NO: 7614 - RNA, 64 nt, Human
ggccagggaagcccgacgugguggggcgcugccucccgcuccguggccuccuuccucccuggcc

SEQ ID NO: 7615 - RNA, 66 nt, Human
ucaguccccacaggcccaugacccaggcggaggccagccgucacaggugcagcucguggguuuuga

SEQ ID NO: 7616 - RNA, 106 nt, Human
aagaugcauuuucauuuuaaacugucuccuggccuguggauuuguggaauggacaguuuguggguuuuaauuuauuugugaggagucggggcugagaaggcauuuu

SEQ ID NO: 7617 - RNA, 62 nt, Human
cuccccacugcccaucugcccccgaauuuccugccaagcucuggggagugggguggggggag

SEQ ID NO: 7618 - RNA, 91 nt, Human
auuauacccuuuaaacagagagaguuuauauaaaggccucuauagaggggugacaauuuuauaaacaauuuucuuuaaaacggguguuaau

SEQ ID NO: 7619 - RNA, 73 nt, Human
gcgcguuccccgguuuucuuuguuccaaggggggccccuauauauagggggggccggauuuuuauuagcgcgc

SEQ ID NO: 7620 - RNA, 62 nt, Human
gggccuaaccgggagaauagugaacuuucuguggaacauuuuuuuuuuuccccgggggaccc

SEQ ID NO: 7621 - RNA, 66 nt, Human
ggggagaaccaccucucgcuuaccuuggggaacucuuucggggagagggagacccuuuuucuucuc

SEQ ID NO: 7622 - RNA, 65 nt, Human
acaggugcacaccaccccacccagcuaauuuuuguauuuuuaguagagaugggguuucaacuugu

SEQ ID NO: 7623 - RNA, 61 nt, Human
acuucaguuuccaugaaauaaacaaugacuauauaaaauuccaccuuucugaaacugcagu

SEQ ID NO: 7624 - RNA, 70 nt, Human
ugaccucaggugaagcucaggugaaaguuucuuucccaagcagcccaucuguguuccaucaagagaguca

SEQ ID NO: 7625 - RNA, 72 nt, Human
ggcguagacgaguuaaguccuggucugcguggaggucgacgacuccguccagacuacggaccugucuggguc

SEQ ID NO: 7626 - RNA, 64 nt, Human
ggcucacuuugagggcaagccuucucggaucgaggcuucuucauggccgcucagaucgugagcc

SEQ ID NO: 7627 - RNA, 78 nt, Human
ccggaacauuggggggcaaacauaagggcaagguuauaggcugacaucuuguucuugucuugguucuuugcugucugg

SEQ ID NO: 7628 - RNA, 80 nt, Human
gugcugggucuccuccuggugagggcaggaaucuacccgguuccguuucugagacuuugccagcugaaaggacuuaguau

SEQ ID NO: 7629 - RNA, 80 nt, Human
ucuugaccauauaccuuggaguugaauauuguuuucauacugcugugguuugaauguucccuccaacacucauguugaga

SEQ ID NO: 7630 - RNA, 73 nt, Human
acuuucaaaaauucaacuaccuagaaauaguuaccuccaguuuagcacauuuagguauuuggacauuuaaagu

SEQ ID NO: 7631 - RNA, 63 nt, Human
gaugcugaauggagaugcuaucaagacccuauaggaugauuacagcacauaccucucagaauc

SEQ ID NO: 7632 - RNA, 69 nt, Human
gcuuccaauuuguuaucaggugacucuggaguaugccaguuugagugaaccuagagacaaaugcucugc

SEQ ID NO: 7633 - RNA, 74 nt, Human
uuacauuuucuuuuacuaaaaaagagacauagaagccgaugagucuuuuuggaucuuggacaaagaaaaugugg

SEQ ID NO: 7634 - RNA, 61 nt, Human; identical to SEQ ID NO: 3030

SEQ ID NO: 7635 - RNA, 61 nt, Human; identical to SEQ ID NO: 776

SEQ ID NO: 7636 - RNA, 89 nt, Human
cucugagaugcugggcccugggcuucuacccugcggagaucacacugaccuggcagcgggauggggaggaccagacccaggacacggag

SEQ ID NO: 7637 - RNA, 77 nt, Human
cuggccugguucuccuuggagcugugaucacuggagcuguggucgcugcugugauguggcaggaggaaacagaucag

SEQ ID NO: 7638 - RNA, 67 nt, Human
gagauacaccugccaugugcagcaugagggucugccaagccccucacccugagaugggagccaucuu

SEQ ID NO: 7639 - RNA, 75 nt, Human
ggagggcacgugcguggaguggcuccgcagauaccuggagaacgggaaggagacgcugcagcgcacggacccccc

SEQ ID NO: 7640 - RNA, 62 nt, Human
gcaggaagcucuuuagcccacagcagauucugcaugccagccuggcaacugaggggaccugc

SEQ ID NO: 7641 - RNA, 63 nt, Human
caccuggguagcugagagagacagaagguaaaauugcggaguugcucucuccgggcucagaug

SEQ ID NO: 7642 - RNA, 73 nt, Human
cgaggagagacuguuuaaagucagcaagaaugaggagaaaccugugcaaaugauguuuaagcaaucuacuuug

SEQ ID NO: 7643 - RNA, 60 nt, Human
guucuggugaaugcugucuauuucagaggaaacugggaugaacaguuugacaaggagaac

SEQ ID NO: 7644 - RNA, 77 nt, Human
ccugcgcgcccucgacgucaauguggccuugcgcaaaaucgccaacuugcugaagccagacaaagagaucgugcagg

SEQ ID NO: 7645 - RNA, 65 nt, Human
gcacuuuuaggaacuacaucauggacuuccagguugggaaggaguuugaggaggaucugacaggc

SEQ ID NO: 7646 - RNA, 62 nt, Human
gcugcaccuggagaugagaguggaagguguggucugcaagcaaguauucaagaaggugcagu

SEQ ID NO: 7647 - RNA, 98 nt, Human
ucccgcccgcuuguggccaacuggcuccagucacucccggaaaugccagucgacuucacuggguacuggaagauguuggucaacgagaauuucgagga

SEQ ID NO: 7648 - RNA, 87 nt, Human; identical to SEQ ID NO: 76

SEQ ID NO: 7649 - RNA, 72 nt, Human
gguuccuguuguuaucuguaccuaaguuacucaguucugagugcaugucugguacagauaacaacaggagcc

SEQ ID NO: 7650 - RNA, 86 nt, Human
cucugcggcuuuccuugaccucugacccgccgaccacgcuugaucccgggccgcggggccaggaagucggaguuugagccccggag

SEQ ID NO: 7651 - RNA, 83 nt, Human
cuuccaaccucuccggccucagccuacaggaggcacagcagauucucaacguguccaagcugagcccugaggagguccagaag

SEQ ID NO: 7652 - RNA, 75 nt, Human
gcccugaagauuucaugacaucuacccagcuggauucucuucccuggccaagucucugagaucuucucccagggc

SEQ ID NO: 7653 - RNA, 77 nt, Human
agccgcuccacucgcauguccacugucucagagcuucgcaucacggcucaggagaaugacauggagguggagcugcu

SEQ ID NO: 7654 - RNA, 85 nt, Human
gggcccagaagaaaauguagguagucuuaggguuagguagcagcugucaggaacuugccccugcccauaagauccuaaagggccc

SEQ ID NO: 7655 - RNA, 80 nt, Human
guccauuccauccgaggcaagucuucugaaaaccugugaacucaguucggaggaaauccugucucgugaacgaaguggac

SEQ ID NO: 7656 - RNA, 60 nt, Human
gcuuauaggaugguaucuuagucugcuucagcugcuaaaacagaauaccauaaauuaggu

SEQ ID NO: 7657 - RNA, 62 nt, Human
ggcgugguggcuuaugccuguguucccaaagugcugggauuacaggcaugagccaccgcgcc

SEQ ID NO: 7658 - RNA, 69 nt, Human
uauaauuugcagcuuaauguauaacuauuuuguccuaacaauucaaauauauuuuuauuccagauugua

SEQ ID NO: 7659 - RNA, 93 nt, Human
gcccacgugguaucaaauauugaaaugcauccguguaacauauaaaucuguuguuaaaggauuguugugauuuggcgcaugaaauaugugggc

SEQ ID NO: 7660 - RNA, 97 nt, Human
gaucaucagacagauggccacucaugugaaaauugauuugugcauaaauguaaggaauaugugcucucauuggguaaucucaucugcuuuggugguu

SEQ ID NO: 7661 - RNA, 84 nt, Human; identical to SEQ ID NO: 384

SEQ ID NO: 7662 - RNA, 89 nt, Human; identical to SEQ ID NO: 385

SEQ ID NO: 7663 - RNA, 62 nt, Human
agaucagauuguuacugugucuaucuaggaaaaggaagacaaaagaaacuccauuuugaucu

SEQ ID NO: 7664 - RNA, 71 nt, Human
cgucugggaugugaggagccccucugcccggcugcccagucugggaagugaggagcgccucuucccggccg

SEQ ID NO: 7665 - RNA, 78 nt, Human
acuguggccuggacaacuucggggacuuugacugggucaucgagaaccauggaguugaacagcgccuggaggagcagu

SEQ ID NO: 7666 - RNA, 72 nt, Human
ggccgugacgcagacgguccgcguuguagcguuggagcagagccgacagcagcggggcuggguguucacgcc

SEQ ID NO: 7667 - RNA, 85 nt, Human
gcguacaacuccuccuccagcuccagcucccgagucucccgcaccaggaagauguccuggcagagcuugaggaugcgguccacgc

SEQ ID NO: 7668 - RNA, 103 nt, Human
gcuggcggccuuggacggggcaguggcucccccggccugaggagugccgccccuuguggccacgcugcccagcaggccggcuccuucccucucgggcgccagc

SEQ ID NO: 7669 - RNA, 121 nt, Human
guagaggaagaugagcuuggcguacaacuccuccuccagcuccagcucccgagucucccgcaccaggaagauguccuggcagagcuugaggaugcgguccacgcacggcagcuccucgaac

SEQ ID NO: 7670 - RNA, 66 nt, Human
uuuuccauuuguauaaauaaaacauuuuuuaauuaaaaaaaaaaacucuacaguacacguggggga

SEQ ID NO: 7671 - RNA, 86 nt, Human; identical to SEQ ID NO: 1403

SEQ ID NO: 7672 - RNA, 60 nt, Human
gacauugugccucgauaguggcagcuuucaauugcaaucaaugcccuucgagaauguguc

SEQ ID NO: 7673 - RNA, 76 nt, Human
gauagcucuauguuggcgucguaugagacggauguaugaccuggcauuuaucaccuagacgcugauacgugccguc

SEQ ID NO: 7674 - RNA, 60 nt, Human
ccaucacuguacuuaaacuccagaaagaaaaagcuaggaaacagaaguagagaggaaugg

SEQ ID NO: 7675 - RNA, 93 nt, Human
ugaguugagugcucagaauucuaccuauaaaugucuaaauauuaagcaggcuaauguuuauacugggcuagauuuaaaaagguacucaagcca

SEQ ID NO: 7676 - RNA, 67 nt, Human
ggucagcagcuuuaccgcccgcucugcucuccacugcggagacuggggcuccggcagaggcuggacc

SEQ ID NO: 7677 - RNA, 73 nt, Human; identical to SEQ ID NO: 2359

SEQ ID NO: 7678 - RNA, 73 nt, Human; identical to SEQ ID NO: 2360

SEQ ID NO: 7679 - RNA, 128 nt, Human
ucauaacucuuuucacucucaucuuccuugggcaagcuuggcugauccucuuugcuaggcuuacugauugacucguauggaggaacagauggguuuuggugcagcagauguuuuggguaggguggugg

SEQ ID NO: 7680 - RNA, 78 nt, Human
uggcaucacagucacauuugaagcgguucccucaggaaaaggacuggguugaacaguuugaauuggcugugguaucca

SEQ ID NO: 7681 - RNA, 77 nt, Human; identical to SEQ ID NO: 7160

SEQ ID NO: 7682 - RNA, 65 nt, Human
uugacauuguaggcuggcgcuggcaucagguucacacucauguucaugccucuuugcaucguuaa

SEQ ID NO: 7683 - RNA, 69 nt, Human
gaauggcuucgguuauugccuuuccuugguguacucgcacuucuuggcuaccuugcaguucguccauuc

SEQ ID NO: 7684 - RNA, 82 nt, Human
uugugucuuacuaaagcagcuuauuguagguguggcguucuaaaacguuuccugccugcgaugguucacaaaauaaacacaa

SEQ ID NO: 7685 - RNA, 66 nt, Human; identical to SEQ ID NO: 4822

SEQ ID NO: 7686 - RNA, 66 nt, Human; identical to SEQ ID NO: 4823

SEQ ID NO: 7687 - RNA, 84 nt, Human; identical to SEQ ID NO: 286

SEQ ID NO: 7688 - RNA, 64 nt, Human; identical to SEQ ID NO: 287

SEQ ID NO: 7689 - RNA, 89 nt, Human; identical to SEQ ID NO: 288

SEQ ID NO: 7690 - RNA, 82 nt, Human; identical to SEQ ID NO: 4821

SEQ ID NO: 7691 - RNA, 66 nt, Human; identical to SEQ ID NO: 4822

SEQ ID NO: 7692 - RNA, 66 nt, Human; identical to SEQ ID NO: 4823

SEQ ID NO: 7693 - RNA, 74 nt, Human
cuuugcaagcacagcaagucccuguaauaagauaggcacaacugucugauccagguaggcacgaguuggcaaag

SEQ ID NO: 7694 - RNA, 75 nt, Human
ugcauuaaucuucucauuuucuacuauucucucaacguugucugugagaccguacucagagugaggauuucugca

SEQ ID NO: 7695 - RNA, 78 nt, Human
auacuuuaauagaaccaaaguugcagauauuggaauguauggaaguaucucagucucugcauaagaggauuaaaguau

SEQ ID NO: 7696 - RNA, 68 nt, Human
guuuguacucuaaggagcccagaucauaaugcagugcauuuccuuagcccuuagaguuucuugcaaac

SEQ ID NO: 7697 - RNA, 63 nt, Human
gcggaaacgugccggagauugcuguguaccuggcuuugaagcaacuccucaguacguuuuggc

SEQ ID NO: 7698 - RNA, 83 nt, Human
uguucuuguguucuuugccuuauucaucauuuuuaaggcuuaucuaauuaacuguguuuggaacugguauaaauacaucaaca

SEQ ID NO: 7699 - RNA, 80 nt, Human
cuuucagagcuuuggucccuguaaugcccgucuuuccuguguccaggaauaaccuuugcuacuaggcaguccucugaaag

SEQ ID NO: 7700 - RNA, 69 nt, Human
aggugcugaggaguuccggaaccccaaggcauccuugcgugugcggcucugugaccuccugagccaccu

SEQ ID NO: 7701 - RNA, 61 nt, Human
uccccuggugaacauacuggaggcccacacgagccuaacaggcugugucuuuaccaaggga

SEQ ID NO: 7702 - RNA, 64 nt, Human; identical to SEQ ID NO: 287

SEQ ID NO: 7703 - RNA, 77 nt, Human; identical to SEQ ID NO: 3082

SEQ ID NO: 7704 - RNA, 82 nt, Human; identical to SEQ ID NO: 1770

SEQ ID NO: 7705 - RNA, 68 nt, Human
gguuuuguaugucaaggaggaguuuaaggccuuuccgaccaccuuguguuccccuuuucugcgcagcc

SEQ ID NO: 7706 - RNA, 60 nt, Human
gagacuggccugucacuggggugccauuguucagcugcagcagcccguucagcccaucuc

SEQ ID NO: 7707 - RNA, 96 nt, Human
agugucguggacucuucuguggcaggacuuggaggcugucccuagcgcacagggggcaucaggaaacuuggccacagaagaccuggucuacaugcu

SEQ ID NO: 7708 - RNA, 62 nt, Human
ugagauuugguggggacacagccaaaccauaucauuuugccccuggucccucccaaaucuca

SEQ ID NO: 7709 - RNA, 67 nt, Human
ggagagaagguuuuuuuuuuuuuuaacauucugaagauggugcugugucaagaaggaccuuuuuuuu

SEQ ID NO: 7710 - RNA, 62 nt, Human
ucuaguauguaaauguuacuugaaucugugcuucauaauaguguguggcauguaugugcaga

SEQ ID NO: 7711 - RNA, 63 nt, Human
agguacucuguggauauccccuuggacaaaacugucgucaauaaggaugucuucagagauccu

SEQ ID NO: 7712 - RNA, 66 nt, Human
gauacaagacaggcaagaacaagugguucuuccagaaacugcgguuuuagaugcuuuguuuugauc

SEQ ID NO: 7713 - RNA, 73 nt, Human
gggcggccgcucuagaggauccaagcuuacguacgcgugcaugcgacgucauagcucuucuauagugucaccu

SEQ ID NO: 7714 - RNA, 76 nt, Human
ugaagccaagcuccgccuucugagcaguuuugauuucuuccuuacugaugccagaauuaggcggcucuuacccuca

SEQ ID NO: 7715 - RNA, 69 nt, Human
gaaaacaaacauucaugucuuguuuaaagguaauuuaaaugccacuaaggaaagcagauguuuaauuuc

SEQ ID NO: 7716 - RNA, 72 nt, Human
gaguauauauuaaauucuauauaaaauauuuuaaaaauauuuuccaauguugaaaauuuuaauguagcacuu

SEQ ID NO: 7717 - RNA, 64 nt, Human
uucccuucaaguacugcauaaaagcugauccacauuguuuaaauuucuuguguaauuuugggaa

SEQ ID NO: 7718 - RNA, 100 nt, Human
aacaagaaauccagcugaggagccaguggcaacuucugcagcccuuucuuacuuuccuguugcauuugcugagucuguucucuugagucaauaucuuguu

SEQ ID NO: 7719 - RNA, 79 nt, Human
caccacaaagggaaagugaaagcauuggaggaggauaauuugagugaguccucuucugagagcuuucucuggagugaug

SEQ ID NO: 7720 - RNA, 67 nt, Human
ccagguguggguccucacacaagccagggguccauaugagcccgcagcuucauggcccagaaucugg

SEQ ID NO: 7721 - RNA, 74 nt, Human
ggugcugucgggcggaccaccauguauccgggcauugcugacaggaugcagaaggagaucaccgccuggcgccc

SEQ ID NO: 7722 - RNA, 62 nt, Human
ugcguagcauuugcugcauggguuaauugagaauagaaauuugccccuggcaaaugcacaca

SEQ ID NO: 7723 - RNA, 87 nt, Human; identical to SEQ ID NO: 2862

SEQ ID NO: 7724 - RNA, 74 nt, Human
accgugccagagagaucgugauuggugagucugguugaguccugaucaccaguaucuuuuuucugaaggcaggu

SEQ ID NO: 7725 - RNA, 117 nt, Human
gugcagcugcugcgguccuugcccagcucguucuccaccagcacgcuguaaucgccgcuguccuugagcgugcagguggggaugacgagggugcacacgccgcugguggaguuguac

SEQ ID NO: 7726 - RNA, 72 nt, Human
gaugacgugcuggaacucagagagguugaugguuccaucccugucaaugucagacuccuccaggauguuguc

SEQ ID NO: 7727 - RNA, 64 nt, Human
gguuccgucaucaucaaagucaaagaugcggaaggcauaaugggacuugaugucuggcguggcu

SEQ ID NO: 7728 - RNA, 63 nt, Human
ugagcugcuucaucucagacgcacuaagccguguguccucgcccucucccgugaggcaguuca

SEQ ID NO: 7729 - RNA, 68 nt, Human
gucugacuucucugacuggucuaguuuuaaugccagcaguaccccuggaccagaggagguagacaggc

SEQ ID NO: 7730 - RNA, 102 nt, Human
cccggcagggugggaggcagcaggggucagccugggcaggaaccucucccaacucuguccagguguucagaccucuuggcccaaccugcucaccccaccggg

SEQ ID NO: 7731 - RNA, 122 nt, Human
ggaguagcugggauugcaggugugcgccaccacgccuggcugauuuuuguauuuuucguggagaccgaguuucaccauguuggccaggcuggucucgaacuccugaccucaggugauccucc

SEQ ID NO: 7732 - RNA, 128 nt, Human
uuuuuauuuuauuuuuuggauggagucucacucugucgcccaggcuggaacacagugagcugacaucgugccacugcacucuagucugggugacagagcaagacuccaucucaaaaaaaaaacaaaag

SEQ ID NO: 7733 - RNA, 72 nt, Human; identical to SEQ ID NO: 4935

SEQ ID NO: 7734 - RNA, 88 nt, Human; identical to SEQ ID NO: 4936

SEQ ID NO: 7735 - RNA, 88 nt, Human
auacaggccucugccucggccgcaggcccuucagucaccgucgccucgucucccugacuguccgcaggccugggcagcauggccguau

SEQ ID NO: 7736 - RNA, 66 nt, Human
ccucggcggcccggcuggugaaucacacacucuauguucaccugcagccgggcaugagccuggagg

SEQ ID NO: 7737 - RNA, 62 nt, Human
gagggcccaggauuuuuggauccccagcccugugacaaggguuccuguccaguuucccccuc

SEQ ID NO: 7738 - RNA, 87 nt, Human
gucgccgcuguggggcagcgccuggcgggcggcccgcgggcgggucgccuccccuccuguagcccacacccuucuuaaagcggcggc

SEQ ID NO: 7739 - RNA, 62 nt, Human
agcauccacauggugacaggucuggaccccgagaaguugaucagccugcacacaguggagcu

SEQ ID NO: 7740 - RNA, 60 nt, Human
cagauugacacccugaguggcuucuccagagaaaugaaaucauugcaguaccucaaccug

SEQ ID NO: 7741 - RNA, 63 nt, Human
ugcugaagaagguggaaggcuuggaggaucugagcaaucucaccaccuugcaucuucgagaca

SEQ ID NO: 7742 - RNA, 61 nt, Human; identical to SEQ ID NO: 3057

SEQ ID NO: 7743 - RNA, 72 nt, Human
ggguucacagcaguaggggcugggcuuccagcaggcucaugauucaggccuuaacccuugcccugggagccc

SEQ ID NO: 7744 - RNA, 64 nt, Human; identical to SEQ ID NO: 3058

SEQ ID NO: 7745 - RNA, 108 nt, Human
gcacugcucuggcauaggaauacuugaauagcuugguuaaaugaagggauggccaggagauguuacuuuuccaagcuauucaggcacuccuuaugucagagacagcgu

SEQ ID NO: 7746 - RNA, 85 nt, Human
caggagaaagaaagaaagagaugccugguuuucacagacugguuccuguggcugggaugacugcauccuuuuuuuuuuuuuuuug

SEQ ID NO: 7747 - RNA, 79 nt, Human
ugaccauccugcaggccccgagcccggcccccuccaccaucccugggaccccggcggggcuccgguccugagaucuuca

SEQ ID NO: 7748 - RNA, 78 nt, Human
cucauucacucagcagcauucaccaagcccuacugugugcauuggcugggcaaggggugguguuggggguagagugag

SEQ ID NO: 7749 - RNA, 87 nt, Human
gguggugaccuggaagguguuguaggcauagucacagaaggugaccaccuuuugugcacgcucccggccacgcaugagguucacgcc

SEQ ID NO: 7750 - RNA, 66 nt, Human
aucugggugcaaaagcccaggguuaggaaccguaggcaugcugcgccccaaggcuuugacccaggu

SEQ ID NO: 7751 - RNA, 86 nt, Human
ccuucugcuguguauguaugccaaggagaccgugggcuuuggaaugcucaaggccaaggcccaggcuuuggugcaguaccuggagg

SEQ ID NO: 7752 - RNA, 73 nt, Human
ggaucacugcuggccuacucugguuacggggacacugacgcccgggucaccgcugccauagccaguaacaucu

SEQ ID NO: 7753 - RNA, 67 nt, Human
agauuaauccaucuauuuucugcauucauauuacaaacugcagaugcucugugugauuuguacaucu

SEQ ID NO: 7754 - RNA, 70 nt, Human
cuucucucucuucuguacacagcacaauuuuacuccagggacuuucacgguggcugugugagaguagaag

SEQ ID NO: 7755 - RNA, 71 nt, Human
gucaaaaagcagucaucuauucauugaauuuuacagcaaacccaccucaaagaguauuugaacuuguugac

SEQ ID NO: 7756 - RNA, 70 nt, Human
gaggaagacaccccuucagauaaugauaguggcaucuguaugagcccagaguccuaucuggggucuccuc

SEQ ID NO: 7757 - RNA, 66 nt, Human
gaagcucucuugggcugcuaagaugggccuuggaacacaccgcgcguuauagcccaagaggguuuu

SEQ ID NO: 7758 - RNA, 72 nt, Human
uugcaggaauugaagcuuuuacagcuggagacugagaaguaggcaucuguacuguaaaccuuugaccuguga

SEQ ID NO: 7759 - RNA, 75 nt, Human
uuuuuccaaugaaugacaacuuuauuuuucuuacacuuuuaaggcugaugaaaaaccuucauuucaauugaaaag

SEQ ID NO: 7760 - RNA, 93 nt, Human
gagccauuguggacguuccaguuggugaggagcuguugggucguguaguugaugcccuugguaaugcuaugauggaaaggguccaauugguuc

SEQ ID NO: 7761 - RNA, 89 nt, Human; identical to SEQ ID NO: 504

SEQ ID NO: 7762 - RNA, 77 nt, Human
aaaugcggccgcaauucgagcucacuuggccaauucgcccuauagugagucguauuacaauucacuggccgucguuu

SEQ ID NO: 7763 - RNA, 76 nt, Human
ugggcuggaggccuguguuccuucccauaagcagggccugugggguguauggggcagaacauaggccuccacacca

SEQ ID NO: 7764 - RNA, 79 nt, Human
aaaaugcggccgcaauucgagcucacuuggccaauucgcccuauagugagucguauuacaauucacuggccgucguuuu

SEQ ID NO: 7765 - RNA, 81 nt, Human
ccuuucgccagcuggcguaauagcgaagaggcccgcaccgaucgcccuucccaacaguugcgcagccugaauggcgaaugg

SEQ ID NO: 7766 - RNA, 66 nt, Human
aggcagaaaucuuccuggaugaaaagaaacaaguucuaugguccacaaaggcggaagaugaugucu

SEQ ID NO: 7767 - RNA, 78 nt, Human
uugcccggcccgauucuuaggcuccaggagucuuuggcaacacagagaccuuuaaacagcagaagagucggauggcaa

SEQ ID NO: 7768 - RNA, 69 nt, Human
agggaaugaacacugauugaauaccuaugcacuuauaacuugguaucauucaaugcucacaauaacccu

SEQ ID NO: 7769 - RNA, 85 nt, Human; identical to SEQ ID NO: 6366

SEQ ID NO: 7770 - RNA, 96 nt, Human; identical to SEQ ID NO: 5638

SEQ ID NO: 7771 - RNA, 70 nt, Human
ggacuggcuuccagacauccacucacagcaugucuccucguguccaggaucucugggagauacucagucc

SEQ ID NO: 7772 - RNA, 63 nt, Human
agagccggcugggagaggcggcgucaggguggguccugcgccugcccuuuccgcgccggcuuu

SEQ ID NO: 7773 - RNA, 69 nt, Human
ggcagaccccgauccugcugcgccgccuucaagggggaccgccggccgcgagccagguugggauuugcu

SEQ ID NO: 7774 - RNA, 75 nt, Human
ggccuuuguccccgaggccgcgccgggagcucccaagcgcacuccugggccggaccucggcgcgggacaaaagcc

SEQ ID NO: 7775 - RNA, 71 nt, Human
ggugccuggucaaucaguccucgggauggcagccaucaacccgugggccuccuggggugaccuuacggacc

SEQ ID NO: 7776 - RNA, 79 nt, Human
uaauagaauauguuuauuaggaacuacauguguaauuuucauauggagauugaacgguuauccauagcauuuuuuauug

SEQ ID NO: 7777 - RNA, 69 nt, Human
ugguaaaucgccuuuauagcucgcuuuuuauuuauuguaacacauaaagguaagauggcugauuuacua

SEQ ID NO: 7778 - RNA, 93 nt, Human
uucuuuuggcacugucucaauaugcaaagcguguuaauugcaaaauaccugugcagaaaacauuguguguauaagaucuaaagccuaaaagga

SEQ ID NO: 7779 - RNA, 80 nt, Human
caaaucggugccacccggccgugacaaauccuaguagauucugugcauguggagcggccgcgaagaggugacaccguuug

SEQ ID NO: 7780 - RNA, 62 nt, Human
ggcuguguccuuauuuuauuuuauuuuuuuguagaauguaaaaagucauuuuagaugccacc

SEQ ID NO: 7781 - RNA, 110 nt, Human
gaccacuguaaucccagcgcccaaggaaggccacuucucaacuggcagaacuucugaaguuuagaauuggaauuacuuccuuacuagugucuuuuggcuuaaauuuuguc

SEQ ID NO: 7782 - RNA, 108 nt, Human
gggaaagaggaacaggagugccagacuccuggucuuuccaguuuagaaaaggcucugugccaaggagggaccacaggagcugggaccugccugccccugucuuuuccc

SEQ ID NO: 7783 - RNA, 74 nt, Human
ccacccccacccccugggggcaccuggcaauguccggagacauuuuugguugucacaacaggaggaacgggugg

SEQ ID NO: 7784 - RNA, 69 nt, Human
gagauggguuucacaccaugcuguccaggcuggucuuguauuccugggcucaagugacccucccaccuc

SEQ ID NO: 7785 - RNA, 74 nt, Human
agccuucaucgucuggcuggccaacggggacacccuccgugucuucaagaugaccaagcgggaggaugggggcu

SEQ ID NO: 7786 - RNA, 70 nt, Human
gaggacuucccuaaaaagcacaaggcgccugucaucgacauuggcauuugcuaacacagggaaguuuauc

SEQ ID NO: 7787 - RNA, 62 nt, Human
ugaacaacacacacgcugcuguaucucccugugggcagauuugguagccucguguggguuua

SEQ ID NO: 7788 - RNA, 75 nt, Human
acuuuauuaaaugcuguaaaaucuaaauacgauccuguuggaugugaaugggucuaguccaguuuauuuuaaagu

SEQ ID NO: 7789 - RNA, 84 nt, Human
ccagugcaccccagcuccggggcagaagaggcagccugcagaucucugcugccgggaaagagcuccugaaguuguggggucugg

SEQ ID NO: 7790 - RNA, 68 nt, Human
gcagggagaggcgucuccaguggcagccuugggucacuuccauagcucccccagcggcuucucugugc

SEQ ID NO: 7791 - RNA, 70 nt, Human
uuccaacugauuaccauuuacagugaucacaaugaaacugcucagaguuaucacugaacuucaguaagaa

SEQ ID NO: 7792 - RNA, 74 nt, Human
aggguaguaauuucucauaauauggauaaagcucugaaagaaguguucgacuacaguuauagagauuacauucu

SEQ ID NO: 7793 - RNA, 60 nt, Human
auugccagacagcugcaccacagacugagucacguggaugugguuaaaguugucugcaau

SEQ ID NO: 7794 - RNA, 64 nt, Human
gacuucgccgccgccuggugccggcuggccgcgaccucagccgcccgccgcccgccggggaguc

SEQ ID NO: 7795 - RNA, 63 nt, Human
ggccgccuuccugcuggggauccuguuugcccucgucugccggagcccgcgcgcccagccgcc

SEQ ID NO: 7796 - RNA, 80 nt, Human
uccccgacagguguccucucccggaaucggggucugaaccccgccaagcucugcaggggaggaagcaccugggucgggga

SEQ ID NO: 7797 - RNA, 78 nt, Human; identical to SEQ ID NO: 99

SEQ ID NO: 7798 - RNA, 65 nt, Human; identical to SEQ ID NO: 247

SEQ ID NO: 7799 - RNA, 80 nt, Human; identical to SEQ ID NO: 100

SEQ ID NO: 7800 - RNA, 61 nt, Human
uugagaaccugaagaaaacuuagauuuuccugaguucauugaacuauuucuuaauccucaa

SEQ ID NO: 7801 - RNA, 131 nt, Human
ugacuccagcucagucggugaugaugagcucguccaccccccagucuucauagcucccaucuggcagguaacggcgaaugaugauggggaucuuucgggccuugaguuccuucauggcaaugagcagagga

SEQ ID NO: 7802 - RNA, 79 nt, Human
uagccugggcgcucuccagaaaagcuacacuugaacugacacacaauuggggcacugaagaugaugcgacccagaguua

SEQ ID NO: 7803 - RNA, 73 nt, Human; identical to SEQ ID NO: 729

SEQ ID NO: 7804 - RNA, 62 nt, Human
uuuucacucugcuucuuggcuuaugaggauaaaaaugacaucccuaaagaaaaagaugaaaa

SEQ ID NO: 7805 - RNA, 67 nt, Human; identical to SEQ ID NO: 1379

SEQ ID NO: 7806 - RNA, 63 nt, Human; identical to SEQ ID NO: 1366

SEQ ID NO: 7807 - RNA, 81 nt, Human
gcggccggggcgggagagacucagcaacgacccauaccucagacccgacggcccggagcggagcgcgcccugcccuggcgc

SEQ ID NO: 7808 - RNA, 75 nt, Human
cuuuuccgacuuccuuccauccgaguagagugacccugggccggucacucagcgggggacacaggaagggcugag

SEQ ID NO: 7809 - RNA, 79 nt, Human
gaucuguggcugcugcauuuugggcuuugggaucuaccugcugauccacaacaacuucggagugcucuuccauaaccuc

SEQ ID NO: 7810 - RNA, 85 nt, Human
agggaggggcugggggggggcaugaauggagucagggagucggccuuucacagaacaggaaaccucccccgccccugugcccccu

SEQ ID NO: 7811 - RNA, 62 nt, Human
uuccgaccagauucagcugggagccgggccaggcuuuagguuggggaaugggaaugaaggga

SEQ ID NO: 7812 - RNA, 78 nt, Human
uuuuuuuuuuuuuguuucuaaaagauguuuauuuuccuuaagaguaaaaaacagucauugcauucagaaaaaaaaaaa

SEQ ID NO: 7813 - RNA, 60 nt, Human
gcuagaugguaugaaaacuuauuaggaaccuuuuuguuuuugagaccauugcauucuggc

SEQ ID NO: 7814 - RNA, 66 nt, Human
ggacagcauuauuaggaacccuguaguaugauauuuaacaauauaggcuucaagaagggcuggucc

SEQ ID NO: 7815 - RNA, 131 nt, Human
ugucugauguguucuuccuuuagucaucauguuaggucuguguacccuaaaucagcauauuacucauaaaucauuaauuaauauaagcauaggaaauggucuuaaaagauacugcauucauucaucagaua

SEQ ID NO: 7816 - RNA, 75 nt, Human
agaggaaggaggaguucagagguuccccagggaagaaggcccggggcuugcacugcaccccagacaguuuccuuu

SEQ ID NO: 7817 - RNA, 60 nt, Human
gccauccggaagcggcucuuguucaggacguggacgcaaccagggccggcugggagcggc

SEQ ID NO: 7818 - RNA, 64 nt, Human
uguggcuuaugaauguucuaaucagguguggaaggagcugacacacggagagucacaggcuaua

SEQ ID NO: 7819 - RNA, 68 nt, Human
agccuuuauugggucagggcuugcuccagagcucaggggccagguaggucaggagccuugggauggcu

SEQ ID NO: 7820 - RNA, 66 nt, Human
gcggggcccgggcggcggcgcuagcagauccagcggauaaaagcggucgaagaagccggguugcgc

SEQ ID NO: 7821 - RNA, 82 nt, Human
ggagcuggagaggugcaggcccagggcgucguccgagugagcagcggugcuggccgugugggacccgggcccgcuuagcacc

SEQ ID NO: 7822 - RNA, 79 nt, Human; identical to SEQ ID NO: 6595

SEQ ID NO: 7823 - RNA, 86 nt, Human
uauaaucuagccacaguguggcuauaaugaggcacggcuuauugcagcuggaaaucaauuauccucacgcugagguggggauucua

SEQ ID NO: 7824 - RNA, 73 nt, Human
ugacuuuugguuuuugucuuuguuuuuaaucauggucccaaaggcagaaggcaguauuuuaucuacuaaguca

SEQ ID NO: 7825 - RNA, 69 nt, Human
gaaggaauaaaggaucuucuugggaaaaaaguguuuaccacaccugauaaguugccauuguucaccuuc

SEQ ID NO: 7826 - RNA, 70 nt, Human
uaccagagucauuucuaucaaaagauauauuucaggauccgggauaauuugaccauaugacuuccuggug

SEQ ID NO: 7827 - RNA, 96 nt, Human
uugcagaacuuacuacuguuuaauacuuuguagaaggaggaauauuuaaacacaaaucuuguuucaggaaagugcuccauagaaaguaaguugcgg

SEQ ID NO: 7828 - RNA, 87 nt, Human
uauuuaagaucacucuaggauccccaaauuuauaguaacuuaauaacuuaaaguucuuuuguaaacuccuauagcugcucuuguaua

SEQ ID NO: 7829 - RNA, 97 nt, Human
aaaugacauaguaaaugauuguuuaaaauuuuuaaauccagacauaaacauauggcuucauuauuaacauccuguauaguccauuacuaaauuauuu

SEQ ID NO: 7830 - RNA, 68 nt, Human
gaugcauucuuaauauuguuuuggucagcuggaauacagcagaaaaauuaacacaguugagaaauauc

SEQ ID NO: 7831 - RNA, 87 nt, Human
ggaccuaaacccuuuuacgccucuuguaggcauucggauuccugaucaugcuuuuaugcaagacuuggcucagauguuugagggucc

SEQ ID NO: 7832 - RNA, 71 nt, Human
ugaggggcuccugaaagaccuacugccaggaccagugacccuggugauggaacgcucggaggagcucaaca

SEQ ID NO: 7833 - RNA, 81 nt, Human
aggaguagagaagggggacaggaguuagggggccccuguguagggguauagggcuccugcaucccucugggaucugagccu

SEQ ID NO: 7834 - RNA, 122 nt, Human
gaguccggcgagugccucaauggaagcgguacuuucuggcuggcuugagguugauguauguggccuucaucuccucggccucaggguuccgcacaucuuugaaucgcuccccuuuggugcuc

SEQ ID NO: 7835 - RNA, 70 nt, Human
gcuccccuuuggugcucacuaccugguugucgauguaucggaucagcuucuugggggccuccuugggagc

SEQ ID NO: 7836 - RNA, 79 nt, Human
ggccgcaugcuggagguaaaguccaugguucccuggccccgugcuggaaaacgugagaggucagacuccuaagguggcc

SEQ ID NO: 7837 - RNA, 112 nt, Human
ggguugcugaucagacugcgagcagcaggggggcugccacuggcagagcuggaagcauguagaucagagauggcagcagcagcugcaggcgcucggggcuguccagcagccu

SEQ ID NO: 7838 - RNA, 69 nt, Human
guccugcagcugcagcugagacugcggcggagacugcgcgagcgugaggagaagcuggggccgcaggac

SEQ ID NO: 7839 - RNA, 73 nt, Human
caugcuauugaaugcaucuuguuuauaacugucuucuaaauauugaauagaaauaaagcguuuuuacaguaug

SEQ ID NO: 7840 - RNA, 71 nt, Human
ccagccuggugaugcagcaggugucacagaaggacccugucccagcugguccugcuccacugcuaggaugg

SEQ ID NO: 7841 - RNA, 67 nt, Human
uuuuuuuugugaaaaacaauuaugggaaauuauuuuugcuuuuccaaaauuaugacaacaaagaaaa

SEQ ID NO: 7842 - RNA, 61 nt, Human
gucgguagucaggguacuggguacacggauguucuuuguacuguucuuuggucuguugcgc

SEQ ID NO: 7843 - RNA, 61 nt, Human
uuuguaauuaucuuuuaaugagcucucaucuuggagagauacauucugaaauauuuacaga

SEQ ID NO: 7844 - RNA, 79 nt, Human
aguguccuauaauucuauugaaaguuuuuaauauuuauugaauuauuuuguuacugucuguaguguuuuguggaguacu

SEQ ID NO: 7845 - RNA, 85 nt, Human
cucuucaguguguugacuucuauccuguuaacacuguaauaucuuuaaaugauguacaggcagaugaaaccaggucacuggggag

SEQ ID NO: 7846 - RNA, 69 nt, Human; identical to SEQ ID NO: 1094

SEQ ID NO: 7847 - RNA, 63 nt, Human; identical to SEQ ID NO: 6444

SEQ ID NO: 7848 - RNA, 91 nt, Human
gacucagaauccggcggagaccgaggggggguccuuggccuuucgcuucccaucucccagucccugaaccucugccagaagcuccugaguc

SEQ ID NO: 7849 - RNA, 92 nt, Human
gagaucaaaggggaaugggacuaagacugcagagcccuggcucccccacugccugccaauugccugcgguuuguggucucuuccacuuucuc

SEQ ID NO: 7850 - RNA, 99 nt, Human
cagcgucugugccggcuccaggugccugccucugggugugugagugggagacuuugcucccuggccucauccuagagaggccccuggugccuagugcug

SEQ ID NO: 7851 - RNA, 103 nt, Human
cggcggccgaagaggcuggcagguggcgccguggggugggugcuccuggugagaggaguccacuccgugcgugcgggcggaggccggcccccgagagccgccg

SEQ ID NO: 7852 - RNA, 63 nt, Human
ucugaucugguggaauauaguaguauggagaccauccuuccuauuaugaaccagguauacaga

SEQ ID NO: 7853 - RNA, 93 nt, Human; identical to SEQ ID NO: 6421

SEQ ID NO: 7854 - RNA, 69 nt, Human
gacugaaaggccuugcuauaacaggagagcuucaaaaacugacuuacuaaugcagcagggacuuuuauc

SEQ ID NO: 7855 - RNA, 70 nt, Human
gccacucuuccaagccucuuggugcacaguaaccuauugcugaaagcuuuugaacagcugagaaaguggc

SEQ ID NO: 7856 - RNA, 61 nt, Human
ggggccucuggugccacuggcauaguauauacuaacaucauucugccagguaggaagcccc

SEQ ID NO: 7857 - RNA, 74 nt, Human; identical to SEQ ID NO: 365

SEQ ID NO: 7858 - RNA, 102 nt, Human; identical to SEQ ID NO: 2172

SEQ ID NO: 7859 - RNA, 102 nt, Human; identical to SEQ ID NO: 3952

SEQ ID NO: 7860 - RNA, 77 nt, Human; identical to SEQ ID NO: 3082

SEQ ID NO: 7861 - RNA, 85 nt, Human; identical to SEQ ID NO: 814

SEQ ID NO: 7862 - RNA, 68 nt, Human; identical to SEQ ID NO: 2853

SEQ ID NO: 7863 - RNA, 60 nt, Human
cuccucgcuccgugcucgcaggugccuccuccuggacggcggcagcggcggcgcgaggag

SEQ ID NO: 7864 - RNA, 76 nt, Human; identical to SEQ ID NO: 3277

SEQ ID NO: 7865 - RNA, 64 nt, Human; identical to SEQ ID NO: 1324

SEQ ID NO: 7866 - RNA, 78 nt, Human
acuguagagggaauugccgggugugccccauggauuggaggacaaguuugcgaucacaagggccggcacuucugcagu

SEQ ID NO: 7867 - RNA, 63 nt, Human
gguuuccgaacaccgaaauuuggucggaaguaaacuggccgucuaaaacgggcuucacaaacc

SEQ ID NO: 7868 - RNA, 92 nt, Human
gagcuuucugggcagacuuggugaccuugccagcuccagcagccuucuuguccacuggcuuuggaugacacccaccggcaacugucuggcuc

SEQ ID NO: 7869 - RNA, 69 nt, Human; identical to SEQ ID NO: 1724

SEQ ID NO: 7870 - RNA, 85 nt, Human
agguucuggguccggggcgaggggcccaucuucuucuacacugggaacgagggcgacgugugggccuucgccaacaacucggccu

SEQ ID NO: 7871 - RNA, 80 nt, Human
gcuggcggccgagcggggggcucuacuggucuucgcggagcaccgcuacuacgggaagucgcugccguucggugcgcagu

SEQ ID NO: 7872 - RNA, 94 nt, Human
ucauggauaacugugaggagcuaaucccugaauaucugaacuucauuagaggggugguagacucggaggaucucccucuaaacauaucccguga

SEQ ID NO: 7873 - RNA, 66 nt, Human
uuuugaaaguuaucaggaagaauugggucaaagaaaugcuuagaacucuuuacugaacuggcggaa

SEQ ID NO: 7874 - RNA, 123 nt, Human
cccgguaucauuccucgaauuucagugcgggaaccaaugcagacuggcauuaaggcuguggauagcuuggugccaauaggucgugguccagcgugaacugaucaucggugacgacagacuggg

SEQ ID NO: 7875 - RNA, 75 nt, Human; identical to SEQ ID NO: 74

SEQ ID NO: 7876 - RNA, 67 nt, Human; identical to SEQ ID NO: 836

SEQ ID NO: 7877 - RNA, 87 nt, Human; identical to SEQ ID NO: 76

SEQ ID NO: 7878 - RNA, 60 nt, Human
aacauugccauccuguguguauguauauguauauguauacuuuuuucacuggcuuauguu

SEQ ID NO: 7879 - RNA, 73 nt, Human
agucuccuaaggauaccuauuuucuuuaugaauauucugaacauguguaaaauggcccuauuuuuaacagacu

SEQ ID NO: 7880 - RNA, 62 nt, Human
ccgaccgcucccauggcccccggcugcacugccacaggccccaccacccaccacgacggcgg

SEQ ID NO: 7881 - RNA, 89 nt, Human
gguuuaaacaagauuggaaggaacaauuuaaaagcacucauguauaauugauaugucaaguuacuaaucauuccucuauucauuaaacc

SEQ ID NO: 7882 - RNA, 88 nt, Human
agagucucacucugucaccuaggcugaagugcaguggcgugaucucagcucacugcagccuccaccucccggguucaagugauucucu

SEQ ID NO: 7883 - RNA, 73 nt, Human
gaagaaugaguuuacaguauggauagcuccuccuagauuucaaggggaguaaauuccccccucucauuuuguc

SEQ ID NO: 7884 - RNA, 79 nt, Human
gcacaggagucuucacgaugugcgccucaggcuggcucucucaaauuucugggcccucagggcgccuccucuccugugc

SEQ ID NO: 7885 - RNA, 61 nt, Human
uuguuggccaggcuggucucgaacuccugaccucaagugaucugccugccucggccuccaa

SEQ ID NO: 7886 - RNA, 63 nt, Human
cacuugaggcaugucacaagggcuggggcgucagcgucgugguuggaguagcugcuucaggug

SEQ ID NO: 7887 - RNA, 74 nt, Human
ccugaaccugagucuguggcgaccagaacacagagggcuggagcugcugccugcucacacagaacuaggucggg

SEQ ID NO: 7888 - RNA, 73 nt, Human
uagggaagaucuaggagaagaggaagaacaguaagccacugcuucuuggaaaaucuucugggggucugaccug

SEQ ID NO: 7889 - RNA, 76 nt, Human
ugggagcugugucccuuuccucuugaccccgugaagauuccuagggcgggguggggaggagggggcacaguaccua

SEQ ID NO: 7890 - RNA, 78 nt, Human
ugguguggcgucagcccuaugugcgccccggaagugaugugaagcagugagggcaaaauggguugacgcgaagcacca

SEQ ID NO: 7891 - RNA, 61 nt, Human
cauuaaguuuguguuagucuuuauuaaaaacaaaaaauaacuaaaauuucagacagcgaug

SEQ ID NO: 7892 - RNA, 73 nt, Human
accagguccaguucacagacauuguggaaauauucguuuaagaccuccacgaaguugugaauggccuccaggu

SEQ ID NO: 7893 - RNA, 65 nt, Human
ggggaagcgagcaggcgaguccaggaggggccggggccgggguggggcucgccugcccucacucc

SEQ ID NO: 7894 - RNA, 66 nt, Human
guggcccaaacccagcugggucccuuccuccuaggcagcugagggaaggacugcuggguuggccac

SEQ ID NO: 7895 - RNA, 63 nt, Human
cacccugccuugucuccaggagguccgaagcucugugggaccucuugggggcaagguggggug

SEQ ID NO: 7896 - RNA, 101 nt, Human; identical to SEQ ID NO: 5402

SEQ ID NO: 7897 - RNA, 72 nt, Human
ggcuggggcagguggccgccuuccacacacuugaggaacccuccccucucccucggugacaucuugcccgcc

SEQ ID NO: 7898 - RNA, 97 nt, Human
agaauuaggcagcuggacucaguuuagaugaucccaauuuuguuggcaacauccaaagcaucguaaucaggagccagucgaacauaugccuucuucu

SEQ ID NO: 7899 - RNA, 62 nt, Human
gugucuucggccgccggaaggggggugcguccggaucuucuucuuuuuguggcuguggacac

SEQ ID NO: 7900 - RNA, 70 nt, Human
guaauacacaacauacuuuuauguuucuuuuauagguaucuaucuaauaaaaguuuauuuguguaugugc

SEQ ID NO: 7901 - RNA, 71 nt, Human
uuucauuuaaaaaaugguuucagcaaauaugaaaauagaaaguccguuauuuguccauuuguaauaugaga

SEQ ID NO: 7902 - RNA, 83 nt, Human
ccaugccugaagcuaaaaauauauacggguuuuugaaugcagcagccaauaaauuccauuuuguguggugguuuaggcuaugg

SEQ ID NO: 7903 - RNA, 63 nt, Human
cggagcaccugucuucauugccucucccuucugcagccugaaaggaggauguucaggacucug

SEQ ID NO: 7904 - RNA, 90 nt, Human
cugggcugggcuaggcugggccuagcuguagagacacaccuaaguuccguucucuguuuggaggcugcacccagccugaguccccaccag

SEQ ID NO: 7905 - RNA, 76 nt, Human; identical to SEQ ID NO: 4396

SEQ ID NO: 7906 - RNA, 72 nt, Human
auuugccaaguauguaucugauccacacaaaucccuagaaagguuuucuguguagucuucauuaacgcaaau

SEQ ID NO: 7907 - RNA, 74 nt, Human
aaggcugggggugggaagauggaauacugaccuaauguauaaaacuuaaaacaauucuccaauccccucuccuu

SEQ ID NO: 7908 - RNA, 80 nt, Human
cauugcuaaguguacugcugccgaaguugccccaguuccaugggguucgugucuuuggcaucaacaaauacugagggaug

SEQ ID NO: 7909 - RNA, 61 nt, Human
gaagagaagagauuggcaaauggggcuccugggcccaguccugcuaguggcaaguuucuuu

SEQ ID NO: 7910 - RNA, 65 nt, Human
gggcauggggaaggcacugaaacagaggacuauaaaacauccuucucuuauucuccauacugucu

SEQ ID NO: 7911 - RNA, 65 nt, Human
cuuuucugguggauucaucaucuaugacacacacucacugaugcauaaacuggucaccugaagag

SEQ ID NO: 7912 - RNA, 131 nt, Human
gacuguguauacucuacaaucuaagaaggauuucagcaaauuuggagcagggcuguuugcucuuuuguggauauugugccugucaggauucuugaaguuuuuuuuuuaauagugagauaauggaguugguc

SEQ ID NO: 7913 - RNA, 60 nt, Human
guguuggcagcaggugccucucagcuggugcuggacagaaggggcuugcaguauuugcac

SEQ ID NO: 7914 - RNA, 68 nt, Human
uccaaacccgguacauugucaguugcuuuccucgguucaccugcagucggcgauccaccagguucuga

SEQ ID NO: 7915 - RNA, 75 nt, Human
caguucuugguacucacagauuucagccuuugguguuuuuuaaucuuacccaaacuguaugucagcaccccacug

SEQ ID NO: 7916 - RNA, 63 nt, Human
gacaauaaacuaaauaaauauucuguaugauguuuuaacagaccauugaaaaacaguauaguc

SEQ ID NO: 7917 - RNA, 61 nt, Human
gacggcgcuacgcacggaccgacgggaagguuuuccaguuucuuaaugcgaaaugcgaguc

SEQ ID NO: 7918 - RNA, 130 nt, Human
aaaggaucccgccuugaauggacccauuaccagugaaggggcauuucuuggcaaauguagggccccuaauaagccucuuugguggcuuugagcccaaaccgguggucuuggaguaccgcgggagcuucuu

SEQ ID NO: 7919 - RNA, 76 nt, Human; identical to SEQ ID NO: 758

SEQ ID NO: 7920 - RNA, 83 nt, Human; identical to SEQ ID NO: 2490

SEQ ID NO: 7921 - RNA, 61 nt, Human
agacaaccacauaccugccuucuaauauccugcgauaguggaggcuaaauuuaaauugucu

SEQ ID NO: 7922 - RNA, 77 nt, Human
uuugaacuauguugggccaauccaauucuucccucuuggaaucugaaauugggauuggagacagguaguaaaucagg

SEQ ID NO: 7923 - RNA, 67 nt, Human
ccaaauaaugauaaaaauagauguauccucuguaaaaaucuggacuaaacuauucagucauucaugg

SEQ ID NO: 7924 - RNA, 90 nt, Human
ggguggccucucccuggagcugagcccacccugggggacccuggaucaugccccuuugcccccagcccuugguuugcagggaggccgccu

SEQ ID NO: 7925 - RNA, 80 nt, Human
acaggcugcuauaaaugcgcuugauggccucggcuucuuccuugucaaggaugccuuucuccacauaagcaucagcuugu

SEQ ID NO: 7926 - RNA, 61 nt, Human
agcggacagguccagaagccccccggaaccgcacuguucaccuuuaucugaccaaaccgcu

SEQ ID NO: 7927 - RNA, 65 nt, Human
gauuggacucuaucauaugugucaaauccaagcuuaaacaauuugacagugugguucaucugauc

SEQ ID NO: 7928 - RNA, 61 nt, Human
ggacagugacucuggggcugggaugugacuucgugcugggcccccccaggugaagcuguuc

SEQ ID NO: 7929 - RNA, 73 nt, Human
gaguugagccuuggccagggguccggugcugucgcgggaaaccuccagccuuguucuucaaaccacucagcuc

SEQ ID NO: 7930 - RNA, 83 nt, Human; identical to SEQ ID NO: 1471

SEQ ID NO: 7931 - RNA, 98 nt, Human; identical to SEQ ID NO: 6908

SEQ ID NO: 7932 - RNA, 78 nt, Human; identical to SEQ ID NO: 6909

SEQ ID NO: 7933 - RNA, 104 nt, Human
aaugacccguucuggaaucagcuucucucauuuucuuucccugcaccaacuagcagugaguugaaacucuuggaggaagcaaccauuucagucugcaggucauu

SEQ ID NO: 7934 - RNA, 61 nt, Human
ucggcgaucuuccuaaaaaugaguacuugaaaaaguuaucaggcacggaaucuaucucuga

SEQ ID NO: 7935 - RNA, 72 nt, Human
cagugucccauugucaucuacucagucucuaauagggcuaaggagcaugauaguaucuauuuauaagcacug

SEQ ID NO: 7936 - RNA, 65 nt, Human
gccagaaauuccacacagcauuguuauccaucaugggcauuacuagcaacacuggaguggcuggu

SEQ ID NO: 7937 - RNA, 60 nt, Human
uuuccuacuguagaaggcauggaucuaccccauuuagauuuacugucuauaccauugaaa

SEQ ID NO: 7938 - RNA, 84 nt, Human; identical to SEQ ID NO: 286

SEQ ID NO: 7939 - RNA, 89 nt, Human; identical to SEQ ID NO: 288

SEQ ID NO: 7940 - RNA, 61 nt, Human; identical to SEQ ID NO: 776

SEQ ID NO: 7941 - RNA, 71 nt, Human
uguuuuauuugguucaaaauauaaagggcagguuagagggcuacacagaaaaaaggcuaaaaauaaagaca

SEQ ID NO: 7942 - RNA, 86 nt, Human
ugucuggcaauggucauccagcuuucacagaguaaucuaucuuaagauauaguuuagggaggcaaaaucaaugacucaagaggaca

SEQ ID NO: 7943 - RNA, 62 nt, Human
cugagcuucgcaucaucagcaccaucacgagagaaguggagccugaaggggacggggcugag

SEQ ID NO: 7944 - RNA, 67 nt, Human
gcaaaacagcuguagguggccucccugacaacagacacucagcccuccccacccuagcucuccuugc

SEQ ID NO: 7945 - RNA, 65 nt, Human
gugguccuggcacgugggccaccagucuucugaaugaagaguugagucccgggucaggaguccac

SEQ ID NO: 7946 - RNA, 93 nt, Human
ccggccuugccagacggaagcuccuuguccccgacugcagcacaggcccuggcugugggacauaagcaaagauuuggugcuggaugaggaagg

SEQ ID NO: 7947 - RNA, 72 nt, Human
ccaggagccugcaugugcuuuggccauuucacauaugagguuuggucacugguccaggaaacagguucuugg

SEQ ID NO: 7948 - RNA, 81 nt, Human
uucauugguacaaacaucuuucauacacaauaggcuaugauaaaaugaggcauauggguguauaacuacaguauuaaugga

SEQ ID NO: 7949 - RNA, 66 nt, Human
accauuguccauuucuacauguuauucgcuuguuacccucaaguugauacaaguucuggcauuggu

SEQ ID NO: 7950 - RNA, 72 nt, Human; identical to SEQ ID NO: 1696

SEQ ID NO: 7951 - RNA, 60 nt, Human
gcugggacuugucuuucgggguucuuuguaggcccggggggaggcaucaaaguccacggu

SEQ ID NO: 7952 - RNA, 82 nt, Human
ggugagacagggagucccggcugcccuguggccccauucuguuguggaggcuucgcugggagcugagaacacccugcugucc

SEQ ID NO: 7953 - RNA, 63 nt, Human
uuuuuuuuuaguacaagugguuuauuucucuuccaggugaggccgcauguauauaagcaaagg

SEQ ID NO: 7954 - RNA, 91 nt, Human
ggaucuuccaauucuucugauuuuaggaaauucuguugcgugcuaaccuugaacacaugcuagccucccuuucucagauuuggaaagaucu

SEQ ID NO: 7955 - RNA, 60 nt, Human
guaauaguuauuucucuaaaaugaaacauauauuucauuuuauauauauauauauauuac

SEQ ID NO: 7956 - RNA, 87 nt, Human
acuguauuuuuacuauacuguugcuauguuuggauacauaccacuguguuuaaguugccuacaguauucagcccaguaacauacagu

SEQ ID NO: 7957 - RNA, 65 nt, Human
uuuuuugagauggaauuuugcucuugcugcccaggcugggguugcaauggugagaucucaaaaaa

SEQ ID NO: 7958 - RNA, 62 nt, Human
cagcccugugccuuugcuagagaaccgacaaucaaacccuuuucuguggaggaucaaggcug

SEQ ID NO: 7959 - RNA, 73 nt, Human
cucaacuggauucggaaugugcugauuuccauuggacucaaguugaucucacuuauauucugagugccgggag

SEQ ID NO: 7960 - RNA, 77 nt, Human; identical to SEQ ID NO: 1207

SEQ ID NO: 7961 - RNA, 76 nt, Human
cauuacuggguauuuagcagauauucaaucaauauuuguuggaugcauaucaaucugcuaagugccugaaguugug

SEQ ID NO: 7962 - RNA, 62 nt, Human
gagauguaaaagagcuugucacgccugugcacagcgcagucggaggagagucagaaugucuc

SEQ ID NO: 7963 - RNA, 63 nt, Human
uuccucagcuagugcaauuuauuuuucuuaguauggggcaggaguuaauauggccagaaggaa

SEQ ID NO: 7964 - RNA, 64 nt, Human; identical to SEQ ID NO: 287

SEQ ID NO: 7965 - RNA, 64 nt, Human; identical to SEQ ID NO: 287

SEQ ID NO: 7966 - RNA, 89 nt, Human; identical to SEQ ID NO: 288

SEQ ID NO: 7967 - RNA, 84 nt, Human; identical to SEQ ID NO: 286

SEQ ID NO: 7968 - RNA, 64 nt, Human; identical to SEQ ID NO: 287

SEQ ID NO: 7969 - RNA, 131 nt, Human; identical to SEQ ID NO: 6294

SEQ ID NO: 7970 - RNA, 64 nt, Human; identical to SEQ ID NO: 287

SEQ ID NO: 7971 - RNA, 131 nt, Human
ucuuuuacuacuaaacuuaaauggccaauugaaacaaacaguucugagaccguucuuccaccacugauuaaaagugggguggcagguauuagggauaauauucauuuagccuucugagcuuucugggcaga

SEQ ID NO: 7972 - RNA, 69 nt, Human
cugccugacuaacuccauggcauggaucuuacccgugacaaaauguguuccauggucaaaaaauggcag

SEQ ID NO: 7973 - RNA, 78 nt, Human
uuuuggcucucugaccagcaccauggcgguuggcaagaacaagcgccuuacgaaagggcggcaaaaagggagccaaga

SEQ ID NO: 7974 - RNA, 63 nt, Human
gucuucaggugauggcagaggaggggacccaagagggggccccccacugaagacauuggggac

SEQ ID NO: 7975 - RNA, 82 nt, Human
caggccugggggggccagcccgaggcgcugucuggagcucacccaguccccaccaggcgaugaccucgccccccaggaccug

SEQ ID NO: 7976 - RNA, 103 nt, Human
cgcgcccaccgccgccacccccaggagcgcuggcggcuggaguaccucauggaguuggacggcggccggcugcggccuggugugcggggugugcgggggcgcg

SEQ ID NO: 7977 - RNA, 109 nt, Human
cucggccuccgcugcuggagcccccuccucucaggaucucagccccccagacguaaaggaagaggcuggcugggucccugagaggcccgggcccgcagaggaggaggag

SEQ ID NO: 7978 - RNA, 70 nt, Human
acucuucuucuuuugugagucuucuuuuauuucuuguuuuagaggguuggauuuugauuuggagaggagu

SEQ ID NO: 7979 - RNA, 61 nt, Human
gccauagcuccuggaguuggauuuucagugacuucauugaaaauuaaaacguuucuauggc

SEQ ID NO: 7980 - RNA, 84 nt, Human; identical to SEQ ID NO: 286

SEQ ID NO: 7981 - RNA, 64 nt, Human; identical to SEQ ID NO: 287

SEQ ID NO: 7982 - RNA, 89 nt, Human; identical to SEQ ID NO: 288

SEQ ID NO: 7983 - RNA, 71 nt, Human
cccggcccucccugcccuccauucagggagaaaccucuccuucccgugugagaagggccagaggguccagg

SEQ ID NO: 7984 - RNA, 70 nt, Human
ucccaaguccagcgugaagggccacagccccucuuggcugccaagcacgcagaucccauggacauugggg

SEQ ID NO: 7985 - RNA, 73 nt, Human
ccucacaccuggaccaaaugagcugaagcugauaaaaagaaaaccuagcugcuuauuuauuucaccguggagg

SEQ ID NO: 7986 - RNA, 64 nt, Human
agaugcugacaauacuugggaaccugaagaaaauuuagauuguccagaauugauugaagcguuu

SEQ ID NO: 7987 - RNA, 103 nt, Human
gucucucaugaaauggaaagauucagaugaggcagacuuggugcuggcgaaagaggcaaauaugaaguguccucaaauguaaugcuuuuuaugaacgagagac

SEQ ID NO: 7988 - RNA, 63 nt, Human
ucagaaagcuggcaaagaaaaagaugguacaaaaagaaaaucuuuaucugacagugaaucuga

SEQ ID NO: 7989 - RNA, 95 nt, Human
uuauuuacaaugcuagaaauacagacuuaccuuacaucaauuuuguccuaaaccgaauuucucaggauuacugugguuucuuucauucugauuga

SEQ ID NO: 7990 - RNA, 91 nt, Human
uugcuaccagucuaaucuugccuuaaauguuaaguuauuuuuugaacuauauaaauauaaacauauaaacaccagaugaugacuggaguag

SEQ ID NO: 7991 - RNA, 69 nt, Human
gcaguggcaagagggguucagguagggggaugaugagggaacaccagacuuggcuaguugggccacugc

SEQ ID NO: 7992 - RNA, 73 nt, Human; identical to SEQ ID NO: 6844

SEQ ID NO: 7993 - RNA, 61 nt, Human
uuuuuuuuuuuuugggaguuauuaauucuuuauuaggauucagguuucaaacaagguagaa

SEQ ID NO: 7994 - RNA, 64 nt, Human
cugccggccgccgagcuggugcaggccugccgccuggugugccugcgcuggaaggagcuggugg

SEQ ID NO: 7995 - RNA, 94 nt, Human
ggaggagcgugcggaggaccagcaggaggaggaggcggcggcgccgcgcguaccuggacgagcugccgagccgcugcugcugcgcgugcuggcc

SEQ ID NO: 7996 - RNA, 71 nt, Human
ggggauaggggcagucgaaagggcuuggguucaaaaaaagcccagcugcuuuuucuccugccgcugccucc

SEQ ID NO: 7997 - RNA, 61 nt, Human
cguuuuuuaaacguuaauaaugugauuuucaguaaaguggcaggaucagcauugaagaaug

SEQ ID NO: 7998 - RNA, 118 nt, Human
ggggagcgugcaagugccucucgagcgcuacguggagccucgccuucugcacagacucucggagggccggggcuggauggagcaacugagugggcguggaugucuuugcaugguuccc

SEQ ID NO: 7999 - RNA, 87 nt, Human
ccgagguccgucgcaagguugcccagguccgggccgccguggaggguggugaggcgccggggcccacugagugaggacggagcuggg

SEQ ID NO: 8000 - RNA, 92 nt, Human
cgcuugaggggauuauaauuucuuuaaaaagaggggaggggagaggccauggccgucccagucaagaaaaggaagaugaacuucucagagcg

SEQ ID NO: 8001 - RNA, 66 nt, Human
cgguaucguagauagaccuggcugggaggagaggcaagcaguaaaucgagacuuggccaugaaccg

SEQ ID NO: 8002 - RNA, 60 nt, Human
cuuggccucgagcaagccuggccuauccccuguagggggugggugaggggcgaggcugag

SEQ ID NO: 8003 - RNA, 60 nt, Human
gagguggagaucaucguggaggagcuggagcugaagaagcaccugcuggugaaccacuuc

SEQ ID NO: 8004 - RNA, 77 nt, Human
gugggcacccugccaccagaagccagcugacgccgcauccaaccaugaaaucguccgcccucugccccgcagcccac

SEQ ID NO: 8005 - RNA, 109 nt, Human
aggcuuggcuuuguuacuuuugaugaccaugauccuguggauaaaaucguauugcagaaauaccauaccaucaaauggucauaaugcagaaguaagaaaggcuuugucu

SEQ ID NO: 8006 - RNA, 91 nt, Human
uugguuuguaacuuuuucauccauggcugagguugaugcugccaugggcugcaagaccucauucaaauugaugggagaguaguugagccaa

SEQ ID NO: 8007 - RNA, 64 nt, Human
uggggaaaugguuccuuuccguuaagcccccagggaaaacggaagggaaccuuacuuucuucca

SEQ ID NO: 8008 - RNA, 61 nt, Human; identical to SEQ ID NO: 1988

SEQ ID NO: 8009 - RNA, 60 nt, Human; identical to SEQ ID NO: 2705

SEQ ID NO: 8010 - RNA, 67 nt, Human; identical to SEQ ID NO: 6859

SEQ ID NO: 8011 - RNA, 79 nt, Human
gcggaggccgagcugggccagggccgccagccgcucaggugguagccacgccagagcggggucgccucugggccucugu

SEQ ID NO: 8012 - RNA, 61 nt, Human; identical to SEQ ID NO: 6860

SEQ ID NO: 8013 - RNA, 74 nt, Human
ucucuuguucgugguggaucuuucucagccugagccguggacucaaguugacgauuuaaaauaugaacuggaga

SEQ ID NO: 8014 - RNA, 75 nt, Human
cacagucuuugacaauaguagcuuacuaagacugcucagaaugaguaagcuuuaggaaacuacuaaaaugcugug

SEQ ID NO: 8015 - RNA, 60 nt, Human
gaauaacaaaauccguucucucucuucacuugacagaagcauuaacugaauuuguuuuuc

SEQ ID NO: 8016 - RNA, 69 nt, Human
ggaagggguaaacccagguuccucuucuugagucaaucuccagaaugggacauggguucaucuccaucc

SEQ ID NO: 8017 - RNA, 78 nt, Human
gacucucgccggccgcgcgaacccguuugagcucgguauccuagugcacacgccuugcaagcgacggcgccaugaguc

SEQ ID NO: 8018 - RNA, 62 nt, Human
uguugaaacaucguggugcacauuuguuuaaaccaaaaaaaaaaacacacccaccaccaaca

SEQ ID NO: 8019 - RNA, 75 nt, Human
ccugugaagcagaccucuccagggggaggugaguuaagccuuuccagccacuggacgaguaagucaaugcauggg

SEQ ID NO: 8020 - RNA, 81 nt, Human
gccaucaauuucaacuagaaaggagcuaaagccauagagacaauauagccagagggcucaacaacuaaugaguuggguggc

SEQ ID NO: 8021 - RNA, 78 nt, Human
guguuugcugaugguuucccauuuuaggauagggcucaucaaaagccagucagacuaaaggaagaauuagauggaugc

SEQ ID NO: 8022 - RNA, 68 nt, Human
cccaccaguccuugcacuguucugacacuuuccccaggaggaaaacaaaguacaaagguuacgguggg

SEQ ID NO: 8023 - RNA, 65 nt, Human
cagcuugcuuucugaccaugggcccugagccugagucuguacccggguccgugggaaguuggcug

SEQ ID NO: 8024 - RNA, 86 nt, Human
uccaucaccguggugcugcagguugucagcgaugccggcucucuccuggccuguugucugaaugccgccugcauggcauuggugga

SEQ ID NO: 8025 - RNA, 91 nt, Human
acauaguuccugucaaaaucccaguaagauauuugaauagauacagacaagauuauuccaaaguuuauacgggaagacaaaggaacuaagu

SEQ ID NO: 8026 - RNA, 78 nt, Human
gugauccugugaucaugaucgggaaggcuuaacaugguaaagaugucaaaucuccccaaauugauguauagguauaac

SEQ ID NO: 8027 - RNA, 68 nt, Human
uccccugugaagggcacaagguugggccugggguuggcuuggcacuuggggggccguuggcuugggga

SEQ ID NO: 8028 - RNA, 75 nt, Human
ggccuguggugcgguuugguggauuuggggcgcaccaccuccgcccuaaccccaaccccaacguguccccaggcc

SEQ ID NO: 8029 - RNA, 64 nt, Human
ggcacuuggaagaagccgaggagggggagggccgagcccaacgaguuggcagcuccagggggcc

SEQ ID NO: 8030 - RNA, 63 nt, Human
gugggugcugcgccacaugacgcaggcggggggacgaacacacaugcgcgacgcagcgccgac

SEQ ID NO: 8031 - RNA, 66 nt, Human
ggcagucacuucccaugagggccuggcccacccgcugcaguugcccuaaggaaaaauaaagcugcc

SEQ ID NO: 8032 - RNA, 92 nt, Human
ugcggugcuccccagaaaaggggaaggggcaguggggugagaagguccuggcuccccuucucccggccuuccucugccuggggcccacugca

SEQ ID NO: 8033 - RNA, 93 nt, Human
uggccuuugggacucaaaacacaggaucugacuggugggcacaauaccaucuugaacgcccacaaaaagguuugguuuuguugccaaagggca

SEQ ID NO: 8034 - RNA, 72 nt, Human; identical to SEQ ID NO: 4169

SEQ ID NO: 8035 - RNA, 70 nt, Human
uagguaucacuacuacauuuuacauaaaagggaaguaucaauaaacuuuagaaaguaguaaauucaccug

SEQ ID NO: 8036 - RNA, 105 nt, Human
acccccgcgaagacucuggcgccuccugcaggcgucccgaucgcaggcugcgugggaggggguacugcagggucggguaugcugcuggaggccgguuuugggggu

SEQ ID NO: 8037 - RNA, 130 nt, Human
cucgcucaggcgcgcgcaccacgcccagcuaauuuuguauuuuugguagagccuggccaacaugacaaaaccccaccucuacuaaaauacaaaaaauuagccgggcaugauggcgcggcugaggcacgag

SEQ ID NO: 8038 - RNA, 66 nt, Human
gaucuguacccgacacagacgggccgaggcaagccugaggcugacaguuggugagagggacggauu

SEQ ID NO: 8039 - RNA, 81 nt, Human
aaaauaaaaagcaguugggacuaagauagcuaauuccaaauaucugugucuaaacaauuuuaaaaacuguuuauuuauuuu

SEQ ID NO: 8040 - RNA, 130 nt, Human; identical to SEQ ID NO: 783

SEQ ID NO: 8041 - RNA, 89 nt, Human
cugugcucccugugcacucucagaccccaccucuucguugucauagagugugaccaugcgcacgugaggcucuguggccagggagccag

SEQ ID NO: 8042 - RNA, 62 nt, Human
agggaaaggacugcccugcuccuuuugaggaaggaaaccugcaaggcaaguucucaaucccu

SEQ ID NO: 8043 - RNA, 63 nt, Human
ugugaaugucaaccaguuuuugcuuuauauuccuucaaaaacauuccacccuggucauucaca

SEQ ID NO: 8044 - RNA, 68 nt, Human
cccggcagcaccccuagcaaauaggucuguaucaaagauucuguacagcugguuuugggggugaaggg

SEQ ID NO: 8045 - RNA, 76 nt, Human
gggagaauccccuaagcuccagggcccagggucuaaccugagaggucggggcugcaggaagcugggggaggcuccc

SEQ ID NO: 8046 - RNA, 63 nt, Human
gcccguguacacaugcuguguggagccgcugauggugaccgcgcagaccaccucgccaugggc

SEQ ID NO: 8047 - RNA, 69 nt, Human; identical to SEQ ID NO: 528

SEQ ID NO: 8048 - RNA, 90 nt, Human; identical to SEQ ID NO: 5735

SEQ ID NO: 8049 - RNA, 65 nt, Human
cgcuuucgcuccgcguucgcgcuuucgaccagaggggggggggcgcaccucgcuuaccgaaagug

SEQ ID NO: 8050 - RNA, 79 nt, Human
ggcccagcggccucuuuccuacguaccucggacugacggggcggucugacaagugccguggguugggcuucgccgggcu

SEQ ID NO: 8051 - RNA, 63 nt, Human
guaaaggccccauuguaacgcaaggugccauucccgcauacucgacauuacucuugccuuugc

SEQ ID NO: 8052 - RNA, 81 nt, Human
caaaugauuccaauguacaguuuauacugacaaugacugaacagaagucacaauguuagcacacacacaugaggaacuuug

SEQ ID NO: 8053 - RNA, 79 nt, Human
ggcuuuuuagcuugagacucuauccugagauuuugaugugguaggucuagggugaggcauaggcauuuuuuaaaaagcu

SEQ ID NO: 8054 - RNA, 64 nt, Human
gguuuguuuuuuuuuuuuuuggaccggaaaaaauucuuuuuauuacgaguugaacagaugaacc

SEQ ID NO: 8055 - RNA, 83 nt, Human
cugaccuggccuggccccccgcgggcauggagcccgcccgcaaugcgagcagcgccacccgcccugggcagagccaggcacag

SEQ ID NO: 8056 - RNA, 62 nt, Human
ggaugccgucuggagcccuggaugccccaccaugguggcgcccaugggccccccguggcucc

SEQ ID NO: 8057 - RNA, 61 nt, Human
ggggcgcgcaaagccacgaaaagcaaacuuuuugauguuucugguccauggggugcgcccc

SEQ ID NO: 8058 - RNA, 100 nt, Human
ccucuuaucuggcugcaguguugcggaggccaggaggagaugguaccccuuagggcagccuugcuucaggaccgacugcagcacccgguugggcaggagg

SEQ ID NO: 8059 - RNA, 92 nt, Human
gcggccuucuuccaugaacagaagggcaggcugcuguucauggagguguccucagaaagguagcccugugucuucuggguggacaggccagc

SEQ ID NO: 8060 - RNA, 79 nt, Human
uaaaauguaaacgugaaaaaaaggauggaauaaaagucccuacuuauuucuacuuaagaugucaugugauaauauuuua

SEQ ID NO: 8061 - RNA, 82 nt, Human
cucacuccacgucuugucauaccugaucggcccugcgggucccucacuggagggugggucucucacugggcggggggaggag

SEQ ID NO: 8062 - RNA, 89 nt, Human
cugccaaagguaccggggccgugacgaacugagggaagauuccccugugggagucuuggguuucgucaugcccguggaccuugaggcag

SEQ ID NO: 8063 - RNA, 89 nt, Human
gcagucugaguuuacuuaugccugcuuuuguuagacuaucuugacugacaggauuauugguacauuugggcaggcuggguuuuggaagc

SEQ ID NO: 8064 - RNA, 77 nt, Human
ggguucgggugaugaugguuccacgucagcggcccuccgccucuuggguuugcgugacgguuccacgucaccgaccc

SEQ ID NO: 8065 - RNA, 96 nt, Human
guuaguuuuuggaguguggguuuuguuuuguuuuuugaauuuuuuauuuuguucuacucgguuuuauucuuauugcucaggcuugagugcacuggc

SEQ ID NO: 8066 - RNA, 61 nt, Human
ugacgguuccacgucaccgacccuccgccucuuggguucgggugaugaugguuccacguca

SEQ ID NO: 8067 - RNA, 85 nt, Human
gccaagggagagccgggcuuccgaggacccccggguccauacggacgugcgggguacaagggagagauuggcuuuccuggacggc

SEQ ID NO: 8068 - RNA, 78 nt, Human
ggagccgggaagaugccaaggcugggcuaugggaugagggcgaaaugaccgggaccagcaaggagcucccagggcacc

SEQ ID NO: 8069 - RNA, 63 nt, Human
gggcgaacgaggcuccccgggacccaagggugagaagggugaaccgggcagcaucuucagccc

SEQ ID NO: 8070 - RNA, 67 nt, Human; identical to SEQ ID NO: 2283

SEQ ID NO: 8071 - RNA, 98 nt, Human; identical to SEQ ID NO: 6908

SEQ ID NO: 8072 - RNA, 78 nt, Human; identical to SEQ ID NO: 6909

SEQ ID NO: 8073 - RNA, 80 nt, Human
gcagacggcagaaugccuccaaaggugacuucagagcugcuucggcagcugagacaagccaugaggaacucugaguaugu

SEQ ID NO: 8074 - RNA, 84 nt, Human
ggacgugacgggcggcuacguuucucacaggcugccaaggcaagauggacgagcaacguggacacguuaugaacgaucgggucc

SEQ ID NO: 8075 - RNA, 60 nt, Human
ccaggguugcugugaacagcuuuagauauuuguuuuugcacagccacacugcggccuugg

SEQ ID NO: 8076 - RNA, 79 nt, Human
uccugcuacaacaccucccuuugcauuucguugagcauacugugcaacaacucgagacaacagagaccaaagagcaggg

SEQ ID NO: 8077 - RNA, 60 nt, Human
gaccugcgggacaagauucuuggugccaccauugagaacuccaggauuguccugcagauc

SEQ ID NO: 8078 - RNA, 120 nt, Human
cagcucaaggggaagaaagucacggacaaguucacugagagcgucuacguccuggccaacgagccauccguggcccuguaccggcugcaggagcaugugcgucgcucccuccccgagcug

SEQ ID NO: 8079 - RNA, 62 nt, Human
cuccgggcuuccggugccgugucccgguucgcucggccgcggucgcuauggaggagccggag

SEQ ID NO: 8080 - RNA, 73 nt, Human
ucuacacuguggaguacgccugcagcgccgugaagaaccugguggacagcagcgucuacuuccgcagcgugga

SEQ ID NO: 8081 - RNA, 81 nt, Human
uuaguuaacaaagaaguggaaucuugaugagcugccuaaauuugagaagaauuuuuaucaagagcacccugauuuggcuag

SEQ ID NO: 8082 - RNA, 70 nt, Human
cgcgccgccgcuucgggccucugguugggaguccuguccggccugacuuaggccgagcgcggcgugcgcg

SEQ ID NO: 8083 - RNA, 73 nt, Human
gcggucucccgccuggcccacgcccaccaugcgcauccaccccuguggcggccgggccggguuggggggcugu

SEQ ID NO: 8084 - RNA, 92 nt, Human
ggugguguuaauuggugucuguuuuugcccuguggccuuagggugcccuuccugucccuucuuucagaaacagucauucuguaauaauagcu

SEQ ID NO: 8085 - RNA, 98 nt, Human
ucuuguuucuugauggucaguucguauggaaugcaccugcaaggguaccuccuugucugaaagucgugcuuuaaaccuaacuuaauuaagagacgaga

SEQ ID NO: 8086 - RNA, 94 nt, Human
gaagaucaguguugguacagaugcaaaguacugaaaaucaucagcguugaaaagugucuggugagguacauugacuauggaaauacugaaauuc

SEQ ID NO: 8087 - RNA, 82 nt, Human
gaaaguaagauuaucuccagccaaaaugucaaccaagaauucuacagaucuaguugaauauguugacaagagucaugcuuuu

SEQ ID NO: 8088 - RNA, 67 nt, Human
caaaauuaacccggcauucccaguuuaauugcugcgugcacggcgggcgcugccgggucaaauuuug

SEQ ID NO: 8089 - RNA, 62 nt, Human
ggugagaaggggucugcggccucgucuccagccgagggcgggaggcgccucgccccuacacc

SEQ ID NO: 8090 - RNA, 68 nt, Human
gcugcugggauuguugggaaccugaggucugcaggagugcgaugcuuuggcccaacagcagaagcggc

SEQ ID NO: 8091 - RNA, 71 nt, Human
gcuuucaccaaaccugaagaagccugcagcuucauuuugagugcagacuucccugcuuagguugugaaggc

SEQ ID NO: 8092 - RNA, 69 nt, Human
ggcccucucagggcccuaggagccuuuguguguccugcucacauugucuccagggccucggacagggcc

SEQ ID NO: 8093 - RNA, 75 nt, Human
guacagaacauaugacugaguuucuggagucccacaggccagcguuggaguccugacaccucaguauagcugugc

SEQ ID NO: 8094 - RNA, 71 nt, Human
auggcugauggcaacgaggaucugcgggcugacgacuugccugggccagccuucgagagcuaugaguccau

SEQ ID NO: 8095 - RNA, 61 nt, Human
ccgccgccgcccggcuccgcucgcggccccucugucugcaggcgugccccggcggcggcgg

SEQ ID NO: 8096 - RNA, 78 nt, Human
cggggacugcaggaggcggggcagacgggcugcaagagggagccggcccgacgcggaccgcuucccugcagugccccg

SEQ ID NO: 8097 - RNA, 76 nt, Human
gaggcugggaaacgcgagcgcaggcggcagagaggccucaacgccgucccuuucgccaccgccuuuuccuugccuc

SEQ ID NO: 8098 - RNA, 90 nt, Human
ggcaccccgggguguggccagaggacuucggcgacgcuuccccgagaguagccccccuccucaacccagaaaagacaaccccgcggggcu

SEQ ID NO: 8099 - RNA, 67 nt, Human
ggcccggcccgcagcccgagcaggaagcgccggcgcuaggcuggccccugcgcugccagcuggagcc

SEQ ID NO: 8100 - RNA, 60 nt, Human
cacagaucuggguccccacagugacaugaugauugugacuggaccggaagcggguuagug

SEQ ID NO: 8101 - RNA, 66 nt, Human
gcaccauuuucuccuaagucuuauuccaagcuaagcaggcuuaagguuacaguggaaagugagagc

SEQ ID NO: 8102 - RNA, 74 nt, Human
aaggauuuauuaaaaaaccaguaagacacuacuacaucaugacacugucacacugggcuuuuaacacaagacuu

SEQ ID NO: 8103 - RNA, 116 nt, Human
uuccauucagggacuugauacaaaaaauuuaguuugaacugcuauuagcagguggcaggagccaccuucaaaugaaucuucaaauuggaaaauacugcuucaccaccuguugggga

SEQ ID NO: 8104 - RNA, 63 nt, Human
acuuuuuuaaugggucucaaauucugugacaaauuuuuggucaaguuguuuccauuaaaaagu

SEQ ID NO: 8105 - RNA, 82 nt, Human
gguuuuacgaugcauuguuaucauuaaccagucuuuuacuacuaaacuuaaauggccaauugaaacaaacaguucugagacc

SEQ ID NO: 8106 - RNA, 72 nt, Human; identical to SEQ ID NO: 4935

SEQ ID NO: 8107 - RNA, 88 nt, Human; identical to SEQ ID NO: 4936

SEQ ID NO: 8108 - RNA, 100 nt, Human
guaagacauaugaagaauuggaucagagauuucuaugacagugcgggaaagcagcacugagaaacuuuugauuguuuucaauuucuucuuuuauguucac

SEQ ID NO: 8109 - RNA, 76 nt, Human
uagcucucccacaccaucaaguggcccucauaacuggaguagaguuccugguugcuuuucauaagagggagaguua

SEQ ID NO: 8110 - RNA, 94 nt, Human
cugggcacguaggccucccgcagugagaugaggaucgggucggcaucccgcccgcucacccacuccucagccuccagggcugccucgggcccgg

SEQ ID NO: 8111 - RNA, 113 nt, Human
gugaggaaagcugggcgcuggcuucggccugggccugggacgggugggggugggaacugaccccugcgcugccucagaggcucugggcagccagcuagcccgguucuccaugc

SEQ ID NO: 8112 - RNA, 84 nt, Human; identical to SEQ ID NO: 5301

SEQ ID NO: 8113 - RNA, 109 nt, Human
cguugcccacccaccccacagcccagagugggggcugaacaagcacccagcaggggggcuaaacaagccaauucauuucccaucccugagugggucgggggaggcagcg

SEQ ID NO: 8114 - RNA, 83 nt, Human
ggggcacguggcaggaaggggaggcaaggccaaggcaggggauucccccaccggccgccccccaaaccccuacccaaggcccc

SEQ ID NO: 8115 - RNA, 73 nt, Human
gaaagcucauaauaaaauagacuuuuaaaauuacaaauaaaaucuguacaucaaggauauuuuuaaggcuuuc

SEQ ID NO: 8116 - RNA, 73 nt, Human
uggcucauuucggcuuguaggaccaucucuucuuuucucaagggaaaagugucaaucagguugaacagggcca

SEQ ID NO: 8117 - RNA, 75 nt, Human
aaauaauuuuauaauauccaucuugauuucauuguugacccaacaaucauucaggagcagguuauuuaacuauuu

SEQ ID NO: 8118 - RNA, 69 nt, Human
ggucauuuuuuucuucugcugcguuugaguuugguguguucucucucuuuaguuccuugaggcgugacc

SEQ ID NO: 8119 - RNA, 76 nt, Human
cugacagauuucuucccucuucccuccccaucacccaccucagugauaacacauuacugauagaggaagucauuag

SEQ ID NO: 8120 - RNA, 61 nt, Human
uagcaaguucauaaguuuccaaaaaggaagcccauacauaacaguggagguguuuugucua

SEQ ID NO: 8121 - RNA, 84 nt, Human
uuuaauaacugggggcuauuuuaucagcuugccuauuaaaggacuaugguaaguauagaaucuuaaugguugccaguuaguaaa

SEQ ID NO: 8122 - RNA, 60 nt, Human
aaugcuuacauacuuuugaauuuguaccugcaaaaaucguauacaaguuaugagagcauu

SEQ ID NO: 8123 - RNA, 62 nt, Human
auaaucauauauuauauaaaaauucugauucaugcaucagauuacauaaauuauacaauugu

SEQ ID NO: 8124 - RNA, 65 nt, Human
cuagaggacuuuaacaugcuguaggugauuucccaugaccacagcuguaggauugccagauuuag

SEQ ID NO: 8125 - RNA, 62 nt, Human
gcgcagcgagcgccggaagcggaggaguaccgacucuuccagcgucucgggcuccuugcagc

SEQ ID NO: 8126 - RNA, 92 nt, Human
gcgccgggggcugcgggagcgucagcugcugugggaacgccaauuuuaguggaagugucaccggcggugggagcggcggcagcuguuggggc

SEQ ID NO: 8127 - RNA, 121 nt, Human
uuaguuucuauauaucagacaaaaaagaaaugcuucagcagugcuucuguauuauaggagagaaaaaguuacagaagaugcuuccugauguauuaaagaacuguucaauagaagaaauuaa

SEQ ID NO: 8128 - RNA, 72 nt, Human
ccuucccugcuugccugcucccucacgccccugcucugcguguuggaugugaaaaggaugucagggacuagg

SEQ ID NO: 8129 - RNA, 70 nt, Human
guggaggguccacccaccccagguagcccaggugaggccccugggucccccugucacucaggcuguccac

SEQ ID NO: 8130 - RNA, 79 nt, Human; identical to SEQ ID NO: 6903

SEQ ID NO: 8131 - RNA, 85 nt, Human
ccagagcuuggcauugugcaagauguuggccaggcuaaucaggggcacauccuucaucugguguggcgcauagugcaaagccugg

SEQ ID NO: 8132 - RNA, 72 nt, Human
ccauugccacguagacauugcccagagugaagugguucacagcaaaguguggugcgaucucuacugccaugg

SEQ ID NO: 8133 - RNA, 64 nt, Human
aggggcugcggucucugcaaugaaauguggccucuugccaaucuccccggaggcgcuuucccuu

SEQ ID NO: 8134 - RNA, 91 nt, Human
cugggagugaaucaggccggcuucaccuuacacucugcaauuuaugcugcacgcccggacgugaagugcgucgugcacauucacaccccag

SEQ ID NO: 8135 - RNA, 72 nt, Human
ggccuaaaagcaagguucuuauucuccggaaccaugggccucgugucaguuggagagagcguugaggaggcc

SEQ ID NO: 8136 - RNA, 62 nt, Human
aggauguauuuuguaguauauugggguaauuccucaauuaaaguaagucgcauuaauauccu

SEQ ID NO: 8137 - RNA, 75 nt, Human
ccacugcuucaugagcucaaaucuguuuuuucuagcuaagagaccacaggccaaagaacuaaagggcaagcaggg

SEQ ID NO: 8138 - RNA, 72 nt, Human
guuuaucaauuccaucauaauuauuuacuguugacuugaggcucaaguuagaauucuuaugugguagauuac

SEQ ID NO: 8139 - RNA, 68 nt, Human
gcagcacaaaggcggcgcggugcacaucggaguuguaguacuuuaacugcauuugcgccaccugcugc

SEQ ID NO: 8140 - RNA, 66 nt, Human; identical to SEQ ID NO: 4249

SEQ ID NO: 8141 - RNA, 82 nt, Human; identical to SEQ ID NO: 1766

SEQ ID NO: 8142 - RNA, 98 nt, Human
ccucuccuacauugagcacaucuuugagaucucccgccguccugaccuacucacuauggugguugacuacagaacccgugugcugaagaucucugagg

SEQ ID NO: 8143 - RNA, 85 nt, Human
gucggccugcaaggaagacauccccagcgaaaagagugaggagaucacuacuggcagugccugguuuagcuuccuggagagccac

SEQ ID NO: 8144 - RNA, 74 nt, Human
ccucauuucuucuauuuaaaaaaaagccucuuucagugcaaguggggugccaaggauguagaauaaauaagagg

SEQ ID NO: 8145 - RNA, 66 nt, Human
ggccaggaucagugcacagggaggaagcgcucacggacgcuccgcuccagcccgggcauccuggcc

SEQ ID NO: 8146 - RNA, 60 nt, Human
gcugcucgccccacaugcccucauggcuguuguuccagggggggcaguggggugggccgu

SEQ ID NO: 8147 - RNA, 79 nt, Human
ggcccucgaacuggcuguuccaggcggcgucgggcugguuguuccagggcgcgucgcgcuggccguuccagccgggguc

SEQ ID NO: 8148 - RNA, 78 nt, Human
guccagagaugaggcagaguggagagaaacaacucuggcugagccagagucuccagccacuacuucuuauuccugggc

SEQ ID NO: 8149 - RNA, 70 nt, Human
ggcagcacaaaggcggcgcggugcacgucggaguuguaguacuucagcugcaucugcgccaccugcugcu

SEQ ID NO: 8150 - RNA, 82 nt, Human; identical to SEQ ID NO: 1766

SEQ ID NO: 8151 - RNA, 80 nt, Human
acuuccccuucucccugcuggggcugcuggcccuggccaucgggcucuggggccuggcugucaaggggucucugggaagu

SEQ ID NO: 8152 - RNA, 116 nt, Human
ggcgccugugcugggggcuuucuguuccagcgucaaggauggaggagggggagaggagccccuuacugucccaggaaacugcaggccagaagccccucucugugcacaggccaccc

SEQ ID NO: 8153 - RNA, 93 nt, Human
cgaauuucagugcgggaaccaaugcagacuggcauuaacggcuguggauagcuuggugccaauuggucguggucagcgugaacugauuauucg

SEQ ID NO: 8154 - RNA, 67 nt, Human; identical to SEQ ID NO: 836

SEQ ID NO: 8155 - RNA, 87 nt, Human; identical to SEQ ID NO: 76

SEQ ID NO: 8156 - RNA, 69 nt, Human
ccgacacacagccaggcgcuaggcucccugcggaccucgggaagggggaagagcgucaacaauuuacgg

SEQ ID NO: 8157 - RNA, 85 nt, Human; identical to SEQ ID NO: 45

SEQ ID NO: 8158 - RNA, 70 nt, Human
ccugaaggugacguuccucaucacccgccucacggggccagcccugcagugggugauccccuacaucagg

SEQ ID NO: 8159 - RNA, 80 nt, Human; identical to SEQ ID NO: 887

SEQ ID NO: 8160 - RNA, 70 nt, Human
cuuccugggcaucguggcugaggugcuggugcuggucaccaucaucuucaucuacgagaagcgccggaag

SEQ ID NO: 8161 - RNA, 62 nt, Human
cgccgcccaggccccugcgugggcuggacgcgucagccccacacauuagccucgcugcggcg

SEQ ID NO: 8162 - RNA, 90 nt, Human; identical to SEQ ID NO: 3033

SEQ ID NO: 8163 - RNA, 82 nt, Human; identical to SEQ ID NO: 3034

SEQ ID NO: 8164 - RNA, 60 nt, Human
cgcgcgcggacgagucgaaggaucggacagagugaacacgucgucgacacgccgggagcg

SEQ ID NO: 8165 - RNA, 64 nt, Human
cugggcagcgagcucagguagagcagagccacaacggacucaacuccacccacuaccucuccag

SEQ ID NO: 8166 - RNA, 77 nt, Human
gcccuugacuguagucacccugcuccaggccuccaaugugccugcuguggugguggggaggguggguaccagggagc

SEQ ID NO: 8167 - RNA, 68 nt, Human
ucaucugaauuuauauggauuuaccucauucuuuuuaaaagcuacauaguauuccacggcacagguga

SEQ ID NO: 8168 - RNA, 67 nt, Human; identical to SEQ ID NO: 1379

SEQ ID NO: 8169 - RNA, 63 nt, Human; identical to SEQ ID NO: 1366

SEQ ID NO: 8170 - RNA, 86 nt, Human; identical to SEQ ID NO: 1381

SEQ ID NO: 8171 - RNA, 71 nt, Human
gggaaacuccgaggacagagggcuaaauccaugaagucuguggauggccugaugauccacagcggagaccc

SEQ ID NO: 8172 - RNA, 67 nt, Human; identical to SEQ ID NO: 1146

SEQ ID NO: 8173 - RNA, 131 nt, Human
cacuaacauauacgccccauucccugcugaggccuguccccaccucaccccuugguugucgaugguguggaacauuggggugaggggcaaaaugccuaagcagagcuggagggaggcaaaugggacuggug

SEQ ID NO: 8174 - RNA, 71 nt, Human
ccgcgguccgggcgccaugcgggcaucgcugcugcugucggugcugcggcccgcagggcccguggccgugg

SEQ ID NO: 8175 - RNA, 71 nt, Human
gcuggagacucugagcugccggcgcgcggcaacaaccaacagcggcgcgccggcccaacaucggaugcagc

SEQ ID NO: 8176 - RNA, 61 nt, Human
uccccggucccgccccucggagacuccucuggcugcucuggggguucgccggggccgggga

SEQ ID NO: 8177 - RNA, 77 nt, Human
caguugaugggcugccagaucuggggcaugcccaggaccucauggaugggcugccuccaggugacagcaaucagcug

SEQ ID NO: 8178 - RNA, 87 nt, Human
gcccagggagaaccccuuggauaucgccaggaugauccuagcuaucguucuuuucacucugguggauauggccaggaugccuugggu

SEQ ID NO: 8179 - RNA, 77 nt, Human
uacuuugaaacggagaugucuuggaacauuggaaugucucagauuucugguuguuauguggaucuguguggaaagug

SEQ ID NO: 8180 - RNA, 106 nt, Human; identical to SEQ ID NO: 6411

SEQ ID NO: 8181 - RNA, 61 nt, Human; identical to SEQ ID NO: 4783

SEQ ID NO: 8182 - RNA, 84 nt, Human; identical to SEQ ID NO: 4784

SEQ ID NO: 8183 - RNA, 85 nt, Human
aauuuguacugucugcggcauuuuuuauaauauuguauauagugacuugacaaauauuguauuacuguacauagagagacagguu

SEQ ID NO: 8184 - RNA, 101 nt, Human
ugaaggcccggugggaaaagaccacgauccuccuugacgaguuuuguuuuucaaaauggugcaauaauuuaaguggcaucuucucucccaccgggucuaca

SEQ ID NO: 8185 - RNA, 61 nt, Human
aggcccgagccgcgggagucgagcgaagacagcgccgaggccgcgguuucccccugggccu

SEQ ID NO: 8186 - RNA, 101 nt, Human
cggcugcgcgggucgcggugcugugaggucugcgggcgcuggcaaauccggcccaggauguagagcuggcagugccugacggcgcgucugacgcggaguug

SEQ ID NO: 8187 - RNA, 66 nt, Human
ggguggugggagaaggaggaggcggcgaaucacuuauaaauggcgccgaagcaggacccgaagccu

SEQ ID NO: 8188 - RNA, 74 nt, Human; identical to SEQ ID NO: 365

SEQ ID NO: 8189 - RNA, 102 nt, Human; identical to SEQ ID NO: 2172

SEQ ID NO: 8190 - RNA, 78 nt, Human
uucaguuaaaaaaagaagaagaagaaauggcaaagagaaaguuuuuucaaauuucuuucuuuuuuaauuuagauugag

SEQ ID NO: 8191 - RNA, 63 nt, Human
cuguuucucauuucaucagccuugggacuugaacagcaggucacuccauuugaaaacuagcag

SEQ ID NO: 8192 - RNA, 75 nt, Human
ugucuuggaaaggccaaagagaaugcacuguauacugccauuguaucaaauguuuugggcaccuuuuucagggca

SEQ ID NO: 8193 - RNA, 81 nt, Human; identical to SEQ ID NO: 7833

SEQ ID NO: 8194 - RNA, 70 nt, Human; identical to SEQ ID NO: 7835

SEQ ID NO: 8195 - RNA, 69 nt, Human
agccucaaagcuuggccagggcugaagguaccacacgguugugggugaggcaggcuaagcgggauggcu

SEQ ID NO: 8196 - RNA, 100 nt, Human
cuuggcccacauccaggcuacccccagcccgcuucuccccugcuuagcccagggaggagacaguaaaggugaugggggcagccgggagggaggggccaag

SEQ ID NO: 8197 - RNA, 65 nt, Human; identical to SEQ ID NO: 3029

SEQ ID NO: 8198 - RNA, 72 nt, Human
gacaccaucuccucccccaaggaagacacagcccuucgaugugaaccuaggagggugggaauggcuuauguc

SEQ ID NO: 8199 - RNA, 80 nt, Human
gguacuacggucuauuucucaaccuuaggcaguaauagacaucacaaacugccaugguuuugcacuaugauuauaauacc

SEQ ID NO: 8200 - RNA, 64 nt, Human
guuagugugucuaaaacaaggagguuuaaggcaauauggaacuguaucccguugaugcacuaac

SEQ ID NO: 8201 - RNA, 66 nt, Human; identical to SEQ ID NO: 2189

SEQ ID NO: 8202 - RNA, 68 nt, Human
cucgggaacucaucagccgcaucaaacagagugaacuuucugccaagaugcgggagugguuuucagag

SEQ ID NO: 8203 - RNA, 61 nt, Human
aacgcuccccgaggcacuuuucggggccgucuggcgcccugggccuucgugggugggcguu

SEQ ID NO: 8204 - RNA, 68 nt, Human
gguggugucuuccggcuucugcugcuggcuggcaaaacuguaguaguuguuggggcccaggacccacc

SEQ ID NO: 8205 - RNA, 72 nt, Human
ugaagaagguguaucucucggcggggauguuacccuuggccaagaacacuuuguugaagcugcccuucauca

SEQ ID NO: 8206 - RNA, 74 nt, Human
uggguguguugaagaagaggauccggguggccucagugaaaaggauuuucucguaggccuucucaaugcaccca

SEQ ID NO: 8207 - RNA, 67 nt, Human; identical to SEQ ID NO: 3685

SEQ ID NO: 8208 - RNA, 63 nt, Human
gugcaccugagccguggaggggcugaaguccagaucuuugcuccugacgucccucagaugcac

SEQ ID NO: 8209 - RNA, 85 nt, Human
ucuauuuucaaccucaaagaaaguuggagaggacuccugcauaugcuguaaaggguguccucucagauuuacugaucgaaauaga

SEQ ID NO: 8210 - RNA, 64 nt, Human
uuccuucuuacugcccuguccucugccuuggaagaggcuuugggaauaguucauagggaaggga

SEQ ID NO: 8211 - RNA, 65 nt, Human
gaaaucuaugauaguguggguggagauaaaccaguuuaggauagccacuucacuauucacauuuu

SEQ ID NO: 8212 - RNA, 72 nt, Human
ggugauuugcccucauuuaacgguagcuggaguaagucaaaccacagagagcccuuacaaagacuaagcacc

SEQ ID NO: 8213 - RNA, 101 nt, Human
uugagauggaguuuugcucuuguuccccaggcuggagugcaaaggugcggucuuggcucacugcacuccagccugggauacagagcgagacccugucucaa

SEQ ID NO: 8214 - RNA, 68 nt, Human
uuuguaauugaagaaaaauugagaaaguagaaagcauauuaaguuaaaauuuuacuuuauaauauaaa

SEQ ID NO: 8215 - RNA, 84 nt, Human
auccaauaaaccaaauuacaaucugcugcuucuucucauuuucaaauacuauaaagauucacacuguuaaaggguuuuuugggu

SEQ ID NO: 8216 - RNA, 80 nt, Human
uagaacuucuaucugauuaaucauuguuuggugaauuaucuuuucacuuccuacuuaggcuaggccaggugguaguuuua

SEQ ID NO: 8217 - RNA, 83 nt, Human; identical to SEQ ID NO: 3611

SEQ ID NO: 8218 - RNA, 70 nt, Human; identical to SEQ ID NO: 3612

SEQ ID NO: 8219 - RNA, 65 nt, Human; identical to SEQ ID NO: 3613

SEQ ID NO: 8220 - RNA, 84 nt, Human
ccccuccuugaagcugauggugaaugugugcggacacacucucugugaaaguuguguagauuuacuguuugugagaggagcugg

SEQ ID NO: 8221 - RNA, 68 nt, Human
gggaagaagauuuuccuagucuaagagaauacaaugauuucuuggaagaaguggaagaaauuguuuuc

SEQ ID NO: 8222 - RNA, 68 nt, Human
ggugaccuggcaugugaggcccacgggauccgacgugucccugcaggcacgacauagcacagggcacc

SEQ ID NO: 8223 - RNA, 75 nt, Human
agagcagccaauggcacaagucuuuacaauuaauuaaaaaaauaaaucauucugaagauacugcauuugcucucu

SEQ ID NO: 8224 - RNA, 79 nt, Human
gcagccuccugagguagguaaccuuguuuacugauggggaacaaggcaguguucuuuaccaaaucucagggcggguagc

SEQ ID NO: 8225 - RNA, 74 nt, Human
cugugucuuugguuuuaagaguaaauucuaguuaacaugaccuucagaaacuccuggaaacaucugaggcgcag

SEQ ID NO: 8226 - RNA, 82 nt, Human
ggguggcgucauggaauggguguggucuaagccaggucuccagauaagggcauucugccucuuccuucucuugucgccucuc

SEQ ID NO: 8227 - RNA, 62 nt, Human
ggugacucaggaccacgcugacuagggcuccuucaaggcccugagcugauguccuguguccu

SEQ ID NO: 8228 - RNA, 90 nt, Human
ccccugggcugccuugaguccugcugcagcucccucacagugcuucggacuagguacugggggcuggggcgcaggucgagagcccagggg

SEQ ID NO: 8229 - RNA, 61 nt, Human
gucgaguuccugacaagccacccaguagauuuuccgcugucugucuuggaggaggaucgac

SEQ ID NO: 8230 - RNA, 70 nt, Human
gggccgacgggggagacggagccccaggaguguugaagccuggaaauccccuccccuucccccucccccc

SEQ ID NO: 8231 - RNA, 73 nt, Human
agguugaagugaccagagauugcgccauugcacuccagccugggugacaagagcaaccggucuacaacaaucu

SEQ ID NO: 8232 - RNA, 83 nt, Human
aucugagugagugugugcuuauaaagguccuuugaucaauaaugugacagaacgaggguaguaacauauacucaauaacaggu

SEQ ID NO: 8233 - RNA, 87 nt, Human
cauggcuuauguguauaauccagcccuuuuggaggucaggauggaagaucgcuugaaccugggaguuugagguugcacugagucaug

SEQ ID NO: 8234 - RNA, 91 nt, Human
cggcuccaggcggcgagcugagguugggagccuggcuuuccccuccgagaggguucaggugccucugccauagcuucugucgccugugcug

SEQ ID NO: 8235 - RNA, 100 nt, Human
ggcugagggggcggggcccggcgcuucguccaaucaggggcgcugggcggggccugccgaguguccaucggggagggcgaaggcccugcucuccucgguu

SEQ ID NO: 8236 - RNA, 80 nt, Human
uuuugcuagauauuuuacuguauauuuuuucaaugacuauuucuaacacgacucauagaugaaguaaaaguuugguagaa

SEQ ID NO: 8237 - RNA, 80 nt, Human; identical to SEQ ID NO: 367

SEQ ID NO: 8238 - RNA, 73 nt, Human
aggaguaaaggcauaggccccucaugaccugcagggaccccagccacugccucugggcuuggcuugagcuccu

SEQ ID NO: 8239 - RNA, 64 nt, Human
gcagccagcauauguggaagaauaauacaaagcuuuuuuuuuucuucuaauaugucugugcagc

SEQ ID NO: 8240 - RNA, 61 nt, Human
guuuucccccuccccuguguccucugucaccuuggugaugaggccagagugaugugaagac

SEQ ID NO: 8241 - RNA, 67 nt, Human
caacuuuuuuucuuuguuguuuaaauauaaacagaaguguaccuuuuauaauaaaaaaaagaaguug

SEQ ID NO: 8242 - RNA, 64 nt, Human
ccaccauguaaaagugagcucagacgucucuaaaaaauguuuccuuuauaaaagcacauggcgg

SEQ ID NO: 8243 - RNA, 78 nt, Human
cucuuaguuuugauuugaggcaucccguaaaguuguaguugcagaaucccaaacuaggcuacauuucaaaauucaggg

SEQ ID NO: 8244 - RNA, 100 nt, Human
gccaagcugucuucaugguguauuccucuuacuggugcaccuaauagugacaauacauuagccaccaguggcaaagaaugcguucuauguggagaguggc

SEQ ID NO: 8245 - RNA, 62 nt, Human
uauucauucuguauuuugcaagccucgaaacauacgugaaguuggcuuugaauacaugaaua

SEQ ID NO: 8246 - RNA, 95 nt, Human
ucgaaaccaucauuuagcaucauuugggaaagucaagcagugugugaauuuugugauuggacuuuugaaauuaggugggcugauuaauuuuuuga

SEQ ID NO: 8247 - RNA, 75 nt, Human; identical to SEQ ID NO: 448

SEQ ID NO: 8248 - RNA, 110 nt, Human
ggcaggguguacaccugugguucucggggcugcccuuuggcuuuggagaugguuuucucgaucggggcugggagggcuuuguuggagaccuugcacuuguacuccuugcc

SEQ ID NO: 8249 - RNA, 68 nt, Human; identical to SEQ ID NO: 6247

SEQ ID NO: 8250 - RNA, 88 nt, Human; identical to SEQ ID NO: 2733

SEQ ID NO: 8251 - RNA, 68 nt, Human; identical to SEQ ID NO: 2734

SEQ ID NO: 8252 - RNA, 73 nt, Human
uuuucgaaugaaugacaacuuuauuuuucuuacacuuuuaaggcugaugaaaaaccuucauuucaauugaaaa

SEQ ID NO: 8253 - RNA, 89 nt, Human; identical to SEQ ID NO: 288

SEQ ID NO: 8254 - RNA, 61 nt, Human; identical to SEQ ID NO: 776

SEQ ID NO: 8255 - RNA, 73 nt, Human
uccuuguggucgguggugacgauggugaaguacacguacuugcccgugcgcuccacgcaguccaccuugagga

SEQ ID NO: 8256 - RNA, 60 nt, Human
auugcucagacaccugugaacagucuugauacaugcaagauguuugccaaacuuuguaau

SEQ ID NO: 8257 - RNA, 65 nt, Human
auaagaauauaggaauacauacaaucuauauacauauauuuauugcaaauacuuaaaauucuuau

SEQ ID NO: 8258 - RNA, 73 nt, Human; identical to SEQ ID NO: 7381

SEQ ID NO: 8259 - RNA, 87 nt, Human
gccagaagggaaaaaaauagcuugugguuaauaagucaauuuucuuuuaaaauaaaaaauaaaccccaaaacuauuccccuuauugc

SEQ ID NO: 8260 - RNA, 60 nt, Human
uuuuuuuuuuuauuuucacuuuuaaugaucuuuuacuuaauaauaaaaugaaaaauaaga

SEQ ID NO: 8261 - RNA, 60 nt, Human; identical to SEQ ID NO: 7400

SEQ ID NO: 8262 - RNA, 65 nt, Human; identical to SEQ ID NO: 4986

SEQ ID NO: 8263 - RNA, 65 nt, Human
augcuuguauuuggagccuuugggcacauuacuucccagcucacuagugcugagauuacaggcau

SEQ ID NO: 8264 - RNA, 83 nt, Human
ccacugcgcccagccccagauaauuuuuuuucuuuuuuuuuugagacagauucucgcuuugucaccaggcuggagugcagugg

SEQ ID NO: 8265 - RNA, 83 nt, Human
gcuguguugcccaggccggucacaaaaagaggggcuuuaucuaauguccucuguuuguauguauuugaagugggcgauaaagc

SEQ ID NO: 8266 - RNA, 70 nt, Human
acauuuucagaaccuccaauguggaugaccuggguauaaucucaaaaaaucgaugggacugaagaauugu

SEQ ID NO: 8267 - RNA, 75 nt, Human
cucaggguugucccccaguagaagugaugggcugcuuugagccguucuuacugaugucuggucugauccccuggg

SEQ ID NO: 8268 - RNA, 87 nt, Human
auauauguuuucuuuuuaagcuagcuaaagaaaauacucuugaucgggguuaguucuuaaagcaaaaaacagaagaaaaguauguau

SEQ ID NO: 8269 - RNA, 60 nt, Human
cauguuauaccuggaaaggaccgugggcacuaaucugcacuuuguuccagguaauccaug

SEQ ID NO: 8270 - RNA, 75 nt, Human
caggcacugaaucgaugguaauaauguugucuuuuuuuuucccggcaaacuuucugcuuucgguccagagcucug

SEQ ID NO: 8271 - RNA, 65 nt, Human
ccuucucgaggaggacggggauggccucccuguuguggugcuccuuguggccuuccuugaggagg

SEQ ID NO: 8272 - RNA, 81 nt, Human
ggaggugguggaccuuguugcugcuggccuccuugucgggguggucccugucugagggccaucauucugguucccaccacc

SEQ ID NO: 8273 - RNA, 78 nt, Human
ggguugagauugcuguccucccaaaggugaugucgguccugacgcuccucaucuaugaacugcucagagucuccuccc

SEQ ID NO: 8274 - RNA, 78 nt, Human
auaccaauuccccuuuacaacugaugcagaucauuaugaaauacuggaaggcauacccuacaauuuaggaauuggugu

SEQ ID NO: 8275 - RNA, 98 nt, Human
ucugcccugcauguaccuggugguguuugucuguggucugguggggaacucucuggugcuggucauauccaucuucuaccauaaguugcagagccuga

SEQ ID NO: 8276 - RNA, 66 nt, Human
aggguggggccagcccccaacacagacacugcacccaggaacacaugagcaucugguccacgcccu

SEQ ID NO: 8277 - RNA, 71 nt, Human
uuuuuuuuuuuuuucacccaacaugcaucggauuuacuugaguuccaaauguguuugaggaaaggagagaa

SEQ ID NO: 8278 - RNA, 82 nt, Human
aagcuuugucuuaaugugaacuuuugaguacauuuuaaugggcuuucuauuuuuaaaaacucaaaaucauuagguggggcuu

SEQ ID NO: 8279 - RNA, 69 nt, Human
cuaagagcaaaagagaaucauaaauucugcaaaguaguugcacuccaugauuuuaaaaaaaccucuugg

SEQ ID NO: 8280 - RNA, 67 nt, Human
gcaauccgcucgccguggucucccaaaaugcuaggauuacaggcaugagccaccgugaccggcuugc

SEQ ID NO: 8281 - RNA, 74 nt, Human
ggguuucgccauguugccucggcuggucuaggcuggucuggaccuaggcuggucucaacauggacucugaacuc

SEQ ID NO: 8282 - RNA, 62 nt, Human
ggcaagaggcucagugguaucuggaggacagggcacuggcacugcagucaccaucuucugcc

SEQ ID NO: 8283 - RNA, 118 nt, Human
gcaggcagaucugggagcuguuugauuucuuucugcuuugcaucaaauucuacucccauuuacugcugaagagaagcagagcuuucugaacuauccaaaaguuuccauuguugucugc

SEQ ID NO: 8284 - RNA, 66 nt, Human
aacucgguuaaaugugaucauauugauucuuaagacagugauucaaauggcaccuagaauuaaguu

SEQ ID NO: 8285 - RNA, 61 nt, Human
aauaaaauuucucaaacuauaucaauaucuaaagugcauauauuuuuuaagaaagauuauu

SEQ ID NO: 8286 - RNA, 62 nt, Human
aauucucaaaggugcuagaacaaaucguccacuucuacaguguucucguauccaacagaguu

SEQ ID NO: 8287 - RNA, 61 nt, Human
cuauuuuuuauuugcaacuacaugauuucacacaauucucuuaaacaacgacauaaaauag

SEQ ID NO: 8288 - RNA, 82 nt, Human
gcuuuaugggcaucuccccaagggaaggucagcaccuucuuugccaugugcccuugacuuugggggguugcccaugaugggc

SEQ ID NO: 8289 - RNA, 65 nt, Human
gacgucagcgcaaagaugcucagggaugccuaugcgaaaggaaccaugggaaagaauaugauguc

SEQ ID NO: 8290 - RNA, 61 nt, Human
uuaggcaucgccuugcuagguagacuauccaccuugaaguuagauccuaggugaugccugg

SEQ ID NO: 8291 - RNA, 74 nt, Human
uuuaugguguuggcaguggaaaaauugaggauuugagacaucagaccaucacaauguccacucuaagacaugaa

SEQ ID NO: 8292 - RNA, 60 nt, Human; identical to SEQ ID NO: 969

SEQ ID NO: 8293 - RNA, 63 nt, Human
gcugcagaggggaaacugcacguuuaaagagaaaauaucacgggccgcuuuccacaaugcagu

SEQ ID NO: 8294 - RNA, 63 nt, Human; identical to SEQ ID NO: 970

SEQ ID NO: 8295 - RNA, 61 nt, Human
gaauuugagcuugucuuuuugcccuugggcuuccugcccuggaguccucaggcuucuuuuc

SEQ ID NO: 8296 - RNA, 76 nt, Human
auuuuuggucauuacuugaaaauuaauaaguuugaaaucacuacucuuagaaauggaagaaagugaugacucuaau

SEQ ID NO: 8297 - RNA, 64 nt, Human
gccuaucucagcguguaggcaagaaauucgaaagagaagaugacccagcaaaccaaugguaggc

SEQ ID NO: 8298 - RNA, 76 nt, Human
uguauuuguuuuacuguauauuuaaauacacacauguguguauguauguguguaucuguuccugcuaacaaaagca

SEQ ID NO: 8299 - RNA, 131 nt, Human
agccggcgucgaggcggggcgcgggaacgacggcggccauggcgggcucggggcccgggugucgcagguggugcuugugucccgaggugccauccgccaccuucuucacugcgcugcucucgcugcugguu

SEQ ID NO: 8300 - RNA, 63 nt, Human
agcuuuaaugacguuccauaccaaauauucaagaguauaugcaggcccuggaacuagaaggcu

SEQ ID NO: 8301 - RNA, 81 nt, Human
ggacaauuacaaauguuguaauaugcauaugguggaaauauuaaauuucccauuauauaauauauuacaugggaauugucc

SEQ ID NO: 8302 - RNA, 69 nt, Human
gcuugauuugcuuggugaccgaauuacuagugacuaguuuacuaacuaggucauucaaggaagucaagu

SEQ ID NO: 8303 - RNA, 109 nt, Human
ggagcaaugacuguugguaugggcuauuccauguaucgggaauucugggcaaaaccuaagccuuagaagaagagaugcugucuuggucuuguuggcaggagcuugcuuu

SEQ ID NO: 8304 - RNA, 77 nt, Human
aauggaaaccaugcaauuaccugccuuaguucuuuugucauaaaaacaaucacuugguuggucguauuguagcuauu

SEQ ID NO: 8305 - RNA, 125 nt, Human
agcuagcuaauucuuguuuucugauuuaaagcacuuuuaaaucuuauccugcccccuaaaaacaaaagguuuugaucacaaggggaaauuuaagauuguuaacccuguuuuucagaagggcuacu

SEQ ID NO: 8306 - RNA, 85 nt, Human
gcaaaauucaaacuuauagugguaaagaaacagguuguucacuugcugaggugcaaaaauucuuaagacuucuguuugaaauugc

SEQ ID NO: 8307 - RNA, 89 nt, Human
uuauacagcaaacaauuucuucaauuagcagucuagacauuucuauaaacagaaaucuuggacaauugauaauauuucugacuguauaa

SEQ ID NO: 8308 - RNA, 106 nt, Human
agaaucugaaagccucuuucuuuucaggcuugaugacucuucuaagguauuuguuaugccucucuucuggguuuuucguuuugccuuaucaaguagcucaaauucu

SEQ ID NO: 8309 - RNA, 92 nt, Human
cacagcucuguuuagucucuugcucuuaauacguauagcaucuuccuucuccuguugugcuaaucuaaagaacgaaucaauucggagcugug

SEQ ID NO: 8310 - RNA, 88 nt, Human; identical to SEQ ID NO: 2733

SEQ ID NO: 8311 - RNA, 68 nt, Human; identical to SEQ ID NO: 2734

SEQ ID NO: 8312 - RNA, 73 nt, Human; identical to SEQ ID NO: 8252

SEQ ID NO: 8313 - RNA, 71 nt, Human
cuuauuaggcaaguuaggugcacugaaucuaaccuuuaagguugacaugggcucaaacuuggccuaaaaag

SEQ ID NO: 8314 - RNA, 62 nt, Human
gacauaucuuguauucauuaaaaauauuuuaauuuaaaauauucugauuucuaaaguguguu

SEQ ID NO: 8315 - RNA, 67 nt, Human
gauuuuuuacaauacauacuucuggaacuuugagauuugagaaagcuuccauguauauugauaaauc

SEQ ID NO: 8316 - RNA, 119 nt, Human
uuaauuaucacauuuaaaacuuauauuaaguguaaauuccaguggcuuuaccucacuugaaaaauuaguggggauaagccauuuuguuuugugauauuaaauuuaacuaugauaguuaa

SEQ ID NO: 8317 - RNA, 77 nt, Human; identical to SEQ ID NO: 7086

SEQ ID NO: 8318 - RNA, 86 nt, Human
agaaaaccaguauucuaaacacauuuucuuuaugugacauauucuugugcgucuauguaaugagaauuuuuaaaaaauuguuuucu

SEQ ID NO: 8319 - RNA, 73 nt, Human
auuuaaauuauuuuccuuucuggacuuccaaguccacuuggcaauuuuacuuaggaaaauaucaugcguaaau

SEQ ID NO: 8320 - RNA, 70 nt, Human
cucuguugcucagcaggaaugcagugguacaaucacgacucacuauacccuugaacuucugggcucaggg

SEQ ID NO: 8321 - RNA, 63 nt, Human
guggcuucacgcaauccccacaccucagccuuccaaagugcugggauuacagguguaagccac

SEQ ID NO: 8322 - RNA, 67 nt, Human
acugcaucaggacaguuguccacacaugcuucauguugagggacaguugccuccuucagaugccagu

SEQ ID NO: 8323 - RNA, 63 nt, Human
cacacauucaauauccaacaaauagaguaauaaacguuuguugcuaguguuauugauauugug

SEQ ID NO: 8324 - RNA, 90 nt, Human
ucauuuuacaaggauauauuaaugauauuauuguuauaugugaaaguuuacaguugacagauguuuucuuuauauauuaauguaauauga

SEQ ID NO: 8325 - RNA, 88 nt, Human
gggcuuccgguuagggccggggauaggcucaguccucuagaagagugagccucuguucuaaauccuccggccuucccuggucgugccc

SEQ ID NO: 8326 - RNA, 127 nt, Human
ucggugcugcccugggccgcgagccuucaucccucuccccagcgcuguggugcaagcugucuugugggcgacagcgugccaucaugcugcuggagggccagaaggugaucccacgggcgaacacugg

SEQ ID NO: 8327 - RNA, 81 nt, Human
cuuccuggcggaacuuauucucccagacgcucagccugggcagccagaaggagcgucugcuggacgagcugaccuuggaag

SEQ ID NO: 8328 - RNA, 62 nt, Human; identical to SEQ ID NO: 1789

SEQ ID NO: 8329 - RNA, 68 nt, Human
gagcaggaagaauguacuucugagauucggcagucacucacugacgagccuccccuguaugccugcuc

SEQ ID NO: 8330 - RNA, 111 nt, Human
gauacuuugauuacugcaggaggaacaacgcuuauccuugcaaauauucaacaagguucuguuucagggauaggaacuguuaauacuuccgccaccagcaaucaagauauc

SEQ ID NO: 8331 - RNA, 70 nt, Human
acaugugguguuugguuuccugcuccucuguaaguuugcugaggauaauggcuuccagcuucauccaugu

SEQ ID NO: 8332 - RNA, 84 nt, Human
ugugcgguuuuuuuacauagguaaacgugucccauggugguuugcugcaccuaucaaccuaucaccuagguauuaagccccaca

SEQ ID NO: 8333 - RNA, 79 nt, Human; identical to SEQ ID NO: 6903

SEQ ID NO: 8334 - RNA, 85 nt, Human; identical to SEQ ID NO: 6904

SEQ ID NO: 8335 - RNA, 72 nt, Human; identical to SEQ ID NO: 8132

SEQ ID NO: 8336 - RNA, 74 nt, Human
uuugggagucuggaagcguacuuuauugguuuaggauuuaaacaucuaauaaaaccaauaaaagaucucccaga

SEQ ID NO: 8337 - RNA, 63 nt, Human; identical to SEQ ID NO: 123

SEQ ID NO: 8338 - RNA, 65 nt, Human; identical to SEQ ID NO: 404

SEQ ID NO: 8339 - RNA, 91 nt, Human; identical to SEQ ID NO: 124

SEQ ID NO: 8340 - RNA, 61 nt, Human
gcuggagaugcgcuuggggccgcgcuggaagggcgaggcccuggagcaggccaucaucagc

SEQ ID NO: 8341 - RNA, 63 nt, Human
gguuuugugggggauaggagggaggaaaaggucgucuuccccauucaguccccuuuggaagcu

SEQ ID NO: 8342 - RNA, 78 nt, Human; identical to SEQ ID NO: 2712

SEQ ID NO: 8343 - RNA, 67 nt, Human
guucuugagcagugcguacaugguugugcgaguuugugucaaacuugcuguaggucugcuugaggau

SEQ ID NO: 8344 - RNA, 82 nt, Human
gcaguugucacaaaaacucacucaucaacuucuuagugaauuugacaggcaagaagaugacauucacuuagugacauuaugu

SEQ ID NO: 8345 - RNA, 95 nt, Human
guaaguugguucuguuuugagcuucacugaggaagcacagcuguugguugaaguauuaguaugcuguguccuucauaagcacagagccaugguac

SEQ ID NO: 8346 - RNA, 82 nt, Human
gucuuuaaaaccacagaacauuuaauauacaugaacaucuguuuauguguuuagugcuacuucugugaauucauuuagaggc

SEQ ID NO: 8347 - RNA, 86 nt, Human
aucaaugauuauguggcaaagcaaacgaagggcaagauuguggacuugcuuaagaaccucgauagcaaugcggucgugaucauggu

SEQ ID NO: 8348 - RNA, 66 nt, Human
ggugccacgguggcccccagcagcagaagggacuuuaccuuugaccucuacagggccuuggcuucc

SEQ ID NO: 8349 - RNA, 75 nt, Human
aaacaggugaaccagggccagcaauauuguacaaagcucuuaugcuucugccaguagcaaccguucucuauguuu

SEQ ID NO: 8350 - RNA, 65 nt, Human
cuccugggggaguggugaggaggcauuuuuccuaaggcuucaccucuucccuucaucuccagggg

SEQ ID NO: 8351 - RNA, 121 nt, Human
ucuucccuucaucuccaggggucauccccucaccuuauugggcaaaacugcaucaaucuccuuuugcaguuucugcuggacaucagggugaguggccaguucauauaaagugaaggaaaga

SEQ ID NO: 8352 - RNA, 62 nt, Human
cuccucugcagcugauuggcucuggaguguggccagaagccucucuccugcaauuaaaggag

SEQ ID NO: 8353 - RNA, 71 nt, Human
gguuccccuacuucuuggugagguucacugugauauacaacgacacagauggcaagcaagaagcgggagcu

SEQ ID NO: 8354 - RNA, 63 nt, Human
aaauauauaugucucuuuaaauuuaaaucuucauuuagaugguaauuacauauccuuauauuu

SEQ ID NO: 8355 - RNA, 62 nt, Human
agcaaagaaauauuaauauagugcugcauaguuuggccaagcauacucaucauuucuuuguu

SEQ ID NO: 8356 - RNA, 82 nt, Human
aggucugguucagguguccagagucucaaggggcuggggcccagcccagcucucuucggcugagacucccgccagaaccccu

SEQ ID NO: 8357 - RNA, 86 nt, Human
gggcugcuggucuggcccacccugggccgcuggggagccugcugcugccacagcugcaaggaccaggccaagagaucgcacagccc

SEQ ID NO: 8358 - RNA, 65 nt, Human
guguguccguggggccugccuugccuucugccucccugcagcugagguggcuaggcuugacacac

SEQ ID NO: 8359 - RNA, 94 nt, Human
uacacaggugcaucagacguguggacaugcagacacagacacacggagcauggguacaucaccgcgugucggcacguccagccgcacucgugug

SEQ ID NO: 8360 - RNA, 82 nt, Human
gccucagccucucaaguagcugggacuacaggcaugugccaacacacccagcuaauuuuugcacuuucaguagagauggggu

SEQ ID NO: 8361 - RNA, 66 nt, Human
gugauacacuacuugagagauggauuguugcgcuuucuucuacagucuuuacaaggaguagauuau

SEQ ID NO: 8362 - RNA, 64 nt, Human
guggugccucuucucucuuuugacuuaaggauguugucccuuaaggaaaccuggaggcuacuac

SEQ ID NO: 8363 - RNA, 60 nt, Human
ugaaucugagugaauuguaccuauuucugaugaugucggucuugcaaagcgacagauuca

SEQ ID NO: 8364 - RNA, 66 nt, Human
ucucuaucuguccaccaucuugccuugcccuuccuggggcugaggcagacaaaggaaagguaauga

SEQ ID NO: 8365 - RNA, 74 nt, Human
guagagacggggucuuguuauguuccacaggcuggucuugaacuccugggaccaagcaauccucccaccucugc

SEQ ID NO: 8366 - RNA, 99 nt, Human
uggcugcaugauaguaagaguauggcugagccugucuugcagaucauccaguaccuguacaggccaggcuacacuguucuccagcacucucuguagcca

SEQ ID NO: 8367 - RNA, 96 nt, Human
uuauuccacuucggagaccgccccccuugucccucagaugcauccaaaucaggaguuagggaucauacuccacugugguccugaauuauagaauaa

SEQ ID NO: 8368 - RNA, 83 nt, Human; identical to SEQ ID NO: 3611

SEQ ID NO: 8369 - RNA, 70 nt, Human; identical to SEQ ID NO: 3612

SEQ ID NO: 8370 - RNA, 65 nt, Human; identical to SEQ ID NO: 3613

SEQ ID NO: 8371 - RNA, 61 nt, Human
uuuuuuucauaagcacaaaaaauuuauucugaauaaaucacuuuacaauuacugaaaaaga

SEQ ID NO: 8372 - RNA, 71 nt, Human
ccacauucuuauucucccacaucccuacccacguuugagcuggaaaggaugucccuacccuaggcaugagg

SEQ ID NO: 8373 - RNA, 70 nt, Human
gugaugaugucacuaguacuaccuuucuaguauuuacauacuuaaaaguaguaacuagaacaguuaucac

SEQ ID NO: 8374 - RNA, 82 nt, Human
gcccagccccuggcagcacccacgaugcgggaccugccucucaccagccuggcccuaguggggucugcccugggggcucugc

SEQ ID NO: 8375 - RNA, 104 nt, Human
gcccucagagcagaggagccagcugugggcaccaguggccucaucuuccgagaagacuuggacuggccuccaggcagcccacaagagccucugugccugguggc

SEQ ID NO: 8376 - RNA, 65 nt, Human
gggggcucuaagcgccuaugagcaggccuuccugggggccgugcagagggcccgcuggggccccc

SEQ ID NO: 8377 - RNA, 82 nt, Human
caaacugguuuucugguuuuccaucugguaccuuauauaaucuaaaccaauuaagaauuagcuuccagguuaacccgguuug

SEQ ID NO: 8378 - RNA, 61 nt, Human
ugcucauagacccccuugucucuagcacuuggaguccuuagagaugggaaucuugacagca

SEQ ID NO: 8379 - RNA, 91 nt, Human
uugcuuccucuugagugcaacggaaagggcuaucagauaucugcacguuugugcaauuuauagcuccuccauuacacuucuucauaagcaa

SEQ ID NO: 8380 - RNA, 64 nt, Human
uuuuuuuaauuuaaaauucuuacuguuuauuuauauauugcauagcucaaaaaguuugaaaaaa

SEQ ID NO: 8381 - RNA, 65 nt, Human
cuaaaaaaacagauuggcuucaaagaaaacacuaaggaagacccacagagcuguauuaauuuuag

SEQ ID NO: 8382 - RNA, 119 nt, Human
uaguaaaaauaaucauaugccaacaggggaauugaaccacuuucuaaaucauaguaugaacucaucucuucagauacuugguaaguggucaaagcuuguuuuuauaauuacuuucacug

SEQ ID NO: 8383 - RNA, 72 nt, Human
uuuuuuuuuacuugacaucagcaacuucguguuuauacugcaccuugguuguugaugucaaguaaaaaaaaa

SEQ ID NO: 8384 - RNA, 67 nt, Human; identical to SEQ ID NO: 2785

SEQ ID NO: 8385 - RNA, 72 nt, Human
ccguccccuaacccccaguccucacuguccuguuuucuuaggcacugagggaucugaguaggucugggaugg

SEQ ID NO: 8386 - RNA, 105 nt, Human
ccuugucuccugguugccucucuugccccuuguccugaaagcccagcgaacacagaaagggguggggcagggucuauggggacgaaaggcagccgggguccgagg

SEQ ID NO: 8387 - RNA, 65 nt, Human
uggggaaggggaggguguucagaggcagcaccaccacacagucaccccucccucccucuuuccca

SEQ ID NO: 8388 - RNA, 84 nt, Human
gccacuguccucgcagccugggccagcugggggaacaauguaggguuuguugcuuaggggucccaggcuugcggggggguuggc

SEQ ID NO: 8389 - RNA, 62 nt, Human
ggagagguggagggcacccuuuguggaggaggaccccuaaacaggaugcccuccaccucucc

SEQ ID NO: 8390 - RNA, 71 nt, Human
ggccgcgauacaccagcacgcgcacggcgacaccgcgaccacgggaccuggccgagcacaaaccugcggcu

SEQ ID NO: 8391 - RNA, 60 nt, Human
ucccaagccugccaacgugaauggcuugcagaaucagucagcaggccagcggccuuggga

SEQ ID NO: 8392 - RNA, 91 nt, Human
gcacugggagugggcuccucggggucgggcaucugcugucgcugccucggccccgggcagagccgggccgcccgggggcccgucuuagugu

SEQ ID NO: 8393 - RNA, 75 nt, Human
agaggaggaaauggggugugaugggucaaaggcaggaaagguaagccaugguccucaaaccaaagagcccucucu

SEQ ID NO: 8394 - RNA, 85 nt, Human
uaaauucagcagcaugugguuuuuggaaaucagcccacaagauaagaacacugcaaccaaacucauaacuaauacugcuaauuua

SEQ ID NO: 8395 - RNA, 64 nt, Human
gacauggcagcugguuuucccuacaacaagugcuccaaaagagcaaggcagaaguugcgauguc

SEQ ID NO: 8396 - RNA, 60 nt, Human
agagcuuuaagcuacuuuuccaguaguuugccacuuucuccgagguaguuuggcugcucu

SEQ ID NO: 8397 - RNA, 80 nt, Human
uuuuuuaaaaaacaaaucaauguaaggacugaaguugaaguagcaauguaauaaaguuaauuuguuuauuuuuuaaaaaa

SEQ ID NO: 8398 - RNA, 75 nt, Human
gaggcaugggggaugguccaaucauggccugcucuaguaacgcaucugccagguugagaauaucccagguggcuc

SEQ ID NO: 8399 - RNA, 64 nt, Human
uggcuugcuucagguugaccaccuucauuauuucacucugaucagguggcagcgguggcggcca

SEQ ID NO: 8400 - RNA, 65 nt, Human
cagagaauugccugagcaaacuggaaacugguauacauuaauuucuugcucuccaacauucuuug

SEQ ID NO: 8401 - RNA, 79 nt, Human
guaaaacaauggccauacucuguugaggaccaccaaggaaacuaucuuuuuacuuggucauuaacaaaugccuuuuuau

SEQ ID NO: 8402 - RNA, 94 nt, Human
uuccuuuggcagcauuacuuuugauaagaagucuccaaauaaaauacaaaauuuuggcacagacauuuuaaucuugucaagacaauguaaggaa

SEQ ID NO: 8403 - RNA, 68 nt, Human
ccgguccucagaauacgaaaagugaacaugugaagaagacuuuguuuuugaguauuccugaaagcagg

SEQ ID NO: 8404 - RNA, 61 nt, Human
gcagcauagaagaugcucaguguccuggauuaccagauuuaauugaagaaaaucauguugu

SEQ ID NO: 8405 - RNA, 65 nt, Human
auguggcugaagaaagacaaagaauuauuacugguggaaauaaaacugacaucuuaaggcuacau

SEQ ID NO: 8406 - RNA, 60 nt, Human
ccgcacucuuuuucuucaggccgaccauuuggaagaacuuuuuguggucgaaagagucgg

SEQ ID NO: 8407 - RNA, 68 nt, Human
agaaguucaucccuccugcucuuacuguuuccggcccuggaggagaaugagggaggagaggguuuucu

SEQ ID NO: 8408 - RNA, 73 nt, Human
guuuucagcuucccuaagggacuggcauaggguuuguggggucaaugccaggaaccugggggaaacuggaugc

SEQ ID NO: 8409 - RNA, 76 nt, Human
cagcagcuauugcuauucaauggagacgguggccaccauuuccccugcaucgucucuccuacguaaucagucccug

SEQ ID NO: 8410 - RNA, 88 nt, Human
ugguaguuuugauuaaacucucuacucugauuuaacuguucucucuuccauuugaaaaaucagaguacuuuuuaaucagucuuugcua

SEQ ID NO: 8411 - RNA, 72 nt, Human
uccuccgcagaagguuggugggggguccagucugugauccuuggugcugugugccccacuccaaccugggga

SEQ ID NO: 8412 - RNA, 79 nt, Human
ccucucauauggugcugcaugcccaagauuuuaauguccagacacugaagaacaucuacuaccaucaacaccauccagg

SEQ ID NO: 8413 - RNA, 66 nt, Human
auccuuuugggcauguuccccauuuuuugcuuagcuccaauuagugugggccuaacccaaggggau

SEQ ID NO: 8414 - RNA, 64 nt, Human
ugucuguggcaaaaguuuaaucagaggaaauucuuucccagucugucgauuuaugccucagcca

SEQ ID NO: 8415 - RNA, 131 nt, Human
aggcaaggcuccugacuuccuucuugccggcucaacuucuccgacucuaccagcugaugcucuucacccugccagggaccccuguuuucagcuacggggaugagauuggccuggaugcagcugcccuuccu

SEQ ID NO: 8416 - RNA, 66 nt, Human
cagucaugcugugggaugaguccagcuucccugacaucccaggggcuguaagugccaacaugacug

SEQ ID NO: 8417 - RNA, 84 nt, Human
ucagcuggugcagcuggaguuugucucaggcaaggcuccugacuuccuucuugccggcucaacuucuccgacucuaccagcuga

SEQ ID NO: 8418 - RNA, 74 nt, Human
guagucuccacuggagaaguuaauugaugaguaguagccuacaacucaggcucuagcuucuccaggaacacuac

SEQ ID NO: 8419 - RNA, 68 nt, Human
gucuacauaaaugaagagcucaagaugacaucagucccauuugucuuaaguccugguguuguguggau

SEQ ID NO: 8420 - RNA, 118 nt, Human
ucuuaaguccugguguuguguggaugacaagcagaaggcaguuaugaugacaggugauagauccaaaauaauugccacauuuguuaacauuuuuccauuucuaaaccauccuuaaaga

SEQ ID NO: 8421 - RNA, 88 nt, Human
gcgucgccgcgaugguguuguuggagagcgagcaguuccugacggagcugaccagacuuuuccagaagugccggacgucgggcagcgu

SEQ ID NO: 8422 - RNA, 84 nt, Human; identical to SEQ ID NO: 1447

SEQ ID NO: 8423 - RNA, 64 nt, Human
ucuauaucaccuugaagaaguaugacggucgaaccaaacccauuccaaagaaagguacugugga

SEQ ID NO: 8424 - RNA, 89 nt, Human
gugcguuuucucuugugggcagggguggggguaacaaggugcuuggugaggagcuccugagacucauuguccaggagaaggaaugucac

SEQ ID NO: 8425 - RNA, 87 nt, Human; identical to SEQ ID NO: 76

SEQ ID NO: 8426 - RNA, 71 nt, Human; identical to SEQ ID NO: 77

SEQ ID NO: 8427 - RNA, 79 nt, Human
augaaacaauaaaacaaaacaaaagucauuucaaacaaagcuguuguuuugaaaacucuugcuuucuuuugguguccau

SEQ ID NO: 8428 - RNA, 76 nt, Human
gggaaggagcuccccccacugcccauccugcccgcuuuguggcggguagagucagugacagggaggcagcccuccu

SEQ ID NO: 8429 - RNA, 77 nt, Human
guguauauagagugagcugauuugggcucaggaaaaccuagucgcuuguugcucucgucugugacauuuuuguacac

SEQ ID NO: 8430 - RNA, 70 nt, Human
cugagaagccucaucaggaggccuguccuggagaugagcuuggcacaggucacuugcacauaggucucgg

SEQ ID NO: 8431 - RNA, 73 nt, Human
gcaguccgucuucaagguccagauaacaugagaaaugaagcuucucacaucguuguuggggaugacggacugu

SEQ ID NO: 8432 - RNA, 71 nt, Human
aaaaaucaauggcaacagguugggacacagcuauuucaaaggguagaaugccuauaccuacauugguuuuu

SEQ ID NO: 8433 - RNA, 76 nt, Human
uccacaaaucuuagcuauaauaacaagaugacagauuuugaucguuuuaaaguuaugaaggcaaagaaaaugagga

SEQ ID NO: 8434 - RNA, 109 nt, Human
cgggcaucggcuuccaguccgcggagggcgaggcggcguggacagcggcccggcacccagcgccccgccgcccgcaagccgcgcgcccguccgccgcgccccgagcccg

SEQ ID NO: 8435 - RNA, 66 nt, Human
cugggcugggcuaggcaugggcggcucugggaggacccuuccuuaguccccucucccaccacucag

SEQ ID NO: 8436 - RNA, 67 nt, Human
ggcuguggggggaugagcucacucugguccccucagaccuguggcuccaaggaaucuucccacggcc

SEQ ID NO: 8437 - RNA, 74 nt, Human
guacaggaaugcuuggagugucuuuucuguuauuuauagugauucucuuaaggcacaccugcugccuguuuugc

SEQ ID NO: 8438 - RNA, 78 nt, Human
uguuuauuucucuaauauuaugucaguuuauucucuuuaauggacuguaaaaaaauguaaucacaagagugccaaaua

SEQ ID NO: 8439 - RNA, 70 nt, Human
ccccccgccgcggccccggcgaggcccgcaagaagcccagcgaggaggaggcugcgguggcggcgggggg

SEQ ID NO: 8440 - RNA, 88 nt, Human
uuccugcuggccaccauccuugggaccgccugccuggccauugcgagcggcaucuaccuacuggcggcugugcguggcgagcagugga

SEQ ID NO: 8441 - RNA, 130 nt, Human
cacuggcggaagaggcuuggugccggggccuggggcucugagggaaauugaggcccugcaguuaguuugcgggaacucagcuccuccagccccaccucccagcauggugcccuaccauucaucuccaugg

SEQ ID NO: 8442 - RNA, 67 nt, Human
gcgugaacccagaagaagcagacucagccuucagccuccuggccaccugcuccuucuaugaccaugc

SEQ ID NO: 8443 - RNA, 73 nt, Human; identical to SEQ ID NO: 7929

SEQ ID NO: 8444 - RNA, 75 nt, Human
agucgauuccugauaaggugaauaagcuugauuguuuggucacaaguguuuuauucaacuuauucaggaacgauu

SEQ ID NO: 8445 - RNA, 62 nt, Human
uuuucacucuacuucuuggcuuaugaggauaaaaaugacaucccuaaagaaaaagaugaaaa

SEQ ID NO: 8446 - RNA, 70 nt, Human
cccggagacccgccccggcccgguccacauucuccccaggaagccggacucuauggggcgggacccuggg

SEQ ID NO: 8447 - RNA, 97 nt, Human
agguuuguucauuuucuauagcauuacugaaguguccguaugccuugauaauccuaucaauguuuggaucaucucagugggggaaaugacuuaauuu

SEQ ID NO: 8448 - RNA, 64 nt, Human
uuugcccagcuaacuugccaucucaguuuccccgauuagaaaagguggguggccagcgggugga

SEQ ID NO: 8449 - RNA, 80 nt, Human
gaugcaggcuggacaggaggacucaccaccugagcuggggauacucagguccuggggugcugaggaaauggggcugcauc

SEQ ID NO: 8450 - RNA, 116 nt, Human
uacucucaucuggagagggugcuguugggguguacucucaucuggagagggugcuguugggguguacucucaucuggagagggugcuguugggggcacucccaucuggagagggug

SEQ ID NO: 8451 - RNA, 61 nt, Human
uuggggguggacccccgugggccugagggugcaucccuggggcuggugggugcaccccugg

SEQ ID NO: 8452 - RNA, 61 nt, Human; identical to SEQ ID NO: 1363

SEQ ID NO: 8453 - RNA, 63 nt, Human
ggagaauggcuaugugaccaugucggugggaaaagucuuucacccugguacugcuccaugucc

SEQ ID NO: 8454 - RNA, 63 nt, Human; identical to SEQ ID NO: 1364

SEQ ID NO: 8455 - RNA, 66 nt, Human
ggucauacaggauacaguaugggacaaacagcugacgcagaaaaucccagaugucucuguaggucc

SEQ ID NO: 8456 - RNA, 64 nt, Human
uaguguccuguagaaacuguuccagcucagggaaaggggagaugcugcggauauacaggaucug

SEQ ID NO: 8457 - RNA, 69 nt, Human
gccgccucgucaccuccaguugggugccucuggguucccacuggcucugcccagguggggugggguggc

SEQ ID NO: 8458 - RNA, 80 nt, Human; identical to SEQ ID NO: 4017

SEQ ID NO: 8459 - RNA, 79 nt, Human; identical to SEQ ID NO: 4018

SEQ ID NO: 8460 - RNA, 118 nt, Human
cuucuuagcugucaccugccgaggcuucugggcacucaggcagugcaccccugggcagagccccuuaaagcugcugucgcuagaugcccaugguccagggccuggugggcgugagagg

SEQ ID NO: 8461 - RNA, 75 nt, Human; identical to SEQ ID NO: 74

SEQ ID NO: 8462 - RNA, 71 nt, Human; identical to SEQ ID NO: 77

SEQ ID NO: 8463 - RNA, 66 nt, Human
cugucaucaucauaacauuauuuauuguaaauguaguaauuuggguauuuaauauuaagaugacag

SEQ ID NO: 8464 - RNA, 77 nt, Human
cuuucagaaccgaacccaauccugaggcugacuccucuacggaaaaugaggacaggacgggggugagggaaugagag

SEQ ID NO: 8465 - RNA, 84 nt, Human
gcccggcuccucaggaagaaaaccgcuggcccuucccgagugugccggccgagggccgaggggccgugcaaauggggagagggc

SEQ ID NO: 8466 - RNA, 65 nt, Human
ggagggaaauggaugaaucuggcucguuuuaaaaucacguuuucugacgaauccuuugccccuuc

SEQ ID NO: 8467 - RNA, 79 nt, Human
guggagugcaggccagagcagggugugcguagccccagcacccagguucuucugucagacccugugaccugcgagcugc

SEQ ID NO: 8468 - RNA, 65 nt, Human
agagcaggagaagcagagguuaugacaguuaugcagacuuucccccuccuuuuucucuuuucucu

SEQ ID NO: 8469 - RNA, 64 nt, Human
gagcagccaugggugauguuuggugguaaaaaaccuacaggcguuuggggucccaugauuguuc

SEQ ID NO: 8470 - RNA, 60 nt, Human
caccaaaauccuggagaaaaacauuuuauuaauuuaggggaacaagauagaacacuggug

SEQ ID NO: 8471 - RNA, 66 nt, Human
gugcuucauuguguuuucucagaaacuaaucaaaagauuacagaguccuacacaauuuggagacac

SEQ ID NO: 8472 - RNA, 67 nt, Human; identical to SEQ ID NO: 1379

SEQ ID NO: 8473 - RNA, 63 nt, Human; identical to SEQ ID NO: 1366

SEQ ID NO: 8474 - RNA, 86 nt, Human; identical to SEQ ID NO: 1381

SEQ ID NO: 8475 - RNA, 64 nt, Human
cucuagucccauccaaaaaaaguuggcuucguuucugcagcucaauucacagaucagacuggag

SEQ ID NO: 8476 - RNA, 75 nt, Human
cuuuuuuuucuuuuucucuuuguguuguaugugguuguggcuuuaaauuaaaccaaagaaaaaaagaaaaagaag

SEQ ID NO: 8477 - RNA, 75 nt, Human
guaagcgcuucaucgccucugcugugcauauacuggguaggcuagugugacauugagggagucguugugcugcac

SEQ ID NO: 8478 - RNA, 75 nt, Human
auguguaccuugaugacccccuccagcccgagcccagcccagugggguggcuggguggcaggguagggaacacgu

SEQ ID NO: 8479 - RNA, 97 nt, Human
gcggggcggaggcacucgcgcggggggucauucggggucuggguucuggugccugcgcagcuuuccccgauggcccacugcgugaccuugguucagc

SEQ ID NO: 8480 - RNA, 64 nt, Human
ucggcuccaagucugacccacucugcguccuuuuacaggaugugggagggggcagcugggcuga

SEQ ID NO: 8481 - RNA, 64 nt, Human; identical to SEQ ID NO: 696

SEQ ID NO: 8482 - RNA, 69 nt, Human
ugucuggugauuaguucugugacuguguuuuaccugggccagcaugccauggaaugccaucaccggaua

SEQ ID NO: 8483 - RNA, 78 nt, Human
caggaucucaggauucguagaucccagauuauauuugccuuuaugcuuuaaaaauuagucauugauccuggaguucug

SEQ ID NO: 8484 - RNA, 69 nt, Human
cuccgccugccauaaagcugccuaggugccugacccaggcugcaggacagcugaaggcagagaucgggg

SEQ ID NO: 8485 - RNA, 120 nt, Human
gauggguguuuauugggauuaacacuugugaaaagaugguggagagggcagucaacugcuauguggcccaagaaugccucagccaccagguggugcucccaucagccagaauugcccauc

SEQ ID NO: 8486 - RNA, 69 nt, Human
gcucccaucagccagaauugcccaucaugguguccacugugcuuuuguagcccccuggcagaugggagc

SEQ ID NO: 8487 - RNA, 61 nt, Human
ugccgcacucgcuacagccagggcagcaagcccugccuggaaagaggauguggguggugca

SEQ ID NO: 8488 - RNA, 63 nt, Human; identical to SEQ ID NO: 7379

SEQ ID NO: 8489 - RNA, 67 nt, Human; identical to SEQ ID NO: 7380

SEQ ID NO: 8490 - RNA, 73 nt, Human; identical to SEQ ID NO: 7381

SEQ ID NO: 8491 - RNA, 68 nt, Human
cacaaaggagucuguggacaggcaggggcagaauccuggagggagcgccugagccaccaucccaugug

SEQ ID NO: 8492 - RNA, 72 nt, Human
ggagcucaacccucggcggccugauucccagggguccaagcacccucauucucugagucaggguugggcacc

SEQ ID NO: 8493 - RNA, 82 nt, Human
ggcggggucauugcaugacagcaagaaggcacgagguccccucaucuguccuuucccagcucgcaggccuuggaaccccgcc

SEQ ID NO: 8494 - RNA, 64 nt, Human; identical to SEQ ID NO: 3889

SEQ ID NO: 8495 - RNA, 63 nt, Human
gaagcuguccgcauuuauguggcaucgguccaagcaucccugggccagucgugcgacagacuc

SEQ ID NO: 8496 - RNA, 75 nt, Human; identical to SEQ ID NO: 74

SEQ ID NO: 8497 - RNA, 87 nt, Human; identical to SEQ ID NO: 76

SEQ ID NO: 8498 - RNA, 71 nt, Human; identical to SEQ ID NO: 77

SEQ ID NO: 8499 - RNA, 68 nt, Human; identical to SEQ ID NO: 6247

SEQ ID NO: 8500 - RNA, 88 nt, Human; identical to SEQ ID NO: 2733

SEQ ID NO: 8501 - RNA, 75 nt, Human; identical to SEQ ID NO: 5842

SEQ ID NO: 8502 - RNA, 73 nt, Human
gcaugcugacgagguuuggagaaucgaaacuggcuccgugggcaguuuccuaaaaugugccuccucgaguugc

SEQ ID NO: 8503 - RNA, 90 nt, Human; identical to SEQ ID NO: 3033

SEQ ID NO: 8504 - RNA, 82 nt, Human; identical to SEQ ID NO: 3034

SEQ ID NO: 8505 - RNA, 86 nt, Human
gacucaaugugcaacugacaucugcuagugaugaucugguaauauacaaccuguccaguagccgaacaguuuguuuuuauuguguu

SEQ ID NO: 8506 - RNA, 66 nt, Human; identical to SEQ ID NO: 12

SEQ ID NO: 8507 - RNA, 80 nt, Human
gcagaauugaagaugggaaguucauugggacugugucuuggaaaagcaccaaguucgucucaguuguuccuguuuuuugc

SEQ ID NO: 8508 - RNA, 70 nt, Human
uauguuugggucuuugauccauuuuggguucacuuuugcauaugugaguucgggaucauucuuuuacaua

SEQ ID NO: 8509 - RNA, 64 nt, Human; identical to SEQ ID NO: 287

SEQ ID NO: 8510 - RNA, 89 nt, Human; identical to SEQ ID NO: 288

SEQ ID NO: 8511 - RNA, 80 nt, Human; identical to SEQ ID NO: 174

SEQ ID NO: 8512 - RNA, 64 nt, Human; identical to SEQ ID NO: 175

SEQ ID NO: 8513 - RNA, 66 nt, Human
uuucggcgcugggucgcccaaagcagaauggagacggauagagugguggcuuccagaaucccgaag

SEQ ID NO: 8514 - RNA, 81 nt, Human; identical to SEQ ID NO: 5607

SEQ ID NO: 8515 - RNA, 76 nt, Human
gagucucuguugccuaggcuggagugcaguggugugaucuugguucacugcaacaccuccuggguucaagugauuc

SEQ ID NO: 8516 - RNA, 67 nt, Human; identical to SEQ ID NO: 1862

SEQ ID NO: 8517 - RNA, 65 nt, Human
uuuuuuuuuuuuuuuuuuugacaggggguugcuuugaacuuuauuugaaaaaaacagaagauaaa

SEQ ID NO: 8518 - RNA, 84 nt, Human; identical to SEQ ID NO: 286

SEQ ID NO: 8519 - RNA, 64 nt, Human; identical to SEQ ID NO: 287

SEQ ID NO: 8520 - RNA, 96 nt, Human
guggguuuuagugcaguccuucaagccacaauuuagauugcccuucggugugcuccagauuguugguucauauuaaaggacuguuuuaagauuugc

SEQ ID NO: 8521 - RNA, 84 nt, Human
uccacggacaacgaaaauccaccccgaauccaaaaauucagacauggaauggugguaggauuucacaguaaaguuagucuggga

SEQ ID NO: 8522 - RNA, 67 nt, Human
cagcaauuccuggacucggggguauuuuggucacagggugguuuugguuuaggggguuuguuuguug

SEQ ID NO: 8523 - RNA, 92 nt, Human
cugaggaugggcaacccccaggucugcagcuccagguacauaucacgcgcacagccugggcagccuggcccucaccggucgcccacucccag

SEQ ID NO: 8524 - RNA, 66 nt, Human
cuguuucuccuguuggcucacagggcugaaaggggcuuuuguccuccugggucagggagaacgcgg

SEQ ID NO: 8525 - RNA, 84 nt, Human
gggguuucauguaaugacuacaucagaaaguucuagcuuaucaaucauuaucuuuagaauucuaaugugguacacauauguccc

SEQ ID NO: 8526 - RNA, 61 nt, Human
uacugguuuauuucaggaaagcuaucucggccauggcuuccucugaacacacaaaccagug

SEQ ID NO: 8527 - RNA, 80 nt, Human; identical to SEQ ID NO: 174

SEQ ID NO: 8528 - RNA, 64 nt, Human
gcuaagauaguucaaauugaucuuaggucaaugguaagaccuauguaguucaugaagucuuggc

SEQ ID NO: 8529 - RNA, 66 nt, Human; identical to SEQ ID NO: 7151

SEQ ID NO: 8530 - RNA, 111 nt, Human
gugaccuacaagucucuuuauuugcccuccauuauagacugagcuguuaauaacauuuaaugagcucacauggauucacuggcuaauaaagaagaauagaguugaggacau

SEQ ID NO: 8531 - RNA, 66 nt, Human
uucuuaauuuuuuuaagucaaauuggauagaaacauccaauuggugguuuuuaaaacugguaagaa

SEQ ID NO: 8532 - RNA, 64 nt, Human
aaacaaaguucacuuuauuacauuaauuuuacacacuaaaauaauaugaaaugcagacuuguuu

SEQ ID NO: 8533 - RNA, 107 nt, Human
ugaguucggucacagacuugauguuuuugaaaguugucaccaguuuauugucaccuuccaacugaaccacugucuugacuuucuccccugucauugucuccagcuca

SEQ ID NO: 8534 - RNA, 71 nt, Human
uuccggcagaccgauugccuucaugaaggcuucaaaguuuuccuggcucugcaguuggguacuugccggag

SEQ ID NO: 8535 - RNA, 95 nt, Human
aucagcacuccucgcucuucggccuguggacucagacuggaauuuacaccauugaacuccuggguuuuggcuuggcauggugggcucaugcugau

SEQ ID NO: 8536 - RNA, 111 nt, Human
caauuuuauauguucacuugacuggaucaugggguacugagauagaugggaaaacauuauuucugggugugucuguggggauguuuccggaagagauuagcauuugaauug

SEQ ID NO: 8537 - RNA, 89 nt, Human
aagcgaacuuugugccuguccuagaagugaaaauuguucaguccaagaaacugauguuauuugauuuauuuaaaggcuaaaauuuguuu

SEQ ID NO: 8538 - RNA, 75 nt, Human
caaaaaagaccugcgcugcgaacccuccaccagcuaccggagggaggagggaggaugcgcuguggguuguuuuug

SEQ ID NO: 8539 - RNA, 77 nt, Human
cggcacugccacccuuuuggcauuguugccaccauugacugguggcgauggagagcugccaauugggcuggcggccg

SEQ ID NO: 8540 - RNA, 69 nt, Human
ggagggggcugcccacguuuuaguaacacuuugugguccugcuggcaacggaaucgcggcggcaccucc

SEQ ID NO: 8541 - RNA, 65 nt, Human
ggcuuaaacuugguuucgucacuucgggcacuuugguuuuuuguuccgugaccuucugaguggcu

SEQ ID NO: 8542 - RNA, 71 nt, Human
augcagguccagagccaacugcaguccuguccaaucccauagguacaagggccuggcuccucuuccugugu

SEQ ID NO: 8543 - RNA, 67 nt, Human
gcuccagcagcgagggguucgcguuacuuaggaacagcagcucuuuuuucccuucuucuguaggagc

SEQ ID NO: 8544 - RNA, 88 nt, Human
uucucauguugaagccaauuguuuuccaaauaauacugaauacaacuuucaaauuccuuuggguuauaguuggaaaccaggaugggaa

SEQ ID NO: 8545 - RNA, 64 nt, Human
gaugauggaugaguuugaggugaacauacaugucccggcaccugagcugcagucugacaucauc

SEQ ID NO: 8546 - RNA, 67 nt, Human
ugagugucacuguagaccccaaauaccaucccaagauuaucgggagaaagggggcaguaauuaccca

SEQ ID NO: 8547 - RNA, 85 nt, Human
acacacuuucuaugcauacaaauuuugugaauucccaaaguaugcuuuggaauuggucauaagucuuuucguaucaugagugugu

SEQ ID NO: 8548 - RNA, 66 nt, Human
acggcccaagggcuggagcuguaugagaacacucggaccccuaccagcuccagaccuuuguccugu

SEQ ID NO: 8549 - RNA, 73 nt, Human
aggucacgcacacggugcuggugaggagagaucaccauggagccaauuucucgugccgcacugaacuggaccu

SEQ ID NO: 8550 - RNA, 82 nt, Human
uuuuaguuguuuuagggcuuuuuauugaauagaaaaaauauaaacaauguuguagaguaaugagaaauccuccacacugaaa

SEQ ID NO: 8551 - RNA, 86 nt, Human
gagugcagggaugguccaggaggaggacuggaagcugcaggauggcugcagggggccguggacccuccugggccugaagcucacuc

SEQ ID NO: 8552 - RNA, 70 nt, Human
ccgaagaacaguguuuauugcccuaacggugauuagccuuguggggacaguucuauucuuucucauucgg

SEQ ID NO: 8553 - RNA, 109 nt, Human; identical to SEQ ID NO: 831

SEQ ID NO: 8554 - RNA, 74 nt, Human
aagagacagcuuuacagggccaugucagaauaugucaaagaaauauauuuuuggguaaaguacuucuguuucuu

SEQ ID NO: 8555 - RNA, 85 nt, Human
acuagagucagguugaaauuuggugucuuauugcuacaaagucuguuuugucagucuugggaucucuuuuaaugcuaacgcuggu

SEQ ID NO: 8556 - RNA, 67 nt, Human
gucuuuaguggagccucuccuggcucagggagaagaccuggaaagggagggggauucacuacaggac

SEQ ID NO: 8557 - RNA, 70 nt, Human; identical to SEQ ID NO: 8149

SEQ ID NO: 8558 - RNA, 82 nt, Human; identical to SEQ ID NO: 1766

SEQ ID NO: 8559 - RNA, 127 nt, Human
ugaucuuagaucacuaaagccucagacuccugggcucaagugauccucccagccucaaccuccuaaguagcugaggcaggagaaucacuugaacccacgaggcaaaguuugcagugagccgagaucg

SEQ ID NO: 8560 - RNA, 78 nt, Human
cacaugcagcagagcacacgaaugugugugugccaaggccccagaggcuggaugcccacauaugugcugaugcaugug

SEQ ID NO: 8561 - RNA, 66 nt, Human
cuuuuuuuuuuuuuuugaaugcucaguaucuauuuauuaaaugaaugcacaauugaaagagugaag

SEQ ID NO: 8562 - RNA, 67 nt, Human
ucucugucuucuucuugauagagaaacagcaugguuuccuagacugaauugaagaaugaaggugaga

SEQ ID NO: 8563 - RNA, 89 nt, Human
uucuucuuucuucaaauaucaccauugauuucuguggauauccuuagggugacacucuggaaaucuuggaugaaaguuaggaaguagaa

SEQ ID NO: 8564 - RNA, 64 nt, Human
cccggcagggcuggucagaggggcacagccaccgccugugccugccccucucuggcccacuggg

SEQ ID NO: 8565 - RNA, 66 nt, Human
cugcgaugauuucugugaaaauuuugcuguagcgaugcaccauuguuucacagaauuuccaagcag

SEQ ID NO: 8566 - RNA, 81 nt, Human
gcugcaggaaggugcucucgcacgggggcgucuugaggacgggcagccccucccagccccgguguggagucccgaggcagc

SEQ ID NO: 8567 - RNA, 73 nt, Human
augcacggucagccaauuuuauuuaucuuaagcaucagcugguucaauaaguccccaaucugguugccggcau

SEQ ID NO: 8568 - RNA, 61 nt, Human
gaggugucuccuugcuggcagagugcgcucacgcgagggcuggcugugaugaacacaucuc

SEQ ID NO: 8569 - RNA, 64 nt, Human
ggccugcaggcgcugugaggucccaggccggucuuggcggccgagagccccugcacucaaggcc

SEQ ID NO: 8570 - RNA, 66 nt, Human
uauguuuuugauaauuuuuauuuuugaagcuuaaauguguuucuucugaaagcuguuaaagaugua

SEQ ID NO: 8571 - RNA, 64 nt, Human; identical to SEQ ID NO: 287

SEQ ID NO: 8572 - RNA, 84 nt, Human; identical to SEQ ID NO: 286

SEQ ID NO: 8573 - RNA, 64 nt, Human; identical to SEQ ID NO: 287

SEQ ID NO: 8574 - RNA, 89 nt, Human; identical to SEQ ID NO: 288

SEQ ID NO: 8575 - RNA, 76 nt, Human
cagccuaacuuccuagugugcaucaggcaagaugagcaggcaccaucauguaaagagcaccuugggguguaggcug

SEQ ID NO: 8576 - RNA, 99 nt, Human
cuuggugaccaggguacaagccccugaugagcuugccauggcagccaaggacaccuggugccggaggaacgacaggggccugcaaaggggacauccgag

SEQ ID NO: 8577 - RNA, 96 nt, Human
gcuguagcauagguccugcucuguggauggggaaagccagggggcacauacguccccaugccgcccccuccaaagacuccucgcuggugcugaggc

SEQ ID NO: 8578 - RNA, 69 nt, Human
gucccucuccacguucuggguaugauggaguuugaggcuaugacuccucucugguuuagggggugggac

SEQ ID NO: 8579 - RNA, 67 nt, Human
uugcucgcagggcucauucugcauggaucuguguuucaggaugcugcaaggacaacucugcgggcag

SEQ ID NO: 8580 - RNA, 76 nt, Human
agccgcagucuguauggccuggggggcuccaagaggaucuccauuggagggggcagcugugccaucaguggcggcu

SEQ ID NO: 8581 - RNA, 60 nt, Human
gccgccgggaguggauucgguuucggugguggagccggcaucggcuucggucuggguggu

SEQ ID NO: 8582 - RNA, 74 nt, Human
ggagccacagcagcagccgccgggguuucagugccagcucagccaggcucccuggggucagccgcucuggcuuc

SEQ ID NO: 8583 - RNA, 66 nt, Human
ggccuugcugguggcuuugggggcccuggcuucccugugugccccccuggaggcauccaagagguc

SEQ ID NO: 8584 - RNA, 71 nt, Human; identical to SEQ ID NO: 4541

SEQ ID NO: 8585 - RNA, 70 nt, Human; identical to SEQ ID NO: 5824

SEQ ID NO: 8586 - RNA, 96 nt, Human
gccccccuacuuccgcuuccugacacucauggccuuccacgucuuccuccaagagaagguggaccugccacugguggaggugggcauuggcggggc

SEQ ID NO: 8587 - RNA, 79 nt, Human; identical to SEQ ID NO: 6903

SEQ ID NO: 8588 - RNA, 63 nt, Human
uuuuuuuuuuuuuuuuuuuuuuuuuuuuagagcaugaguaaagagaaagagagaaggaagaag

SEQ ID NO: 8589 - RNA, 77 nt, Human
agggaggagggacucugguagcuccaggaaccagguugggaggccagcuugcccaucagucaccggagccugucccu

SEQ ID NO: 8590 - RNA, 69 nt, Human
auaggcggcagaccccagguggugcguggacagacccuguccacagcgccuggcucccgugcugccugu

SEQ ID NO: 8591 - RNA, 67 nt, Human
ggucccaguccugaaauauacaaaguggcgccucccacugggcaguggucacugggcugcacggucc

SEQ ID NO: 8592 - RNA, 86 nt, Human
gaugucaaugcugccauugccaccaucaaaaccaagcgcacauccaguuuguggauuggugccccacuggcuucaagguuggcauc

SEQ ID NO: 8593 - RNA, 98 nt, Human; identical to SEQ ID NO: 5891

SEQ ID NO: 8594 - RNA, 79 nt, Human; identical to SEQ ID NO: 728

SEQ ID NO: 8595 - RNA, 77 nt, Human; identical to SEQ ID NO: 3129

SEQ ID NO: 8596 - RNA, 99 nt, Human; identical to SEQ ID NO: 3131

SEQ ID NO: 8597 - RNA, 85 nt, Human
gccguuagcuugugggagaacgugcuucuuauuccugggcaggcuucaaggaacagcuugcacaugugcccgcuaaacugaccgc

SEQ ID NO: 8598 - RNA, 64 nt, Human
gguuuccagcugcaacggcuccacuuugcaggcuugcaggguguauaccugcgcauugggaacu

SEQ ID NO: 8599 - RNA, 131 nt, Human
uggugagauuucggacaaguggcaguacauccggcugauggacaguguggcacugaaggggggccguggagugcuuccaugguccagaagugcaagcugugugcaagagaaaauuccaucgagauuuuaag

SEQ ID NO: 8600 - RNA, 86 nt, Human
uuuaagcaagcaccaucaagccuuacaaugcugaagacaaugagaacuucaagacaauaguggaguuugagugccggggccuugaa

SEQ ID NO: 8601 - RNA, 66 nt, Human; identical to SEQ ID NO: 1008

SEQ ID NO: 8602 - RNA, 78 nt, Human; identical to SEQ ID NO: 8274

SEQ ID NO: 8603 - RNA, 61 nt, Human
cuuaauugaauacuuagaaaaaaauggccaguggccgauugaaagguauauuaaaauuaag

SEQ ID NO: 8604 - RNA, 67 nt, Human
ggaaagcuggcggggccgaaaaguagggucuaugucugccaacucuaacagccugcccgugcuuucc

SEQ ID NO: 8605 - RNA, 82 nt, Human
ucaguacauuuuaaaagcuccacaaguaauuugauguucagccaaggaugagaauuagugguuuagcccuuaaaacuucuga

SEQ ID NO: 8606 - RNA, 65 nt, Human
agucugaaauauucgauucaauugcaaacuuugaguguaguuuuugaaaagauguuauuuagacu

SEQ ID NO: 8607 - RNA, 72 nt, Human
aggaaucgccacacugucuuccacaaugguugaaaucauuuacacucccaagaacagugugaaagcauuccu

SEQ ID NO: 8608 - RNA, 63 nt, Human
gcauuucucugauaaccagugaugaugagcauuuuuucauaugucugcuggcugcauaaaugu

SEQ ID NO: 8609 - RNA, 62 nt, Human
uccugacuuuuuaaugauugccauucuaacuggcgugagaugguaucucauugugguuuuga

SEQ ID NO: 8610 - RNA, 64 nt, Human
uugucagauggauagauugcaaaaauuuucacccauucuguagguugccuguucacucugauga

SEQ ID NO: 8611 - RNA, 85 nt, Human
cugugaaauccagucugugccacuggccuuugggcugacugggcaacgguugcugggagugccuaucauuguacaggcuucacag

SEQ ID NO: 8612 - RNA, 81 nt, Human
gaguccugaggagcgugaugcccgcacaguuuucuguaugcaguuagcugcccgaauucggccucgagaucuggaggacuu

SEQ ID NO: 8613 - RNA, 80 nt, Human
ucugcuguaggcaagguucgcgauguacguaucauuucagaucggaacucacgucguucuaagggcauugccuacgugga

SEQ ID NO: 8614 - RNA, 70 nt, Human; identical to SEQ ID NO: 4167

SEQ ID NO: 8615 - RNA, 61 nt, Human
ggcuucaugauauacaccaauuccacaauaaaacaaucauaugguccagguguauaaugcc

SEQ ID NO: 8616 - RNA, 63 nt, Human
caucgcagcugcaaauaaucagaagccaaggccaggccaucgauuugacacugcaggcagaug

SEQ ID NO: 8617 - RNA, 76 nt, Human
cucacaucaaacggagcugggagucgcuuuugcguguguccgcaguuugaaguguccucuccgaaggugaaguggg

SEQ ID NO: 8618 - RNA, 79 nt, Human
gaagaacgaguaaccugaaaugaaggagcgagaaucccacccucagccccccaacagcuuccucagcuucuuuuucuuc

SEQ ID NO: 8619 - RNA, 73 nt, Human
gcaggugcgcuccgggaugaagugcagggaggcaaacucuggcuggguuccuguaaacacccaucgcagcugc

SEQ ID NO: 8620 - RNA, 60 nt, Human; identical to SEQ ID NO: 2924

SEQ ID NO: 8621 - RNA, 90 nt, Human
gcaucuggguuauuuuuauuuucuuugcuuuggucuauacaaaaaaaccaauaaccaaaaacauaaagcgauaauaauaaaacacucugc

SEQ ID NO: 8622 - RNA, 118 nt, Human
uauauauauauacacacauauauauacguauauauguguauauauauauacacauauauacguauauguguguauauauauacacauauacguauauauauguguauauauacguaua

SEQ ID NO: 8623 - RNA, 73 nt, Human
uuucuaauaaauguaaaaagcuuaguuuuguuuuauaacuuauagaggauaauuuuuauuaacuuguuagaga

SEQ ID NO: 8624 - RNA, 92 nt, Human
ucucccucaggaccagcugucaguccccaggcccugagguggugccugcauccuaggucuguggggcauuacuggugucacucugagggaga

SEQ ID NO: 8625 - RNA, 86 nt, Human
gagaagggggccacggcuucucacaggguggggcgggccugguguacccuccccgaaagcacuggagaagggggccacggcuucuc

SEQ ID NO: 8626 - RNA, 93 nt, Human
uauauuugugaaauucauccacacugauguguauaacuguuauccauuuccauuguuguauagcauuccaccacaugaauacaccacaauaua

SEQ ID NO: 8627 - RNA, 77 nt, Human
ccggguguggucaccgaaguccggcuaucccggccaugccgccuaccgcgacuucacaccuacgaccaugacaccgg

SEQ ID NO: 8628 - RNA, 66 nt, Human
gcccgcgcggguuaccggacgcaauguggcaccggaagccaaggcgccguacgaccccgagcgugc

SEQ ID NO: 8629 - RNA, 88 nt, Human
agcaucauggagguuugaagaugccgcaugcggagucggaugaauuccaaauacugcguugcuggcgugguuuaauacucgauaugcu

SEQ ID NO: 8630 - RNA, 62 nt, Human
gucuccacguaugauguaucugagccgguugcuccacagguagcucuagcauggguggggac

SEQ ID NO: 8631 - RNA, 62 nt, Human
aucuaaguuaacagugugcugugccaccaaugaaaauaacaaaacaaagugacaaaauggau

SEQ ID NO: 8632 - RNA, 64 nt, Human
gauacuuccacgaagcuggcuaaggagguguggccacaggccagguaugccacguggacguguc

SEQ ID NO: 8633 - RNA, 72 nt, Human
ucccauuuucacccuggguuggugacugcauuaguuugcuaggguugccauaacaaaguaguacagaugggg

SEQ ID NO: 8634 - RNA, 80 nt, Human
augucauuuuuagagggaaauaguguaucugcuauggggaagacaaaucauggaaagccauuucucuuuaaaaaaaacau

SEQ ID NO: 8635 - RNA, 74 nt, Human
cugaucaauccuucuuuuucucuuuugcccacaauuuaagcaaguaaaugugcaaaagaaauggaaggauucag

SEQ ID NO: 8636 - RNA, 102 nt, Human; identical to SEQ ID NO: 2172

SEQ ID NO: 8637 - RNA, 77 nt, Human; identical to SEQ ID NO: 3082

SEQ ID NO: 8638 - RNA, 96 nt, Human
uuuuauuuuucaauuuuuauuuugguuuucuuacaaagguugacauuuuccauaacagguguaagaguguugaaaaaaaaauucaaauuuuuaggg

SEQ ID NO: 8639 - RNA, 69 nt, Human
ccuugcacaucugacauggcuaagcaggcucaggugccccuggcagcagucaucaaaccgcuggcaagg

SEQ ID NO: 8640 - RNA, 95 nt, Human
guuacuggaguacggggccaggugccacccuuagucacuaccaacuuccuggugaaagaccaagggaaugcaaguccccgauacauccgauguac

SEQ ID NO: 8641 - RNA, 63 nt, Human
cuucaaaagugaaucacuguggaccaagcaccagaaacaucgucccaaagauucaucuugaag

SEQ ID NO: 8642 - RNA, 87 nt, Human
agggcucgggggcggggaggccccuccggcggggcgugccugggugguccggcagaggcggaggccugcuccgagccugugagcccu

SEQ ID NO: 8643 - RNA, 94 nt, Human
gcgcacguccagguaacgcgcuucaaggggccgcggcucggagcugggggaccccgggccgcccugcccauacgagugcgagcguggagagcgc

SEQ ID NO: 8644 - RNA, 80 nt, Human
ggauccggguccccgaccaaaggccgacacccgagaggugcgcucggacccggccggucccccgaggguggcucggaucc

SEQ ID NO: 8645 - RNA, 67 nt, Human
aucgcagacuuucucaacucguucgccuacucagcaggaagacaaugaggaugaagaccuuuaugau

SEQ ID NO: 8646 - RNA, 67 nt, Human
ggugcagcgggagauucaccaggacugggcuaaccgggaguacauugagauaaucaccagcagcauc

SEQ ID NO: 8647 - RNA, 73 nt, Human
aaagccacagguaagaauucucauuugcuaaauuacaaugauuggugcaaauuaugccuaugacauuggcuuu

SEQ ID NO: 8648 - RNA, 91 nt, Human
cuuuuuuaaguuugaacagaaggguugaucaaaauguguuuugucuguuuuaggcuugaugauucacgcuucucuuuaaacugccuuaaag

SEQ ID NO: 8649 - RNA, 71 nt, Human
uauggcauucuguuuaauacacgaaagguuuccacuugauauacauuguguuaaaacagaagauagccaua

SEQ ID NO: 8650 - RNA, 94 nt, Human
ucuguuucugaaaccagacuuuguuaauuaacaguuuuaaaauauuaauuaguuuugacaucuuguaaauuuuaggucaaaaauacaguccaga

SEQ ID NO: 8651 - RNA, 62 nt, Human
ccacgacacuucggcaauuuggaaggacccaggauuggguccaaggguuucggacaacgugg

SEQ ID NO: 8652 - RNA, 97 nt, Human
ccgcuauaaagggguuagcaagucagucaucaaaacaauguccaucauggauuuugaaaaggugaaucuugaauuaauagaggccuuauuagagugg

SEQ ID NO: 8653 - RNA, 80 nt, Human; identical to SEQ ID NO: 100

SEQ ID NO: 8654 - RNA, 86 nt, Human
guagaguuaagccuggcaggagcgugcucuguugcacuaaaugugugguggcaggccccucaaagccgugguuggaauaaucuuac

SEQ ID NO: 8655 - RNA, 78 nt, Human
auuguugagauuauaauaucaauaacuuacugcaguuuugagugagcuacuuagugcaugguauuauaaaacaacgau

SEQ ID NO: 8656 - RNA, 131 nt, Human
gugguucacgccuguaaucccagcacauugggaggccggggcggguggaucaccugauggucucgaucuccugaccuugagauccgccuaccucggccucccagaguacugggauuaugggcgugagccac

SEQ ID NO: 8657 - RNA, 65 nt, Human
ugggugguccuuggucccuuugaauuuguauccuaaaguuuuacauuuauuuuaaguacccccca

SEQ ID NO: 8658 - RNA, 69 nt, Human
auggcugucuuuuggaggucauuuuuuugagccuaucucgggucucuaagggcaaacuccagcagccau

SEQ ID NO: 8659 - RNA, 76 nt, Human
aguggucgagcggcguaucaaccucgcgugauaaaguucucaggacguggguguauccugcgacugcgcgacugcu

SEQ ID NO: 8660 - RNA, 88 nt, Human
ccugggaauuccuauguaugucccuuuccaaaccgaggggguggggguucacccgcguauugcagggacguacuuggaauuugccggg

SEQ ID NO: 8661 - RNA, 89 nt, Human
agcuccauuuacagaacuguugcuuuuuugcaguugucuuuguucuugaaaaaccaguaacugcuucugcauaccuuuuguguagagcu

SEQ ID NO: 8662 - RNA, 81 nt, Human
ggagcugacuggguguugcugaagcaaauguuggacuuuguguuagauagucuugcauaucuuaaucgacauucccagccc

SEQ ID NO: 8663 - RNA, 88 nt, Human
uagugaaauauugaggcagcaauuuuuuacaaaaaggucauccucugcucuauucguuaccuuguuauugcugucucaacauuuacua

SEQ ID NO: 8664 - RNA, 87 nt, Human
ucggcaguggcauccggggccgggggucgcggccguggcacggggccggggccgaggccgucggagcucgcggaggcauagugccga

SEQ ID NO: 8665 - RNA, 68 nt, Human
cuggguuauggugagaaacauaguuaaauaacugacauuuuagaaauauguuuuuaccuauuacuuag

SEQ ID NO: 8666 - RNA, 99 nt, Human
guauuuucuucauggcaagucuugugcaguucauuggugauuaguaauaauaauaagauugcuguuuauuaacucuguauaugcuugccugauuugugc

SEQ ID NO: 8667 - RNA, 108 nt, Human
uuuuuuuccuuuuagaauguaucucuuugauuaauaaaagcuuugaauuaaaucucauauuuugaaauaaaguauugaaaauugagguauauuuuucacuaaagaaaa

SEQ ID NO: 8668 - RNA, 79 nt, Human
agguaauguuacguagacgucauuccucuugugacuuacuuccauuuugcauuucauaugaacgucuggauaacagccu

SEQ ID NO: 8669 - RNA, 72 nt, Human
uugaauuuguuuuauuguagauuuguuacuggagcacuagugaagucaguaaccuaacugcaauuuguuuag

SEQ ID NO: 8670 - RNA, 76 nt, Human; identical to SEQ ID NO: 758

SEQ ID NO: 8671 - RNA, 71 nt, Human; identical to SEQ ID NO: 1764

SEQ ID NO: 8672 - RNA, 71 nt, Human
gagauuugcaaauuuaaaaaaaugaagaaucaaacuauauuuucuuuucuguuuuuuugaaacagagucuc

SEQ ID NO: 8673 - RNA, 61 nt, Human
uuuuuugaaauuugaaauggcagauuuauuaaguauuuuuaagccaucaaguuacaaaagg

SEQ ID NO: 8674 - RNA, 77 nt, Human
ugcuuugucguucaguugguuacuucuuuuaauguauucaaaaauguugaacacauacagaacugaauuaagaagca

SEQ ID NO: 8675 - RNA, 60 nt, Human
ugcuuuuaagaaccaaggacaaauuuucaguauugaagaagacaacauacauaaaaagca

SEQ ID NO: 8676 - RNA, 68 nt, Human
guccuuccaguggucgaggaagacauguccaguguguccacaucauacuucuucuucagcugggggau

SEQ ID NO: 8677 - RNA, 83 nt, Human
gugcacucaaagcagcugcucccgcgcacgugugcuaggaagucuggcgcaccugggcagaucacguugucagccaguagcac

SEQ ID NO: 8678 - RNA, 62 nt, Human
guucuugucagugagaggggucacaaaguguggugacaggagccucugacgggacgacuaac

SEQ ID NO: 8679 - RNA, 95 nt, Human
guggcgaccuagaggaucccuuagcuguguauuacaggacaaucacugaaucaugugcucuguaaucaagauagugaucuuccagaaggagccac

SEQ ID NO: 8680 - RNA, 61 nt, Human
gcagaauacuuuguggccugaaguucaaaaacuauaugggcacgguuaugaaauauuuugu

SEQ ID NO: 8681 - RNA, 64 nt, Human
gcagguaaaucaugugcucuguaaucaagauagugaucuuccagaaggcagccacugucccugc

SEQ ID NO: 8682 - RNA, 70 nt, Human
gguuuugaguaucagcagguggccuuucagcccuccauacuuacugagccucccacugaggaucaucuuc

SEQ ID NO: 8683 - RNA, 71 nt, Human
ccaccaucauacuuuuuuuuuuuuuugcuuuuaaaaaguggagguggaaaaaaaaaaaaaacugaaggugg

SEQ ID NO: 8684 - RNA, 66 nt, Human
ggacccuugacucuguucccuucaagaucacacacauaggucaccacuggggaccagucaaaggcc

SEQ ID NO: 8685 - RNA, 89 nt, Human
uuuuuuuuuuggacaggcaaaggaaugcuuuaauugaggucacaggcaucacaggggucugcucagcuuccucgccaccagggagaaaa

SEQ ID NO: 8686 - RNA, 66 nt, Human; identical to SEQ ID NO: 7949

SEQ ID NO: 8687 - RNA, 72 nt, Human; identical to SEQ ID NO: 1696

SEQ ID NO: 8688 - RNA, 61 nt, Human
aguuaucucuaccagugguucucaaacuuuagacuuuuugagaaucaccugguggguugcu

SEQ ID NO: 8689 - RNA, 92 nt, Human
cuuuuguuacauagagauuuaaagaaaaagaaaguaguaccuuaguauguaccgcauccuucuuuuccucagccacccuaucauaacagaag

SEQ ID NO: 8690 - RNA, 82 nt, Human
gacugauaaacaggggccagaaaccugcauuuuuaacauggagcccaagugauuuugauccagguggcccccaaauccaguu

SEQ ID NO: 8691 - RNA, 66 nt, Human; identical to SEQ ID NO: 4249

SEQ ID NO: 8692 - RNA, 84 nt, Human; identical to SEQ ID NO: 286

SEQ ID NO: 8693 - RNA, 89 nt, Human; identical to SEQ ID NO: 288

SEQ ID NO: 8694 - RNA, 80 nt, Human
gcuuccaugagucacaugcuucccuuauggguccucacaacaguccaacgaguuagguuuguguguacgguuauggaagc

SEQ ID NO: 8695 - RNA, 64 nt, Human
gugcuccgccgcuguccauugaagcucccgugccaaaaagugcucacaggccagcugcggacac

SEQ ID NO: 8696 - RNA, 106 nt, Human; identical to SEQ ID NO: 6411

SEQ ID NO: 8697 - RNA, 73 nt, Human
gugauggcuuauuuguuuuguauucaaugauugucuuuccccauucauuugucuuuuuagagcagccaucuac

SEQ ID NO: 8698 - RNA, 77 nt, Human
ugggggagcgagggaaggaguuaaugaaacuguauugcacaaugcucugaucaauccuucuuuuucucuuuugccca

SEQ ID NO: 8699 - RNA, 64 nt, Human
cuaaucuuuuuuuuuucacuuggaauuauguugaauguuucauuuugacaaaaaaguagacuag

SEQ ID NO: 8700 - RNA, 77 nt, Human
ccauaaucuucauagcaaacuugaaaauugaaaaaaaaaauucacauuuccuuauuugcuuauguacuaccccaugg

SEQ ID NO: 8701 - RNA, 93 nt, Human
gcuaaguggggcugaaaucaacaaaaggucuuggacuguuggcucagaaaucauccuagaaagcccgcccuguugauaucugucaugcuuagc

SEQ ID NO: 8702 - RNA, 100 nt, Human
gaguucaagaccagucugggcaacacagugaaaccccaucucuacaaaagauacaaaaauuagcagaugugguagcgugugccuauggucccagcuacuc

SEQ ID NO: 8703 - RNA, 100 nt, Human
ugaggugggaggcucccuugagccaggaggucaaggcugcagugagcugugaucaugccacugcaguccagcccgggcgacagagugagaccccaucuca

SEQ ID NO: 8704 - RNA, 80 nt, Human
ccaggcucuucuggacaaguacaaugcugagaagccuaagaaugcgauucacaccuuugugcaguccggaucucacuugg

SEQ ID NO: 8705 - RNA, 68 nt, Human
uuuuuauuuugguuuucuuacaaagguugacauuuuccauaacagguguaagaguguugaaaaaaaaa

SEQ ID NO: 8706 - RNA, 63 nt, Human
ccggaguaggagcaaugaucagaugggugcacagaccagugccaaucugaacauuguuaaugg

SEQ ID NO: 8707 - RNA, 65 nt, Human
guuuucuuuauuacggauucaaagacuuauuuugaaaguuggaaggagaagggagggaagagagc

SEQ ID NO: 8708 - RNA, 64 nt, Human
acuuaaggaccaagauuuaauaaaaguaauaauuuuuauugcuucuccaaggucauucuuaagu

SEQ ID NO: 8709 - RNA, 60 nt, Human
ugagacaaauguuguacuucaguaugcaggugcuuuauggguacuucucaucuuguguca

SEQ ID NO: 8710 - RNA, 84 nt, Human
uucuaaauguugacauauuucauuauauaauaucaaaaaaaucacauuaucauauacauuaaaauaccaccagcaguaucagaa

SEQ ID NO: 8711 - RNA, 78 nt, Human
uugaagggauaggcucacuuuguuaauauuugagaacauaccauccauagaaccauagcuugucaguuguucuuucaa

SEQ ID NO: 8712 - RNA, 84 nt, Human; identical to SEQ ID NO: 286

SEQ ID NO: 8713 - RNA, 89 nt, Human; identical to SEQ ID NO: 288

SEQ ID NO: 8714 - RNA, 94 nt, Human; identical to SEQ ID NO: 5398

SEQ ID NO: 8715 - RNA, 99 nt, Human
guucuagcucagguaguagucguacuucuucucggucuucuucuccuaaaaggaaaaagagacacaguaggaguagaucuccaacaaucaaagcuagac

SEQ ID NO: 8716 - RNA, 60 nt, Human
ggcugcaccaccagcucucccaguggggugcguucuggugggaggguaggaggugcagcc

SEQ ID NO: 8717 - RNA, 80 nt, Human
cuauuucucuauguuuauucuaguuaaggaaauguugagggcaagccaccaaauuaccuaggcugagguuagagagauug

SEQ ID NO: 8718 - RNA, 64 nt, Human
gggaagacguuuucuuuaucgcccugagaagaucuaccccagggagaaucugagacaucuugcc

SEQ ID NO: 8719 - RNA, 83 nt, Human
guaucuggggaugaaaaaggaguaguuuucuguuacugguuuaacagaaaugacagccagcaccucuuuauagaacccaggac

SEQ ID NO: 8720 - RNA, 97 nt, Human
uuuucugucuuacuuguucaccucaucaugaagauuuaguagccauuggcuacaaggauggcauaguggugauaauugacaucaguaagaaaggaga

SEQ ID NO: 8721 - RNA, 65 nt, Human
gccagugucauuuuauagcaaauugccauuuucuucaaaguguggcaguaucuugugacuuuggu

SEQ ID NO: 8722 - RNA, 82 nt, Human
gucagaaaacgcucuuguuaccacucauguucuucauuucuuuauucagaaaugcugacuauaucaucaaccaguuuucugc

SEQ ID NO: 8723 - RNA, 109 nt, Human
uauaucaucaaccaguuuucugccaauuaucuagcuuuuugucaugaagccuuuauacaugaaaaaguuaucacuuguauuuggaucaauaauguaaguuuaugauaug

SEQ ID NO: 8724 - RNA, 72 nt, Human
caauauuccaaauuauagguugagagaaugugacuaugaagaaaguauucuaaccaacuaaaaaaaauauug

SEQ ID NO: 8725 - RNA, 84 nt, Human; identical to SEQ ID NO: 286

SEQ ID NO: 8726 - RNA, 89 nt, Human; identical to SEQ ID NO: 288

SEQ ID NO: 8727 - RNA, 94 nt, Human; identical to SEQ ID NO: 5398

SEQ ID NO: 8728 - RNA, 68 nt, Human
uguagauugucaacaucgaauugaugggaucauacuuuugagcuccauacauggguguuauuucugca

SEQ ID NO: 8729 - RNA, 102 nt, Human; identical to SEQ ID NO: 2172

SEQ ID NO: 8730 - RNA, 63 nt, Human
guuaaaaaagaagaagaagaaauggcaaagagaaaguuuuuucaaauuucuuucuuuuuuaau

SEQ ID NO: 8731 - RNA, 62 nt, Human; identical to SEQ ID NO: 1277

SEQ ID NO: 8732 - RNA, 62 nt, Human; identical to SEQ ID NO: 4194

SEQ ID NO: 8733 - RNA, 67 nt, Human; identical to SEQ ID NO: 4195

SEQ ID NO: 8734 - RNA, 68 nt, Human
aagcagugaguggcccgugaacaugcgucgguuuugucuuucgacgcucaaggucugggcgccugcuu

SEQ ID NO: 8735 - RNA, 61 nt, Human
cagggccuggaguccugggggagcucagccagcucugccuuucucagggccuggaguccug

SEQ ID NO: 8736 - RNA, 81 nt, Human
ccugccccucugccugugcuccuggcaguguggcuucccggugcucaccugcacagcaguuaacagcagaggccgagcggg

SEQ ID NO: 8737 - RNA, 95 nt, Human
ggggcagggcuuuggggcugugaugcucugggaagccagcuuggguccugggucuacagagggcccuggccccggagcccagccagcucugccuc

SEQ ID NO: 8738 - RNA, 82 nt, Human
cccuuaaaugccuuauaaaagaccauccauccagucugcgcuuuugacugugugcaaguaucaguaauaaugcuuuuggggg

SEQ ID NO: 8739 - RNA, 71 nt, Human
aggauggguaccaggccugagauugugggaguggcauuacccucugggagucucgggcagaucaccaucuu

SEQ ID NO: 8740 - RNA, 63 nt, Human
cgucgaugguguugauagauggugacuuuuucagcccacaugagcaacaccaccacaaugaug

SEQ ID NO: 8741 - RNA, 79 nt, Human; identical to SEQ ID NO: 2369

SEQ ID NO: 8742 - RNA, 64 nt, Human
gcagccggagcacaggaacaccagcggccucuccuccgcagccgccgccuccuccuccagcugc

SEQ ID NO: 8743 - RNA, 84 nt, Human; identical to SEQ ID NO: 286

SEQ ID NO: 8744 - RNA, 89 nt, Human; identical to SEQ ID NO: 288

SEQ ID NO: 8745 - RNA, 64 nt, Human
cacacggauaaccuuuggaguacgugacaacaacuuugucaccuaugacaccagcuucugcgug

SEQ ID NO: 8746 - RNA, 122 nt, Human
uagagcuucacagugccagggggcaggcugucguugcagagcucuguaguuagcgcaggucguagaccaaaccugugccacauccaugggugcaaugagggcagguccccuauccaucucug

SEQ ID NO: 8747 - RNA, 70 nt, Human
agaauuaaaaaucugcaucuuccacuauuuucaauauauuaagagaaauaagugcagcauuuuugcaucu

SEQ ID NO: 8748 - RNA, 81 nt, Human; identical to SEQ ID NO: 4673

SEQ ID NO: 8749 - RNA, 62 nt, Human
ggcuacgcagcacugguugcuucuggugggaucauuggcuauguaaaagcaggcagcgugcc

SEQ ID NO: 8750 - RNA, 79 nt, Human
gcauaguuaaaaaaaugaagcgagauggcaguuugugcaguaauaucugcccuucgaaguucaugcaaccaacuaaugc

SEQ ID NO: 8751 - RNA, 66 nt, Human; identical to SEQ ID NO: 1008

SEQ ID NO: 8752 - RNA, 60 nt, Human
uuuuuuuuuuuuuuuuucacgauaagguggauguuuauuuaaaacaaaaauaagaagaga

SEQ ID NO: 8753 - RNA, 62 nt, Human; identical to SEQ ID NO: 1277

SEQ ID NO: 8754 - RNA, 62 nt, Human; identical to SEQ ID NO: 4194

SEQ ID NO: 8755 - RNA, 67 nt, Human; identical to SEQ ID NO: 4195

SEQ ID NO: 8756 - RNA, 76 nt, Human
ccugugggcuuucuacaguaucccacugugucugguaugugucaauuuaugggauuacugagaauugccucuaagg

SEQ ID NO: 8757 - RNA, 69 nt, Human
uagggaaagcugguacgccugcagguaccgguccggaauucccgggucgacccacgcguccgcacccua

SEQ ID NO: 8758 - RNA, 62 nt, Human; identical to SEQ ID NO: 4194

SEQ ID NO: 8759 - RNA, 67 nt, Human; identical to SEQ ID NO: 4195

SEQ ID NO: 8760 - RNA, 92 nt, Human
agugacugucacccacacuuugauuguguugccaggacacaggcagauauuuuuuguuuuuguuucugggagcguguggguucuuaaacacu

SEQ ID NO: 8761 - RNA, 68 nt, Human
ggacaguaauaccuggcuuuaucauaugccugacagcauugcugcauaguaccagaguuaagcugucc

SEQ ID NO: 8762 - RNA, 98 nt, Human
uugggaaucuccaggugaccuaauccucauugguggcuugauguuugcugguaucuuccaaacucaguucccagacuagauugauaccuggagcccag

SEQ ID NO: 8763 - RNA, 85 nt, Human
cagccuggacgagagcauccuccucaaguggacaaaaggcuucaaggcaucuggcugcgagggcgaggacguggugacccugcug

SEQ ID NO: 8764 - RNA, 65 nt, Human
gcauuggugaucuuugcuacagaaagcuguucaugguaggcuuucucagcagagaugacaggggc

SEQ ID NO: 8765 - RNA, 78 nt, Human
guugaugccaaccuugaagccaguggggcaccaauccacaaacuggaugcugcgcuugguuuugaugguggcaauggc

SEQ ID NO: 8766 - RNA, 87 nt, Human
gccagucugcccagcugcaguacucacgccccaugggggaucuuggucuguuuuucuugugggagccuaguggagagcagacguggc

SEQ ID NO: 8767 - RNA, 78 nt, Human
ugcauuucgccauguugcccagcacucaagcaaucauccuaccucagccucccaaguagcugggauuacaggcaugua

SEQ ID NO: 8768 - RNA, 67 nt, Human; identical to SEQ ID NO: 1379

SEQ ID NO: 8769 - RNA, 72 nt, Human
gcaggugcgcuccgggaugaagugcagggaggcaaacucuggcuggguuccuguaaaauccaucgcagcugc

SEQ ID NO: 8770 - RNA, 81 nt, Human
gggaaggccagaggcaggcuuagcuucgggcggcagcggucuggggcugcucggacuggagcugcuugccaagguauuccc

SEQ ID NO: 8771 - RNA, 92 nt, Human
gggugggagggaggauggugcgucauuuaacauuaaauugccucucucuacaguauguggcugagcaucauggaccuuccucccucugcccc

SEQ ID NO: 8772 - RNA, 60 nt, Human; identical to SEQ ID NO: 7400

SEQ ID NO: 8773 - RNA, 78 nt, Human
aagccuuuuccucuacucucuuccuuguucugaaucauuucuucuucucaggccaaaguagccaugguaaggaggcuu

SEQ ID NO: 8774 - RNA, 85 nt, Human
agcugagacugacgggugauguugcucauaggcuccagcucugcauaagaccuuggcuuggagaccucccucucagucaacagcu

SEQ ID NO: 8775 - RNA, 73 nt, Human
cacuugugugaauuaguuuauaaguauacaugaaauauauuuuaaaaaaacauuauaaaaaauucauacagug

SEQ ID NO: 8776 - RNA, 76 nt, Human
cauacacuauacaagguuuguugaauacuaguuucuuuggaaccauagggaaagcuuugcucugggucaguguaug

SEQ ID NO: 8777 - RNA, 85 nt, Human
gucugaauugucaaauaguucuaaagugcauucuugcagcuaauaaauagcagcauuuguuuauaaaaccuuaagaaauucagac

SEQ ID NO: 8778 - RNA, 98 nt, Human
gaggaaauguuucaccuaaauauauuauggucaaugaaaaaaccggacuuuagaguaaaugugauaaccaaguagauuuguggaaccuuuauuuccuu

SEQ ID NO: 8779 - RNA, 60 nt, Human
aaaggaggggggcaggcauggcccugauuccuuauuaagggccccccacccuccaccuuu

SEQ ID NO: 8780 - RNA, 78 nt, Human
cagggggggcccccaaagggacauuuuuaacgggggggggauucgccccggccgggcuccuaagggaggcuaccccug

SEQ ID NO: 8781 - RNA, 77 nt, Human
gacccaucuuggcaauggauaugacccccaaagucaccagaucacgaggggucccaagucuagcccggacgaggguc

SEQ ID NO: 8782 - RNA, 73 nt, Human
uccgugcgcguugcugcggccgugguccgcgcccuuccucggcgggccggacuggucuccagaaaugcuuggg

SEQ ID NO: 8783 - RNA, 84 nt, Human; identical to SEQ ID NO: 286

SEQ ID NO: 8784 - RNA, 64 nt, Human; identical to SEQ ID NO: 287

SEQ ID NO: 8785 - RNA, 89 nt, Human; identical to SEQ ID NO: 288

SEQ ID NO: 8786 - RNA, 73 nt, Human
agcuggcagugccagggcugugaaccgugugccugcgaccgcacaacucccucagcccacagugcaaccaguu

SEQ ID NO: 8787 - RNA, 71 nt, Human
caggcuguaaucugucucugcuggggugaagggacggagggagacagaugagaaaugagaacacagaccug

SEQ ID NO: 8788 - RNA, 93 nt, Human
gucacuucagcccagcccagggagccccugcccagcacaagccucaugcacaguagcaguguuaagaugggcccuugggcugggugcaguggc

SEQ ID NO: 8789 - RNA, 103 nt, Human
uugagacaggagaaucgcuugaacccagguguuggagguugcacugagcugagauugcgccacugcacuccagccugggugacaaagcgagacugugucucaa

SEQ ID NO: 8790 - RNA, 101 nt, Human
aggccugccgucaugucuaagucagagucuccuaaagagcccgaacagcuaaggaagcucuucauuggaggguugagcuuugaaacaacugaugacagccu

SEQ ID NO: 8791 - RNA, 83 nt, Human
agccaucugagauacccaaguaguagaauccuuucaagcacugguuacuggugaugaauuuuguuuuguacugucacagagcu

SEQ ID NO: 8792 - RNA, 64 nt, Human; identical to SEQ ID NO: 5090

SEQ ID NO: 8793 - RNA, 81 nt, Human
aaagggcaagaauaucacggcaugggcaugaguagcuugaaacugcugaaguauguccuguuuuucuucaacuugcucuuu

SEQ ID NO: 8794 - RNA, 79 nt, Human; identical to SEQ ID NO: 7809

SEQ ID NO: 8795 - RNA, 99 nt, Human
gagacaggagaaucacuugaaccggggagguggaggcugcaaugagccaagaucacgccacugcacuccaaccugggcaacagagugagacuucgucuc

SEQ ID NO: 8796 - RNA, 97 nt, Human
gucacgauggcucaugccuguaaucccagcuacucaggaggauugcuugacccugagagguggagguugcagugagcucagaucacaccaucgcaac

SEQ ID NO: 8797 - RNA, 81 nt, Human
ucuuugaugauuaaaauauuuuagaaaucugaauuacaaauccgcaguauaaagaugaaaaaugucacuucaguaaaaaga

SEQ ID NO: 8798 - RNA, 131 nt, Human
aaaauuuaccuuuaaguauuuacuuuaaaaaauuuaauggcuuaacucgaacuugaagacacauacuucaacuguccuuauuguccauuaaacugauaauuuugauuuuucuugcuuuuauagauuuuacu

SEQ ID NO: 8799 - RNA, 69 nt, Human
aaagugcuaaauaaauagaucuacauuuuguacauauuuauauaaaauuuaccuuuaaguauuuacuuu

SEQ ID NO: 8800 - RNA, 60 nt, Human
uuuaauggcuuaacucgaacuugaagacacauacuucaacuguccuuauuguccauuaaa

SEQ ID NO: 8801 - RNA, 96 nt, Human; identical to SEQ ID NO: 5665

SEQ ID NO: 8802 - RNA, 78 nt, Human; identical to SEQ ID NO: 5666

SEQ ID NO: 8803 - RNA, 95 nt, Human
gagagacauacaaggacagugggucauggguaguaccagccucaaauucccacaggcucauacucagacaauuguauuacugccuuauguuuuuu

SEQ ID NO: 8804 - RNA, 91 nt, Human
gcaguuaaauacauuuuguauacaugaagcuuagauuaauucccaucaucaucaucuccuguuuuuauaugugucccuauguguuucaugc

SEQ ID NO: 8805 - RNA, 62 nt, Human
gugcuauuaaagaauauguguuccuuuuuauuauauuaucagauacuuauguuuaauuguac

SEQ ID NO: 8806 - RNA, 86 nt, Human
ggguucaguguaguguguucucuaccgaaaugguuauauacagaugguauggaaaugguuuuaaaggauuacucauaaacuauccc

SEQ ID NO: 8807 - RNA, 63 nt, Human
agaggacuguguuguggucuggggagaauguaaucauuccuuccacaacugcugcaugucccu

SEQ ID NO: 8808 - RNA, 65 nt, Human
gagaacuccuccugcaugacaaacuucucuccuuuagcaguucugauagcaacaacaggaaucuc

SEQ ID NO: 8809 - RNA, 79 nt, Human
ugggauagguucagacuucagguaucucuucagauugccaucaaaguaauccugcaggaaccucuccagagccuuccca

SEQ ID NO: 8810 - RNA, 66 nt, Human
ugggucuuugcugagcuucucgccaaguucuuuauacuugggcuccagguucuuacagugaccaca

SEQ ID NO: 8811 - RNA, 90 nt, Human
gggaagcacugucugugaggucucuaacuagcuguauugaaaaugauaaaugauccuagaggcuaguauuaucucguugacauuuuucuc

SEQ ID NO: 8812 - RNA, 111 nt, Human
agcuuugccacauucugcacagacguggacucugggaccguggugugcagauguuuucucauggccgaguuaucccugaaccaucuugugcagccuuuaugagggcaagcu

SEQ ID NO: 8813 - RNA, 82 nt, Human
guuaguaccacuuagggcuacaaggacccuggguucuucugucagaggaauuggguucagguuucaggcuuuaggguguaac

SEQ ID NO: 8814 - RNA, 67 nt, Human
gcugcuuacccuucccggaaccacaagauugucaaugccaaucaaaucuuucuugaguucgugcagc

SEQ ID NO: 8815 - RNA, 87 nt, Human
gguucaaauguaagucccuccgaugccuucuuucugcuccccgcgcagugcauagugaggccacugcugcuuacccuucccggaacc

SEQ ID NO: 8816 - RNA, 69 nt, Human
ggucuuugcggauguccacgucacacuucaugauggaguugaagguaguuucguggaugccacaggacu

SEQ ID NO: 8817 - RNA, 65 nt, Human; identical to SEQ ID NO: 6774

SEQ ID NO: 8818 - RNA, 76 nt, Human; identical to SEQ ID NO: 758

SEQ ID NO: 8819 - RNA, 62 nt, Human
caccuuuacgggcaaaccguccaccucgaccgauucuguggauauaguuuucccuguuggug

SEQ ID NO: 8820 - RNA, 62 nt, Human; identical to SEQ ID NO: 4194

SEQ ID NO: 8821 - RNA, 67 nt, Human; identical to SEQ ID NO: 4195

SEQ ID NO: 8822 - RNA, 86 nt, Human
gcaggcaggcaaggugacgggacuggaagcccuuuucagagccuuggaggagcugguccguccacaagcaaugagugccacucugc

SEQ ID NO: 8823 - RNA, 76 nt, Human
ugcaggggauggauaaacagggaaacacugugcauuccucacagccaacaguguaggucuuggugaagccccggcg

SEQ ID NO: 8824 - RNA, 75 nt, Human; identical to SEQ ID NO: 8270

SEQ ID NO: 8825 - RNA, 99 nt, Human
uuaaaccuuugaucucccacaccaaaagagaaaauaauauuuauauggaaguaauuuuauuuuaguguuugugauuuauuguggagagcagguguuuaa

SEQ ID NO: 8826 - RNA, 85 nt, Human
agggucaugaucaaaauuuuuuggguaccaguauuuagcaacaauauagguaauuuuagagaguauaauuuuggauccugauucu

SEQ ID NO: 8827 - RNA, 74 nt, Human
aagcucuuauugcaaaagacauuaaugagaccagaaaauaucuaccuggcuagcuuuuguaguagguaugguuu

SEQ ID NO: 8828 - RNA, 65 nt, Human
gacauugugaauuuaaccucucccgaucugggauuuaccccaugggaguggccguucacuuaauc

SEQ ID NO: 8829 - RNA, 81 nt, Human
guugaagcugauguuacuagugguagauugguucauacgaugcacggaggggucaaugugucaaagacaucgguuaucaac

SEQ ID NO: 8830 - RNA, 106 nt, Human
gggagcggcuaggccgggacgcccgugguccucaccccuugagcugcuuuggagacucggcugccagagggagggccaugggccgaggccuggcauucacguuccc

SEQ ID NO: 8831 - RNA, 73 nt, Human
gugcccacagugccccggacacauuucacaccucaggcucgugguggugcaggggacaagaggcugugggugc

SEQ ID NO: 8832 - RNA, 71 nt, Human
uucccgugggcccccgagacccgccuagauggaggaagcgcugcugggcgcccucuuaccgcucacgggga

SEQ ID NO: 8833 - RNA, 62 nt, Human
uguucaaggcaauggcuuuuuaaaucuuggcuaucuaaaauuuuuucccuuuguuuugaaua

SEQ ID NO: 8834 - RNA, 74 nt, Human
cuggguaucaccagcggaggcugcagagcagcaaugauugcugccuguuguuuccucuggaagcugcgacccag

SEQ ID NO: 8835 - RNA, 61 nt, Human
gauuugauauguucuuugucuuaaucuuagccaagaaaacaaacaggaccaacuucaaauc

SEQ ID NO: 8836 - RNA, 63 nt, Human
gucauugaucaugacaucaacaauagguacuugaucaauuuuugguguauugauuucaaugac

SEQ ID NO: 8837 - RNA, 72 nt, Human
ugcuucucaaggcugcuggaggugccucuucgucauaugaaggucacccguucccagggcuccuaaguggca

SEQ ID NO: 8838 - RNA, 99 nt, Human
cuaagauguuaccaguuucuuauuuuuacacauucuuuuuauugaagucccuuuuuauguugcugaauuguauauuaauguaaaaaagguuuguaguag

SEQ ID NO: 8839 - RNA, 61 nt, Human
gcuuauucucuccccaacauuucuaauuucguuuucauuuucuguuagagagaggauaugu

SEQ ID NO: 8840 - RNA, 60 nt, Human; identical to SEQ ID NO: 2705

SEQ ID NO: 8841 - RNA, 72 nt, Human; identical to SEQ ID NO: 1989

SEQ ID NO: 8842 - RNA, 71 nt, Human
auuuagaggaauugaaaguuaaagcaucucccauaacaaaugauggggaagaugaauuuguuccuucagau

SEQ ID NO: 8843 - RNA, 60 nt, Human
ggaagauucugcuucuguuuuuucaccaucauuuggucugaaacagacagauaaaguucc

SEQ ID NO: 8844 - RNA, 68 nt, Human
gggauuucucuacaggcuggcccgaaccaguuguuuugucuugcgggucugucagguuuggaaagucc

SEQ ID NO: 8845 - RNA, 78 nt, Human
agaggucagaauggcaggcaggggguggggaaggcggugcuucuugagccccacuuagcaacuggucacucauccucu

SEQ ID NO: 8846 - RNA, 79 nt, Human
ggcagcuggaucuugcuggggucgaagcaguuggauuccaugaugggaaggccauuggcucuucgguauuucacaagcc

SEQ ID NO: 8847 - RNA, 90 nt, Human
agcauguggccaggggugcaggguggcggggggucagcagcaugucccugggcaggcccugggcacccugucuccccuggucucacugcu

SEQ ID NO: 8848 - RNA, 70 nt, Human
gcugaugguccaauaaggggggugugagccccgcagggacuggcccgcaccugccuuggauguuuucagc

SEQ ID NO: 8849 - RNA, 64 nt, Human
ugcuguuccaguucuggucaagggccuugggggcuggccccccaccaggccuucuagagcagca

SEQ ID NO: 8850 - RNA, 66 nt, Human; identical to SEQ ID NO: 4822

SEQ ID NO: 8851 - RNA, 83 nt, Human; identical to SEQ ID NO: 6696

SEQ ID NO: 8852 - RNA, 66 nt, Human; identical to SEQ ID NO: 4823

SEQ ID NO: 8853 - RNA, 77 nt, Human
uuuacaccugaaagaaacuucauacuuguguguucuguuccccaucucagagcaagauuaugaagagaaggucuaaa

SEQ ID NO: 8854 - RNA, 61 nt, Human; identical to SEQ ID NO: 1363

SEQ ID NO: 8855 - RNA, 63 nt, Human; identical to SEQ ID NO: 1364

SEQ ID NO: 8856 - RNA, 102 nt, Human; identical to SEQ ID NO: 2701

SEQ ID NO: 8857 - RNA, 90 nt, Human; identical to SEQ ID NO: 2702

SEQ ID NO: 8858 - RNA, 88 nt, Human
gcacgagggggugcuggcggcugcagccggaguucaaaccuaagcagcuggaaggaaccauggccaacugugagcguaccuucauugc

SEQ ID NO: 8859 - RNA, 67 nt, Human; identical to SEQ ID NO: 6560

SEQ ID NO: 8860 - RNA, 80 nt, Human; identical to SEQ ID NO: 7925

SEQ ID NO: 8861 - RNA, 76 nt, Human
uugaugaagucucucaucuuugaaaggccauaaucuucuuuauuucccuuuuugucauguuucuucaaccauucaa

SEQ ID NO: 8862 - RNA, 65 nt, Human; identical to SEQ ID NO: 7133

SEQ ID NO: 8863 - RNA, 71 nt, Human
ggccaucuuuaccgugcagcuggaugacguaccugaacggacgggccgugcagcaccgugagguccaggcu

SEQ ID NO: 8864 - RNA, 71 nt, Human
gguguaaauguugagccuuuuuggccuggcuuguuugcaaaggcccuggcaaacgucaacauugggaagcc

SEQ ID NO: 8865 - RNA, 66 nt, Human; identical to SEQ ID NO: 50

SEQ ID NO: 8866 - RNA, 81 nt, Human
cugggguguuuauggcaagucacuuugacagacauuauuguggcaaauguuguccugacuuaccuguuuccaacaaaccag

SEQ ID NO: 8867 - RNA, 65 nt, Human; identical to SEQ ID NO: 247

SEQ ID NO: 8868 - RNA, 80 nt, Human; identical to SEQ ID NO: 100

SEQ ID NO: 8869 - RNA, 67 nt, Human
gggcacauuggugguauuuugguauguggccacuggcccuaaacaacugaccauuucuacccugccu

SEQ ID NO: 8870 - RNA, 105 nt, Human
ggggccggcuuggcuggguggggaccucaagucugagggugaggauggcugaaucuaccucgcuuaugucucagggacggucacccauuaccuaaggaugacccc

SEQ ID NO: 8871 - RNA, 84 nt, Human; identical to SEQ ID NO: 286

SEQ ID NO: 8872 - RNA, 64 nt, Human; identical to SEQ ID NO: 287

SEQ ID NO: 8873 - RNA, 65 nt, Human; identical to SEQ ID NO: 2

SEQ ID NO: 8874 - RNA, 79 nt, Human; identical to SEQ ID NO: 995

SEQ ID NO: 8875 - RNA, 96 nt, Human
ggcagcggcagcagcggcagcaguagcagccccucccacagcugugggcucccucucgggggcggagggggugccugugagcucucagccacuucc

SEQ ID NO: 8876 - RNA, 97 nt, Human
gcccaugcugauuaaaauuuugcuaccaagaagugggaugccuuuguaccaaauaccuaaaaauguggaaauggcuuuguaacuguugguaaugggu

SEQ ID NO: 8877 - RNA, 89 nt, Human
ggagucuucacucucuugcccaggcuggagugcaguggcacaaucuuggcccacugcaaccuccgccuccuggcuucaagugauacucc

SEQ ID NO: 8878 - RNA, 81 nt, Human
agggaaauggccuucccgccggacgaaggcuuaucugccugacaggcugugacucuucucucaaccuugggcuucuucccu

SEQ ID NO: 8879 - RNA, 95 nt, Human
ccacccccacgauucgguaugaugcugccggcacagcugggauacacacggcucccccaggccugagcugcuucacuagggaauccugcggcagg

SEQ ID NO: 8880 - RNA, 78 nt, Human
gcacauguuggaggagagagccuugggagccacugccacuccaguccugccaccacccuugucuuccucugcaagugc

SEQ ID NO: 8881 - RNA, 89 nt, Human; identical to SEQ ID NO: 288

SEQ ID NO: 8882 - RNA, 94 nt, Human; identical to SEQ ID NO: 5398

SEQ ID NO: 8883 - RNA, 74 nt, Human
ccaggucuaucuguccaauacuuugugucuaggguagaggucccuaacccuggcugcacauuggaagcaccugg

SEQ ID NO: 8884 - RNA, 72 nt, Human
gaauuccugaggcccgagccacacccuaaaccaauuucaucagaaucucugggugggacggagccuggauuc

SEQ ID NO: 8885 - RNA, 77 nt, Human
gacauccaauuuuguucaggucccuuuuaauggcacuuaauaaauauacauucugagaccuggcagaacaggcuguc

SEQ ID NO: 8886 - RNA, 72 nt, Human
cagauuagaaaaacugagguuauggcacugacuuaggcaccccccagcaaggcaacccagggacuacaacug

SEQ ID NO: 8887 - RNA, 63 nt, Human; identical to SEQ ID NO: 123

SEQ ID NO: 8888 - RNA, 99 nt, Human
ccaagaacuuuuuggccccguguuggaugcagugucucgggacuucgucaguguccugcacaggucgcaucaagaaggcgggcuccggaacuuacucgg

SEQ ID NO: 8889 - RNA, 65 nt, Human; identical to SEQ ID NO: 404

SEQ ID NO: 8890 - RNA, 91 nt, Human; identical to SEQ ID NO: 124

SEQ ID NO: 8891 - RNA, 105 nt, Human; identical to SEQ ID NO: 979

SEQ ID NO: 8892 - RNA, 73 nt, Human; identical to SEQ ID NO: 4762

SEQ ID NO: 8893 - RNA, 62 nt, Human
cuugguucuacagccauggggauccagacaucagagggugugugccuagcuguggagaagag

SEQ ID NO: 8894 - RNA, 72 nt, Human
ggacccaucugggaccuuuguacagugugaugcucgagcaauuggcucuguucagagggugcccagagcucc

SEQ ID NO: 8895 - RNA, 74 nt, Human
ggugaguugggugccgguggagucguguagguccucagaauccccgcguagccgcugcuccuccuacccucgcc

SEQ ID NO: 8896 - RNA, 76 nt, Human
guguuuggaacugcuaccgauacaucaaugguaggaacuccucugauguccugguuuauguuaccagcaaugacac

SEQ ID NO: 8897 - RNA, 74 nt, Human
uccuguacgauuggggauauaacgggcuucacuaacuuucccuaggcauugaaacuucccccaaaucugaugga

SEQ ID NO: 8898 - RNA, 71 nt, Human; identical to SEQ ID NO: 1007

SEQ ID NO: 8899 - RNA, 79 nt, Human; identical to SEQ ID NO: 8750

SEQ ID NO: 8900 - RNA, 66 nt, Human; identical to SEQ ID NO: 1008

SEQ ID NO: 8901 - RNA, 75 nt, Human; identical to SEQ ID NO: 6455

SEQ ID NO: 8902 - RNA, 102 nt, Human
cuggaggcuguggggcagguacaguugcuguuggugcagguggucuauuaagaauaccuggcgcugaaacagccugugcuugagucauuggaggaauuccag

SEQ ID NO: 8903 - RNA, 61 nt, Human; identical to SEQ ID NO: 3654

SEQ ID NO: 8904 - RNA, 77 nt, Human; identical to SEQ ID NO: 3655

SEQ ID NO: 8905 - RNA, 65 nt, Human
ccagucacguugaauuuaugguucguccaaaugaauuuacgagcaguaagugguuuuguuguugg

SEQ ID NO: 8906 - RNA, 64 nt, Human
gaaugguaaacaguaaaagaguaauuacaugaaaagcuccauauuuugcauguuucaacuguuc

SEQ ID NO: 8907 - RNA, 70 nt, Human
ggaucaucagucauacugugaagccaacgaugccaaaaaauugcuuguugucuucauaguauuuguuucc

SEQ ID NO: 8908 - RNA, 75 nt, Human
cuguggaaaaacuaagggaugcuuuagauauggcaaaccaggcuguaaugcagagaccugugacuauuuccucag

SEQ ID NO: 8909 - RNA, 64 nt, Human
gacuccuccuacggcaccuucgcgggggaguucuacgaccugcgcuaccugucggaggaggguu

SEQ ID NO: 8910 - RNA, 65 nt, Human
guuuguuuuauaguacaguguaugcggccaugugcugcauaacacuguuucagucaagaaugaac

SEQ ID NO: 8911 - RNA, 72 nt, Human
aagaaaggacgggguuucuaguugcuaagauuugccaaacauggcuacaaaacugguaaacaaaccuuucuu

SEQ ID NO: 8912 - RNA, 69 nt, Human
gcaucaugggagugacagggccacuggcaagacuuuuugccagucagccuaguucuucuuuuaagaugc

SEQ ID NO: 8913 - RNA, 68 nt, Human
gguccuauguucagccccuaaacgaauggcacaaugccaccaauuuugggauuccugaguuugguucc

SEQ ID NO: 8914 - RNA, 63 nt, Human
auggugacaacaugcuggagccaagugcuaacaugccuugguucagggauggaacgucaccgu

SEQ ID NO: 8915 - RNA, 81 nt, Human
acucaguuuuauugacuuccagcauuucccccuggaucugagcucagcccagcugguuuugguucgucucugaggcucagu

SEQ ID NO: 8916 - RNA, 81 nt, Human
acaaaauagacacuuuuggauuuucccgucuuuuccaacaccaaggaugagauuaucaaaagauguguuaaauuaauuugu

SEQ ID NO: 8917 - RNA, 69 nt, Human
aaggaccaaggaugggagguuuuaaagcaggaaacagcaguuguugaaaacguccccauuuugggacuu

SEQ ID NO: 8918 - RNA, 93 nt, Human
gauuguacuguauggggacuccaauugcuuggaugacagucaccgacagaaggacugcuuugggcuucuggaugcccuccuccaguacacauc

SEQ ID NO: 8919 - RNA, 60 nt, Human
ucgucaucuucagugacgguacaacacuucuguuaugagaagagugaaguuuuaugauga

SEQ ID NO: 8920 - RNA, 76 nt, Human
uggggugacgccgccuagccucagucacucugggaaccgccagcgcccucccaguggagcaggcucagucacucca

SEQ ID NO: 8921 - RNA, 81 nt, Human
cugggguuguuuauggccaagucacuuugacagacauuauugugggcaaauguugucugacuuacuguuucaacaaaccag

SEQ ID NO: 8922 - RNA, 80 nt, Human; identical to SEQ ID NO: 100

SEQ ID NO: 8923 - RNA, 77 nt, Human
uugguucccuuccagucucuucccccuuucuaucccaaucaccaauagaaaugcuaacaucccugccugguagccag

SEQ ID NO: 8924 - RNA, 86 nt, Human
uacugccaaaacuuuaaauaucucaagagcauaccacauuuuaaacacauuauggucauguagcuauuucaauauuccugggagug

SEQ ID NO: 8925 - RNA, 84 nt, Human
uccugagcuucuucuaccucugagaguuuuucaucauuuuccaauguuugcugaaguucauggaugguacuaagaagaacauga

SEQ ID NO: 8926 - RNA, 78 nt, Human; identical to SEQ ID NO: 7184

SEQ ID NO: 8927 - RNA, 60 nt, Human; identical to SEQ ID NO: 7400

SEQ ID NO: 8928 - RNA, 65 nt, Human; identical to SEQ ID NO: 4986

SEQ ID NO: 8929 - RNA, 64 nt, Human; identical to SEQ ID NO: 8200

SEQ ID NO: 8930 - RNA, 66 nt, Human; identical to SEQ ID NO: 2189

SEQ ID NO: 8931 - RNA, 71 nt, Human
cuugaccaggcucggaggucgccccgaucgaaacagugaccgggacauggggugccccguuuaaggucagg

SEQ ID NO: 8932 - RNA, 71 nt, Human
uuuuauuucugaacugacucccaguuauguucuugggauauagauauggggggaaagcuuagaacauggaa

SEQ ID NO: 8933 - RNA, 65 nt, Human
gcggcggcuuucuucgcuuucuucgguguuuucuuagcgcucuucuucggaguugcgccgccagc

SEQ ID NO: 8934 - RNA, 81 nt, Human
gagcuuaaguacccgccagugagcagugagagggaacggagccgcuaugucgcaguguuccaggaccaguacggagaguuc

SEQ ID NO: 8935 - RNA, 101 nt, Human
auuacucauauuuaagagaucuaggaaugaggagucucugauccccuuucuucaaaucagagcuuuaauuucauagacgcucucucucucucugugguaau

SEQ ID NO: 8936 - RNA, 80 nt, Human
gugaugucugcguaacgagucuuuauaccaucuaguuuuuccuggauaaguaacaccuccucaccuauggaagauagcac

SEQ ID NO: 8937 - RNA, 65 nt, Human
ugucuucuguacaucuuacuggguuuaauuaaaaaaaaagaaaaaacucuguuguacaaagggca

SEQ ID NO: 8938 - RNA, 60 nt, Human
gcugcucgccccacaugcccucauggcuguuguuccagggggggcaguggggugggccgc

SEQ ID NO: 8939 - RNA, 60 nt, Human
gguggcgucgggcugguuguuccagggcgcgucgcgcuggccguuccagccggggucacc

SEQ ID NO: 8940 - RNA, 61 nt, Human; identical to SEQ ID NO: 3609

SEQ ID NO: 8941 - RNA, 66 nt, Human; identical to SEQ ID NO: 3610

SEQ ID NO: 8942 - RNA, 82 nt, Human
gggguggaucagggcucuaucacuugguccccaccucaccuugguggggccagagugagccccuuccugccacagucacccc

SEQ ID NO: 8943 - RNA, 94 nt, Human
gugacugacgaggagaucuccccacagcuuaguuguagugagccagacgaggcagcuuauggaaccuggggggguucucuccauuugucaccgc

SEQ ID NO: 8944 - RNA, 68 nt, Human
cggggacuggauugacaguauccuggccuucucaaggucccugcacagcuugcuugucgaugucccug

SEQ ID NO: 8945 - RNA, 104 nt, Human
gcaucaauacuaucuggagauaauucuucuaagggacaaacugcaggacauaagggauccugaacagucagugguggaggaguucucggugagguaguaguugu

SEQ ID NO: 8946 - RNA, 74 nt, Human
ggaagugggcagcaagaucuacguggaugaugggcuuauuucucuccaggugaagcagaaaggugccgacuucc

SEQ ID NO: 8947 - RNA, 63 nt, Human
ugcagauuucauauauuucugaaucaaaaacaccuuugucuucacaguaugaguuagaaugca

SEQ ID NO: 8948 - RNA, 72 nt, Human; identical to SEQ ID NO: 5753

SEQ ID NO: 8949 - RNA, 84 nt, Human; identical to SEQ ID NO: 286

SEQ ID NO: 8950 - RNA, 89 nt, Human; identical to SEQ ID NO: 288

SEQ ID NO: 8951 - RNA, 84 nt, Human; identical to SEQ ID NO: 286

SEQ ID NO: 8952 - RNA, 89 nt, Human; identical to SEQ ID NO: 288

SEQ ID NO: 8953 - RNA, 94 nt, Human
uuuuuuuuuucauuuaacuuuuuuaaugggucucaaaauucugugacaaauuuuuggucaaguuguuuccauuaaaaaguacugauuuuaaaaa

SEQ ID NO: 8954 - RNA, 84 nt, Human; identical to SEQ ID NO: 286

SEQ ID NO: 8955 - RNA, 89 nt, Human; identical to SEQ ID NO: 288

SEQ ID NO: 8956 - RNA, 94 nt, Human; identical to SEQ ID NO: 5398

SEQ ID NO: 8957 - RNA, 74 nt, Human; identical to SEQ ID NO: 365

SEQ ID NO: 8958 - RNA, 68 nt, Human
gauggcuuauuuguuuuguauucaaugauugucuuuccccauucauuugucuuuuuagagcagccauc

SEQ ID NO: 8959 - RNA, 71 nt, Human
gccaauguccacaaagaauuccuggucagcaccaccgauguccaaaggugcaauaucaaggaagggcaggc

SEQ ID NO: 8960 - RNA, 90 nt, Human; identical to SEQ ID NO: 1501

SEQ ID NO: 8961 - RNA, 82 nt, Human
ucagcuuucaguuaaaaaagaagaagaagaaauggcaaagagaaaguuuuuucaaauuucuuucuuuuuuaauuuagauuga

SEQ ID NO: 8962 - RNA, 77 nt, Human; identical to SEQ ID NO: 8698

SEQ ID NO: 8963 - RNA, 74 nt, Human
aagaauucuaagaacacuacuagaagcauuuguucccuccuagucaaugcuucauacuuuuucuugggauucuu

SEQ ID NO: 8964 - RNA, 60 nt, Human
ggugaccccgaggcagcucacgcgguugucguggccagcgaggacuccugcacggucgcc

SEQ ID NO: 8965 - RNA, 86 nt, Human
uggcaucccagauguugcaguugaagucgucguagccagcgagcagcagccguccgcugcgcgagaaggcaacagaggugaugcca

SEQ ID NO: 8966 - RNA, 80 nt, Human
gagcuggagagauguuagaagauggcucugagagauuccucugcgaaucuguuuuuagcuaucaaguggcauccacgcuu

SEQ ID NO: 8967 - RNA, 78 nt, Human
gguggggggcgaacacgccgcgguccucgucgugugaaguaagaacucugcuagagaggaaauggcugcuucaucauc

SEQ ID NO: 8968 - RNA, 64 nt, Human
ugguggggucaguggaaguucugucacuggaucugguuucagugucucagaccuugccccacca

SEQ ID NO: 8969 - RNA, 71 nt, Human
gaccgucacggccauggaugugguguacgcgcugaaacgccagggucgcacccuuuaugguuucggcgguu

SEQ ID NO: 8970 - RNA, 105 nt, Human
agauucgcauugaaaauagucauucugaauccuauugauuauccaaaaauccaggcugauuugucuuuuaucagagguaggauccuguuuuauaguauagaaucu

SEQ ID NO: 8971 - RNA, 65 nt, Human
augauguaaagaaugcuucuuguucauuacaugggagucaugaugaucaagaaucuggauaucau

SEQ ID NO: 8972 - RNA, 111 nt, Human
aaaguuauuuuggguguaaguggugaaugaaugugaaggccuaggacauuacuguacacuacuauagacuuuauaaacauuguacacuuagacuacacuaaacauaauuuu

SEQ ID NO: 8973 - RNA, 70 nt, Human
gccccauucccaugauaauccauuaaucuaucaauccuugaauagauuaauccaaucaccucuuaagggc

SEQ ID NO: 8974 - RNA, 65 nt, Human
gcugagaaguccaagguugagggccacaucaggucagggucuucuugcugguagggacucucugc

SEQ ID NO: 8975 - RNA, 60 nt, Human
ggcaucauauggugggggcgcugagcaugcuagcucaggucuucaucuucuuacaaagcc

SEQ ID NO: 8976 - RNA, 94 nt, Human
auacauguaagauuuguuauauauccuuaguuuuaaaaaaucacuaucaccugaccuuauuuaaccuuaauuauacuuguuuuucuuacugugu

SEQ ID NO: 8977 - RNA, 78 nt, Human
gccguugagcugguacaccguccggaaggcauuggccauacccgacagccggccgcugauguuggccagcgagagggc

SEQ ID NO: 8978 - RNA, 78 nt, Human
ggucuuacagacguccaggggggucgguggcggccgcggcgagggccccggccagcccgccugagaugaugugggacu

SEQ ID NO: 8979 - RNA, 80 nt, Human
guggauggacuggaaggggauguucauggucagcugcgugguguagcuccgguagaaggccccaacccucgguccuccac

SEQ ID NO: 8980 - RNA, 60 nt, Human
uggcgguggagggcaucugguagaugacacgcgccuggaugccuuugaaguagccggcca

SEQ ID NO: 8981 - RNA, 79 nt, Human
uucugcucuguucuuuguuuuauguuuaacugcuguuucuaauugcagguguauuacagauacaaauaagaguacagaa

SEQ ID NO: 8982 - RNA, 61 nt, Human
caugcucaagugaaaguuguaaaaauaucauaagacaugaauuuuugugaacaggagugug

SEQ ID NO: 8983 - RNA, 63 nt, Human
uaguaaacaacuguauaaagcaccacuuauuacucagaguuaggucgcauagaguggaugcua

SEQ ID NO: 8984 - RNA, 71 nt, Human
uccgauucuucucaaagugcacuguguuaagccuaguguaagguagcauaauagaaaaguggagaauucga

SEQ ID NO: 8985 - RNA, 66 nt, Human
gcguuuggagaacaucuucuugcuccuuuuccggaaacgagauaauggacacagagucccagacgu

SEQ ID NO: 8986 - RNA, 82 nt, Human
gagcacgcuucccaagcuuggggugggcaauguaggcaagucgaucgagcuugcggcugacacccuuugggaucuugggcuu

SEQ ID NO: 8987 - RNA, 79 nt, Human; identical to SEQ ID NO: 6024

SEQ ID NO: 8988 - RNA, 79 nt, Human; identical to SEQ ID NO: 6025

SEQ ID NO: 8989 - RNA, 71 nt, Human
cagagaucagaauacgaagcuuccucucagcaucaugggaggagauaaaauaauucauucuauggucuuug

SEQ ID NO: 8990 - RNA, 86 nt, Human
gaauucugaucauaccaguuuccaucaggauuuaucagaucugaaacauccugcagauaagcugguugacaaucccacagcaguuc

SEQ ID NO: 8991 - RNA, 78 nt, Human
gacaaucccacagcaguucuuuuuuuuuuuccuuuuucuuuuuagauuuuuuuaaacagagaacaaagggauucacuc

SEQ ID NO: 8992 - RNA, 98 nt, Human
gugcuccuuuuugauauagauaaaauauuuaaugcuucuauuuacaucugcucauguagguuuuacaauauuccauguauauccaauguggaugguac

SEQ ID NO: 8993 - RNA, 69 nt, Human
uuuucccccaucccccuccaaagucuugauagccaagcguuauuuugggggguaggaaacgggugaaaa

SEQ ID NO: 8994 - RNA, 61 nt, Human
uuuuguuuugucuauaugugcggcuuuucagaagaaauuuaaucagugugacagaaaaaaa

SEQ ID NO: 8995 - RNA, 66 nt, Human
gccaaccuugaagccaguggggcaccaauccacaaacuggaugcugcgcuugguuuugaugguggc

SEQ ID NO: 8996 - RNA, 69 nt, Human
ugggaaccacgucaccacgguacaacaggcagcaagccauguauuuaccauggggagggucacauuuca

SEQ ID NO: 8997 - RNA, 63 nt, Human
gaaaacauaguguuuuuuguguuaucaacaaaaaucagcacaaucccacacaauaaugucuuc

SEQ ID NO: 8998 - RNA, 74 nt, Human
caagaggcucacugaugugcacuuggcaaugacgcuauugucaaaagaacacagaauuuauuuguagcagcuug

SEQ ID NO: 8999 - RNA, 65 nt, Human; identical to SEQ ID NO: 5312

SEQ ID NO: 9000 - RNA, 70 nt, Human; identical to SEQ ID NO: 314

SEQ ID NO: 9001 - RNA, 79 nt, Human; identical to SEQ ID NO: 1103

SEQ ID NO: 9002 - RNA, 67 nt, Human; identical to SEQ ID NO: 1862

SEQ ID NO: 9003 - RNA, 69 nt, Human
uacaggugguugcuuugaacuuuauuugagaaaaacagaagauaaauguaucaaaagaacacacaggug

SEQ ID NO: 9004 - RNA, 81 nt, Human
ccggugacacagcggcccuugacauugugcgaaacugauuuagccacauaaaauaaagggcuuuacaauguguccacacgg

SEQ ID NO: 9005 - RNA, 80 nt, Human; identical to SEQ ID NO: 788

SEQ ID NO: 9006 - RNA, 75 nt, Human
gcgaugauggacgcguguguucaacuaucacagcuucccaccugcauacucuuugaaaccaccacgacaugucgc

SEQ ID NO: 9007 - RNA, 96 nt, Human
gggggaacugguucuggggucacuccugcucauggaacgucucucagugauuauggcaagcaguccaagcggagucuccauuuaccaagcgccccc

SEQ ID NO: 9008 - RNA, 117 nt, Human
auauugguaugcuuauacacuuacacuuuaugcacaaaauguaggguuauaauaauguuaccauggacaugaucuuucuuuauaauucuacuuugagugcugucuccauguugaugu

SEQ ID NO: 9009 - RNA, 64 nt, Human
gggcauuccugaagcugacagcauucgggccgagaugucucgcuccguggccuuagcugugcuc

SEQ ID NO: 9010 - RNA, 71 nt, Human; identical to SEQ ID NO: 8959

SEQ ID NO: 9011 - RNA, 90 nt, Human; identical to SEQ ID NO: 1501

SEQ ID NO: 9012 - RNA, 80 nt, Human; identical to SEQ ID NO: 367

SEQ ID NO: 9013 - RNA, 86 nt, Human
gcuucccacuggcacccugaaaccugcccaggcugggccgccagcgucguccacaggccuuggccagcgggggcccucagggaagc

SEQ ID NO: 9014 - RNA, 71 nt, Human
gcuuguugaucucucugugucguucuuugguuacgauuuccucuaggaccucgccaucucccuuaauaagc

SEQ ID NO: 9015 - RNA, 68 nt, Human
cagagaugguuucaucgacaaggaagauuugcaugauaugcuugcuucauuggggaagaauccaacug

SEQ ID NO: 9016 - RNA, 66 nt, Human; identical to SEQ ID NO: 5320

SEQ ID NO: 9017 - RNA, 64 nt, Human; identical to SEQ ID NO: 7119

SEQ ID NO: 9018 - RNA, 71 nt, Human; identical to SEQ ID NO: 3322

SEQ ID NO: 9019 - RNA, 77 nt, Human; identical to SEQ ID NO: 3323

SEQ ID NO: 9020 - RNA, 77 nt, Human
gauauucugguuauucauuaugcagaagguauagggguuaguccuugcuauauuaugcuugguuauaauuuuucauc

SEQ ID NO: 9021 - RNA, 84 nt, Human
gcgccagguuucaauuucuaucgccuauacuuuauuggguaaaugguuccgguaagguugucagguaguaagguggacgugggu

SEQ ID NO: 9022 - RNA, 62 nt, Human
gcuagguuuagccuacuauggguguuaaauuuuuuacucucucuacaagguuuuuuccuagu

SEQ ID NO: 9023 - RNA, 60 nt, Human
caaaugccagugguuuaauucaguggaguucaaaccucauuccuauaucauugcagugug

SEQ ID NO: 9024 - RNA, 86 nt, Human
gggguguaugguaagcaaaauaaauuguauuuuuccauccuuggggaggauaaaggaacucuuugcacugcuauaauaaacagccc

SEQ ID NO: 9025 - RNA, 81 nt, Human
ggugauucauggacccagccuccuucugccuugcggcuuugccuuuuaaagguccucagggugcucuccauguaucuugcc

SEQ ID NO: 9026 - RNA, 88 nt, Human
gaguuuguuaucuggggucgugugauaaacucuuguggaauaaacacguuuacaguuuauuauuuuacuccucccauguuacauccuc

SEQ ID NO: 9027 - RNA, 83 nt, Human
cugcggccgggcggcucggcggggccagcagcaggagcaguaagcucagcgccccgcgcggcccugcaagggaagcgccgcag

SEQ ID NO: 9028 - RNA, 83 nt, Human
gcacgcucggggcggccggccagccaggcgcgcagcggcacaaggcggcagucgcagcgccagggguuggcgcccaggugugc

SEQ ID NO: 9029 - RNA, 72 nt, Human
guucuucaauuuugugcccuucucuagugccagccauugugguaggcccugaagaacacccucauggagagc

SEQ ID NO: 9030 - RNA, 95 nt, Human
uuuagcaguacaaaaucuuugacuaugaccaugggacacagacaugaguuuauguuuugguuuguuguggucuggggaucauguacuuuucuaaa

SEQ ID NO: 9031 - RNA, 104 nt, Human
uugagacagaguuuugcucuuguugcccaggcugaaaugcaguggcgugaucucggcucacugcaaccucugccuccuggguucaagcgauucuucugccucag

SEQ ID NO: 9032 - RNA, 71 nt, Human
acaugagggugcacaugucaaguacuuagcuaaaaucaacaaagugaggacugugaagauaacuuucaugu

SEQ ID NO: 9033 - RNA, 76 nt, Human
ggagcuauuaaauuuugauguugccucaguuauuuucauuaauaacuuuugcuaaaauuuaccuuuuaaaaguucu

SEQ ID NO: 9034 - RNA, 89 nt, Human
ccuccgugcagucccggguagagagcccggucccugcgcuagucgauuugugcaguaggaaaggaggcugcaggggaucugcgccgggg

SEQ ID NO: 9035 - RNA, 89 nt, Human
ugcuuccucuugagugcaacggaaagggcuaucagauaucugcacguuugugcaauuuauagcuccuccauuacacuucuucauaagca

SEQ ID NO: 9036 - RNA, 80 nt, Human
cccgacaggccucccggcucucccgcccucccucccgagacacgagccgaacugggcgucaggucggggagccggucggg

SEQ ID NO: 9037 - RNA, 82 nt, Human
ccgccgccgccgccgcccccugcagccacucucccgccucuaccgccgcgggagcugcaucguccacuccggucggcggugg

SEQ ID NO: 9038 - RNA, 91 nt, Human
cgcggagccucauggggguuggaguccccaagguuuccuuugugcgcaguauuggcggggccuuggacuaccacucccacaaggcaccgcg

SEQ ID NO: 9039 - RNA, 84 nt, Human
agaaaagcuagauuuuucguauacuuugaaauaaugugucacaacagauuguaugcagaaauagauaugaaaauccugcugucu

SEQ ID NO: 9040 - RNA, 65 nt, Human
gcuauguuagagauuugcauauguaaaacauugccauucuucuacuaaauguuucuuguuauggc

SEQ ID NO: 9041 - RNA, 79 nt, Human
gggaggggcggggggccuggccccagggcgguggugcgggaugccgccgccuccgggccgcguccguucuccaccuucc

SEQ ID NO: 9042 - RNA, 104 nt, Human
uuugauacuggugaugacugcacaaccaauauugaaaaccauugacuaguaacuacacuuuuaaugagugaauuuuaugguaugugaguuuuaucucaaucaaa

SEQ ID NO: 9043 - RNA, 66 nt, Human
cuuuaaggacagacaaaaauaaggacgacuauuuaaaguuucagauauuggucuguuucacuaaag

SEQ ID NO: 9044 - RNA, 70 nt, Human
gcaugugcaucuguggugaagaaaugaggaauuaguuaugccugcugcuaguugacuacaguaaauaugc

SEQ ID NO: 9045 - RNA, 63 nt, Human; identical to SEQ ID NO: 386

SEQ ID NO: 9046 - RNA, 61 nt, Human; identical to SEQ ID NO: 387

SEQ ID NO: 9047 - RNA, 67 nt, Human
gagcauggaacguucugccauuuguuuguguccucuuuuauuucguugagcagugguuucguaguuc

SEQ ID NO: 9048 - RNA, 69 nt, Human
gaggcagagguugcacugagcugagaucgugccacugcacuccagcuugggcaacagcgacucugucuc

SEQ ID NO: 9049 - RNA, 65 nt, Human
gggcgggcacaucacuugaggccaggaguucaagaccagccuggccaacauagugaaacccgucu

SEQ ID NO: 9050 - RNA, 74 nt, Human; identical to SEQ ID NO: 365

SEQ ID NO: 9051 - RNA, 102 nt, Human; identical to SEQ ID NO: 2172

SEQ ID NO: 9052 - RNA, 77 nt, Human; identical to SEQ ID NO: 3082

SEQ ID NO: 9053 - RNA, 74 nt, Human
aucauuuuuaaacuuuguuuauuuguagauuaaaauguaaugcauuacaauuuuaacaaucacuuaaaaaugau

SEQ ID NO: 9054 - RNA, 65 nt, Human
ccgcucaccuauagccaauauaagcagucaccauccaggugcugcuggacaggcucguguagcgg

SEQ ID NO: 9055 - RNA, 73 nt, Human
ggccgugcagcagugcauugaggcugcaggacaugagcaccagccagacaugcagaagagucugcucagggcc

SEQ ID NO: 9056 - RNA, 87 nt, Human
uccuggacagauuuccacccgacagcuucgugcacaugugucaggaccugcgugugcucaaugcuguucgggacuaucacaucggga

SEQ ID NO: 9057 - RNA, 63 nt, Human
auuucacagucuuggcccuucacauccugcccccugagcaguggagagccacacgugugaaau

SEQ ID NO: 9058 - RNA, 67 nt, Human
ggaagcuugccgacaaagcccugaaaaaccuuccaggaggaguuucauugccagugggagaccuucu

SEQ ID NO: 9059 - RNA, 66 nt, Human; identical to SEQ ID NO: 12

SEQ ID NO: 9060 - RNA, 72 nt, Human
ucuucaagggcaccuuuugcccagcuugagugaacugcacuguugacaagcugcaugugggauccuugagga

SEQ ID NO: 9061 - RNA, 74 nt, Human
augggccagaaggacuccuacgugggcgacgaggcccagagcaagcguggcauccugacccugaaguaccccau

SEQ ID NO: 9062 - RNA, 71 nt, Human
cuucacccacguaauguauguccugcaagcugucccacaguuguggggcacgucucgguugucgggugaag

SEQ ID NO: 9063 - RNA, 75 nt, Human
cugacgaagccauugaaacagaugaucugaccauuaagcuggugaucaaggcacuccuggaagugguucagucag

SEQ ID NO: 9064 - RNA, 80 nt, Human
gaaaaagaagaaaacgaaaagaagaaacaaaagaaagcaucaugaugaauaaaaugucuuugcuuguaauuuuuaaauuc

SEQ ID NO: 9065 - RNA, 92 nt, Human
gacuuugauggcacuccuaggcucuaucagacugaccccucgggcacauaccaugccuggaaggccaaugccauaggccggggugccaaguc

SEQ ID NO: 9066 - RNA, 84 nt, Human
aaaagaaaaccaaagugguccacaaaacauucuccuuuccuucugaagguuuuacgaugcauuguuaucauugaccagucuuuu

SEQ ID NO: 9067 - RNA, 72 nt, Human
guacaguacuuugaauuuuagcacauugcauaguaguuuuaaguaugucuaauuuaaacguauaauauguac

SEQ ID NO: 9068 - RNA, 84 nt, Human; identical to SEQ ID NO: 286

SEQ ID NO: 9069 - RNA, 71 nt, Human
cagaagccguucuucacuugccuucugcagcuccacuugagcuuccugaaugccuuuccgaaccacuucug

SEQ ID NO: 9070 - RNA, 64 nt, Human
cugcuuggugcgagugcccgagggcguuggaggcagcgugacuccugcaccuugugcuuuguag

SEQ ID NO: 9071 - RNA, 129 nt, Human
cguauaacugaaaguuggggaagaccaccaggucaguggaguggagagguuuuguauauggucuucuuugaagaaacuuacuucuugcaagcccuggcaucuuccaauuggcuguccuaguaguggacg

SEQ ID NO: 9072 - RNA, 61 nt, Human
ggaccagacuguacuguggccauguacacaaaggcaugcaccacaucccagcucugcugcc

SEQ ID NO: 9073 - RNA, 68 nt, Human
agccucccaccacgcucacugccuggcuugaaaaaguuaagaagccccucaggaagagaaucgaggcu

SEQ ID NO: 9074 - RNA, 86 nt, Human
uucaggccacccugcucauggcccuuccuggccgccugccacaccgcaagcucgcuggggggacacuagaagcaccguggccuggg

SEQ ID NO: 9075 - RNA, 90 nt, Human
uagcugggauuacaggugugugccaccacgcucggcuacuuuuuguauuuuuuuuaguagagaugggguuucaccauguuguccaggcug

SEQ ID NO: 9076 - RNA, 61 nt, Human
uggucucaagugauccacccaccuuggccucccaaagugccgggauuacagacaugagcca

SEQ ID NO: 9077 - RNA, 103 nt, Human
uugaggcagagucucacucugucacccaggcuggagcgcagugacaugaucucugcucacugcaaccuccaccuccuggguucaagagauucucgugccucag

SEQ ID NO: 9078 - RNA, 70 nt, Human
gauaucuaacagcaauaccugaucacuacuucgcacuaguuucucgguacuaugcauaugguccaauauc

SEQ ID NO: 9079 - RNA, 72 nt, Human
gggaaugauagcauugaaggacucggggauaucuaacagcaauaccugaucacuacuucgcacuaguuucuc

SEQ ID NO: 9080 - RNA, 75 nt, Human; identical to SEQ ID NO: 5382

SEQ ID NO: 9081 - RNA, 60 nt, Human
ccucauucgccauuaucagauccacacagaagugaaacaguaugaaugcaaagaaugugg

SEQ ID NO: 9082 - RNA, 68 nt, Human
cuggggagaggccuuacguaugcaaugagugugggaagcgcuucagccagacgucaaacuucacccag

SEQ ID NO: 9083 - RNA, 102 nt, Human
ugggaaagcuuucuuucugaguucauaccuuauucgacaccagaaaauccacacuggagagagaguguaugaauguaaggaaugugggaaagcguuucucca

SEQ ID NO: 9084 - RNA, 88 nt, Human
agggaauagaucuguucugaguguccccaaaaaaguuguccuaggaacugauguggagaaguuacagggagacugauuuccauuccuu

SEQ ID NO: 9085 - RNA, 72 nt, Human
gaaucugaguuuuuaaucaguaaagucugauguuuugauaacuugauguuuugaugguagacucuugaguuc

SEQ ID NO: 9086 - RNA, 72 nt, Human
ggaugaagccucugugggaucuuugggcuuggggcugaauuucucaggcauaaauaccuaauggccuugucu

SEQ ID NO: 9087 - RNA, 61 nt, Human
ggucgcugguggauugugggguccgccuggaguggggccccgaugaucgacaacagucacc

SEQ ID NO: 9088 - RNA, 72 nt, Human
cuucuucuuugccagggagcucagagccaaguuauacuaaugauuaagggaccuaagacaggcaggaggggg

SEQ ID NO: 9089 - RNA, 69 nt, Human
ggaaugagaauaccugaaaccaaaccguuaacaaggaaugguagugaaguuaaggaguuagcucauucu

SEQ ID NO: 9090 - RNA, 90 nt, Human
gaaaggucgaagauaugaggcggugaaguggauggugguguuugccauuggagucugcacuggccuggugggucucuuuguggacuuuuu

SEQ ID NO: 9091 - RNA, 72 nt, Human
ggggugcagggggucucugugcugcugcugcagguggugcugcugcugcggugagcgugagacccgcacccc

SEQ ID NO: 9092 - RNA, 86 nt, Human
cuauguaugagagaauaaaguauuuuggaaaaacaaacggauaauucuuuaaauccagaacuacuuuuuaucuucugauaucauag

SEQ ID NO: 9093 - RNA, 79 nt, Human
gcagugaaucuuugcuggucauagaaagaagugagaugccuuuucacauaaaguuauuacuaguaucgguuaccacugc

SEQ ID NO: 9094 - RNA, 79 nt, Human
gcauaaguugacguggacauuugucagguuuucaugaacuucucaaagauaucauacauuaauccaucuuagcaaaugc

SEQ ID NO: 9095 - RNA, 82 nt, Human
aagaguaguuuggacccacaauauugcauuacugauuuauucacuaccuuagcagcauguaguauacagacauucugcucuu

SEQ ID NO: 9096 - RNA, 83 nt, Human
uaauguucauaacuggugauucauuacacuggauguacaaacccucuugcaugaauuaauguuuuucccuguuuugaauauua

SEQ ID NO: 9097 - RNA, 82 nt, Human
uuccuuuuugaguuguuuuguuuuuauuuuuaaaugaaguuuccaucuguacacguuaagaaaauaaacaaaacaacaggaa

SEQ ID NO: 9098 - RNA, 81 nt, Human
gcauguuuaauuguccaggauuugcagauguaaacaugaaaaugaaucuuucauuugguagaccgacaaacuguaacaugc

SEQ ID NO: 9099 - RNA, 61 nt, Human
gguggacuuguggguaggcaugugcagacacacaugugagaacauuccugcaaagucuccc

SEQ ID NO: 9100 - RNA, 71 nt, Human; identical to SEQ ID NO: 4802

SEQ ID NO: 9101 - RNA, 104 nt, Human; identical to SEQ ID NO: 4803

SEQ ID NO: 9102 - RNA, 80 nt, Human
aaaauucccacuuaauugaauacuuagaaaaaaauggccaguggccgauugaaagguauauuaaaauuaagggcaguuuu

SEQ ID NO: 9103 - RNA, 130 nt, Human; identical to SEQ ID NO: 3361

SEQ ID NO: 9104 - RNA, 103 nt, Human
gaagcuucaugcacuuaaagaaguauuuuuagaauaagaauuugcauacuuaccuagugaaacuuuucuagaauuauuuuucacucuaagucauguauguuuc

SEQ ID NO: 9105 - RNA, 87 nt, Human
gugcaguuaugaauuguuaacauguuaauacacaguugcuuuauuucagauguguuugucuugacucacuaacaguuccuucugcau

SEQ ID NO: 9106 - RNA, 91 nt, Human
cuugaacuucagaaaguaucagguaaucagcagauuguaggacagccucagauugcuauuacuggacaugaucaggggcuguuaguucaag

SEQ ID NO: 9107 - RNA, 82 nt, Human
gacacucuugaugaccugauagcagcugugaguaccagagugcccacugguuccaacaguucuucucagaccacagaguguc

SEQ ID NO: 9108 - RNA, 72 nt, Human; identical to SEQ ID NO: 3359

SEQ ID NO: 9109 - RNA, 73 nt, Human
gcaguucagagaaggcugcagucagcuaccuugaccuaggggcugaagccuuaacuucccacucugauucugc

SEQ ID NO: 9110 - RNA, 88 nt, Human
gggggcugcagaacuggaauucuggucuaggacaagacaagugccagccagcguucucuaucuuuauccggaauccucugcucacccu

SEQ ID NO: 9111 - RNA, 79 nt, Human
gcccugagcaggaagaugugccacuuccuagcaggcgcaaggccugugcggaagaaacgccgcucccugccaccagggc

SEQ ID NO: 9112 - RNA, 75 nt, Human
ccuggacuuguuguugcagcugaggcacagcaaugacuuggggcuguggcugcuguauuuguagcugaggacggg

SEQ ID NO: 9113 - RNA, 66 nt, Human
gggaugaaacaguaacuugauuuaaaguuuguccugaugaaagaguuugaguugaagacuguaccu

SEQ ID NO: 9114 - RNA, 91 nt, Human
gcuuuacuccagccuccuuguggaaacccagcucuccugucucccagugaagacuuggaugggcagccaucagggaaggcugggucccagc

SEQ ID NO: 9115 - RNA, 80 nt, Human
ggugaccaacuuauacucaacuugaauaaacaucagcucugaucggauccagcugaugaacucugggauaggcugguucc

SEQ ID NO: 9116 - RNA, 64 nt, Human
gugaagggcuugggauucguggcagcugaguccucacugaccaaggauugcccuugugcuuuac

SEQ ID NO: 9117 - RNA, 97 nt, Human
uggugacugauuccaaaucuaccagcuaacacauccaccaccacugcgggcaggcaagugacuagaaggcaaguuguggacuuggccucagggacca

SEQ ID NO: 9118 - RNA, 71 nt, Human
ccccucauuaggaugcaucacuggccucgugcaccggcuucaccagcacugcacccuaaucaaaacagggg

SEQ ID NO: 9119 - RNA, 62 nt, Human
acugaggcugcccgcugugcuaacuaaaggcacacggcauguucucucuuugcagcuuuugu

SEQ ID NO: 9120 - RNA, 64 nt, Human; identical to SEQ ID NO: 8200

SEQ ID NO: 9121 - RNA, 66 nt, Human; identical to SEQ ID NO: 2189

SEQ ID NO: 9122 - RNA, 73 nt, Human
uaauugcaauggaguugacguuucccuccuuuuugguuuuaggaggggaauuauuugaaucgugguguaauug

SEQ ID NO: 9123 - RNA, 60 nt, Human
cgccuucucugucccccagaacagaacaaacucuuguucucugugguuggggaaaaggug

SEQ ID NO: 9124 - RNA, 97 nt, Human
aaucauauuuuagaaucaggaacgaagauucagggaaugucugucacauuuuauggcaucccaccuggacagaauauccgauuugaagauugugauu

SEQ ID NO: 9125 - RNA, 65 nt, Human
gcaagaggacaacagucuaucacucuuaaacaauaaacaggguaagacugaaaaaaaccucgugc

SEQ ID NO: 9126 - RNA, 73 nt, Human
uuggcuugcagccgcaucacuucugucucugauccaucuucacauggcauuuucucugugucucugcauccaa

SEQ ID NO: 9127 - RNA, 60 nt, Human
acuguccucauggagcuuacagacuaauuacauaaaguaagagcuaaaacugaugacagu

SEQ ID NO: 9128 - RNA, 65 nt, Human
aguguaccccuauaacccuuuggcuuuuuucagagaaagacuucagccaaauugucccuuucacu

SEQ ID NO: 9129 - RNA, 75 nt, Human
uguaugcauuuccucugguuuuauuauucaaauuaagaaaauacuuaaaaauuuuuugguaacagcuugcaugca

SEQ ID NO: 9130 - RNA, 110 nt, Human
uuuuuuuuuuuuuuuuaauaagaauuacaaagacaaugacauccucagcucccucucaccccaaguaugccauugucuuuguaauucuuauuaaaauacuaaagcaaaaa

SEQ ID NO: 9131 - RNA, 97 nt, Human
uggcaacuuagagguggggagcagagaauucucuuauccaacaucaacaucuuggucagauuugaacucuucaaucucuugcacucaaagcuuguua

SEQ ID NO: 9132 - RNA, 94 nt, Human
uguaagcagcaucauggagguuugaagaugccgcauugggaugggaugaauuccaaauucugcuugcuggcuuuuuaauauugauaugcuuaua

SEQ ID NO: 9133 - RNA, 66 nt, Human
gagcccagaagugcugaggugacgaggaagcccaaggcugcuguuccuucugugaacaagaggccc

SEQ ID NO: 9134 - RNA, 75 nt, Human; identical to SEQ ID NO: 448

SEQ ID NO: 9135 - RNA, 110 nt, Human
ggcaggguguacaccuguggcucucggggcugcccuuuggcuuuggagaugguuuucucgauggaggacgggaggccuuuguuggagaccuugcacuuguacuccuugcc

SEQ ID NO: 9136 - RNA, 96 nt, Human
agggagcugggggguggcugagggcucaggcugcuugggguggaccucucucugggccgccaggcuuucagcuccaucccugcccuccaguuuccu

SEQ ID NO: 9137 - RNA, 66 nt, Human; identical to SEQ ID NO: 12

SEQ ID NO: 9138 - RNA, 70 nt, Human
gaggguaucuaggccaauuuauucagcuggaaaucaaucuguccagggcuggaccaggcgccucccccuc

SEQ ID NO: 9139 - RNA, 83 nt, Human
gcccagggcucggcgggcuggucagguggcggcagcagcaaggcugcgcucccggccagcaggaugugccauaugcugugggu

SEQ ID NO: 9140 - RNA, 63 nt, Human
aucuguguaacuagaacacuugacuaaaauuauauaauuuuuacaacgcuucacugcauagau

SEQ ID NO: 9141 - RNA, 75 nt, Human
augaacauaauuuauuuguaauuggaacaaagccccaaaguagcaguuuuguucuaccagguaauuaaugcucau

SEQ ID NO: 9142 - RNA, 81 nt, Human
guucguagguuauaaauucuguuaguugcuaagaagcauuuuuaaaauuauguacuauagcucuuuauucagcagacgaac

SEQ ID NO: 9143 - RNA, 64 nt, Human
cggaccgcgcucucgauuucugccgcgucccgccucuaggacgcggaguccgugugcgguuccg

SEQ ID NO: 9144 - RNA, 91 nt, Human
ggggaugaaugaaggugcuggguugcaggguugaaaaagucucccgcuuuuccguuccuacagucccgguucugccuuuguguggugcccc

SEQ ID NO: 9145 - RNA, 88 nt, Human
gcuggcuuuuacagggaggugucugggauuccucauuagcaaucaaaacuuaauuacugggaugcagaguccuuacuuuaucgccagc

SEQ ID NO: 9146 - RNA, 60 nt, Human
uaggcauuucugaagugcacuuuuuugaaacaucauuuugcuaacucucagcagugucua

SEQ ID NO: 9147 - RNA, 67 nt, Human
ucagaaugccuuggucauaguguuguugcaaaauugaccauacagguggcccauguauaaaaucuga

SEQ ID NO: 9148 - RNA, 79 nt, Human
gcgcaucgucgagggcauccucaagcggccuccugacgagcagcggcuguacaaggaugaccaacucuuggaugauggc

SEQ ID NO: 9149 - RNA, 63 nt, Human
gggcuggccuuccgggcagaugacaccuuugaggcccugugcaucgagcccguuuuccagccc

SEQ ID NO: 9150 - RNA, 88 nt, Human
ccuggggagaagcuucugcugggcagcucgugcaauuguugccauuugaaaacccuugcuugauguucaguguuuauuauccuccagg

SEQ ID NO: 9151 - RNA, 78 nt, Human
ggagcccuugauguccugcaaaugaaggaggaggauguccuuaaguuccuugcagcaggaacccacuuagguggcacc

SEQ ID NO: 9152 - RNA, 66 nt, Human
gagcuuucaaggauaggcuuuauucugcaagcaauacaaauaauaaaucuauucugcugagagauc

SEQ ID NO: 9153 - RNA, 88 nt, Human
agcuucugaaagccucaaacaucugugagugugcuaagagccgauccuuagguauuuuauacacucuaugcugagucaguuaggaguu

SEQ ID NO: 9154 - RNA, 83 nt, Human
cugaaccuugagauccuuucacuagaauacacagggaaaagagaaaaagcuugcccuugugaaaggugaguuucauuguuuag

SEQ ID NO: 9155 - RNA, 67 nt, Human
uaccccugcagauccguagguauuaaggaugaccuuaggaagucucacacuguagccacaaagggug

SEQ ID NO: 9156 - RNA, 83 nt, Human
aggaccucaaagagggagucacagccugggcucggggagcucccaggucugggcucccugaguggcugcaucucuucucuccu

SEQ ID NO: 9157 - RNA, 88 nt, Human
caccucguucugcucaccuggccuggcaggcugugcuugguucacacuaccagccuggaucccacaccugccacgggugaaccaggug

SEQ ID NO: 9158 - RNA, 109 nt, Human
gccacugcacacagucaggcaugcaggcugcugcaguggggcgggcagcuccaggugcuggaacagacacuggcucucugugaggcuguggcuugaccaugugcauggc

SEQ ID NO: 9159 - RNA, 96 nt, Human
gcggcaggcggccuccccgaagggccagcgcuggccacgcaggugguaggcgauccgcgggggcagcgccagggccagcaggaggucagcagccgc

SEQ ID NO: 9160 - RNA, 75 nt, Human; identical to SEQ ID NO: 1111

SEQ ID NO: 9161 - RNA, 80 nt, Human; identical to SEQ ID NO: 367

SEQ ID NO: 9162 - RNA, 72 nt, Human
ugcagaagucucccugggaguaauuuuggugaagucagcuuuugccuuuuucaucacaggcaggcuuuagua

SEQ ID NO: 9163 - RNA, 111 nt, Human
agaaguucccccuacccuugcugcauuuacuuuugcuuuaaagagagagaauucuucacuauaaaucuuuuuuuaauaaaaaaucccccagcagccaggaacggggcuucu

SEQ ID NO: 9164 - RNA, 62 nt, Human
agcugaaucucaggguaagacuccccauaaaugugcagaaaaucugcccugaaauuccaguu

SEQ ID NO: 9165 - RNA, 90 nt, Human
uuuuuucacugggacaguugcuuuuauuaucuucauuuacaaaugaaacuguggaacagaaaguaauauggccaauuauuaguggagaaa

SEQ ID NO: 9166 - RNA, 64 nt, Human
gcacccuugaaaaaagcuuugccuccuucaucacgagcaaucuuccgccagcagucaagcgugc

SEQ ID NO: 9167 - RNA, 68 nt, Human
gauggcuuauuuguuuuguauucaaugauuggcuuuccccauucauuugucuuuuuagagcagccauc

SEQ ID NO: 9168 - RNA, 61 nt, Human
acaaugucauuguaaacuucuugaggggcauccauugcccagauaaaguccaagugauugu

SEQ ID NO: 9169 - RNA, 64 nt, Human; identical to SEQ ID NO: 3180

SEQ ID NO: 9170 - RNA, 82 nt, Human
uauagcguaaugcuguguuuauuaagccagggauugugggacuucccccaggcaacuaaaccugcaggaugaaaaugcuaua

SEQ ID NO: 9171 - RNA, 74 nt, Human; identical to SEQ ID NO: 5229

SEQ ID NO: 9172 - RNA, 61 nt, Human; identical to SEQ ID NO: 8603

SEQ ID NO: 9173 - RNA, 67 nt, Human; identical to SEQ ID NO: 7074

SEQ ID NO: 9174 - RNA, 62 nt, Human; identical to SEQ ID NO: 7075

SEQ ID NO: 9175 - RNA, 80 nt, Human; identical to SEQ ID NO: 7076

SEQ ID NO: 9176 - RNA, 91 nt, Human
ggccgacgggcugcaaaagauggugccccugcucaacaagaacaaccccaaguuccuggccaucaccaccgacugccugcagcuccuggcc

SEQ ID NO: 9177 - RNA, 77 nt, Human
gcuauaaauccagaacgggaaguguccagcaagccuacucugacuucugacuuguuuuuguuuucuggauuuuuagc

SEQ ID NO: 9178 - RNA, 60 nt, Human
uuauuguuuccccuucuaaagcucaagaucauuucuuuccaguuuuuggggaaauggugg

SEQ ID NO: 9179 - RNA, 67 nt, Human; identical to SEQ ID NO: 1347

SEQ ID NO: 9180 - RNA, 125 nt, Human
cucuggccugggguugcucccugcccggcaggcugcuguuuggcagcuggagguggcaagagcugcuggugcugccagggcguguugggcaggaaugaucucccagggcagcccugaggaaaggg

SEQ ID NO: 9181 - RNA, 70 nt, Human; identical to SEQ ID NO: 4167

SEQ ID NO: 9182 - RNA, 64 nt, Human
cauuaaacugaaagcaccauggcauaaagucuaguaacauuauccucaaaagcuuuuuccaaug

SEQ ID NO: 9183 - RNA, 63 nt, Human
ugucccucuguucaacaauacaguccuuuuuaauuauuugagaguuuaucugacagagacaca

SEQ ID NO: 9184 - RNA, 67 nt, Human
gacggacaacccaucgugugaacuauagaguuugugaacaaauuuauauuggguucauaguggcguc

SEQ ID NO: 9185 - RNA, 87 nt, Human
uccugcgaguuccccuaaguucuuagaggacugcuuugccuuuugaucugagaguugcaaaguucccuaaagaauggcccuugugga

SEQ ID NO: 9186 - RNA, 97 nt, Human; identical to SEQ ID NO: 6471

SEQ ID NO: 9187 - RNA, 71 nt, Human
cccugccuagcacuucucuucuggccauggacuaaguacaguggcacuguuugaggaccaguguuccgggg

SEQ ID NO: 9188 - RNA, 80 nt, Human
guaaaaacaagugaacuuugcaugaggaaagaggcuccaugucucacagccagcuaugcccacauugcacuugcuuuugc

SEQ ID NO: 9189 - RNA, 61 nt, Human
cugggcaggccugggggcuguguggggaguggcauccaugugggccucugguccugcccag

SEQ ID NO: 9190 - RNA, 72 nt, Human
ggcugaggcagggggaucaugaggucaggagaucgagaccauccuggcuaacacugaaaccccgucucuacc

SEQ ID NO: 9191 - RNA, 80 nt, Human
ugugccacugcacuccagccugggcaacagagugagacccugucucuaaaauaaauaaauaggccgggcgcgguggcuca

SEQ ID NO: 9192 - RNA, 67 nt, Human
ugcuccugcugcagggccucggcgugcugccuguucucgcugugccacaucugcagcucauucugca

SEQ ID NO: 9193 - RNA, 96 nt, Human
ugcuguaacuccaucuuaacaaguaaccccaaauuauacccaccugaaagaccuuuguggguuguggaaaaccuggaagauggcugagagacagua

SEQ ID NO: 9194 - RNA, 64 nt, Human; identical to SEQ ID NO: 7119

SEQ ID NO: 9195 - RNA, 71 nt, Human; identical to SEQ ID NO: 3322

SEQ ID NO: 9196 - RNA, 77 nt, Human; identical to SEQ ID NO: 3323

SEQ ID NO: 9197 - RNA, 65 nt, Human
ccaaaacuguagaaagagauaaagcuguuaauagagacauggguaucccuuuuuaucaggucagg

SEQ ID NO: 9198 - RNA, 107 nt, Human
gaguuucaagaaaaaaauuaaaggccaaaacugucuuacauuaccauugcuguuucugcaaucuucaacaaaccaaaauuuucucuguaauugugaaaaaagaacuc

SEQ ID NO: 9199 - RNA, 83 nt, Human
guaacugaauaguggaacucagaaagacauccuauucagaaggaucucucaugauaauaguuuccuucacuauuguaguauac

SEQ ID NO: 9200 - RNA, 67 nt, Human; identical to SEQ ID NO: 1862

SEQ ID NO: 9201 - RNA, 73 nt, Human
aaggguccauucaacauauagcagcuuauaucuaaauauguacagguauguauguuuucacaguuagaucuuu

SEQ ID NO: 9202 - RNA, 69 nt, Human
gagacaggguuucaucauguuggcgcaggcuagucucaaacugcugaccucaggugauuugcccgccuc

SEQ ID NO: 9203 - RNA, 66 nt, Human
ucagugucccagaauuuaaaauuuccuugcacuuuacagcaaagauacauauuguggcucuacuga

SEQ ID NO: 9204 - RNA, 86 nt, Human
cugucuuugcccggggaagguauccuccgaugacgagcuguccgacaguacccggaugaaguugucggaguccccaucggaggcag

SEQ ID NO: 9205 - RNA, 73 nt, Human; identical to SEQ ID NO: 4293

SEQ ID NO: 9206 - RNA, 70 nt, Human
ggcucccaauguugacguuggccagggcauuugcaaacaagccaggccaaaaaggcucaacauuuacacc

SEQ ID NO: 9207 - RNA, 101 nt, Human
aguuccugagcgacagguggaugcugcagaagggcuuucugaaggaggaggaccucacggagaagaagcccugguguguggcaccuccguguucaggagcu

SEQ ID NO: 9208 - RNA, 62 nt, Human
aaaucacauuucuuuuuaucauguaaacuuguaccaaagacuuaugaauagauuuaugaauu

SEQ ID NO: 9209 - RNA, 66 nt, Human; identical to SEQ ID NO: 915

SEQ ID NO: 9210 - RNA, 85 nt, Human
uuuuuuuuuuuuuguacuagaugcuauuuauuaaacuguagacaggagauaaauacuuuauuucaaaagugcaaagaagggaaga

SEQ ID NO: 9211 - RNA, 60 nt, Human
augcauguauccuuacccccaugggaaaauguugguguguucucaaggguaugcaugugu

SEQ ID NO: 9212 - RNA, 77 nt, Human
uuuucugugaaccaugcacgugcuggcacuggccucaggagacagugcccugccuuggcugucagguccacggagaa

SEQ ID NO: 9213 - RNA, 71 nt, Human
cuaccugaggcgucuccagaacagcucagcgccccaaggagcuggaauucgagguaggccggccucggugg

SEQ ID NO: 9214 - RNA, 65 nt, Human
uuggaggggagcguggggagggcgagugcugguaaaucucugcaccucacccugaucuccuccaa

SEQ ID NO: 9215 - RNA, 62 nt, Human
agcagcaggcgggcgccaugcuucucuugcacacgagcagaacucucugcccgcaucaugcu

SEQ ID NO: 9216 - RNA, 89 nt, Human
cagaucaaugccuggggguacagggcaggggacaguagauauguccccugauaaugcaucaccuucccuaaacaucccaacauggucug

SEQ ID NO: 9217 - RNA, 87 nt, Human
ggcugcaucaaaggcugccaggaagccccgugccacuccagugcccaggguaccagaagggcuccaccaggcagucccccaccaguc

SEQ ID NO: 9218 - RNA, 72 nt, Human
cgggggcaauggcaucgugggagcgcagguagucaaggacgaggauugugugcugcuuuagauuuggcccug

SEQ ID NO: 9219 - RNA, 66 nt, Human
gacugaacuggccucuguguucuaaugguugagccucagaguacauauuuggggugcgguuugguu

SEQ ID NO: 9220 - RNA, 92 nt, Human
guucugcacauguguauguucugccauuuccaggacgaaaaggagguugugcuaaagggaaaggaggaucgaugcacauguaugccaagaac

SEQ ID NO: 9221 - RNA, 63 nt, Human
gaugaaaaaauuuagacuguaaccgcacaccauauguaaucccagcuuuucuaauuuuacaac

SEQ ID NO: 9222 - RNA, 81 nt, Human
gggaguacgugaggaaaggauuccacucaaguauaaucagcaauacucuauugaaugaaaccauaacuccacuucacuccc

SEQ ID NO: 9223 - RNA, 61 nt, Human
uccuguagcaucaguagaacuauuuuugaaaauauuacaaacaugcuuaugaugcauagga

SEQ ID NO: 9224 - RNA, 77 nt, Human
aauacauaagauuauuccaugauuaaaagcccaaaucuaauaaccuuaagcuacauuaguggaucucuuuucauauu

SEQ ID NO: 9225 - RNA, 74 nt, Human; identical to SEQ ID NO: 1525

SEQ ID NO: 9226 - RNA, 66 nt, Human; identical to SEQ ID NO: 1526

SEQ ID NO: 9227 - RNA, 68 nt, Human
ggucugaaaccuccuccacccuacagaaaauaugauuggaucucgggacuugaggauuuucuuauacc

SEQ ID NO: 9228 - RNA, 85 nt, Human
cagaaaaauaaaugucuaucaguacuuucuguuugaaaaagaagcccauuugagacccagaaggaagacugaggcacagauucug

SEQ ID NO: 9229 - RNA, 63 nt, Human
gacuugcuuauuucacuugauguuauguuucugaguuacuaauauuggguauagauguaaguc

SEQ ID NO: 9230 - RNA, 83 nt, Human
acucugaagaugaucagacagggcaagcgaaauuggucauucucgcuaacacugcccagcuuugaggagaucugaaauagagu

SEQ ID NO: 9231 - RNA, 63 nt, Human
uaugcuauguuggcuaaacuggugucaucacuacaguggcauaauauugacuggcacagcaug

SEQ ID NO: 9232 - RNA, 100 nt, Human; identical to SEQ ID NO: 3028

SEQ ID NO: 9233 - RNA, 64 nt, Human
ugugaaugggaagugguuaaagccugaacacagaaauucagugccuugccaggaucccaucaca

SEQ ID NO: 9234 - RNA, 100 nt, Human
guccaugaguggagacccgucagagcccaggagccggaaagcagccuugcucccaggcaacgucugcuucucgggguccucggucagcuucauucguggc

SEQ ID NO: 9235 - RNA, 65 nt, Human; identical to SEQ ID NO: 476

SEQ ID NO: 9236 - RNA, 69 nt, Human
uggcugaugggcaagggggcaaagucaggacaucuuuggugcaaagacucccccugacccaccaggcca

SEQ ID NO: 9237 - RNA, 62 nt, Human
uguuuaguaaagacaauuucgcucauacaaaacaacaguuuacaacaaucgagugcuggaca

SEQ ID NO: 9238 - RNA, 61 nt, Human
cgcagccauugccaaugcuuuucgacgaauucugcuagcugaggugccaacuauggcugug

SEQ ID NO: 9239 - RNA, 63 nt, Human; identical to SEQ ID NO: 4019

SEQ ID NO: 9240 - RNA, 70 nt, Human
ucuuacacaaugaaaaaauacuugcagauaauuagcauuaagaaugcaaauauauuuuuacuguggaaga

SEQ ID NO: 9241 - RNA, 71 nt, Human
uuacuguuuuauuuauaccaugcauagcucaaaaagagagauaaaaugaaguguuaacaggaagucaguaa

SEQ ID NO: 9242 - RNA, 98 nt, Human
aacagacugggccaauguccacaaagaauuccuggucagcaccaccgauguccaaaggugcaauaucaaggaagggcaggcgugauggcuuauuuguu

SEQ ID NO: 9243 - RNA, 63 nt, Human; identical to SEQ ID NO: 8730

SEQ ID NO: 9244 - RNA, 102 nt, Human; identical to SEQ ID NO: 3952

SEQ ID NO: 9245 - RNA, 65 nt, Human
ucacugcgcccgcucauaaggggauggccauggcuagguuuauagauaguuggguggcgcgguga

SEQ ID NO: 9246 - RNA, 77 nt, Human
uuaaugguugauauugcuaggguggcgcuuccaauuaggugcaugaguagguggccugcaguaauguuagcgguuag

SEQ ID NO: 9247 - RNA, 63 nt, Human
uuuuauggcuaagcuuagacucauaucuuuaaacaaaagaacaagaguugaagaucuaugaaa

SEQ ID NO: 9248 - RNA, 72 nt, Human
ccagguucaaaggauucucgugccucagccuccugaguagcugggacuacaggcaugugacucuaugccugg

SEQ ID NO: 9249 - RNA, 64 nt, Human
uggggcagugucucucacccagucuggaaugcaacagcguggucucggcucacugcaacuucca

SEQ ID NO: 9250 - RNA, 65 nt, Human
gcauugaucuuauccuccgugacugucaccucaucgucgugcagaauugagggccgaguagaugc

SEQ ID NO: 9251 - RNA, 69 nt, Human; identical to SEQ ID NO: 6356

SEQ ID NO: 9252 - RNA, 84 nt, Human
aaccuucuguuacucccugggagaaaggcgcugagcguggcaugcaggugucuuugcuguguuuuucuccacuucuaaaugguu

SEQ ID NO: 9253 - RNA, 91 nt, Human
auagggaacaguuuugcccuggaacagaguuacagauacacaaucaagaguguucuugcugaugcucggggucugaagacugucuuccuau

SEQ ID NO: 9254 - RNA, 81 nt, Human
caguuuacaaaacaagugcaaauuaccaaacucaaagcuuauuugaguagaaugggcucaugggcaaugugauguucccug

SEQ ID NO: 9255 - RNA, 67 nt, Human; identical to SEQ ID NO: 1379

SEQ ID NO: 9256 - RNA, 79 nt, Human
gcaagagcacccguaacuguaaccuauccuuuaucugaggagaagaaaaggacagggcauacuuucagguuccgcuugc

SEQ ID NO: 9257 - RNA, 89 nt, Human
gccaugcaugcuccucucagggacucuggcugggccaggaccaccagcacacacacgugucuagccacccagacagggccaugaaaggc

SEQ ID NO: 9258 - RNA, 104 nt, Human
gccaugcaugcuccucucagggacucuggcugggccaggaccaccagcacacacacgugucuagccacccagacagggccaugaaaggcacacuuuuuucuggc

SEQ ID NO: 9259 - RNA, 88 nt, Human
agugccaucucucucaaggccaacaucccugagguggaagcuguccucaacaccgacaggaguuuggugugugaugggaagaggggcu

SEQ ID NO: 9260 - RNA, 69 nt, Human
auagggcuggaaaacgcugaaaaugacugcuuucacugaggucaaggauuguaauauugccagcuuugu

SEQ ID NO: 9261 - RNA, 62 nt, Human
cccgacccacagucaggcccagggccacaccacguuuuuggaguucuugggaaaggguuggg

SEQ ID NO: 9262 - RNA, 66 nt, Human
acaacagguaggauguggguaggauuuggccugugggccauuguuugccauugccugcuuuggugu

SEQ ID NO: 9263 - RNA, 128 nt, Human
uagagugcgguggcgugaucugggcucacugcaaccugcgccagcugcucgggaggcugaagcaagagaauugcuugaacccgggaggcggagguugcagugagccgagauggcgccauugcacucua

SEQ ID NO: 9264 - RNA, 65 nt, Human
guuuucaucucaguuacugauuaaacuacucuuaaaaguuuuccucuagauuguauauugaaaau

SEQ ID NO: 9265 - RNA, 72 nt, Human
uccauucccgcuuuucagaaguaacgauaguuggugguuugugcuuccaaggccuauaacauaggggguggg

SEQ ID NO: 9266 - RNA, 113 nt, Human
uguauauugaaaaugcugaauuauuguaaucuaucuuguaagaucuucuuacuuguacacuaaagcaccuuaguuuaucuuacggaauugcagugauagcuauucugaguaca

SEQ ID NO: 9267 - RNA, 95 nt, Human
cucugcacagcagcccagcagggauguccucucuagagaugguuuaucaaggguaccccaugagagggcagcuccugaugcagcugccggaagag

SEQ ID NO: 9268 - RNA, 72 nt, Human
uuuuuuuuuuaaucagaaugcuguuuauugacaagauagggugucacaaauacaucauuuauagggagagag

SEQ ID NO: 9269 - RNA, 73 nt, Human
aagcaaaauuacaaauaccagccuacucacaugaaaauuuuucauguuuacgcugauauauaucugagugcuu

SEQ ID NO: 9270 - RNA, 67 nt, Human
cguguuuuugugaacacaaauucuccacaaaugggggagguacccuagaagggagcacaauuacacg

SEQ ID NO: 9271 - RNA, 81 nt, Human
gcugaggcaggagacuggcgugaacccaggaggcggaccuuguagugagccgagaucgcgccacugugcuccagccugggc

SEQ ID NO: 9272 - RNA, 78 nt, Human
gugguuaaacgugagacccugggggccaaaagguguggggaccacaaggagaagacucucgggggaacaaugagccac

SEQ ID NO: 9273 - RNA, 75 nt, Human
guagggagcacccgcgugccagucacucgagacggcucuucgagcacuggccuacuggcacucggcgcuucguac

SEQ ID NO: 9274 - RNA, 104 nt, Human; identical to SEQ ID NO: 6365

SEQ ID NO: 9275 - RNA, 93 nt, Human
aaccaacagcaacugaaccacuauuuaagaaagucaguccaugggaaacaucuacuucuagcuuuuuuccuauuuuggcuccggccguugguu

SEQ ID NO: 9276 - RNA, 64 nt, Human
aggcccugugccuggcacuugugcugacuggaucccacagucggcgucuugucccacaggaccu

SEQ ID NO: 9277 - RNA, 87 nt, Human
gcuuccuugucuuuugccucauaucgucagguagcuaguuucgguucagcugcuccucccagacaguuugaugcaucucaauucagc

SEQ ID NO: 9278 - RNA, 65 nt, Human; identical to SEQ ID NO: 247

SEQ ID NO: 9279 - RNA, 80 nt, Human; identical to SEQ ID NO: 100

SEQ ID NO: 9280 - RNA, 68 nt, Human
uuucacaucuguaauuuuaauaugauuuaaaaaauccagguuauagaaaaacauaaagacagaagaaa

SEQ ID NO: 9281 - RNA, 69 nt, Human
caccauguuggccaggcgguccugaacuccugaccucaggcgauccgccugccucggccucccaaagug

SEQ ID NO: 9282 - RNA, 89 nt, Human
ggagucucgcucuuuuugcccaggcuggugugcaguggugcagucuuggcucacugcaaccucugccuccugcguucaagugauucucu

SEQ ID NO: 9283 - RNA, 68 nt, Human
gcgcuuccgcaaguuccugguguuguggcaaacuucgaugagaaugaccccaagaccuuugagggcgu

SEQ ID NO: 9284 - RNA, 95 nt, Human
ggcgcucuaccgacugaugacuaccuggaccagcccugccuugagacgucaacggaucaaguguacagugaguccuggccgguauggaagagccc

SEQ ID NO: 9285 - RNA, 71 nt, Human
ggcggcgguggcggcggcgacugcugcggugaaggaggaggaggagccgagcgggcgcuggcaccgaggcc

SEQ ID NO: 9286 - RNA, 82 nt, Human; identical to SEQ ID NO: 119

SEQ ID NO: 9287 - RNA, 60 nt, Human; identical to SEQ ID NO: 723

SEQ ID NO: 9288 - RNA, 75 nt, Human
agagggucguuucuggcaggaacggagugguugguagucucaggcgccaggcguccugccagguaugcccgcucu

SEQ ID NO: 9289 - RNA, 61 nt, Human
ccccuccagcccccaugugcucugagccagucccaacacuggcugaguuggcugcgagggg

SEQ ID NO: 9290 - RNA, 84 nt, Human
aacuguuacagauuaauacagaaaaacaggaaaugguuaaaagauuuuuacaagcauuuuaaaaaagaggugaucugaaugguu

SEQ ID NO: 9291 - RNA, 109 nt, Human; identical to SEQ ID NO: 831

SEQ ID NO: 9292 - RNA, 75 nt, Human; identical to SEQ ID NO: 74

SEQ ID NO: 9293 - RNA, 71 nt, Human; identical to SEQ ID NO: 77

SEQ ID NO: 9294 - RNA, 115 nt, Human
uguaucuuuuugguggggggagucauaugaacaaguaacugaagcauuuggggauaaaaugauuaacuagcucugaagauaacuuaucauagauuuuuuauuucauugagauaua

SEQ ID NO: 9295 - RNA, 117 nt, Human
cugcccguuuucccccaucucagggccuggcugaggcagggcaggcaggagagaggccccugagggcggguuucaggcccugggccaggcacucagauggggugcacgaacugguag

SEQ ID NO: 9296 - RNA, 77 nt, Human
ggaggaagcaccccugccccagggucccgaaggccccagaggacccauaucccccuggggcaguugguugccccucc

SEQ ID NO: 9297 - RNA, 62 nt, Human
guagcuaagaguuacaggacagaaggauaauauauauucuguuuuauaauuaguaaaguuac

SEQ ID NO: 9298 - RNA, 66 nt, Human
gcaucuucuacuaguguguuaguagauggauucacagauccuucaaauaacaaaaguagauucugc

SEQ ID NO: 9299 - RNA, 99 nt, Human; identical to SEQ ID NO: 334

SEQ ID NO: 9300 - RNA, 61 nt, Human
gacacuuaggaucuacagcuguuaucauguugaccucagaaguaagcuuggauugaguguc

SEQ ID NO: 9301 - RNA, 66 nt, Human; identical to SEQ ID NO: 6268

SEQ ID NO: 9302 - RNA, 85 nt, Human
caggaggccaugagccaaggaaugcaagcagccucuggaaguugaaaacgacccaagugcucaguccuacagcugcauggaacug

SEQ ID NO: 9303 - RNA, 69 nt, Human
ccagccagcugacagauugacuucagcacuaugacaucaaagagcccacccaaggcuguuacuggaagg

SEQ ID NO: 9304 - RNA, 60 nt, Human
ccagauugccucguuaaauccuuaaccuuggugaaaugguuugggaaaaugcaggucugg

SEQ ID NO: 9305 - RNA, 112 nt, Human
cuugguggggcugguuagcgagucauuguauguagagguggaguaaaggcagcacaggugcagucgugaacaugcuuccgcauagaagguggcaaauaagcuccucccugag

SEQ ID NO: 9306 - RNA, 65 nt, Human
ggguuuuaaguaugccaaugaggagaguugccaaagucaucucuaacucaggcaucucuggaucc

SEQ ID NO: 9307 - RNA, 65 nt, Human
uuacuugcaacaaggaggacacuggggauaauuccucaaagcagcaccuccuggaacgaagguga

SEQ ID NO: 9308 - RNA, 67 nt, Human; identical to SEQ ID NO: 5269

SEQ ID NO: 9309 - RNA, 81 nt, Human
cuguggaccugaauguugaucccucgcuucagauugacauaccugaugcguucagugagagagacaaagucaaauuuacag

SEQ ID NO: 9310 - RNA, 86 nt, Human
ggcccugcgguuggcggccuccucguggagcggagcaaggccaggcggccccugcucgagucccgcgucgccauggccgcgguucc

SEQ ID NO: 9311 - RNA, 61 nt, Human
guuucagagcccagaguuuucuguuacaaggcaacaugaagacuuuguguggcuacaugac

SEQ ID NO: 9312 - RNA, 70 nt, Human
accacaaacuaugcuucaacaccuucuucaacuucgaggacaugcaggagaucaccaagcacuuuguggu

SEQ ID NO: 9313 - RNA, 76 nt, Human
ggccuucugcauguagugauccggggcucccccaaggggaaccgcccagccauccucaccuaccaugaugugggcc

SEQ ID NO: 9314 - RNA, 86 nt, Human
gaauaaaauuaaauuguuuuaaaugagauaggaagugaaaaauaaccugguacaucccuuuugccucuuaaaaccuuuuuauauuc

SEQ ID NO: 9315 - RNA, 73 nt, Human
gagcaaaagaaauauuaaaauuuuacgucuaaaaaauaaguuuuauuagugaauaucaaguuuugauuuguuu

SEQ ID NO: 9316 - RNA, 131 nt, Human
ccaaagcaaaguguuuaugaugccuaucggaaguacugugagagucuugccuguugccgcccacucagcacagccaacuuuggcaagaucaucagagagaucuucccugacaucaaagcucgaaggcuugg

SEQ ID NO: 9317 - RNA, 64 nt, Human
gggcagaucucgcgagcaacgcgguaaaaauauugcuucggugggugacgcgguacagcugccc

SEQ ID NO: 9318 - RNA, 68 nt, Human
gcaccccuccccucuuggcagccagugggcaagaaccuuacccuacgcugccagguggaggguggggc

SEQ ID NO: 9319 - RNA, 71 nt, Human; identical to SEQ ID NO: 6991

SEQ ID NO: 9320 - RNA, 81 nt, Human; identical to SEQ ID NO: 8793

SEQ ID NO: 9321 - RNA, 64 nt, Human
gcugaaugaguauguggcuaagggucugaccgacagcauccaccguuaccacucagacaauagc

SEQ ID NO: 9322 - RNA, 81 nt, Human
ggaucuguggcugcugcauuuugggcuuugggaucuaccugcugauccacaacaacuucggagugcucuuccauaaccucc

SEQ ID NO: 9323 - RNA, 81 nt, Human
ccuuccugacucggcuugggggaacugcggccagugaagaggcuccggugugucuccucuuccuugauugugucugggagg

SEQ ID NO: 9324 - RNA, 67 nt, Human
cugaggcugagggcccucugccugccugauucaucuguagcugaggauaaauggcuuucagcccugg

SEQ ID NO: 9325 - RNA, 72 nt, Human
ggaacacgauggcuggacuaugucagggcucgucuucgaaagugcagugacauuucaguauucgugacaucc

SEQ ID NO: 9326 - RNA, 65 nt, Human
ugcuccaggcugggcauucagaugugguccggguagacacuauggaugagcugcccagccuugca

SEQ ID NO: 9327 - RNA, 80 nt, Human
uggaugcagugacacaccaguagggagcuagcuggcugccccuugcagcccacuccccaaacuggcuacccaggcaucca

SEQ ID NO: 9328 - RNA, 82 nt, Human
ccuuaauguguguguuuauuuacaaguacuaaaucugaagaacaguaaaauaggaaauagccguauauguacacaucugagg

SEQ ID NO: 9329 - RNA, 71 nt, Human
gagggccgggccacaagucagcggugcugcuucugcaaaaagcccggcugagggugcccgcccggaccguc

SEQ ID NO: 9330 - RNA, 86 nt, Human
guaucucuuccgucuguuuguccauucuuuuaacacugggcuuuggcuucacuucacagguaggaggcugggcacaaaagggauac

SEQ ID NO: 9331 - RNA, 72 nt, Human
cagccauuguccuuuucaccagcucuacaugugcuggguccauggaaauagagcugugguuguacaaggcug

SEQ ID NO: 9332 - RNA, 73 nt, Human
cccgaggguugccaguuccaccuccucuuguacaggaucuugguacaggggcugguaggaguacgcaguuggg

SEQ ID NO: 9333 - RNA, 75 nt, Human
ugggccuguuguggaguacgcuuuggacugagaagcaucgaggcuauaggacgcagcuguugccaugacggccca

SEQ ID NO: 9334 - RNA, 65 nt, Human
uucaagaauguuagaaguucaagccagaaguuucuuucaggguuuuggucuaucucauuugggaa

SEQ ID NO: 9335 - RNA, 80 nt, Human; identical to SEQ ID NO: 6866

SEQ ID NO: 9336 - RNA, 60 nt, Human
gcccaucauuggcaucaugggagggccccccauauggggugcuggcaucauaccaagggc

SEQ ID NO: 9337 - RNA, 84 nt, Human; identical to SEQ ID NO: 286

SEQ ID NO: 9338 - RNA, 89 nt, Human; identical to SEQ ID NO: 288

SEQ ID NO: 9339 - RNA, 94 nt, Human; identical to SEQ ID NO: 5398

SEQ ID NO: 9340 - RNA, 77 nt, Human; identical to SEQ ID NO: 3082

SEQ ID NO: 9341 - RNA, 65 nt, Human
ccucaugagcaagguugcagaucgguccuuccucagcuccuugauuugugaccuugaccaagggg

SEQ ID NO: 9342 - RNA, 67 nt, Human
ggaagaaagcaaaagggacugaacuagccucugguaggauugcagggguccagccuugccuguuucc

SEQ ID NO: 9343 - RNA, 67 nt, Human
cgcagcgagcuggcugcacuugcuccgcagcgauacuauggaggagcacggugcaagcugcguugcg

SEQ ID NO: 9344 - RNA, 61 nt, Human
gccggauggcugacuguauuucaauugggcaugucaaaguccaauggcagcgucuaucggc

SEQ ID NO: 9345 - RNA, 79 nt, Human
gcuucugcuaggggcuguguacagagugcaaaugucugauuuaccacacuaaaguucuauuguaucccuaugugaaagc

SEQ ID NO: 9346 - RNA, 74 nt, Human
gggugacucgcguaccgugcggcuugcugacaggagcugcggcgggcccugggccgcaugguggagcggaaccu

SEQ ID NO: 9347 - RNA, 73 nt, Human
agcauguggccuccccgucccuuccccgguggcgaacccagugacccagggacacguggggugugcugcugcu

SEQ ID NO: 9348 - RNA, 62 nt, Human; identical to SEQ ID NO: 6172

SEQ ID NO: 9349 - RNA, 71 nt, Human
cucccccacccacaggcccagccuccucggucuccugucucguugcugcuucugccugugcugugggggag

SEQ ID NO: 9350 - RNA, 66 nt, Human
ggagauggcuccggcggcuuggggaaaagccaaauugccaaaacucaagucaccucaguaccaucc

SEQ ID NO: 9351 - RNA, 80 nt, Human
gggaugcacggccucgugggggccgggccguccuccagccccgcugcucccuggccagcccccuugucgcugucgguccc

SEQ ID NO: 9352 - RNA, 68 nt, Human; identical to SEQ ID NO: 6247

SEQ ID NO: 9353 - RNA, 68 nt, Human; identical to SEQ ID NO: 2734

SEQ ID NO: 9354 - RNA, 75 nt, Human; identical to SEQ ID NO: 5842

SEQ ID NO: 9355 - RNA, 76 nt, Human
cuggagaccucggcucaagucuuugcccugcugccgacgcauugugucaccuugggcaaggacuucgcaucuccag

SEQ ID NO: 9356 - RNA, 66 nt, Human
ccuccccgggggguguggcuaagggacgaggcaguucucguccagagcccagguaauccgggcggg

SEQ ID NO: 9357 - RNA, 61 nt, Human
cggcugcgguacggcguguggucccagcgguucagcugagguagggacgugccguaggccg

SEQ ID NO: 9358 - RNA, 61 nt, Human
guaggcaaccuucccucucuccuuggugaagaacaucccaagccagaaagaaguuaacuac

SEQ ID NO: 9359 - RNA, 62 nt, Human
ccuuuuugguucucagccucucucgaaauagcgugggacaucgaggcacccugcaaauuagg

SEQ ID NO: 9360 - RNA, 80 nt, Human
gcugcugucuauguugaugaccauaacugggauguauaauauuuacagacaacucuaaguuauguucacauggauuaugu

SEQ ID NO: 9361 - RNA, 67 nt, Human
guacaucauugauuuuuuuuuuuuuuuuuuuuuuugugggaaaaaagagaauuugugccucgugugc

SEQ ID NO: 9362 - RNA, 60 nt, Human
agauccuccugugccuucuucuucuucuuggguuuuucuucuugaauuacagggggguuu

SEQ ID NO: 9363 - RNA, 78 nt, Human
uuuuuuuuuuuuuuuuuuacaguuuaaaggggucucauuuauugucacggguccaaauguacaaaaaaaauuagaaaa

SEQ ID NO: 9364 - RNA, 111 nt, Human
ccgcaggucaggagggaaagcagggcucagagggcaucguggcccaggcaggguccuaccugggggucaggagcaccuuggucuugaugauugaucggauugauagaaugg

SEQ ID NO: 9365 - RNA, 82 nt, Human
cugggagugcugggggacagguaccccccggugguccuauggcaggaugagaagggagggacuuggcucccccagagcccgg

SEQ ID NO: 9366 - RNA, 78 nt, Human
ggugggggagcgagucugggaagauuggcuuugacucucuguugccagaggagaugccaucccagcacggcccccacu

SEQ ID NO: 9367 - RNA, 75 nt, Human
acuggugggccugggcuucugagguggccuccugcccugaucagggacccuccccgcuuuccugggccucucagu

SEQ ID NO: 9368 - RNA, 81 nt, Human
cuuuucucucugcuagauggauguugaugcacuggaggucuuuuagccugcccuugcauggcgccugcuggaggaggagag

SEQ ID NO: 9369 - RNA, 61 nt, Human
gucuucuuuaauagaguaucuuucaaacacaacuuugcuagaaacugguccaaagaucgac

SEQ ID NO: 9370 - RNA, 63 nt, Human
uuauuuuaaugcacaguaugagaaaugaacuuuuuuaaaucaacugauuuguauggaaaauga

SEQ ID NO: 9371 - RNA, 64 nt, Human
cgaggcagcgagcgacccccagcaucccgcggccuccgaaggggccgccgccgccgccgccucg

SEQ ID NO: 9372 - RNA, 73 nt, Human
acaauaauuauuggccuacuuaauacuccagugccuugagauaguuggacauauuuuaggaagauuuuauugu

SEQ ID NO: 9373 - RNA, 61 nt, Human
guguuuugauuaguccugucacuguuuuuauuuaaaaugcagugucagcaaaccgaaaugc

SEQ ID NO: 9374 - RNA, 64 nt, Human
ucuuuuuuaguaacagaguacucguauacuuaucacuguaugcacucauugggucuaagggaga

SEQ ID NO: 9375 - RNA, 85 nt, Human
aaaagguuucucuuaacaguauuuccagugacaaugcaagguaaguauaucaaaggaaaucaacaguugugcuugggggcuuuuu

SEQ ID NO: 9376 - RNA, 127 nt, Human
gugaauguuuuucucuucagcugaucuaaaaaugaaagccagauaucuuauguagaaauauuuugauaauauuuuuacagugagcuuucccauguuuuuaugucuuaaguuucuuugcugcguuuau

SEQ ID NO: 9377 - RNA, 74 nt, Human
ggucagaaaagccccaaagaaaaaggcuuuuucaguagauaacauguugggccgaucagggcuucaguuagauc

SEQ ID NO: 9378 - RNA, 76 nt, Human; identical to SEQ ID NO: 758

SEQ ID NO: 9379 - RNA, 63 nt, Human
ucuucaucuuggucaccacgccagagaggauccgcccucgaauggacacauuaccagugaagg

SEQ ID NO: 9380 - RNA, 74 nt, Human
ccucagauaaaaccucaauuacugguaauuguacauuuccaucaauaucccuuuuaaagagguuuauucugagg

SEQ ID NO: 9381 - RNA, 72 nt, Human
ggcaaucuugaacuucuauugaacuuggaaagcggucaagacucacuccauaauaagaaguuaaggacuguc

SEQ ID NO: 9382 - RNA, 60 nt, Human
guugucaaucguuuuaaaugguuucacuuuauuugugaaaaauaaagccaaaaugccaac

SEQ ID NO: 9383 - RNA, 79 nt, Human
auguuuugaagcaggccauugagcugaguccugauaaccaauacgucaagguucucuugggccugaaacugcagaagau

SEQ ID NO: 9384 - RNA, 118 nt, Human
gaaacaaaccugcaagaaauuuucaaauccauacaguauugaguauucugaacuugacugugaggaaggguggacacaacugaaguguggaagaaaugaaagggcgaagguguguuuu

SEQ ID NO: 9385 - RNA, 74 nt, Human
gcugaaggagagcaguuuguugaagaagccuuggaaaagucuccuugccaaacagauguccuccgcagugcagc

SEQ ID NO: 9386 - RNA, 75 nt, Human
acggagggucaguggaaaugggaccuugguugugacaaagccugagaaugucauguugauccauccaccccucgu

SEQ ID NO: 9387 - RNA, 66 nt, Human
ggccauggcugcucccgucaucugcuccugcaucauucgugauuggucagcggcauuaucuuggcc

SEQ ID NO: 9388 - RNA, 90 nt, Human
ucuugaucuuuauugcuaugugugaaaacuuggcuuccucacugaacggugaggaauggauuuaaagcaugagcuuuaguaguaucaaga

SEQ ID NO: 9389 - RNA, 86 nt, Human
uucauucuucauacacuggccuuggcauccuguggaauuugacccaacuagcagcuagucagucugucagugagcagaagagugaa

SEQ ID NO: 9390 - RNA, 65 nt, Human
ucaagacccauauauuccgacaguuucaguaauaugaagauuucggaaauucuaaaagguuuuga

SEQ ID NO: 9391 - RNA, 96 nt, Human; identical to SEQ ID NO: 9136

SEQ ID NO: 9392 - RNA, 72 nt, Human
gagggacgcugcuucuccccugcccacgucuccaaggccugaaaggcaggguucuguggaacagcauuucuc

SEQ ID NO: 9393 - RNA, 68 nt, Human
uggggccucacgcaaccuugguguuugguuaaauuugugccuuggcuccuguugcguuuaggcaccca

SEQ ID NO: 9394 - RNA, 128 nt, Human
gaucacugacucccugaagccgagacacugaauccaggaggcggagacugugcugauaagaccuaucugcuucaauuuccgcuugaguggccucccuugucaacugcugggccagggacuugguuuuc

SEQ ID NO: 9395 - RNA, 70 nt, Human
guggagcugucggaggccaggcuccgggacgugcugcagcgcgccgggcccucucucccacuuuuuccau

SEQ ID NO: 9396 - RNA, 106 nt, Human; identical to SEQ ID NO: 6411

SEQ ID NO: 9397 - RNA, 77 nt, Human; identical to SEQ ID NO: 2332

SEQ ID NO: 9398 - RNA, 80 nt, Human; identical to SEQ ID NO: 367

SEQ ID NO: 9399 - RNA, 73 nt, Human; identical to SEQ ID NO: 7713

SEQ ID NO: 9400 - RNA, 75 nt, Human
uucgccagcuggcguaauagcgaagaggcccgcaccgaucgcccuucccaacaguugcgcagccugaauggcgaa

SEQ ID NO: 9401 - RNA, 85 nt, Human
gcccccagcagcgccggcgggcuaagcccagggccgggcagacggccgggcgagggggcagcgcgcugcuggcucugugcggggc

SEQ ID NO: 9402 - RNA, 115 nt, Human
aagacaguaugaguaaugauaauuuuuagaggcauuaggaucuugauugaaauucuggcucuguuguauccuguugugaugucacuguaagaauugugcauuuaauauugaucuu

SEQ ID NO: 9403 - RNA, 63 nt, Human
gcagcucuuugaaauaaaagugauuuuaguuccuaggacuauuuguuauacuuuuggagcugu

SEQ ID NO: 9404 - RNA, 67 nt, Human
gggaauuuuugaacacuuuugcuuuaacaguuauuagcacuauugauuauuuuguuaaaauuuuccc

SEQ ID NO: 9405 - RNA, 75 nt, Human
ugcauauuuuaacaucugaaaucagaaagugucuuuacuggguuuuugguuuuagaaacauaaaauaauaaugua

SEQ ID NO: 9406 - RNA, 68 nt, Human; identical to SEQ ID NO: 8913

SEQ ID NO: 9407 - RNA, 85 nt, Human
cucacuauagggaaagcugguacgccugcagguaccgguccggaauucccgggucgacccacgcguccgcaaauacugccaugag

SEQ ID NO: 9408 - RNA, 73 nt, Human; identical to SEQ ID NO: 7713

SEQ ID NO: 9409 - RNA, 105 nt, Human
uucauguuuuuguauuauguaucuuuuuguaugguaaagacuauauuuuguacuuaaccagauauauuuuuaccccagauggggauauucuuuguaaaaaaugaa

SEQ ID NO: 9410 - RNA, 90 nt, Human
uuggucagucacucucagccauagcacuuuguucacuguccugugucagagcacugagcuccacccuuuucugagaguuauuacagccag

SEQ ID NO: 9411 - RNA, 82 nt, Human
aagagacuguccuucccucaauguauauucuuggcacccuuguugaaaaugaguucacaauagauguauggauuuguuucuu

SEQ ID NO: 9412 - RNA, 75 nt, Human
gccauuaucugucuuuuuugguuucauauaaauuuuaggauugguuuuauauuacugugaagacgguuauuuggc

SEQ ID NO: 9413 - RNA, 71 nt, Human
gcgacgagcugguacgccugcagguaccgguccggaauucccgggucgacccacgcguccgauucuucugc

SEQ ID NO: 9414 - RNA, 78 nt, Human
ggcaauacugugcuguuuugguuaccauagauuucuaguauaauuugaaguuaggugauuugauucuccaguuuuguu

SEQ ID NO: 9415 - RNA, 80 nt, Human
ugaaaaugaguucacaauagauguauggauuuguuucuugguucucuauucuauuuuauuggucuaggugcuuauuuuua

SEQ ID NO: 9416 - RNA, 69 nt, Human
agggaaagcugguacgccugcagguaccgguccggaauucccgggucgacccacgcguccgcuuuugcu

SEQ ID NO: 9417 - RNA, 61 nt, Human
auguuccuuguagaaaaccuaucuccauacuccuuucuggauuuuuguuuauaggggagau

SEQ ID NO: 9418 - RNA, 86 nt, Human
cugcuugaauggauguauuuugucuguauguaaagauuuaacuacguaaauguugacauauuaauuagaugguuuguuucaagcag

SEQ ID NO: 9419 - RNA, 72 nt, Human
gcaaaagagucuugccaaggaagaaagcagcuugaaggaaagaaagagaagauccuuggaagaauuguuugc

SEQ ID NO: 9420 - RNA, 73 nt, Human
gcuacugcuccagaagcugcugcagcgaagacgcaagggagcugcggaggaagagcagcaggacagcgguagu

SEQ ID NO: 9421 - RNA, 71 nt, Human
ggccagcagaguggccucagauguuccugcaccuggcccaggagcccaggacagaggucaaaucuagggcc

SEQ ID NO: 9422 - RNA, 77 nt, Human
guggccggggcgcggccuggucucggcgguggccuguaagaaggccuguaugcugggccagugagagcaguggccgc

SEQ ID NO: 9423 - RNA, 81 nt, Human
ugcgcaucacugugggcguggauggcuccguguacaagcugcaccccagcuucaaggagcgguuccaugccagcgugcgca

SEQ ID NO: 9424 - RNA, 74 nt, Human; identical to SEQ ID NO: 365

SEQ ID NO: 9425 - RNA, 102 nt, Human; identical to SEQ ID NO: 2172

SEQ ID NO: 9426 - RNA, 77 nt, Human; identical to SEQ ID NO: 3082

SEQ ID NO: 9427 - RNA, 75 nt, Human
uaggggagggacuuuguucaggaagaaauccgugucuccaaccacacuaucuacccaucacagaccccuuuccua

SEQ ID NO: 9428 - RNA, 85 nt, Human
agguucagcugaagucccgacuggugaggacaaguggagccacaaggguccagacguaaagcaggaggcagacccagcuggagcu

SEQ ID NO: 9429 - RNA, 67 nt, Human; identical to SEQ ID NO: 4553

SEQ ID NO: 9430 - RNA, 64 nt, Human; identical to SEQ ID NO: 931

SEQ ID NO: 9431 - RNA, 75 nt, Human
ugacccacacagcuggccacuugcuggucaugcucugaaacuuugcaucagggcuguaccagcuggucaggguca

SEQ ID NO: 9432 - RNA, 74 nt, Human
gguuguacuuggccaagcgcucagaucggcaaggggcaccagucuugaucugcccagugcacagccccacaacc

SEQ ID NO: 9433 - RNA, 81 nt, Human
guucacggccuugcgauccucuuuggguuggucacugugagaucaucccccacuaccuggauuccugcacuggcugugaac

SEQ ID NO: 9434 - RNA, 60 nt, Human
uugcacgccugaagagacucggucacggagccaaucugguugacuuugagcaggaggcag

SEQ ID NO: 9435 - RNA, 89 nt, Human
aagucgccauaguguuugcagaaauuuuuaaaauuaaaaaaacuaaaagguuuuuuuaaaaaaaguuucaagacaggaaguggugacuu

SEQ ID NO: 9436 - RNA, 69 nt, Human
ggaaaauacaggauuugcaggauuggaaaccuguaaagggaaggccaacuuuuuguaucuguggguucc

SEQ ID NO: 9437 - RNA, 72 nt, Human
guaugcagaaagaauagcuggcagagauaacaaaugacaacuaggauugauuuuuguaacauuuaagcauac

SEQ ID NO: 9438 - RNA, 66 nt, Human
ucucguuguaaccuguauauuaaucauacaaauccaaacuuaauuuguaguaucaggacagugaga

SEQ ID NO: 9439 - RNA, 82 nt, Human
ugaaaaugauagguuuucuaguauggaauuauccuuuuauuauugcaauaaacuccacuuuaccaugcucugucauuauuua

SEQ ID NO: 9440 - RNA, 91 nt, Human
uuuuaaagauuuuauauuauuuuuaaagauuuaaauuauaugaaaauguuuuuucaaaggucuauuaaugugauuuuuuuaaucuuuaaaa

SEQ ID NO: 9441 - RNA, 64 nt, Human
cagucauaguggaucuggcacguggguguuuagguaacaaucacuuuuuggaauugacugacug

SEQ ID NO: 9442 - RNA, 60 nt, Human
cuggcccugaaggauggagaugguagugguagugcugcaaugcaccaucagagggauaag

SEQ ID NO: 9443 - RNA, 65 nt, Human
auauacauagauacauuuacauauuuauauauaaauuuaaauguuuaguuuauauaaauguauau

SEQ ID NO: 9444 - RNA, 65 nt, Human
gaaggauauaaaaagaaaacuuaaaggcccucuucucauuauuaacaguuucuuauguauccuuc

SEQ ID NO: 9445 - RNA, 100 nt, Human; identical to SEQ ID NO: 698

SEQ ID NO: 9446 - RNA, 60 nt, Human; identical to SEQ ID NO: 2705

SEQ ID NO: 9447 - RNA, 72 nt, Human; identical to SEQ ID NO: 1989

SEQ ID NO: 9448 - RNA, 73 nt, Human
cuccuuguuccagggaacacucauuucccuacaggugaucuuggggagagacuguucccaggcaacccuggag

SEQ ID NO: 9449 - RNA, 79 nt, Human
ucagcgcacaaaucuguccagggcagauggccgggcccccgugggcuuggccuucgccuccuuaugaugcugcugcuga

SEQ ID NO: 9450 - RNA, 65 nt, Human; identical to SEQ ID NO: 8905

SEQ ID NO: 9451 - RNA, 64 nt, Human; identical to SEQ ID NO: 8906

SEQ ID NO: 9452 - RNA, 70 nt, Human; identical to SEQ ID NO: 8907

SEQ ID NO: 9453 - RNA, 94 nt, Human; identical to SEQ ID NO: 807

SEQ ID NO: 9454 - RNA, 77 nt, Human
guggaagaucuuaaaauugccugccucauuugcugggaaaaaucagauaggaaguggccuuuaggggauacuuuuac

SEQ ID NO: 9455 - RNA, 77 nt, Human; identical to SEQ ID NO: 796

SEQ ID NO: 9456 - RNA, 70 nt, Human
ccaucuuacguauguguuaaguuucucucucuguugauuacaaggcaagcuccaaacauuaaaaugaugg

SEQ ID NO: 9457 - RNA, 65 nt, Human
uagggccaaacuuuuguagguuggacaaaacacauuuuauucaacccauauuuacugggauccua

SEQ ID NO: 9458 - RNA, 75 nt, Human
ucaaguccaugaaccacaugaauuaccuccccagccaggaggauaugccucauaaccaguucaucaagaugauga

SEQ ID NO: 9459 - RNA, 105 nt, Human
ucuuuuccaucgccuucaucacuguccuuaucuucaaggucuacauguucaagugcguguggcggugcuacagauugaucaagugcaugaacucgguggaggaga

SEQ ID NO: 9460 - RNA, 70 nt, Human
accucuucaaaaagcgaugcuaccaccuaauaguuuucaaggaaaaguggcauucauuacugggggaggu

SEQ ID NO: 9461 - RNA, 79 nt, Human
cgaggagacucaacaugaagcuaccggccaggguuuucuuuacucuggggucccggcugcccuguggccucgcuccucg

SEQ ID NO: 9462 - RNA, 70 nt, Human
gagugcggcugacgggccccggguguuccgagugguggacagcauggaggaugaggugcagcggcggcuc

SEQ ID NO: 9463 - RNA, 63 nt, Human
gcacugggagcuuacugcggagggcgaggagauugcccgggagggcagccaugaggcccgugu

SEQ ID NO: 9464 - RNA, 95 nt, Human
auuguauauuuauauauaaucgccuuuuuguauaugucuuagucucuucaggcugcuauaacaaaauuccuucgacuguguaauuuauaaacaau

SEQ ID NO: 9465 - RNA, 75 nt, Human
gcaaaugguuagccugguaucagcagaaaccagggaaagccccuaagguccugaucuaugaggcuuccacuuugc

SEQ ID NO: 9466 - RNA, 65 nt, Human
ucccagcuuccagaugcgacauccagaugacccagucuccaucuuccgugucugcaucuguggga

SEQ ID NO: 9467 - RNA, 61 nt, Human
gaggugcgcuguguuccagugcgcacagugucacgcagugcucgccgacucggugcaccuc

SEQ ID NO: 9468 - RNA, 74 nt, Human
uugaagguucacucaaaggcagcuaucucuuaaaaacaaaagccauaguaaaugcaucagagauggauauucaa

SEQ ID NO: 9469 - RNA, 80 nt, Human; identical to SEQ ID NO: 174

SEQ ID NO: 9470 - RNA, 64 nt, Human; identical to SEQ ID NO: 175

SEQ ID NO: 9471 - RNA, 66 nt, Human
uuucggcucugggucgcccaaagcagaauggagacggauagagugguggcucccagaaucccgaag

SEQ ID NO: 9472 - RNA, 60 nt, Human
gauauugcuuucauaauuuauacuaacauaaaauaauauuuuucacuguuuugcaauguc

SEQ ID NO: 9473 - RNA, 74 nt, Human
uuaauuucuguauugcagcuagaggaaguccaaagaaaacuuggauuugcucuuucugacaucucggugguuag

SEQ ID NO: 9474 - RNA, 78 nt, Human; identical to SEQ ID NO: 5110

SEQ ID NO: 9475 - RNA, 84 nt, Human; identical to SEQ ID NO: 5111

SEQ ID NO: 9476 - RNA, 60 nt, Human; identical to SEQ ID NO: 5112

SEQ ID NO: 9477 - RNA, 65 nt, Human; identical to SEQ ID NO: 1245

SEQ ID NO: 9478 - RNA, 130 nt, Human
ccuugucagcagccuuuucuucgcuggagcccacggauucugaaguccugccaaugcugggaacccaggcagcgucaauccccccaguccugggagguagaaacaugggauggguagaagaggcccgggg

SEQ ID NO: 9479 - RNA, 84 nt, Human
gagggaggacucugcagucuuauccaggcucuccucggcaucgcugccuucaagggucucuccaucuuuaaaggguccucccuc

SEQ ID NO: 9480 - RNA, 72 nt, Human
guguggucgaagcuucugaagcugccuacaaggaagccuuugaaaucagcaaagagcagaugcaaaccacgc

SEQ ID NO: 9481 - RNA, 72 nt, Human
guuaaagcuuaccgggagaagauugagaaggagcuggagacaguuugcaaugauguccugucucugcuugac

SEQ ID NO: 9482 - RNA, 115 nt, Human
uccggcugggccuggcccucaacuucuccguguucuacuaugagauccagaaugcaccugagcaagccuggcucuuagccaaacaagccuucgaugaugccauagcugagcugga

SEQ ID NO: 9483 - RNA, 61 nt, Human
aggagacccagucaggacacagcauggacaugagaguccucgcucagcuccuggggcuccu

SEQ ID NO: 9484 - RNA, 81 nt, Human
gcucuguuucccaggugccagaugugacauccagaugacccagucuccauccucacugucugcaucuguaggagacagagu

SEQ ID NO: 9485 - RNA, 72 nt, Human
gucccugaucuaugcugcauccaguuugcaaaguggggucccaucaaaguucagcggcaguggaucugggac

SEQ ID NO: 9486 - RNA, 61 nt, Human
cagauucuauucagacuucaucaguuuuuucauuacugaucuuuuucuguuccaggaucug

SEQ ID NO: 9487 - RNA, 70 nt, Human
uccaagaagcacauugcauuuggcucacaugucuccuuagucucauguggucugugauuguuucucagga

SEQ ID NO: 9488 - RNA, 84 nt, Human; identical to SEQ ID NO: 286

SEQ ID NO: 9489 - RNA, 89 nt, Human; identical to SEQ ID NO: 288

SEQ ID NO: 9490 - RNA, 61 nt, Human; identical to SEQ ID NO: 776

SEQ ID NO: 9491 - RNA, 93 nt, Human
cuuuacugaagcucacuggguguccaucaaucacaaaguggcguaugcagccugugaaggguuugcugggggccaagcguggugucaguagag

SEQ ID NO: 9492 - RNA, 100 nt, Human
gcucacugggcacaugcaccagguacaugcacuggguacccgugagacagaggcuacuugggggauacagggucaauguggcugaguagugccuuugggc

SEQ ID NO: 9493 - RNA, 66 nt, Human
ugccugggggaacacagaugucaccggguuacaggggaaggaacaacuguguaaagacccugggua

SEQ ID NO: 9494 - RNA, 91 nt, Human
ugccuuugggcuaagcccuggcugucuacaagcccgcaguaccauuaguguacaacggagacugccuacuggggcccguucccugcaggca

SEQ ID NO: 9495 - RNA, 78 nt, Human
ggguccuaggagaaaaaguccuacuuuucuggguccccaggugcaagcaccucccggagacuguuucucccauggccu

SEQ ID NO: 9496 - RNA, 64 nt, Human
gccgcucgccccaggccugggcccgcuccuguagcggcuggccggccagggagcccacaguggc

SEQ ID NO: 9497 - RNA, 73 nt, Human
ggcugcaggcuucggcguucagugauugucgcugggcacaggggcggcgcugaugcccacggcagccugcacc

SEQ ID NO: 9498 - RNA, 64 nt, Human; identical to SEQ ID NO: 287

SEQ ID NO: 9499 - RNA, 88 nt, Human
ggaguggggcuaggggcugggcgggguggugggggagcggaugcucacauuucucuuuuucacccucugcccagcugggccuugcucu

SEQ ID NO: 9500 - RNA, 68 nt, Human; identical to SEQ ID NO: 9318

SEQ ID NO: 9501 - RNA, 68 nt, Human
gcggucccaagggcuggagcuguuugagaacaccucggcccccuaccagcuccagaccuuuguccugc

SEQ ID NO: 9502 - RNA, 71 nt, Human; identical to SEQ ID NO: 6991

SEQ ID NO: 9503 - RNA, 78 nt, Human
agaagcuucugcaauucucaaaucucugggaagcuuccaucaguggucucagucuauagugggaaagcaggugcuucu

SEQ ID NO: 9504 - RNA, 80 nt, Human
gagcugugggaaagaaggucaaagcagccuccagcuauaucucagucugaaggucaaagucacguuguucuucauagcuc

SEQ ID NO: 9505 - RNA, 82 nt, Human; identical to SEQ ID NO: 9328

SEQ ID NO: 9506 - RNA, 60 nt, Human
cagacuacuuccuauaaauuucuccugggaaaccugccuuuguauguggaaguauaccug

SEQ ID NO: 9507 - RNA, 108 nt, Human
cugaaaccuuuaaccaugccaaugucucacacugguuucucgugcccaccagcuuguaauggagggauacaauuggugucaugaucggaaugugguuaccauuuucag

SEQ ID NO: 9508 - RNA, 67 nt, Human
caugcgggaugcccagggacggcuggacagcacgcgugggcugcugugcggccugggcgcuggcgug

SEQ ID NO: 9509 - RNA, 65 nt, Human
gcucccugcucuacgguuccauccccaaggcggccgucagguuuggaauguucgaguuccucagc

SEQ ID NO: 9510 - RNA, 79 nt, Human
ccagaagcagcuccagggcccccgagaaagagccgcccaaccagagcaggucgagucccgggcgcucaccuguuucggg

SEQ ID NO: 9511 - RNA, 72 nt, Human
cggugcuggggaagucggaggagugggcggacaaccaccugccccuuacggaugccgaacuggcccgcaucg

SEQ ID NO: 9512 - RNA, 82 nt, Human
ggcugcggcagcacgccuaugagcacucgcugggcaagcuucgagccaccaagcagagggcacaggaggcucugcugcagcu

SEQ ID NO: 9513 - RNA, 87 nt, Human; identical to SEQ ID NO: 76

SEQ ID NO: 9514 - RNA, 79 nt, Human
cgcuaccaagcgguguggucccagcaugggggguccuacuacaugauaucgcgcucgcugggacccgaguuuggaggcg

SEQ ID NO: 9515 - RNA, 68 nt, Human
aggacagaggccggaggcaggcggcuuagacgcucgcagugcccgugccaccugcccugcccugcccu

SEQ ID NO: 9516 - RNA, 69 nt, Human
gcugugcuugcugcucuguguguugcgcccgugcuuggaugugugcgauguugcuguugcuggugcggu

SEQ ID NO: 9517 - RNA, 92 nt, Human
ggcugagcugugcgugggcugcugcgcggagugugcuguuccugcuugcccgcccugcacaccccugagcugccugugccgccugcugggcc

SEQ ID NO: 9518 - RNA, 78 nt, Human; identical to SEQ ID NO: 99

SEQ ID NO: 9519 - RNA, 65 nt, Human; identical to SEQ ID NO: 247

SEQ ID NO: 9520 - RNA, 80 nt, Human; identical to SEQ ID NO: 100

SEQ ID NO: 9521 - RNA, 97 nt, Human; identical to SEQ ID NO: 7898

SEQ ID NO: 9522 - RNA, 80 nt, Human
ggguguugaacuuggccacaucaaugucauacagcuucuucacagccuguuuaaucuggugcuuguuggcuuuaacaucc

SEQ ID NO: 9523 - RNA, 65 nt, Human
uccggagucgcagugucuucggccgccggaaggugggugacgugcggaucuuguagcaaccugga

SEQ ID NO: 9524 - RNA, 78 nt, Human
caccuacggugaaaagaaagaugaauccuagggcucagagcacugcagcagaucauuucauauugcuuccguggagug

SEQ ID NO: 9525 - RNA, 87 nt, Human
guggggauagcgauaauuaugguagcggaggugaaauaugcucgugugucuacgucuauuccuacuguaaauauauggugugcucac

SEQ ID NO: 9526 - RNA, 70 nt, Human
ccgaguugggggagggggccaccgagccacgagcaggaguggcuuuugucccucauccuuguuuacucgg

SEQ ID NO: 9527 - RNA, 60 nt, Human
gccagcccccauuucgagcggggcuucucccugcgccgagccugacaaaaugggggcggc

SEQ ID NO: 9528 - RNA, 64 nt, Human
gcggcgcgggccugcagggccugccgggcgcacguggcggccucgggccugggagccgggccgc

SEQ ID NO: 9529 - RNA, 65 nt, Human
auuuaauuuuucuuuuuggaaaauguauguauacauacacacaguuuccauaaaaaaacauagau

SEQ ID NO: 9530 - RNA, 74 nt, Human
gcuucccuguaacuucccuguaauucugugggucccuuguagccacagagaaggcagcaaucaguaggggaagu

SEQ ID NO: 9531 - RNA, 74 nt, Human
ggcugagguggguggaucacaaggucaagagauggagacaauccuggccaacauggugaaaccucaucucuacu

SEQ ID NO: 9532 - RNA, 100 nt, Human
cuuggcccacauccaggcuacccccagcccguuuuuccccuguuuagcccagggaggaaacaguaaaggugaugggggcagccgggagggaggggccaag

SEQ ID NO: 9533 - RNA, 131 nt, Human; identical to SEQ ID NO: 6294

SEQ ID NO: 9534 - RNA, 91 nt, Human
ccggccucugagcaagacagugcgcuucaacgugcucaaggucaccaaggcugccggcaccaagaagcaguuccagaaguucugaggcugg

SEQ ID NO: 9535 - RNA, 66 nt, Human; identical to SEQ ID NO: 3294

SEQ ID NO: 9536 - RNA, 71 nt, Human; identical to SEQ ID NO: 3295

SEQ ID NO: 9537 - RNA, 81 nt, Human
ggcaaagacggccauagggugcucugaguuuugggauggucacaugacacaauccagcacuugaaccuggggccucgugcc

SEQ ID NO: 9538 - RNA, 61 nt, Human
gugccaacuuguguuuuguguuucaaaguuccagaagcaaaaacaaaaaaaguucggguac

SEQ ID NO: 9539 - RNA, 64 nt, Human; identical to SEQ ID NO: 287

SEQ ID NO: 9540 - RNA, 94 nt, Human
aaauguaggaagguuucaaagacauuuuggaagaaagaggaaaucagagucugauuuuuaaaaauucguuuuuguagcugaagcuucuucauuu

SEQ ID NO: 9541 - RNA, 69 nt, Human
cccaaaaauuauuauagaugagagaauugaaugugacauaaguucuacuauacgcgugacuucuuuggg

SEQ ID NO: 9542 - RNA, 96 nt, Human
ggccaccucccugacccucauauuuguaaggccguuucugggucuuugccaccaggagcuccuuggaauaucacaggccuuaggcuggaagagguu

SEQ ID NO: 9543 - RNA, 68 nt, Human
ucaugcaaaggaagccuaguuccuucagacacuucuuguuugacacugucuugccuucuucugcauga

SEQ ID NO: 9544 - RNA, 63 nt, Human
aaggccucucggagucaccaggagcuccaccgggagcugcucaugaaccacagaaggggccuu

SEQ ID NO: 9545 - RNA, 100 nt, Human
cugaccagcgaagagagagagcuguagggccagcugccgggcucaggccacugcccacccuggccuggacagccuccuucagcccuucuguaccuggcag

SEQ ID NO: 9546 - RNA, 65 nt, Human
cuucccuucccaaggacucgaccugagaaccgccauguacucggagauccagagggagcgggcag

SEQ ID NO: 9547 - RNA, 62 nt, Human
gcaccgccggcggaaccagcucaucaagaagaagaaggaggagcuggaagccaagcggcugc

SEQ ID NO: 9548 - RNA, 79 nt, Human
ggugaaggugccugaggagccuguguuacucaucacugcuugcugggggguggagcagguuucuaauuggugcuucacc

SEQ ID NO: 9549 - RNA, 68 nt, Human
gaggugccggugggccuguguugcugcgauuuuagucugugcugggaggcagggcuccgcugcgccuc

SEQ ID NO: 9550 - RNA, 76 nt, Human
auuuggacuucuuuacagcuuaagcucauuugcuauuuuugaugcaauguucuuaaaggcaauagaugucccagau

SEQ ID NO: 9551 - RNA, 70 nt, Human
caggcagaccacauuaggcauuaccaguacauucaaaaacuguaccucauauauguauguaucuucccug

SEQ ID NO: 9552 - RNA, 71 nt, Human
agcuaugaaggacaccuacuagaaagcuccacacuugaaggguucucuuaaggugguaacauuuuauggcu

SEQ ID NO: 9553 - RNA, 85 nt, Human
gagaaaccuuuuuaaaaaauggagaugaauguuacaguauuggacaacccgaacugcuuuucaaaaccagaggaaggagguucuu

SEQ ID NO: 9554 - RNA, 77 nt, Human
ugugaugggcucauuguaguucugacaggaaaauaaugcuauacucuuucugguaacuuacuugaaucuuuaucaua

SEQ ID NO: 9555 - RNA, 61 nt, Human
uuugucuuagucuuuuuuuaaagauauaauuuuaauaccuuuaauugucaucuaagauaaa

SEQ ID NO: 9556 - RNA, 82 nt, Human
ccucuugaauaagcucucugccuccuccucccuuucucccuuguggggaaauguuuggaggcaucacuggcauucgaugggg

SEQ ID NO: 9557 - RNA, 80 nt, Human
ggacauaccagugcaguauguugaaugucuguuucuucguuccucgguucucucauuccacaagugcauagguuaugucu

SEQ ID NO: 9558 - RNA, 68 nt, Human
cucaguaucucugauuucugaagauguacaaaaaaauauagcuucauauaucuggaaugagcacugag

SEQ ID NO: 9559 - RNA, 88 nt, Human
ggagaaucgcuugaacccggggggcagagguugcagugagcugaguuugcgccacugcacucuagccugggggagaaagugaaacucc

SEQ ID NO: 9560 - RNA, 85 nt, Human
guuuuuuugguaaagaaaaaauauuuguucuuauguauugaagaaguguacuuuuauauaaugauuuuuuaaaugcccaaaggac

SEQ ID NO: 9561 - RNA, 79 nt, Human
ugaauucagugagauacaaaaagcuccuucuguauuggagaauuccgauggagugaauacaugugauauccugaauuca

SEQ ID NO: 9562 - RNA, 91 nt, Human
ugccugauguccaaagugagcgauacgaauagucucugcaaguagaagugacgagcuggggguguauguacguagcgauggcucgguggca

SEQ ID NO: 9563 - RNA, 89 nt, Human
gcgucgccgcgacugguguuguuggagagcgagcaguuccugacggagcugaccagacuuuuccagaagugccggacgucgggcagcgu

SEQ ID NO: 9564 - RNA, 84 nt, Human; identical to SEQ ID NO: 1447

SEQ ID NO: 9565 - RNA, 87 nt, Human
agucuuguguagagaucuauaaaaucucagggcaauuuacagaauacggaaacauugucuuagaaacacuauucucuccacauuccu

SEQ ID NO: 9566 - RNA, 61 nt, Human
cugagggaaguauaccuguccugccagccuuggucucuggcagggaagguccuuccaacag

SEQ ID NO: 9567 - RNA, 62 nt, Human
gcaacagcaucaccuggaaugaauuccuuuagaacauacugucuuggaaaucugaagccugc

SEQ ID NO: 9568 - RNA, 74 nt, Human
guccagggaaagagcaguaagggucagaagagaaagagccugguguucucacugccuccugccuuccuuaugac

SEQ ID NO: 9569 - RNA, 67 nt, Human
ggcaaagcuggggauuggccagcugacaugcucaggaaguaaaaucggcuuguuaucuccgugggcc

SEQ ID NO: 9570 - RNA, 60 nt, Human
gaagacgaggcugacuauuucugucaaucaacagacaggagugguccuuauccgguuuuc

SEQ ID NO: 9571 - RNA, 66 nt, Human
gcggagggaccaagcugaccguccuaagucagcccaaggcugcccccucggucacucucuucccgc

SEQ ID NO: 9572 - RNA, 70 nt, Human
ugguggugaguaaagacgcugagaggcccucaggaucccugagcgauucucuggcuccagcucaggauca

SEQ ID NO: 9573 - RNA, 65 nt, Human
cuucaaagcucucacaggaagcguuaauacagaguauggaucguguagaucgagaaauugcgaag

SEQ ID NO: 9574 - RNA, 67 nt, Human
gaggcaaacuugaugcuccauccucuccaauuccggggcccccauguggaguugaucaaaaugcuuc

SEQ ID NO: 9575 - RNA, 62 nt, Human
uccaagugauuuauugaugagacaucggcaaacaagcagaagacgcucauaaaaauuuugga

SEQ ID NO: 9576 - RNA, 69 nt, Human
uguaauuguuaaaugugcaugacuuaaauguuaaaauccuguauuuuaagauagucuucugcaguuaca

SEQ ID NO: 9577 - RNA, 68 nt, Human
gcagcacgucaucugcgacaagguggggcugcagaagauccccaaggugucagagaagaccaagcugc

SEQ ID NO: 9578 - RNA, 69 nt, Human
cagugugacaagugccgggagaucuugucuguggacuguuccaccaacaaccccucccaggcuaagcug

SEQ ID NO: 9579 - RNA, 61 nt, Human; identical to SEQ ID NO: 347

SEQ ID NO: 9580 - RNA, 61 nt, Human
gggagcucgacgaaucccuccaggucgcugagagguugaccaggaaauacaacgagcugcu

SEQ ID NO: 9581 - RNA, 87 nt, Human
ggaguuuugcacuaucaccaggcuggagugcaguggugcgaucucggcucaccgcaaccuccaccucccagguucaagcaauucucc

SEQ ID NO: 9582 - RNA, 60 nt, Human
aacaaaaaguacuaaaugaaucccuauauuuccauuauaguauuuauguauuuuuauguu

SEQ ID NO: 9583 - RNA, 71 nt, Human
cauucuagggaaagaauacaggcggaugacacuuguguuacaguguuauuuuaacuguauuaccuggaaug

SEQ ID NO: 9584 - RNA, 92 nt, Human
gggggcgccugaguacuccccauaguuugccagcucguuugacacccccuagaucacagaugguaucgcuguacacgacagaggcgccaccc

SEQ ID NO: 9585 - RNA, 104 nt, Human
uuuauauguuuucuauuaguaauuuccuuugcacuaugcuuuauuuuaaucaaguuuggaauugagucaaagucacaucauaagcauacuggaaaaccuauaag

SEQ ID NO: 9586 - RNA, 64 nt, Human; identical to SEQ ID NO: 1375

SEQ ID NO: 9587 - RNA, 92 nt, Human
uuuuuuuuuuuuuuuuuaaaaaggacauauuaaauguauuuaaaucugggcuuuucuguacuuaauuuuucuucuaaaaaaaaguuuaaaaa

SEQ ID NO: 9588 - RNA, 94 nt, Human
cggccgucgggugugagcugcgccgaccgcucugaggguucguggcccaccgcuccuucgcggucccugccgccaccguacacgcucagcgucg

SEQ ID NO: 9589 - RNA, 67 nt, Human
gggaaagcugguacgccugcagguaccgguccggaauucccgggucgacccacgcguccgcuggccc

SEQ ID NO: 9590 - RNA, 69 nt, Human
gccaagguuuguacacgacucccaucuaggcugaaaaccuagaaguggaccuuguguugugugcauggu

SEQ ID NO: 9591 - RNA, 71 nt, Human
gcccaaagccaggcugagacaguccucauauccucuugagccaaacuguuugggucucguugcuucauggu

SEQ ID NO: 9592 - RNA, 67 nt, Human
gguggcuauucccaguguggggugguuuuccaacccaaaagcgccccagauguggggaacagcgauc

SEQ ID NO: 9593 - RNA, 96 nt, Human
cucuugacagaucuuggucucaacaauaaauucguuggggaagugucuaaucuuccagcauuuaucaauggcacguuuguugaaacccagcaagag

SEQ ID NO: 9594 - RNA, 69 nt, Human
gaguaucccauaaaccuuaauguuaaagucauauuguaaaucucugacuucuuauuaccaaggacacuc

SEQ ID NO: 9595 - RNA, 71 nt, Human
ggaaggacuuucuguuauugcaaaguugguaaauaaagaugccaagguuacuaacaucacgaauuuccucc

SEQ ID NO: 9596 - RNA, 67 nt, Human; identical to SEQ ID NO: 8241

SEQ ID NO: 9597 - RNA, 64 nt, Human; identical to SEQ ID NO: 8242

SEQ ID NO: 9598 - RNA, 64 nt, Human; identical to SEQ ID NO: 287

SEQ ID NO: 9599 - RNA, 89 nt, Human; identical to SEQ ID NO: 288

SEQ ID NO: 9600 - RNA, 116 nt, Human
cgguauuuaacuuuuuggcaaaauagaagcuuuggucauagccauaguucuuuaaaaauuuuuuuaaagagguuaucucugauuaaaacaauauuuuuagcaagugccucgugccg

SEQ ID NO: 9601 - RNA, 91 nt, Human
ccuuuuauccuucgaauaggauuagauguuuaaaaaaaaguucuucugugggaacuaauauuugauauuuuaaccuaccagaguaaacagg

SEQ ID NO: 9602 - RNA, 66 nt, Human
gcaggugaaagugaagucacagaaacgucucgguguuuuuuuucugcugauuuacaucuuuccugc

SEQ ID NO: 9603 - RNA, 70 nt, Human
uugccaaccugagucgggaugcggaggauauuggggguuucuuccaugacccugacaagcagguugucaa

SEQ ID NO: 9604 - RNA, 61 nt, Human
uuuuuuuuuuuuuuuucagcaucaugaacauuuauuaugauuauuuuauuuaaaaaaaaag

SEQ ID NO: 9605 - RNA, 80 nt, Human
gagguuggaagaaugacacgggcucaggacacagagugaggacucaugucuaaugagcaccggccaaaacuuccaucuuc

SEQ ID NO: 9606 - RNA, 83 nt, Human
ggcuaccucggaccugaacagcugccugacugccugaaagguugugaugugguaguuauuccggcuggaguccccagaaagcc

SEQ ID NO: 9607 - RNA, 74 nt, Human
ucuggaggcaucgggcagccacuuucacuucuccugaagaacagccccuuggugagccgccugacccucuauga

SEQ ID NO: 9608 - RNA, 65 nt, Human
aggcagggcaccugggggaugcuggggccaucggcucucagauggcaacucccagggcccagucu

SEQ ID NO: 9609 - RNA, 66 nt, Human
gguucuguacaggagaaaggacucacaggagggagggacacugucuucagggggcucucuggagcc

SEQ ID NO: 9610 - RNA, 61 nt, Human; identical to SEQ ID NO: 823

SEQ ID NO: 9611 - RNA, 70 nt, Human
ucaaaaacaugauuacagggacaucucaggcugacugugcuguccugauuguugcugcugguguugguga

SEQ ID NO: 9612 - RNA, 64 nt, Human; identical to SEQ ID NO: 175

SEQ ID NO: 9613 - RNA, 66 nt, Human
uuucggcgcugggucgcccaaagcagaauggagacggauagagugguggcucccaaaaucccgaag

SEQ ID NO: 9614 - RNA, 61 nt, Human
agggugcaaugaauguguuacuuucguauucccaguaacuaccuuuccucaccugcucccu

SEQ ID NO: 9615 - RNA, 73 nt, Human
auuucccccuccuuugggugaauuccucucuugauuagcucaggaacggaaugugauccaaucugggcaaaau

SEQ ID NO: 9616 - RNA, 60 nt, Human
gaaaccuacuuugaaguuauccccacuauuauuauggggguuaaggagcuaguagauuuc

SEQ ID NO: 9617 - RNA, 100 nt, Human
gccaagcauauguucuucacagagcccacaucuguauuuuguggugauuuauuggaauccuauaugagagugugcuuuacugagaaugauuaugcugggu

SEQ ID NO: 9618 - RNA, 71 nt, Human
cagacaccagcuucccaucacgugucucgaucuucuucacaaccacggcccuggaggagcuggugcggcug

SEQ ID NO: 9619 - RNA, 60 nt, Human; identical to SEQ ID NO: 7431

SEQ ID NO: 9620 - RNA, 92 nt, Human
ggcaugggcaagggggguccccagguaguaaacuccccaggugggcugagggcuagggcugagccucaggugggucuccuguucccagugcu

SEQ ID NO: 9621 - RNA, 66 nt, Human
aaagaaguaugaggaauacuugaccaauaaccaaaguauaguuauuuauuuguuaaugacuucuuu

SEQ ID NO: 9622 - RNA, 66 nt, Human
caaauguaguuguauuucaagguuugguccaaagaccagagaaucccuaaguaggaagacaguuug

SEQ ID NO: 9623 - RNA, 71 nt, Human
uuauugcccauucugggaguguugagcguuuuaaguuugcuaugcuuguaaaaaucaaugaauggcaaugg

SEQ ID NO: 9624 - RNA, 66 nt, Human
aucuucucagaaaaccaaaccaaaggcagccaugaaaacccguguucuguacgugguugagaaggu

SEQ ID NO: 9625 - RNA, 101 nt, Human; identical to SEQ ID NO: 3418

SEQ ID NO: 9626 - RNA, 68 nt, Human; identical to SEQ ID NO: 1919

SEQ ID NO: 9627 - RNA, 81 nt, Human; identical to SEQ ID NO: 5988

SEQ ID NO: 9628 - RNA, 69 nt, Human
ggcgccgccccacucgccccagccgccgccaugaaggccguggugcagcgcgucacccgggccagcguc

SEQ ID NO: 9629 - RNA, 106 nt, Human
cugugagacugaagagccuccuuggaacgaacuaauccugaaagaagaacuacuugugaagggcaaacaguuuaguucaagaaagcaaggcuaugcaauaccacag

SEQ ID NO: 9630 - RNA, 73 nt, Human
gccaugucuuaagagcgggaagaaaaagcagcaaacaggcucuaucuccacaggcucuggggacagugacggc

SEQ ID NO: 9631 - RNA, 117 nt, Human
ccucucucugugugggaccaggacaguggcuuaagucuccacuccaggaaagaaucaaaguuucuagaguugugagaaaaccagagaguggcuguccugauucuucacugugagggg

SEQ ID NO: 9632 - RNA, 104 nt, Human
ugagaaaaaagagggccauuuaaaggggccuggggcaccaaacaauggaaccuuuggaaacggaacccggggacccucgaaaaaaaacuggucccucgugcuua

SEQ ID NO: 9633 - RNA, 69 nt, Human
ggagcgccuggucggagccugugucgcugcugacgccuagcgaccuggacccccucauccugacgcucu

SEQ ID NO: 9634 - RNA, 61 nt, Human
gcccuguugccgaccgaggacugaccacucgaccagguucuggguugacaaauaucagggu

SEQ ID NO: 9635 - RNA, 84 nt, Human
acgugcccucgcgggucuugaggcuguagauggagcagauguuguccaaccccccacaggccacaaaguucccugagggcgcgu

SEQ ID NO: 9636 - RNA, 78 nt, Human
cccaggaggagcgcagcgggauggcguggaccuuguuggugguguagcugucccagaugaugagcuucccauccuggg

SEQ ID NO: 9637 - RNA, 74 nt, Human
cuggggcucaccgcaauccuuccaacucucagccuccacagguagcuggggauaacggggcugugagccacugg

SEQ ID NO: 9638 - RNA, 75 nt, Human
gagcuuaucauuuaaccagucccaaccccauaagugucgccuagcccagagggucggccugggggaaccgagcuc

SEQ ID NO: 9639 - RNA, 77 nt, Human
guugggagcuucuugcaauguggacuccuggagaugacugggucaagcuccuggauaguuaacguagcgaucuuggc

SEQ ID NO: 9640 - RNA, 64 nt, Human
gggcgcuugggcuggggggcccuuguugcggcaucacgugcauaaggugaacucgguggcgccc

SEQ ID NO: 9641 - RNA, 109 nt, Human
ccgcgguggcuuccgcggagguuucggcaguggcauccggggccggggucgcggccguggacuggggccuggggccgaggccgcggagcucgcggaggcaaggccgagg

SEQ ID NO: 9642 - RNA, 67 nt, Human
gucuugugcccacacugagccagcaaaguccugcugucacacccacaagcuccuugggggacaggac

SEQ ID NO: 9643 - RNA, 65 nt, Human; identical to SEQ ID NO: 2198

SEQ ID NO: 9644 - RNA, 87 nt, Human
cuuugucagaauaugucagaaaacaaaacaaaaaaaguuuuaaaugcuaaagauuuuaaaaauuaguucucugaaauuucuguaaag

SEQ ID NO: 9645 - RNA, 90 nt, Human
gagcacgggcucaugugacaccagccccgacaccgucucgcccucccugagccccggcuucgaggaccugucccaugugcagccugucuc

SEQ ID NO: 9646 - RNA, 94 nt, Human; identical to SEQ ID NO: 2800

SEQ ID NO: 9647 - RNA, 67 nt, Human
gccagaaacuauauuuguucaaauauauugaaaagguauaagaauacaaauagauauuaacaguggc

SEQ ID NO: 9648 - RNA, 63 nt, Human
uccuuuaaagugauuuugucaugaaagagucaucugaaaugacucucgugauggaggaaagga

SEQ ID NO: 9649 - RNA, 66 nt, Human
cggcugcccaggcccugccuuggcaugugugucuccagagcgugcccggccaggccaucccagccg

SEQ ID NO: 9650 - RNA, 74 nt, Human
gccggagcgcgcggggccggaagaggcgggcggccaguggagguccgcagaguuugggcgccaggcgagacggc

SEQ ID NO: 9651 - RNA, 77 nt, Human
auguguguguguguauauacacacacauauauaaauuagaauuugcagauauuauguguauauauauacacacauau

SEQ ID NO: 9652 - RNA, 68 nt, Human
ucuaaaccuuugccaucaccaucuauguguccaacaucaacacugugaugaaguuguuccuguuuagg

SEQ ID NO: 9653 - RNA, 60 nt, Human
agugcgauuuucaacacguauagugaaaaaauuuauuuuuuauuaaaauugcguuguacu

SEQ ID NO: 9654 - RNA, 72 nt, Human
auuauuagagacaagaguaccaaagcgguguguguuuuuugugugugugguuuggcugucguuuguggugau

SEQ ID NO: 9655 - RNA, 65 nt, Human
ugugugggcgcugcuuccaggauaaggagacugaggcuuagagagaggaggcagcccccuccaca

SEQ ID NO: 9656 - RNA, 66 nt, Human; identical to SEQ ID NO: 3532

SEQ ID NO: 9657 - RNA, 76 nt, Human
ggugucggcuccgucaaccacuuuugugcaccuguccccacgaggacacauggacaauagugcgacugcugagacc

SEQ ID NO: 9658 - RNA, 67 nt, Human
aaaaaccccgcacuguggcaacuucuucucuuuuucagccuagaaaugucuguguuaagugguuuuu

SEQ ID NO: 9659 - RNA, 74 nt, Human
guuugacugaauucuucaaaaaugucaaugucauagaagacaaagaaagguuguggaaauguuucagauuaaau

SEQ ID NO: 9660 - RNA, 113 nt, Human
gauuccauaagaggccuggaaaagcucaguucugccucagagaguccacguccagaagagcauggacuggagaagcucaguggggaaagcugggaaaagcugggagaggaguc

SEQ ID NO: 9661 - RNA, 84 nt, Human
ucaaucaaugaaaugcaaagcgcacaaguaggcuccagggucccccagggcagaauugaugugugauugcagcacugggauuga

SEQ ID NO: 9662 - RNA, 64 nt, Human
gcccaagcccuagcugauugguacagccccaugugauccccguaacagacaggguuccuguggu

SEQ ID NO: 9663 - RNA, 62 nt, Human
guauuugaggaacuugucugacuuuaagugugagguucuaggagaccaaguaacacagauau

SEQ ID NO: 9664 - RNA, 64 nt, Human
guucgagggugcgccgugucuuuugcgugguaccagcggugacaugacgggguacacuccggau

SEQ ID NO: 9665 - RNA, 64 nt, Human
ccccccugggaagggaugcagagacggggagcuucucuguauccccuuacaggcaggacagggg

SEQ ID NO: 9666 - RNA, 93 nt, Human
gggacugcaagggcgggcuguauugagaaggauggcccccuggugugaugagcuuggggccucaucugcucaccgugcacgcccuggaguccu

SEQ ID NO: 9667 - RNA, 61 nt, Human
uuggagaccgaccaagccucucuguugggcaggacuugagggguugggccugugucuccag

SEQ ID NO: 9668 - RNA, 61 nt, Human; identical to SEQ ID NO: 6171

SEQ ID NO: 9669 - RNA, 79 nt, Human
cuguggugggacggccaaaagacaggcggggggccuacacuccaaagcuugagaaggaaauggccgcaauuuaccgaag

SEQ ID NO: 9670 - RNA, 65 nt, Human
cuuucuugauuaguaucuacaaggcacuuaaugcacauuuucagugaggaagcugauggagagag

SEQ ID NO: 9671 - RNA, 62 nt, Human
guucucuagaaguauguuacuggcucuuaaaagauuucacaaaaauacgcuuugaggagaau

SEQ ID NO: 9672 - RNA, 64 nt, Human
agacgcucuuugugcuagggugaugucaauuggacagauucucccuuucuucacaaugggcucu

SEQ ID NO: 9673 - RNA, 90 nt, Human; identical to SEQ ID NO: 1501

SEQ ID NO: 9674 - RNA, 77 nt, Human; identical to SEQ ID NO: 2332

SEQ ID NO: 9675 - RNA, 80 nt, Human; identical to SEQ ID NO: 367

SEQ ID NO: 9676 - RNA, 68 nt, Human
agaauuugcauacuuaccuagugaaacuuuucuagaauuauuuuucacucuaagucauguauguuucu

SEQ ID NO: 9677 - RNA, 63 nt, Human
uuugauuauuugcauguuauguuuaauaagcuacuagcaaaauaaaacauagcaaauggcaaa

SEQ ID NO: 9678 - RNA, 90 nt, Human
cuucaucugguguugagacuucgggguggugcuaagaaaaggaagaagaagucuuacaccacucccaagaagaacaagcauaagaggaag

SEQ ID NO: 9679 - RNA, 65 nt, Human
gguuaaguuggcugugcugaaauacuauaagguggaugaaaauggcaaaauuagccgacuucguc

SEQ ID NO: 9680 - RNA, 78 nt, Human
guuuucaugggaagccacuuugacaggcauuacuguggcaaguguugucugacuuacugcuucaacaaaccagaagac

SEQ ID NO: 9681 - RNA, 92 nt, Human
cauggccaagcggcugagccaaauugggguggaaaacacagaggagaaccgccggcuguaccgccaguccauguucagugcugaugaccgug

SEQ ID NO: 9682 - RNA, 60 nt, Human
gaugauaaugguguucccuucguccgaaccauccaggauaagggcaucgucgugggcauc

SEQ ID NO: 9683 - RNA, 66 nt, Human
ucagaacgcugugcccaauacaagaaggauggugcugacuuuugccaaaguggcgcugugugcuga

SEQ ID NO: 9684 - RNA, 87 nt, Human
aagguaaugcucauuuagacugacacagguaugaaaauuccaaucccuucuuuucacuaucauuguaucugacacacacaucaccuu

SEQ ID NO: 9685 - RNA, 90 nt, Human
cugguacuccucauggggcuugaccauuaucacacagguggggcgcuuggagcugcgcugcacccaggucccgucuuagaggggauauag

SEQ ID NO: 9686 - RNA, 80 nt, Human
aguucuccaaaagacaaaacagaacaauuauuauaacaaaauaauuaugguugaaaugucugugguuccuuggaaaugcu

SEQ ID NO: 9687 - RNA, 89 nt, Human
cugugaauacuauuuggagggucccuggucagacauuuaaauaucaaacuuaagaacugacauggagccuuugauuaguuuauauacag

SEQ ID NO: 9688 - RNA, 65 nt, Human
ucauuucuaccaauaauuucagauguuuaaugggacuuugaaaagauaggaaaaaauagaaauga

SEQ ID NO: 9689 - RNA, 80 nt, Human
gagaaaaauaaaaagauccaugaaugucaucuuuuaucuuuuauuuucaguuggcugauguuggaauuuuuguucuuguc

SEQ ID NO: 9690 - RNA, 68 nt, Human
cggccgcggccaaucggagccgcucuugcugcgacgcagcggucggaagcggagcaaggucgaggccg

SEQ ID NO: 9691 - RNA, 67 nt, Human; identical to SEQ ID NO: 3685

SEQ ID NO: 9692 - RNA, 60 nt, Human
uuaucuguaagcucucagcacugaucauggccugugggugugcaacaaguuuggggauaa

SEQ ID NO: 9693 - RNA, 63 nt, Human
ccuccggcuugagcucaccaccuaccucuuuggccaggacccuugaccagccaggccugaagg

SEQ ID NO: 9694 - RNA, 66 nt, Human; identical to SEQ ID NO: 3532

SEQ ID NO: 9695 - RNA, 60 nt, Human
guggaaccacgcugcuugaggcucuggacgugcauuccuagcagcaaaguccgguuccau

SEQ ID NO: 9696 - RNA, 82 nt, Human
ugucacuguuggacgauuggcagaauggauguccucaaaacccggaaugggggccaccauuugguccaggucaacgguuaca

SEQ ID NO: 9697 - RNA, 61 nt, Human
uguggggugcccccgaugggaggcugucccaucucccaguccccaucucuuuuuccccaca

SEQ ID NO: 9698 - RNA, 60 nt, Human; identical to SEQ ID NO: 1551

SEQ ID NO: 9699 - RNA, 77 nt, Human
gggaccauuggaccucgaggggcacggggaagcgccuauuauaaccccugugaaccccugagggauacaugggaucc

SEQ ID NO: 9700 - RNA, 103 nt, Human
cgagguuguggugucugggaaacuccgaggacagagggcuaaauccaugaaguuuguggauggcugaugauccacagcggagacccuguuaacuacuacguug

SEQ ID NO: 9701 - RNA, 67 nt, Human; identical to SEQ ID NO: 1146

SEQ ID NO: 9702 - RNA, 76 nt, Human
uguucuuggugagaagggccggcggauucgggaacugacugcuguaguucagaagagguuggcuuuccagagggca

SEQ ID NO: 9703 - RNA, 78 nt, Human
uaagauucugcugaggagcccccgcuggucccucugggcaugcugugcucggacggaaagcggggcugcggguccuug

SEQ ID NO: 9704 - RNA, 86 nt, Human
accccagccuuucugcagaugucccuaagguagagguguggaacgggagcuggccuggcugaaggagcaucugucccagcuggagu

SEQ ID NO: 9705 - RNA, 88 nt, Human
gcuacaacuucugaagggucucaaugccaggaagccucccgcuccuaaacagcguguucgcuucuugcugggccccauggaaggcagc

SEQ ID NO: 9706 - RNA, 61 nt, Human
caccuugggaaggggguuccuggugguccugugacaaccagagacccccaggcccaaggug

SEQ ID NO: 9707 - RNA, 67 nt, Human
ggcagguguuugaggaggcccugcacagggucccaggacugcaccagggccucaucagcaaccugcu

SEQ ID NO: 9708 - RNA, 65 nt, Human
ggugacaacaugcuggcagccaagugcuaacaugccuuggcuucaagggcauggaacacgucacc

SEQ ID NO: 9709 - RNA, 80 nt, Human; identical to SEQ ID NO: 174

SEQ ID NO: 9710 - RNA, 64 nt, Human; identical to SEQ ID NO: 175

SEQ ID NO: 9711 - RNA, 65 nt, Human
uuucggcgcugggucgccaaagcagaauggagacggauagagugguggaucccagaaucccgaag

SEQ ID NO: 9712 - RNA, 61 nt, Human
uucguuuguuauuuguguuuguggcuugucuuaugucgugauagcacaagugccagucgga

SEQ ID NO: 9713 - RNA, 73 nt, Human
ugaucuuacuggacauuuuaugguucaaguauucaacuagcuuauuagaauacucccuaaaugcaguagauua

SEQ ID NO: 9714 - RNA, 63 nt, Human
gagccugccucccucuuggccucucauccauuggcucaugcagggcaggggugaggcagguuu

SEQ ID NO: 9715 - RNA, 63 nt, Human
uacuguguuucucuuuugggggagcuuaacugcuuguugcucccugucgucugcaccauagua

SEQ ID NO: 9716 - RNA, 72 nt, Human; identical to SEQ ID NO: 1989

SEQ ID NO: 9717 - RNA, 73 nt, Human
gcgcugaggccggcggaggcgguguccgagcccacgacgguggcguuugacgugcggcccggcggcgucgugc

SEQ ID NO: 9718 - RNA, 72 nt, Human
guuuucuaccugggcugacguugccuuguccggaggggcuugcaggguggcugaagcccuggggcagagaac

SEQ ID NO: 9719 - RNA, 86 nt, Human
ggcuugcaggagcuuucgggacacuuugagaaccagaaggugauguacggcuucugcagugucaaggacucccaagcugcucugcc

SEQ ID NO: 9720 - RNA, 95 nt, Human
aggagagggaagaggugauaugagccuccucugugcucugacagagaaauguccaauuccagaucaaaggcaucauugccacccucuccucuccu

SEQ ID NO: 9721 - RNA, 73 nt, Human; identical to SEQ ID NO: 2843

SEQ ID NO: 9722 - RNA, 78 nt, Human; identical to SEQ ID NO: 2844

SEQ ID NO: 9723 - RNA, 70 nt, Human; identical to SEQ ID NO: 2845

SEQ ID NO: 9724 - RNA, 89 nt, Human
ggccaaggcagucgccagggcuucuuguccccaccuucugaaccuucuucaaacaguaguacaagcuccccucagccagccugccugcc

SEQ ID NO: 9725 - RNA, 60 nt, Human
gguguuggcgggggcggagggcaggggaacgggauccuucucccgcugcccaccaacacc

SEQ ID NO: 9726 - RNA, 63 nt, Human
gcaggugucaccagccgccaucaagaagaccauccuggacaaggugaagcuggacuccccugc

SEQ ID NO: 9727 - RNA, 81 nt, Human
ccucuagguaaagguuccaaggcaugccccaagagcaccuccuccucacccuucuggggacauuccuguagcaaccagagg

SEQ ID NO: 9728 - RNA, 60 nt, Human
gaccccagaugaggccuccagucaccucugguaacgucccccaggcaaagcucugagguc

SEQ ID NO: 9729 - RNA, 64 nt, Human
gaugguguaaaugguaaacgugauaucaugagacauuccugauaucucacaccaacacauuauu

SEQ ID NO: 9730 - RNA, 63 nt, Human
uccuuuauugaaaauauugggauagcacugcauuacauauagucaauauccauaaaugaaggg

SEQ ID NO: 9731 - RNA, 69 nt, Human
gcgggcguuuucguggcggaauggcguccucacugagcgcucagccaccaccgcgggacucgcgcucgc

SEQ ID NO: 9732 - RNA, 79 nt, Human
aggccugcucucggggaggguaccgugcauccuugcagauggaaacgccuucaugcuggaccaggccgagggcaggccu

SEQ ID NO: 9733 - RNA, 61 nt, Human
uuuuuuuuuuugaaguucaccggaaccccucaaauauuccugggaacuucaaacaaaaaaa

SEQ ID NO: 9734 - RNA, 107 nt, Human
ggauggaugagcagagggagcggguacuggcagcaacuccggcccuaggcagaggguucgauacucccagccugaguugcagggccugcccuucugcucucccagcc

SEQ ID NO: 9735 - RNA, 73 nt, Human
ggugaagguuuuaucagagcccagggcagacucaguggcuuccuauccagggcucuucccacagcucgucacc

SEQ ID NO: 9736 - RNA, 67 nt, Human
ucugcccacucccauccucuccccaagcucccauuucuccagggcuugucccugcggugugggcaga

SEQ ID NO: 9737 - RNA, 68 nt, Human
cagguccagcccuggggcaaguaacuggaaggguuuauaggcccccugaauaaaggcuauggcgcuug

SEQ ID NO: 9738 - RNA, 89 nt, Human
ccccaccaaacuaaaugaucaggucauuggaggugaagggguucaugacugcuggacagagaaugaaauaucauguuuauuuggugggg

SEQ ID NO: 9739 - RNA, 69 nt, Human
ggcugccuaauuaacugcuuugugcauguuccuaucuggagacagugcugagggguuagggccagagcc

SEQ ID NO: 9740 - RNA, 108 nt, Human
gggucuaaugcuauuccaaaagguuacuucucaaauuagggaaaccugggaauuugaagcgauacagguccagcccuggggcaaguaacuggaaggguuuauaggccc

SEQ ID NO: 9741 - RNA, 64 nt, Human
ggaccugucaccccaccauggagaaaagagucuuuugguucuuuuuaacauaagugauuaguuu

SEQ ID NO: 9742 - RNA, 61 nt, Human
cucugaugccaggaaugccaccaguuaugccaggcaugccaccuggauuggcucaucagag

SEQ ID NO: 9743 - RNA, 62 nt, Human
gccacugucacaggauccuuagggugucacuucaccagcuggagacuucuguggccaguggc

SEQ ID NO: 9744 - RNA, 113 nt, Human
ucugucacucauaguccggaaacucauggaucugucagaacuacgaccauucucuaaaccagaaauagcacugacagaagcccugaggcuuuuggcugaugaggauugggaga

SEQ ID NO: 9745 - RNA, 66 nt, Human
uuucauucugagauacugaacacaaaguugcuugcaacaaauuuugcaguuguucaagaggugaaa

SEQ ID NO: 9746 - RNA, 76 nt, Human
cuggccagcggaaaguuuuauuuaccuguuucaagaggaaugauaaacgugaaguaaaaguugcccaguuggcugg

SEQ ID NO: 9747 - RNA, 81 nt, Human
cagggcagaagcaugaaaggacaccaaccacgagugacacacuauacuauggcuguccugugucacaugcuauuuggccug

SEQ ID NO: 9748 - RNA, 72 nt, Human
ggaggccaagguggaucaccugaggucaggaguucgagaccagccugaccaacauggugaaaccccgucucu

SEQ ID NO: 9749 - RNA, 75 nt, Human
ccuggaggccgaguggaaacuggcagucccaaacccggaaggacggccaccuagauccagccaccgguacacagg

SEQ ID NO: 9750 - RNA, 60 nt, Human; identical to SEQ ID NO: 1551

SEQ ID NO: 9751 - RNA, 79 nt, Human; identical to SEQ ID NO: 1810

SEQ ID NO: 9752 - RNA, 68 nt, Human
uaggaaugaacagaaagaauuauaaauuuaagugaaacucaaguuguaugccaaaaauaacauuccua

SEQ ID NO: 9753 - RNA, 68 nt, Human
cccggacccgcagggcugccugguuccuggaagucuucccagucuucccagccagcccgggcccuggg

SEQ ID NO: 9754 - RNA, 61 nt, Human
ccgagcccagacugucagguccgagcacagugcagguuauggucugacguugggccuuugg

SEQ ID NO: 9755 - RNA, 75 nt, Human; identical to SEQ ID NO: 2950

SEQ ID NO: 9756 - RNA, 96 nt, Human
uccucgucaacagcaaccuggucugcagggugucugacuuuggccugucccgcgugcuggaggacgacccuaagaaccggaugcugcuuauggaga

SEQ ID NO: 9757 - RNA, 61 nt, Human
aagcuccacacauggcagucacggcgucugaugaagaaaacgugagguggccaugaugcuu

SEQ ID NO: 9758 - RNA, 66 nt, Human; identical to SEQ ID NO: 3532

SEQ ID NO: 9759 - RNA, 65 nt, Human
ggugacaacaugcuggagaccaacuugcuaacaaugccuugguccacggcgaugcgcaagucacc

SEQ ID NO: 9760 - RNA, 62 nt, Human
gcugacacgggaugcaguacagcaccgauuucacaguucgcuuaugcaauccuggagucagc

SEQ ID NO: 9761 - RNA, 70 nt, Human
ucucccgcaguccuacccagccuuuuaacuugcuaaaaggagaggcuguguuuuuagcaucuuugggaga

SEQ ID NO: 9762 - RNA, 62 nt, Human
caagauucuugauacugcacucucuaagauuggagagaaaagccuguuuaccaaggagcuug

SEQ ID NO: 9763 - RNA, 67 nt, Human
cccuggaggagaucuaucucuucugccugcccauuaaggaaucagagaucauugauuucuuccuggg

SEQ ID NO: 9764 - RNA, 108 nt, Human
acaagcugcugucuuugcaccuugguccuuggccaagccuccccuugccacgggggcaugggaugaccugugaacgagacagggugcaggagucacagcauagcuggu

SEQ ID NO: 9765 - RNA, 77 nt, Human
gagacuggauggcuuuucauugacaugguagagaggaaauggaucaaauccaccaaugaaaucaaagcuguccucuu

SEQ ID NO: 9766 - RNA, 63 nt, Human
gauggacucauuuccugguccuuaaagaugcagccucuuaagggcuccuugauggaugccauc

SEQ ID NO: 9767 - RNA, 64 nt, Human
gccaggcccagccucauaagccacaacuugggaacaacgugcacaugggauccaugggcuuggc

SEQ ID NO: 9768 - RNA, 66 nt, Human
cuugcuuugaguuggaagcgguuugcauuuacgccuguaaauguauucauucuuaauuuauguaag

SEQ ID NO: 9769 - RNA, 73 nt, Human
uagaaauguuuaagauugaagauguccaauauuuuuaaaacuggacauuaccauauacagguagacauuucua

SEQ ID NO: 9770 - RNA, 62 nt, Human
uuuuuuuuuuugagcaugaaaauaaaucuuuauuuucaguuauuacccaccaauaagagaaa

SEQ ID NO: 9771 - RNA, 85 nt, Human
agacaguuauucaguugagacauguauuacaucauuucuuacuuuucaaggaaaaacauguuuuacaacuugaguuuaucugucu

SEQ ID NO: 9772 - RNA, 77 nt, Human
gcugcacagcugggagaaacaggugucuucacaaugccuggggaaaggugagagauaaggcuucacuagcauacagu

SEQ ID NO: 9773 - RNA, 66 nt, Human
uuuaagcauuucauggggugagaggggagaucugugcagggggaagcuuacuacagaagugagaaa

SEQ ID NO: 9774 - RNA, 92 nt, Human
guuuccuucauuguuuuuggaaauuuuguuuugguuuauaaaacauagaaauagccaacacuuaaagcaaacauucaaaaccccaaggugac

SEQ ID NO: 9775 - RNA, 77 nt, Human
gcccgcguggccuucuccucguaggacucccaaacucguucacucugcguuuauccacaggauaaagccacgcuggu

SEQ ID NO: 9776 - RNA, 79 nt, Human
gggcucagcccccuucccccacgucacgucugcaucacuacugugggugagccuggacggacgggggcuggggcugccc

SEQ ID NO: 9777 - RNA, 68 nt, Human
caggugaaggcaccuggcugaccaucaaugcuuuccacauuguauucaucaccagucaccuccacuug

SEQ ID NO: 9778 - RNA, 66 nt, Human
uuuuuuuuuuuuuuuuuaguugcuguucauaaguuuauuaucuauaucugaaaaaaucauagaaaa

SEQ ID NO: 9779 - RNA, 64 nt, Human
auauauacuuuuauauauguguaaauauuaaauauauauguucacauaaauauaaauuauauau

SEQ ID NO: 9780 - RNA, 68 nt, Human
ucaacugaaagaguuuaggaacuuacucacugaacaguaguauaacaguuaucuuacuuaacagcuga

SEQ ID NO: 9781 - RNA, 67 nt, Human
cagcaccacagucucuauggugggagccuuaaaagggcccccuucuugcuucccuaucugucgucug

SEQ ID NO: 9782 - RNA, 61 nt, Human
cccgcgcgcccggugcagggagcccgaguccagcggguuaccuggcggcgggcgggcgcgg

SEQ ID NO: 9783 - RNA, 71 nt, Human
cggggguucggggggaugcccaggcccggugagcucgcucuccgccugggcacuugggcuccgggcccuug

SEQ ID NO: 9784 - RNA, 77 nt, Human
gggggggacuuuggcgacccgggucagccggccgcccccugggcugcuggugggcgucgggcggcggcuccuccccc

SEQ ID NO: 9785 - RNA, 81 nt, Human
gcugauuagcagauauccacaaacauagcuaugaaguucugacugggauaaccuugcuguuugucuauuuugcagucuugc

SEQ ID NO: 9786 - RNA, 88 nt, Human
uugcuguuugucuauuuugcagucuugcuaaauuuguuuguucuuguugugauuugguuuuuguugcuuucuggaauuuaggcaguga

SEQ ID NO: 9787 - RNA, 75 nt, Human; identical to SEQ ID NO: 9063

SEQ ID NO: 9788 - RNA, 68 nt, Human
gaagaaaacgaaaagaagaaacaaaagaaagcaucaugaugaauaaaaugucuuugcuuguaauuuuu

SEQ ID NO: 9789 - RNA, 63 nt, Human
aguggcucacaccugugcacgguggcuccuagcacuuugggaggccgaaguggguggauugcu

SEQ ID NO: 9790 - RNA, 72 nt, Human
gguugaagauaacgaggcagugggcugacuggugaaaacuaaaucaucuuuuguccuucaaagucuugggcc

SEQ ID NO: 9791 - RNA, 130 nt, Human
ugggcaacauggcggaacccaucucugcuaagaauacaaaaaaucagcuggaacugcaggcaccugccaccaagccccggcugauuuuuuuguauuuuuugguagagacaggguuucgccauguuggccg

SEQ ID NO: 9792 - RNA, 64 nt, Human
gaguucuacauugauugauaccacaauuuugaucuaacaucacuguguucauucuaaacuucuc

SEQ ID NO: 9793 - RNA, 68 nt, Human
uauauaugcauguguaugcauagacaccuaucuaaaucuaguuguguguguguguguguguguguaua

SEQ ID NO: 9794 - RNA, 84 nt, Human; identical to SEQ ID NO: 286

SEQ ID NO: 9795 - RNA, 89 nt, Human; identical to SEQ ID NO: 288

SEQ ID NO: 9796 - RNA, 94 nt, Human; identical to SEQ ID NO: 5398

SEQ ID NO: 9797 - RNA, 60 nt, Human
caccaguggccaucugagguguuucccuggcucugaagggguaggcacgauggccaggug

SEQ ID NO: 9798 - RNA, 89 nt, Human; identical to SEQ ID NO: 288

SEQ ID NO: 9799 - RNA, 92 nt, Human
caugcagcuaauuuuuguauuuuuaguagagaucggauuucaccauguuggccagucuggucucgaacuccuggccuaaagugaucugccug

SEQ ID NO: 9800 - RNA, 73 nt, Human
ugugugugaugagaacauguuugggccaauuaagauauuauacuucacaaauacuugcuuuauauuuacacca

SEQ ID NO: 9801 - RNA, 64 nt, Human; identical to SEQ ID NO: 287

SEQ ID NO: 9802 - RNA, 92 nt, Human
uaagcaccagaucauaugggauguggaaauacuggcuucaguguaagcuucacucuauuccaggguucacacucaacaauugaugguguuug

SEQ ID NO: 9803 - RNA, 70 nt, Human
ugucucaaagcagcccaggggccugaaauacccugauucaccuacaguguuccccugggcucagcaggca

SEQ ID NO: 9804 - RNA, 80 nt, Human
uuuuucauuuccuuaccuccuugccauaaucuuaacaaguaacaguaaaguauauggcaaggagguaaggaaaugaaaaa

SEQ ID NO: 9805 - RNA, 84 nt, Human; identical to SEQ ID NO: 286

SEQ ID NO: 9806 - RNA, 94 nt, Human; identical to SEQ ID NO: 5398

SEQ ID NO: 9807 - RNA, 93 nt, Human
acaagaucacagacaggguaagaagggggagagaggaaauuuacaauuccucauaaauaguuccuuauuuacagagauuguuagugauuaugu

SEQ ID NO: 9808 - RNA, 66 nt, Human
cacaaacguaggggcuuuccaugugcagggcacagugcuggacacugaggccucugcccuccagug

SEQ ID NO: 9809 - RNA, 66 nt, Human
ucugccuuucuuuggaacguuguccuggacuucaguccauccaguacuucuuuccagaacuucaga

SEQ ID NO: 9810 - RNA, 65 nt, Human
gugaggucugaggaggagacguuggcgggcgcaccccugugcagccucauacucaccuuccucgc

SEQ ID NO: 9811 - RNA, 62 nt, Human
uugagugguuuauuuuugccuuuuuuuuuuuuuaaagaaaauacagugaagacacuaagcaa

SEQ ID NO: 9812 - RNA, 105 nt, Human
uaguucuccccauacauaccccaagucacccuucucuuuccucgaaggcucaagguuuucgugaucuuuucagcuguacuuuauggaguauguucuugaguucug

SEQ ID NO: 9813 - RNA, 92 nt, Human
aauuucccuuucgccagcugccguaauagccaagaggcccgaaccgaucgcccuucccaacaguugcgcagccugaaugcggaauggaaauu

SEQ ID NO: 9814 - RNA, 76 nt, Human
uugcuugaacccaggaggcggagauugcagugagccaagaucacuccacugcacuccagccugggcaacagagcaa

SEQ ID NO: 9815 - RNA, 87 nt, Human
cuauugaguacaaaggcuguuacuugaaagaacacacugcuugguuggugauggaauauugcuuaggcucagccucugauuuauuag

SEQ ID NO: 9816 - RNA, 77 nt, Human
gcaggaaauauucuucuaacagagccaggucagguaaaacuagcugauuuuggaucugcuucaaugguuucuccugc

SEQ ID NO: 9817 - RNA, 62 nt, Human
guaucaugcuguuuuguuuacugcagcccuguaguauaguggggaguuagguagugugaugc

SEQ ID NO: 9818 - RNA, 86 nt, Human
guggagaagggguccaguuucaaucuucugcauauagcuagccaguuguccuugcaccauuguugaacagggaauccuuuccccau

SEQ ID NO: 9819 - RNA, 85 nt, Human
guugaagaucagauagcuauagguguguggucuuauuucuggguccucuauuguguuccauuugucugcgugucuguguuugugc

SEQ ID NO: 9820 - RNA, 100 nt, Human
gcagguugguacuacuucugauuaggcagaaaacaccaggauuccuuaagugauccuugaaaugguuauuguuuucugccuugucacauuugccaccugu

SEQ ID NO: 9821 - RNA, 73 nt, Human
gugugugugcuaggagcuggagcgcuagcacucuucaggugacaauucucaacuccauuuccuccacaugcau

SEQ ID NO: 9822 - RNA, 76 nt, Human
acugugaaaaagauaucuguugguggcauuaaagaagacacugaagaacaucaccuaagagauuauuuugaacagu

SEQ ID NO: 9823 - RNA, 70 nt, Human
ucugagugaauagauggcggcauggagggauaccaaacacuccaauccccaacgcgaucucaaguucaga

SEQ ID NO: 9824 - RNA, 131 nt, Human
cucuuguccacgguuagccugcuguagaggaagaaggagccgucggaguccagcaacgggaggcguggucuuguaguuuguucuccggcugcccauugcucucccacuccaacgggcgauugucgcugggg

SEQ ID NO: 9825 - RNA, 68 nt, Human
gaagccuuugaccaggcagggucaggcugaccugguucuuggucaucuccuccugggauugggcuauc

SEQ ID NO: 9826 - RNA, 71 nt, Human
gcaaggaccccugcaaguguuggucgggggccucgagcugccugagcugacacgaggggaggggucugugu

SEQ ID NO: 9827 - RNA, 73 nt, Human
gcuggaaaacgccgaaaugcuucccaacuaucugaaaagauguuguacuugaggaacacucgguguuccaagc

SEQ ID NO: 9828 - RNA, 71 nt, Human
uuuuuuuuuuuuacaccuaccaauucaauucagucauguuucugcuuuauugggcagauaaagagaagaaa

SEQ ID NO: 9829 - RNA, 75 nt, Human; identical to SEQ ID NO: 9431

SEQ ID NO: 9830 - RNA, 85 nt, Human
aaaaucauaaggacaaaaaucugcugaugcugugagauaaaaccgaugauucugcagucaauuuguuuuguaccugugugguuuu

SEQ ID NO: 9831 - RNA, 72 nt, Human
gcauauagaaaggcaguccugggaccuccuguucuucagaauauacaggucuuuaaacuguaaucagguagc

SEQ ID NO: 9832 - RNA, 63 nt, Human
caucuuuggguauuugaauagcaagcgcucuuuuuugaguggcgcugcuuaaaaaccgagaug

SEQ ID NO: 9833 - RNA, 85 nt, Human
gcccaccugaggauagauuauuggauaauugucauuauuuucuuucauaaaauauugucauuucuccauuuucuuuuucagcggu

SEQ ID NO: 9834 - RNA, 82 nt, Human
uccaaguaauggaucccugauggauucaccauaguuacaugacuaugucgugaauuauacauuucuuguccacauauuugga

SEQ ID NO: 9835 - RNA, 78 nt, Human; identical to SEQ ID NO: 5302

SEQ ID NO: 9836 - RNA, 62 nt, Human; identical to SEQ ID NO: 484

SEQ ID NO: 9837 - RNA, 70 nt, Human; identical to SEQ ID NO: 5304

SEQ ID NO: 9838 - RNA, 63 nt, Human
ccccagccaaagaugacagcagaacaacauaauuuacacugugauuuaucuuuuugcugaggg

SEQ ID NO: 9839 - RNA, 71 nt, Human
acuuugauuuacuuagauauguauguaacaacagugaauguacauuaagaugaagucaaguguugcaaagu

SEQ ID NO: 9840 - RNA, 73 nt, Human
gcuuuuaacacuguuugggaaaaaaaguuguucacauuggugaagggaagcaguccgaacauauguuaacagu

SEQ ID NO: 9841 - RNA, 85 nt, Human
ucagacaguugagccauuaaaaacaagaccacagaagcuuuauuuuaaaaaggcauuggcucuugaacugauggcugaaaaauga

SEQ ID NO: 9842 - RNA, 60 nt, Human
uuauaaagguaccacucacuacauuacaaaauagucucuaacauaaaauugccuuaauaa

SEQ ID NO: 9843 - RNA, 60 nt, Human
ggaugucucauucuagagugacagccaaaaggguaucucacccuagagugacagcuaucc

SEQ ID NO: 9844 - RNA, 60 nt, Human
gggccaguuuauauacugcuauuacacuauuuauuucuauagcuacaugugcuuuggccc

SEQ ID NO: 9845 - RNA, 63 nt, Human
gucacuuaaauuuguucuuuguuuagccugaaaaccuuuauggcucaagaucagauuccugac

SEQ ID NO: 9846 - RNA, 85 nt, Human; identical to SEQ ID NO: 866

SEQ ID NO: 9847 - RNA, 71 nt, Human; identical to SEQ ID NO: 2252

SEQ ID NO: 9848 - RNA, 64 nt, Human; identical to SEQ ID NO: 287

SEQ ID NO: 9849 - RNA, 84 nt, Human; identical to SEQ ID NO: 286

SEQ ID NO: 9850 - RNA, 64 nt, Human; identical to SEQ ID NO: 287

SEQ ID NO: 9851 - RNA, 89 nt, Human; identical to SEQ ID NO: 288

SEQ ID NO: 9852 - RNA, 82 nt, Human
cagaugugucaggcgaggacugucuugcuguuuggugacucaagccuagaaagcuagacaggaaaucagcugagaccauuug

SEQ ID NO: 9853 - RNA, 79 nt, Human
caugcccagggccgcgugugcccccagaggugcucuuggaggagggugccagggggaagagcgauggguccugugggug

SEQ ID NO: 9854 - RNA, 62 nt, Human
cuggucagggcgccugauuuccacgacaccgucaccgguucggggaaguaguccuugaccag

SEQ ID NO: 9855 - RNA, 104 nt, Human
ugucgcugacgaaugaugacaagacaagcgaagaucagggccacacacacgacagccccuucgaacuuccaaaauaagcguuguuccaucaaagcugagcggca

SEQ ID NO: 9856 - RNA, 73 nt, Human
uuuuuuuuuaaccauuuuacucuuuuuauucugcucauuaaugaucugaaagaagaagauggggaaaagggga

SEQ ID NO: 9857 - RNA, 106 nt, Human
ggggcgaguccacuggugcccaguaacacccuccgugggaccaccuugggaagcaugugccgcggaguccaccacgggggguccugggucccgggagggcuccuuc

SEQ ID NO: 9858 - RNA, 77 nt, Human
uuuguucauaaucccaaacaagggcccugcuggcagcaacaggacagguggggccaggacagggaagcuggagcagg

SEQ ID NO: 9859 - RNA, 81 nt, Human; identical to SEQ ID NO: 2741

SEQ ID NO: 9860 - RNA, 78 nt, Human
ugucgacuccucaugcuggacuugucuuucggguucuuuguagcccaggggagcaucaaaguccacguucaugucaca

SEQ ID NO: 9861 - RNA, 81 nt, Human
cugggguguuuauggcaagucacuuugacagacauuaugguggcaaaauguggucugacuuacuuguuucaaacaaaccag

SEQ ID NO: 9862 - RNA, 80 nt, Human; identical to SEQ ID NO: 100

SEQ ID NO: 9863 - RNA, 78 nt, Human
cucucaccccauucuuccauaaugagucccaguuggucccuagaggugccagggcaucuggaaguucugggcugggag

SEQ ID NO: 9864 - RNA, 95 nt, Human
ggaguggggugcagugaguggccucaaaguugugcagaugcuuccgagccagaaacaaagccagcugccgccguccaucugcacucauguccucc

SEQ ID NO: 9865 - RNA, 62 nt, Human
uguccucccccacgcuccaggggaagucgggcccguguucugccugguaggagcggaggaca

SEQ ID NO: 9866 - RNA, 70 nt, Human; identical to SEQ ID NO: 4167

SEQ ID NO: 9867 - RNA, 100 nt, Human
ggaacuugaggcuuccugucuccuccaugggccccaccagucacagggacaugaaauccguggcuggaggagggagaggggagagcaggagccacacacc

SEQ ID NO: 9868 - RNA, 74 nt, Human
cgcggccagcaguuaccugagccugaggcccgagcuagugcacgucccacagaagcuacagcugccaggucacg

SEQ ID NO: 9869 - RNA, 65 nt, Human
auauuggccaaaaggagacagucuuggaggugcugcuuacuguugaacuuccuuuuggaauguau

SEQ ID NO: 9870 - RNA, 85 nt, Human
cuguucuuucuuccucuucugucuacugcaugcaggcccggaagcugagcguuagucaaagguacaggaagggaaaagagaagag

SEQ ID NO: 9871 - RNA, 74 nt, Human
ugaugcagagggagcaggagcugagguggagacggccacugccucucucacccucuguuccaucccucugcuca

SEQ ID NO: 9872 - RNA, 67 nt, Human
aguuauaccuccggugacaaucauccaaguaggccugaaacgucuugggugauugaaccggauagcu

SEQ ID NO: 9873 - RNA, 87 nt, Human
agcuuuguacuaacaucaaaaguuuuaugauuaggaguugagaauuuauacagucuucagaauguaaaagaaaguguuauaaaagcu

SEQ ID NO: 9874 - RNA, 84 nt, Human; identical to SEQ ID NO: 286

SEQ ID NO: 9875 - RNA, 89 nt, Human; identical to SEQ ID NO: 288

SEQ ID NO: 9876 - RNA, 94 nt, Human; identical to SEQ ID NO: 5398

SEQ ID NO: 9877 - RNA, 67 nt, Human
ugagaugcuaaauacauauaucacuuugcacuuagaugucaauagauauaucgaacguaagcgucca

SEQ ID NO: 9878 - RNA, 89 nt, Human
gcggugcuggccgacuucgcgucgcccuuccacgagcgccacuuccacuacgaggagcaccuggagcgcaugaagcggcgcagcagcgc

SEQ ID NO: 9879 - RNA, 60 nt, Human
ggaaggcccucaaauaaagcuauuauuuuuauuaauuguaucaugcuuuauaggcucucc

SEQ ID NO: 9880 - RNA, 63 nt, Human
gcaggaacuggauauagcaccgucuuucccuccccauccccgaggcugugcuuccaguuuugc

SEQ ID NO: 9881 - RNA, 84 nt, Human
gguggacacuucugccacccuauucuguagccccagacagagauggggaaacauaugccuggagugacagagccuuccuccacc

SEQ ID NO: 9882 - RNA, 78 nt, Human
cugggguguuuauggcaagucacuuugacagacauuauuguggcaaauguugucugacuuacuguuucaaccaaccag

SEQ ID NO: 9883 - RNA, 64 nt, Human
gaagguuaagcuggcuguccugaaauauuauaagguggaugagaauggcaaauuagucgccuuc

SEQ ID NO: 9884 - RNA, 80 nt, Human; identical to SEQ ID NO: 100

SEQ ID NO: 9885 - RNA, 77 nt, Human
aauguaaugacaacaauuuaggcaucauaaaauacugaacuauugugacuuuauacuuagaauugcugucuuacauu

SEQ ID NO: 9886 - RNA, 96 nt, Human
guauggugucuucacuuauuauguauguuuaucuguauguauauuccuuauuuugucauauauguagagaaaauugcaugacuugaggcaucauau

SEQ ID NO: 9887 - RNA, 79 nt, Human
gcgucaugacugcuguacagcuagggugcguuuggccgacugccguaauucuuaauguucgcugcugcaguuaugccgc

SEQ ID NO: 9888 - RNA, 63 nt, Human; identical to SEQ ID NO: 1364

SEQ ID NO: 9889 - RNA, 68 nt, Human
uauagucaaguuacuuauuaaaaaaaaaacacauuuuggccauuuuuuuuacagugaacaauucuaua

SEQ ID NO: 9890 - RNA, 62 nt, Human
uuuuuuuuuuuuaaagauuuuaaaguagaugauuuuauucuaguaacuggcuacaagagaaa

SEQ ID NO: 9891 - RNA, 88 nt, Human
gcgcaggucgguagugaggggaucgugcuggaucgucuggugcagcaucagggccagcaaucccgcgcgguuugucaugguugugcgc

SEQ ID NO: 9892 - RNA, 83 nt, Human
ugaguggaggaacggacacacgggcaccgggcggcucccccaucuggaaugcaggguguaagggguccgggccaggaggcuca

SEQ ID NO: 9893 - RNA, 79 nt, Human; identical to SEQ ID NO: 8060

SEQ ID NO: 9894 - RNA, 100 nt, Human; identical to SEQ ID NO: 3028

SEQ ID NO: 9895 - RNA, 65 nt, Human; identical to SEQ ID NO: 3029

SEQ ID NO: 9896 - RNA, 104 nt, Human
cgcaucccauauugcaaagagaggacagcccaugguaucggaagaaauucuggcggagagcacuguacuugggguccuucucucgcaucuggcgguagggaucg

SEQ ID NO: 9897 - RNA, 64 nt, Human
uugccugaagaagcauuuauuagcaugcagggcccaugcuagaggcuccuuauuuccagggcaa

SEQ ID NO: 9898 - RNA, 73 nt, Human
uggcugucuucccccucaguguuuaggaacgucuccaagacgucugaagacaaccuugaggagggagcaguua

SEQ ID NO: 9899 - RNA, 76 nt, Human
ggagugcaauggcgcgaucuuggcucacugcaaccuccgccucccagguacaagugauucuccugccucagccucc

SEQ ID NO: 9900 - RNA, 82 nt, Human
auguagccagagcaauggugauguucuuauugcucccugaauucaggucuauugcauggacaucaggauuccucugggacau

SEQ ID NO: 9901 - RNA, 101 nt, Human
ggucuuguacuacuuccaagauugugcuaauuagugacaaacauugggcuuucccuucaauguuauggucuuuaugaaaacaaacaggauaguucagggcc

SEQ ID NO: 9902 - RNA, 82 nt, Human
cccaucucaaacguccuugcuacucugugauuguagaauaucugaucaaccuucugggagcgagaaaguaguugugaauggg

SEQ ID NO: 9903 - RNA, 95 nt, Human
guauuuuuaguggagauaggguuucaccauguuggccaggcuggucuugaauuccuggccucaggugauccgccugucucagccccccaaagugc

SEQ ID NO: 9904 - RNA, 68 nt, Human
acaacccaguaaccauucuguccaauuugaugucauuugcaauaugggcuauguagcuacugguaugu

SEQ ID NO: 9905 - RNA, 75 nt, Human
uugaguuuuuaaucaaguacagcacuucaugagaauuauacauuuguucccauucagauucuucuugauacuuaa

SEQ ID NO: 9906 - RNA, 77 nt, Human
gccccuauggggcccacaugggugguaacagcagcaggacaccuuuuccaaagcuguccaccagccccacuaggggc

SEQ ID NO: 9907 - RNA, 62 nt, Human
ggaguaccagaucagggcagagacuucccagcuggguaaggcaugcuuugagggaagacucc

SEQ ID NO: 9908 - RNA, 87 nt, Human
uuuuuuuuuuuuuuuuuuuuuaagaacuuauuuuuauuuuauuuuagaacuuaaaaauaaauuuuuaagaacuaaaaaagggaaaga

SEQ ID NO: 9909 - RNA, 103 nt, Human
aaggggagguuuuugcaaauucccaaggaaaugucaaaaaggcaaaauggccaccauuauccauuugcuuuuuuggguuuacugggggaaaaacacuuuccuu

SEQ ID NO: 9910 - RNA, 77 nt, Human
uaggcaugugauuucagguuuuucguacugaaaacauugaaauuucaguuggaaaacccccugaaauuuuaugagua

SEQ ID NO: 9911 - RNA, 131 nt, Human
agagcaagcacaaagaccggauauuuguggugccaccgcaguugcagaaaggaaugucagucagaaaugaauuguguuucagucacucugcaugguugcugccacgcauggaacauuuuuaggccaacuuu

SEQ ID NO: 9912 - RNA, 63 nt, Human; identical to SEQ ID NO: 7225

SEQ ID NO: 9913 - RNA, 66 nt, Human
gaggcaggcggaucacaaggucaggagaucgagaccaucuuggcuagcacggugaaacccugucuc

SEQ ID NO: 9914 - RNA, 79 nt, Human
gcuagaaggggccugggaggcggggcuggaccuuccugcaagucgcagcuccaccccucacuaacuguuggcccucagc

SEQ ID NO: 9915 - RNA, 66 nt, Human; identical to SEQ ID NO: 4988

SEQ ID NO: 9916 - RNA, 60 nt, Human
uccccuccugaaagaugucaucgcaacagauaaagaagacguugccuucaaagaccugga

SEQ ID NO: 9917 - RNA, 103 nt, Human; identical to SEQ ID NO: 5697

SEQ ID NO: 9918 - RNA, 73 nt, Human
gcuccugucccucuugcuuuauagcuagcugcccggagaccaagguacaggugaaagcaagguagcagcuugc

SEQ ID NO: 9919 - RNA, 98 nt, Human
uggcagugauccuuuucuuugcaaaguacugucucuuugguuccaguaaguuggaccaccacaugacaucauuuucccuggaaccuggucacugacua

SEQ ID NO: 9920 - RNA, 60 nt, Human
aguuuaaaagcaguuuccauguguuuucguuucugauaccuggaauacugcauuuuuacu

SEQ ID NO: 9921 - RNA, 60 nt, Human
gguaucuggcacauaauaggugaccacaacaagcuuagucccuuauguuuucaguauauu

SEQ ID NO: 9922 - RNA, 67 nt, Human
ccaccugcucuuguccacggugagcuugcuguagaggaagaaggagccgucggaguccagcacgggg

SEQ ID NO: 9923 - RNA, 92 nt, Human
cucccacuccacggggaugucgcugggauagaagccuuugaccaggcaggucaggcuugacugguucuugucagcucauccccggauggggg

SEQ ID NO: 9924 - RNA, 67 nt, Human
uugccggccgucgcacucauuuacccggagacagggagaggcucuucugcguguagugguugugcag

SEQ ID NO: 9925 - RNA, 99 nt, Human
agggggacaacacccugauccgcaucauggucucccggagugaguuggacaugcucgacauucgggagaucuuccggaccaaguaugagaagucccucu

SEQ ID NO: 9926 - RNA, 77 nt, Human
cagcaugaucaagaaugacaccucuggcgaguacaagaagacucugcugaagcugucugggggagaugaugaugcug

SEQ ID NO: 9927 - RNA, 74 nt, Human
ggcagcgcagguggccuaucagaugugggaacuuagugcaguggcccgaguagagcugaagggaacugugcgcc

SEQ ID NO: 9928 - RNA, 61 nt, Human; identical to SEQ ID NO: 387

SEQ ID NO: 9929 - RNA, 73 nt, Human; identical to SEQ ID NO: 7069

SEQ ID NO: 9930 - RNA, 80 nt, Human
caccucgcagucauucuugcggcuugcgcgcccuuguagacagccggggccuucgugagaccgcuuguuuucugcaggug

SEQ ID NO: 9931 - RNA, 60 nt, Human
cagagaagagaaaaaugcaggacacuggcucaguagugccuuugcauugguuuggcuuug

SEQ ID NO: 9932 - RNA, 81 nt, Human; identical to SEQ ID NO: 4673

SEQ ID NO: 9933 - RNA, 92 nt, Human
ccuccucuuccucuucagucuccaacgacucugcccccgaugguccucguggguuggguuguuuuggggggguugugcugggggggaggggg

SEQ ID NO: 9934 - RNA, 73 nt, Human; identical to SEQ ID NO: 4293

SEQ ID NO: 9935 - RNA, 63 nt, Human
gcuugauuuuuauuccuaaugaaauggggauccauugaaggaauaggaaaagaggagucaggu

SEQ ID NO: 9936 - RNA, 80 nt, Human
uuggauguggcuggcucacacucuagaggacaaucuguccuacucaaaguccauggagcuaaaaguugauuuucauccaa

SEQ ID NO: 9937 - RNA, 67 nt, Human; identical to SEQ ID NO: 1862

SEQ ID NO: 9938 - RNA, 71 nt, Human
gagguagcugugguuguauuucacccaggagagugguccuuugggaugcaaggcaguuguucuaauaccuc

SEQ ID NO: 9939 - RNA, 62 nt, Human
aaggccugcuguuucuggagugaagucugccuaauucuggagugaaauauuagcaggaccuu

SEQ ID NO: 9940 - RNA, 68 nt, Human
cucagaguaggucauucugguuugcccuaugccaugugguaagaagccagucagccugcccauuugag

SEQ ID NO: 9941 - RNA, 64 nt, Human
uuugaucugaacuuaaaagaggaagaaaggauuaugucuugagcuccuaaaacuucaacucaaa

SEQ ID NO: 9942 - RNA, 93 nt, Human
gcuagccacagggaaguugagaaaagagggaaacggggauaacagaagcuaaaaauguccugaguggccuggaagaagaccccugaggugggc

SEQ ID NO: 9943 - RNA, 67 nt, Human
gaggaaauuacuagcacugccuaaacauucagaagucugugacacaguuuaggucuaggguugucuc

SEQ ID NO: 9944 - RNA, 70 nt, Human
gccaaggaacagaguagauucaacagcauauuaaaguaauuuaguuaacccugaguaauuacuaacuugc

SEQ ID NO: 9945 - RNA, 80 nt, Human
gggaauaaaaauccauauuucuuaauaauuuauguauagcccaacuuuuagaacauagaauauuaucaauuuggcuuccc

SEQ ID NO: 9946 - RNA, 118 nt, Human
aaagcgacccaaagguggauagucugagaagcucucaacacacaugggcuugccaggaaccauaucaacaaugggagcaucaccagacuucaagaauuuagggccaucuuccagcuuu

SEQ ID NO: 9947 - RNA, 64 nt, Human; identical to SEQ ID NO: 287

SEQ ID NO: 9948 - RNA, 131 nt, Human; identical to SEQ ID NO: 6294

SEQ ID NO: 9949 - RNA, 67 nt, Human
ccuccuggagcuggagcuuggugagugggcugcuggugaucacggagggcuccgggcucuguauggg

SEQ ID NO: 9950 - RNA, 78 nt, Human
gucugaaacauuuuacuucauauuacacauacuuuucuuuuaaaaaaggcagaaacauugaaggaaacaacacucaac

SEQ ID NO: 9951 - RNA, 74 nt, Human; identical to SEQ ID NO: 365

SEQ ID NO: 9952 - RNA, 102 nt, Human; identical to SEQ ID NO: 2172

SEQ ID NO: 9953 - RNA, 77 nt, Human; identical to SEQ ID NO: 3082

SEQ ID NO: 9954 - RNA, 79 nt, Human
uuucaauuuuuauuuugguuuucuuacaaagguugacauuuuccauaacagguguaagaguguugaaaaaaaauucaaa

SEQ ID NO: 9955 - RNA, 91 nt, Human
gacagagaggcagccaagacuccugcacauuuccucaucugucugacacccccuuccagaaccagaaagugugcugagcucggccucuguc

SEQ ID NO: 9956 - RNA, 64 nt, Human
uguucacuagacuauguuuucuauucauuucuuuaaaaugaaaaaggagaauuucaagucagca

SEQ ID NO: 9957 - RNA, 64 nt, Human; identical to SEQ ID NO: 287

SEQ ID NO: 9958 - RNA, 89 nt, Human; identical to SEQ ID NO: 288

SEQ ID NO: 9959 - RNA, 74 nt, Human
ccugcccaggccgggccucccgccgccggaggucgccgcgaccaccgaggagggagccguggccgaggacgagg

SEQ ID NO: 9960 - RNA, 66 nt, Human
cccacagcggagucugugucuuuuagcuacagaggagguuccuuguugcuaaagaugaccuguggg

SEQ ID NO: 9961 - RNA, 66 nt, Human
cugugugguugggugugcguucuucuuugaacuccugcaugaacaccuuuccaaugaccacauaag

SEQ ID NO: 9962 - RNA, 78 nt, Human
cggauucuuggcgaggaugugcuugucuuggaugauguacucguacgucgucagcaagacguugaacuucccacuccg

SEQ ID NO: 9963 - RNA, 130 nt, Human
ccgugaggccaagaauccccaggucagagaacacgaggcuugccaccaucuuggaaguggccugccgccauuuuggaaguggcccaccaccaucuugggagcucucggagcaaggaccccuggcaucugg

SEQ ID NO: 9964 - RNA, 84 nt, Human
gguugagagaggaagcaaacacggaggaauggauuugacaacccacauguccgugacucaaugcaagcaaggccuuucacaacc

SEQ ID NO: 9965 - RNA, 90 nt, Human
ucaaagcugaggcuuggagcaggugugaguugccuuccauugauugguuaggugaccuccgcccaccccugcuccaacuuccauaguuga

SEQ ID NO: 9966 - RNA, 65 nt, Human
cuucaagaguucauguuaacuucuuuucuggaaacuuccuuuucuuaguuguuguauucuugaag

SEQ ID NO: 9967 - RNA, 80 nt, Human
gccugggccaugaagagcuugccuaaguuuugggcagugaacuccuugauguucuggcaguaaguguuuaucuggccugc

SEQ ID NO: 9968 - RNA, 91 nt, Human
uagggaagaaaacaaguauuaguaucaguuaucuuagaaauggcaucuaaacuagaaugacauuugcucaguaugauauguucuuucccua

SEQ ID NO: 9969 - RNA, 74 nt, Human; identical to SEQ ID NO: 365

SEQ ID NO: 9970 - RNA, 77 nt, Human; identical to SEQ ID NO: 3082

SEQ ID NO: 9971 - RNA, 74 nt, Human; identical to SEQ ID NO: 365

SEQ ID NO: 9972 - RNA, 102 nt, Human; identical to SEQ ID NO: 2172

SEQ ID NO: 9973 - RNA, 77 nt, Human; identical to SEQ ID NO: 3082

SEQ ID NO: 9974 - RNA, 79 nt, Human; identical to SEQ ID NO: 9954

SEQ ID NO: 9975 - RNA, 60 nt, Human
cauccaaguuaucgaagacauacugcuagaauuugcacaguauuuuagauuacuugguug

SEQ ID NO: 9976 - RNA, 87 nt, Human
cgggguugcgaccaggcagcuguaggugccauucggaccagcacaaccgcaggaccugugacaucaacaagccuguccguggcucug

SEQ ID NO: 9977 - RNA, 66 nt, Human
cuguuugaucuuucuccagcacacgaaagccagguccaccagcagugcaaugagacagacagacag

SEQ ID NO: 9978 - RNA, 81 nt, Human
uauucuuggccucaauaucuaccaccuauuuuuuaaccagacaaguuugaauguagcaagauaauuuggggcaagagagua

SEQ ID NO: 9979 - RNA, 75 nt, Human
uuuuuuuuugccaguugcuauguuuuauuuugcuaguagcuuauuaaacauaacaugcaaauaaucaaagagaaa

SEQ ID NO: 9980 - RNA, 60 nt, Human
accuuaugauaauuuauuagguuauacuuuccuuuauggccuuuauuuaucuuauauggu

SEQ ID NO: 9981 - RNA, 63 nt, Human
ugugacccuaucucagaaagagggaguuaggauauugacuuuuuuggggagguggguguugua

SEQ ID NO: 9982 - RNA, 79 nt, Human
agggcagaacuauaccgggugccugacaagagcacuugcuacagguucuacagcaccagagguacuuaguaaaagcccu

SEQ ID NO: 9983 - RNA, 78 nt, Human
cuaggaauaucaggcucucagaagcugccugugaggaugaagauucagccucagaaggucuaggugagcuuuuccugg

SEQ ID NO: 9984 - RNA, 72 nt, Human
agcagguuuaaaaggugcucaguuagagauucuaaccaauuaaguggugaauuauaaaauuucuuuccugcu

SEQ ID NO: 9985 - RNA, 75 nt, Human
uuauggggacaugagaauuacugcgaaaauaaauagaauguccuuuuguaaaagcagcaauaucaugucuuguaa

SEQ ID NO: 9986 - RNA, 65 nt, Human; identical to SEQ ID NO: 7001

SEQ ID NO: 9987 - RNA, 85 nt, Human
aguacaagggcuaucugguaucuguagauggcuacaugaacaugcagcuugcaaauacagaagaauacauagauggagcuugucu

SEQ ID NO: 9988 - RNA, 72 nt, Human
ugagagaauagcaucuuugugggggauuuuuuuuauauauauuucuagacaauaaagauuuguuguuuuuca

SEQ ID NO: 9989 - RNA, 80 nt, Human
gcacauuugugucuuggguuaucuguggggugagaaaccuccucacuuccaaucccagcuaucuggguacaaucuggugu

SEQ ID NO: 9990 - RNA, 103 nt, Human
guggggcggcguggguggggcgcagcuggauaugcacguggugaugucuccuagcuccccccgcuguaugcuccggucagugcucugccaugacgugucccac

SEQ ID NO: 9991 - RNA, 90 nt, Human
guggucuggcugucggcgagggguagaggugggugcaggacuggcccccgagucugcaccgaccucuucagggcagggagcucagaccau

SEQ ID NO: 9992 - RNA, 94 nt, Human
aagcagaauuccagacaagaacuacaggucagaaauggaagggaugucggaaaucuaaucuaaaccucugacuuucuagacuaggaagcugcuu

SEQ ID NO: 9993 - RNA, 60 nt, Human; identical to SEQ ID NO: 3188

SEQ ID NO: 9994 - RNA, 70 nt, Human
aaggaguaguugugagcucuauucuaaauaaaauacucuaagaauuuauuucucucugcagcuauuucuu

SEQ ID NO: 9995 - RNA, 75 nt, Human
uguuauuguugcuguuguuaauuacaaaaguucagucuuuuuguuuugguagauuagcuuuaaguaacaauuaca

SEQ ID NO: 9996 - RNA, 71 nt, Human
cucccucuuuuuugauuuacugguacauuuuuaaaauaauaaaucugccauaaaaugcauuauaucuggag

SEQ ID NO: 9997 - RNA, 61 nt, Human
aguuagagacaaaaggaugcugacaaauacuuaacuaggagcacuauuuguuuacugcacu

SEQ ID NO: 9998 - RNA, 84 nt, Human; identical to SEQ ID NO: 2859

SEQ ID NO: 9999 - RNA, 102 nt, Human; identical to SEQ ID NO: 2701

SEQ ID NO: 10000 - RNA, 87 nt, Human; identical to SEQ ID NO: 4680

SEQ ID NO: 10001 - RNA, 90 nt, Human; identical to SEQ ID NO: 2702

SEQ ID NO: 10002 - RNA, 60 nt, Human; identical to SEQ ID NO: 5595

SEQ ID NO: 10003 - RNA, 78 nt, Human; identical to SEQ ID NO: 99

SEQ ID NO: 10004 - RNA, 65 nt, Human; identical to SEQ ID NO: 247

SEQ ID NO: 10005 - RNA, 80 nt, Human; identical to SEQ ID NO: 100

SEQ ID NO: 10006 - RNA, 66 nt, Human
gagacgggguuucaccauguuggucaggcugguccaguacuccugaccucgugauccgcccgccuc

SEQ ID NO: 10007 - RNA, 66 nt, Human
ugaggacagagguugcggcucucguaacccagggcugggauugcggggggcgcgaccucuuucuca

SEQ ID NO: 10008 - RNA, 76 nt, Human
caucaggccgaaucaggguguugaccuuggccacaucaaugucauacagcuucuucacagccuguuuaaucuggug

SEQ ID NO: 10009 - RNA, 78 nt, Human
acaucaagacaauguauacuauuucaaauauauccauacauaaucaaauauagcuguaguacauguuuucauuggugu

SEQ ID NO: 10010 - RNA, 61 nt, Human; identical to SEQ ID NO: 6530

SEQ ID NO: 10011 - RNA, 61 nt, Human
gagaaggaggguaagagugcauugccccauucuagcucuguugcuaccuuaccucugacuc

SEQ ID NO: 10012 - RNA, 100 nt, Human
ggcccugugggaugaaaagcagguauccaaaagaacucugcuuggcccucugauacggccuugaggucaacccuggugccugcuuucuggcccacagacc

SEQ ID NO: 10013 - RNA, 74 nt, Human
gcuucauccuguuccacaauccugaguauaacaagaacaccucgaaguuugaugggacaagacucuaugaaagc

SEQ ID NO: 10014 - RNA, 94 nt, Human
cagggggugugccugccugcgccuuucgcuuccuccucgguccugcguggucucgagcugggugagcgagcgggcgggcugguaggcuggccug

SEQ ID NO: 10015 - RNA, 62 nt, Human
gaguggucggcugggcagagugcacgcugcuuggcgccgcaggcugaucccgccguccacuc

SEQ ID NO: 10016 - RNA, 72 nt, Human; identical to SEQ ID NO: 8911

SEQ ID NO: 10017 - RNA, 69 nt, Human; identical to SEQ ID NO: 8912

SEQ ID NO: 10018 - RNA, 68 nt, Human; identical to SEQ ID NO: 8913

SEQ ID NO: 10019 - RNA, 71 nt, Human; identical to SEQ ID NO: 1007

SEQ ID NO: 10020 - RNA, 79 nt, Human; identical to SEQ ID NO: 8750

SEQ ID NO: 10021 - RNA, 66 nt, Human; identical to SEQ ID NO: 1008

SEQ ID NO: 10022 - RNA, 75 nt, Human; identical to SEQ ID NO: 6455

SEQ ID NO: 10023 - RNA, 77 nt, Human
agaauagggaguuuucacacguuucuugaucuuuucaccugauccugauuugccaucuuguguugacucaccuaucu

SEQ ID NO: 10024 - RNA, 97 nt, Human
cagacaguucauuccuauaucuuuagacaccaugguuguagcagugccuccuucugcaagguaaacagcagugcuggauuuggaaugaacugcccug

SEQ ID NO: 10025 - RNA, 61 nt, Human; identical to SEQ ID NO: 3057

SEQ ID NO: 10026 - RNA, 85 nt, Human
ggaaugcugcaaaaauacucuaguucaacaaagaguuaugaucacaaaauaauuuuuauccauucuacaguguuucagaauuacc

SEQ ID NO: 10027 - RNA, 66 nt, Human
ucugguauguuucuuauagcaaacuguuguucaugcaacacuugugcucaaaggggaaggcacagg

SEQ ID NO: 10028 - RNA, 79 nt, Human
aaauguggaauacuggcaguguaaaagucuuaaacuaacuuuaaagcuaacaaaucaaaggcacaguauuaacacauuu

SEQ ID NO: 10029 - RNA, 77 nt, Human
cuauagggaaagcugguacgccugcagguaccgguccggaauucccgggucgacccacgcguccgcauuaccuguag

SEQ ID NO: 10030 - RNA, 98 nt, Human
guaaguuacugacaagccucagcaaacccaaagauguuaacaguauuuuaagaaguugcugcagauuccuuuggccacuguauuuguuaauuucuugc

SEQ ID NO: 10031 - RNA, 64 nt, Human
guuuagucauaucuaucuaaucagaucuucuuuugggaggauuugauguaaguuacugacaagc

SEQ ID NO: 10032 - RNA, 116 nt, Human
cagccccaccgguuucgucgcaguccugaggcaggugcguguuggcugugcuguggucagccuggcgcugcccugaguccacuugucccuccacagaacgaaugacucugggguug

SEQ ID NO: 10033 - RNA, 86 nt, Human
gacugacagaggaccuuguugcaccucguggcugcuuuguucacccgcagggcggccugugggcaccccgggguuccccuucaguc

SEQ ID NO: 10034 - RNA, 66 nt, Human
gcuguaguguugcuggugagagugucuuuuaguaugcuaauacauuauaauuagcacauaauaagc

SEQ ID NO: 10035 - RNA, 91 nt, Human
uuuuuuuuuuuuuugaccgagucucacucugucucccauugcacuccagccuggaugauagagcaagacuccaucucaaaaaaagagaaag

SEQ ID NO: 10036 - RNA, 73 nt, Human; identical to SEQ ID NO: 7713

SEQ ID NO: 10037 - RNA, 98 nt, Human
uacgacucacuauagggaaagcugguacgccugcagguaccgguccggaauucccgggucgacccacgcguccgaaacugucccccauagagguugua

SEQ ID NO: 10038 - RNA, 81 nt, Human
uuuguaugucuucuuuugagagaugucuauucaaauacuuugcccauuuuuugauuggauuauuagauuuuuacccacaaa

SEQ ID NO: 10039 - RNA, 125 nt, Human
uacagcugcuacuuuaccuucuuguaaccugguguaauuacaugguauuuuuaagcauuaugcaauuugagccuuaggacaauuaugcaaauuagguauggcagagggugguagcccuuacugua

SEQ ID NO: 10040 - RNA, 118 nt, Human
cgccuugcagcacaucccccuuucgccagcuggcguaauagcgaagaggcccgcaccgaucgcccuucccaacaguugcgcagccugaauggcgaaugggacgcgcccuguagcggcg

SEQ ID NO: 10041 - RNA, 73 nt, Human; identical to SEQ ID NO: 7713

SEQ ID NO: 10042 - RNA, 61 nt, Human
ccaguuaaacugcucguucagcugcuccagcaaggaggagguguugagcaucuuccacugg

SEQ ID NO: 10043 - RNA, 69 nt, Human
acacaccacauuuucuuuauccacucguugguugauagcaucuaauguucaucagagauauuggugugu

SEQ ID NO: 10044 - RNA, 108 nt, Human
aauugauaaaagccagaguuggagacacagaaccacugguucaccuaccaaugagacaaugacaguggagagugugacccaagcuguguccaaucuggcuuugcaguu

SEQ ID NO: 10045 - RNA, 62 nt, Human; identical to SEQ ID NO: 5971

SEQ ID NO: 10046 - RNA, 63 nt, Human
ggaaucgggugucucaggaaccuugagcccauuccacagggcaggacaacugaggucgccucc

SEQ ID NO: 10047 - RNA, 64 nt, Human
ggugcaggcucgucuugaucugcgcgugcauguuugccgcccggaacuggcucgggcacgcgcc

SEQ ID NO: 10048 - RNA, 78 nt, Human
cugggguguuuauggcaagucacuuugacagacauuauguguggaaauguggucugacuuacuguuucaacaaaccag

SEQ ID NO: 10049 - RNA, 65 nt, Human; identical to SEQ ID NO: 247

SEQ ID NO: 10050 - RNA, 75 nt, Human
cugggguguuuauggcaagucacuugacagacauuauguggcaaugucgucugacuuacuguuucaacaaaccag

SEQ ID NO: 10051 - RNA, 65 nt, Human; identical to SEQ ID NO: 247

SEQ ID NO: 10052 - RNA, 80 nt, Human; identical to SEQ ID NO: 100

SEQ ID NO: 10053 - RNA, 62 nt, Human
aaugcaucagaagaagaaaugucaggaaaaaaagcauuguauuuauuucugaaugauguauu

SEQ ID NO: 10054 - RNA, 68 nt, Human
gccucaaggacuuucucauguaauucuaugauuaaagaaaaaggucgaggguuaagcaaggucgaggu

SEQ ID NO: 10055 - RNA, 83 nt, Human
cuagaagccuugguaccuuccucauaguguaaagccacggguggacgcagcaugagacuagaggcuggggaaccuggcuauag

SEQ ID NO: 10056 - RNA, 89 nt, Human
gcaccccuugcagcuccagcuccagcuccagcuccagccaugacugaaagaugcacagguacagcuggggucacggcuacagagggugc

SEQ ID NO: 10057 - RNA, 63 nt, Human
gcuaaggaucugggauuggcacaagacucugcuaccagcacaaagagcccaauccuucuuggc

SEQ ID NO: 10058 - RNA, 64 nt, Human
gcugcucgaugacccguuugccucguggauaaugccgcacauauucuccaacaucgugagcagc

SEQ ID NO: 10059 - RNA, 81 nt, Human; identical to SEQ ID NO: 8770

SEQ ID NO: 10060 - RNA, 64 nt, Human
gcaccugggggaccacgaagccagcuaccacucgcugugccacggcucacccccaacggucugc

SEQ ID NO: 10061 - RNA, 71 nt, Human
gggaggaaggaaguuccgcaaguucaucgggcaggcggcuuuggagcgaaugcggaauccaacuuucuucc

SEQ ID NO: 10062 - RNA, 77 nt, Human
ggugccaagguaggggacagggccugggggugguuuugagggcaggcugccugggguguuguccucuucuugggauc

SEQ ID NO: 10063 - RNA, 66 nt, Human
guuggugacuuugguguaucgagcauggagaccgcacagucccauugaacaccuuuccucacugac

SEQ ID NO: 10064 - RNA, 65 nt, Human
cccuccaguccccaaaccaguccucggcccugcagccagguuucuggucaguggacagugguggg

SEQ ID NO: 10065 - RNA, 103 nt, Human; identical to SEQ ID NO: 294

SEQ ID NO: 10066 - RNA, 78 nt, Human
ucuuaaaucaguuuguguacugacagccaaaaaugaauuccauuuuggugauuccaccucauggacugaguucuggga

SEQ ID NO: 10067 - RNA, 64 nt, Human
ugacuuucagguggggcaaucagugaaauucaguuuaggucacuguuugucagcuuaaaauuca

SEQ ID NO: 10068 - RNA, 69 nt, Human
ugcccacuagcuaauguaaacaccaaagaaccauuaccugcuuauugguguauaacuugcuucugggua

SEQ ID NO: 10069 - RNA, 72 nt, Human; identical to SEQ ID NO: 7666

SEQ ID NO: 10070 - RNA, 64 nt, Human; identical to SEQ ID NO: 4448

SEQ ID NO: 10071 - RNA, 78 nt, Human
ucggaagcacaucaugggccagaauguugcagaauacaugcgcuacuuaauggaagaagaugaagaugcuuacaaaga

SEQ ID NO: 10072 - RNA, 68 nt, Human
gagaggcguggaguauaaccuauauauaagugugguauaaaacuuauagaguucuccgagugcuuuuc

SEQ ID NO: 10073 - RNA, 82 nt, Human
aggaccaguagccacuuuaacuuuuuggggcugggcuuaaccuaaaguugcaggcucagcucuccuaugcugcugcuggccu

SEQ ID NO: 10074 - RNA, 67 nt, Human
cuguuugauuuuucaugauguagaucacauaccggaaagugaucgcaacuauuauggauguggacag

SEQ ID NO: 10075 - RNA, 83 nt, Human
gccagcgcuugcaguuugcauuuuaugugguugagcagguugguacccaacccuuuaaucgagccaugcuuuucaacguuggc

SEQ ID NO: 10076 - RNA, 73 nt, Human; identical to SEQ ID NO: 4762

SEQ ID NO: 10077 - RNA, 62 nt, Human; identical to SEQ ID NO: 5971

SEQ ID NO: 10078 - RNA, 79 nt, Human
aaggcgcaaacccgccacguucuggaaacuauccgcaagugaucgagacggcggguggcacgauggcggaugugaccuu

SEQ ID NO: 10079 - RNA, 68 nt, Human
uauucccgcuggcagcaggcaccgcuggcccccuucguucccggcacgcuggcugauggcguggugua

SEQ ID NO: 10080 - RNA, 67 nt, Human
uuauuaccgacuggaaaaauuacgccgcgauuaacgaaaucuacgccgaguuuuuuccgggugauaa

SEQ ID NO: 10081 - RNA, 75 nt, Human; identical to SEQ ID NO: 74

SEQ ID NO: 10082 - RNA, 87 nt, Human; identical to SEQ ID NO: 76

SEQ ID NO: 10083 - RNA, 71 nt, Human; identical to SEQ ID NO: 77

SEQ ID NO: 10084 - RNA, 73 nt, Human
ucgcuguagggcaggcugaagggguagaggggucuguaacgugaguccugccagagcagcuuguccuccagga

SEQ ID NO: 10085 - RNA, 83 nt, Human
ugacaccuuccucgaagggugggcgugggccuaaggcucccaagucggccaggggcucggccuggcucagaagaggugcuuca

SEQ ID NO: 10086 - RNA, 61 nt, Human
agaaaggucuuucaggaaauucgguaccauauuagcuggcaacuuugggaguacucuuuuu

SEQ ID NO: 10087 - RNA, 130 nt, Human
cagcuguuaucaccugcuaguugugugagccugagcaaguuacucuaccaaucuguggcucaguguccucaucuauagaauggggagaguaacaauagccaccucauagggcagcggugaagauucagug

SEQ ID NO: 10088 - RNA, 86 nt, Human
gccucacccuuagaaguuccaccuccuaggcugggcacgguggcgcacaccuguaaucccagcacuuuacuucgggagggugaggc

SEQ ID NO: 10089 - RNA, 66 nt, Human
gguggaucaccuaaggucaggaguuggugaccagccugacuaacauggugaaacucugacucuacu

SEQ ID NO: 10090 - RNA, 64 nt, Human; identical to SEQ ID NO: 287

SEQ ID NO: 10091 - RNA, 66 nt, Human; identical to SEQ ID NO: 6432

SEQ ID NO: 10092 - RNA, 83 nt, Human; identical to SEQ ID NO: 6433

SEQ ID NO: 10093 - RNA, 84 nt, Human; identical to SEQ ID NO: 286

SEQ ID NO: 10094 - RNA, 89 nt, Human; identical to SEQ ID NO: 288

SEQ ID NO: 10095 - RNA, 73 nt, Human
cccaauuacaggauuauacgguaccaucacaucauuuguggaaauuggggugacuguauagcuugggauuggg

SEQ ID NO: 10096 - RNA, 60 nt, Human
gcuccuaccaacgaggauaugaauauaucgugagauugcacaugucaugugaguuggagc

SEQ ID NO: 10097 - RNA, 76 nt, Human
ugucacagugggauuugguggaaaacuauuuggcagcagauggaaaaucuacaacauggagugucagacugggaca

SEQ ID NO: 10098 - RNA, 81 nt, Human
uuuuuuuuuuuuuuuuugguuacaaagcgguuuaauagagauuuauuuccaaggcuuguuuuccaugaaacagucaaaaaa

SEQ ID NO: 10099 - RNA, 77 nt, Human
gagggauggccagagcugcuggagauggagggcugcaugcccccgaagccauuuuaggguggcuguggcucuuccuc

SEQ ID NO: 10100 - RNA, 92 nt, Human
ggggcugaggaggaggagcagggggugcugcguggaaggugcugcagguccuugcacgcugugucgcgccucuccuccucggaaacagaacc

SEQ ID NO: 10101 - RNA, 68 nt, Human
ucccacagcacauccuacccggaagaccagccucagaggguccuucuggaaccagcugucuguggaga

SEQ ID NO: 10102 - RNA, 63 nt, Human
agggaccaucaccgccccgagcgugcgcacacagaaccggucggaaggcgagaacuggucucu

SEQ ID NO: 10103 - RNA, 61 nt, Human
uggggcacugaggcccgggauguaggcacuggacagcaacaacccaggcauuugggcccca

SEQ ID NO: 10104 - RNA, 62 nt, Human
gaacaaacguccuuuucauuuugguuuagaaauagaaacgugguaaaaggaggcgacuguuu

SEQ ID NO: 10105 - RNA, 76 nt, Human
ugccuuuuccagacugccagcgcggagcacuaguuugacuuugggugcucuucaaauagcuggcauugauaaggca

SEQ ID NO: 10106 - RNA, 74 nt, Human; identical to SEQ ID NO: 6462

SEQ ID NO: 10107 - RNA, 72 nt, Human
gcauugcccggaagaucaagucgugcuccuggcaggcgcgccccuggaggaugaggccacucugggcagugc

SEQ ID NO: 10108 - RNA, 80 nt, Human; identical to SEQ ID NO: 367

SEQ ID NO: 10109 - RNA, 77 nt, Human; identical to SEQ ID NO: 7086

SEQ ID NO: 10110 - RNA, 60 nt, Human; identical to SEQ ID NO: 8964

SEQ ID NO: 10111 - RNA, 86 nt, Human; identical to SEQ ID NO: 8965

SEQ ID NO: 10112 - RNA, 66 nt, Human
gaagguuaagcuggcugguccugaaauauuauaagguggaugagaauggcaaaauuagucgccuuc

SEQ ID NO: 10113 - RNA, 64 nt, Human
gggcggcucuggccccggagaaaaguuuuuuacccccccuccgguuugggggcgcggggccccc

SEQ ID NO: 10114 - RNA, 80 nt, Human; identical to SEQ ID NO: 100

SEQ ID NO: 10115 - RNA, 62 nt, Human
ggcaaucugaaguacuccuguuggugcgaaaggcgauauugggggugcgaaagccuauugcc

SEQ ID NO: 10116 - RNA, 62 nt, Human
ugauuugcuuggugaccgaauuacuagugacuaguuuacuaacuaggucauucaggcaguca

SEQ ID NO: 10117 - RNA, 62 nt, Human
gccuccccacuucccacauccccugaauucuucgugaaggggauggccuaauaugggaaugc

SEQ ID NO: 10118 - RNA, 66 nt, Human; identical to SEQ ID NO: 4249

SEQ ID NO: 10119 - RNA, 82 nt, Human; identical to SEQ ID NO: 1766

SEQ ID NO: 10120 - RNA, 74 nt, Human; identical to SEQ ID NO: 365

SEQ ID NO: 10121 - RNA, 102 nt, Human; identical to SEQ ID NO: 2172

SEQ ID NO: 10122 - RNA, 77 nt, Human; identical to SEQ ID NO: 3082

SEQ ID NO: 10123 - RNA, 80 nt, Human; identical to SEQ ID NO: 367

SEQ ID NO: 10124 - RNA, 63 nt, Human
cacgaccggcuuggcucgggacccucggcucggccgccgccggccgcccuucagccgguccug

SEQ ID NO: 10125 - RNA, 65 nt, Human
ugcaguuucuugggacauaggagcgcaaagaagcuacagccuggacuuaccaccacuaaacugcg

SEQ ID NO: 10126 - RNA, 68 nt, Human; identical to SEQ ID NO: 7914

SEQ ID NO: 10127 - RNA, 83 nt, Human
gauggaacacaugaaaucuuugguucacagacuauuuacaaucuugcauuuagaagagucucagaaaaagagagagcaccauu

SEQ ID NO: 10128 - RNA, 95 nt, Human
gcucauucggaagccaaaaccaguggacuccugugggcuggauuggcacugcuguccauucaggguggggcacuggccuggcucacguggugggu

SEQ ID NO: 10129 - RNA, 90 nt, Human; identical to SEQ ID NO: 6402

SEQ ID NO: 10130 - RNA, 61 nt, Human; identical to SEQ ID NO: 6403

SEQ ID NO: 10131 - RNA, 69 nt, Human; identical to SEQ ID NO: 6404

SEQ ID NO: 10132 - RNA, 93 nt, Human
agccuccagucccaagcaagccuccaggcccugaguguucugaugccugaaggguagucauaggucccgagguggagucggggguggagugcu

SEQ ID NO: 10133 - RNA, 62 nt, Human; identical to SEQ ID NO: 3436

SEQ ID NO: 10134 - RNA, 61 nt, Human
aacagagcacuguacuuuuuuuuuuuuuuuuuuuuuuuaagagacaggguauugcucuguu

SEQ ID NO: 10135 - RNA, 79 nt, Human
cagaagccucugaugcuuuccccuggcagguccaucuuucugaucuaauccugggggugcauccauugucagaggucug

SEQ ID NO: 10136 - RNA, 95 nt, Human
gcagcccaacauccuuucucuggggagaagagcaaaugcaugcaaugcaauguauuuucuuuucaaaaagaggaaggcuucuuugggccaaaugc

SEQ ID NO: 10137 - RNA, 69 nt, Human; identical to SEQ ID NO: 2697

SEQ ID NO: 10138 - RNA, 86 nt, Human; identical to SEQ ID NO: 2698

SEQ ID NO: 10139 - RNA, 96 nt, Human
gaucuugagggcuguugucuauacuucucgugguuccacacccaugaacgaacuugggggcucugcgaggggggcgagaugaugacccuuuugguc

SEQ ID NO: 10140 - RNA, 60 nt, Human
gccaucacgccacaguuucccggaggggccauccacagucuucuggguggcagugauggc

SEQ ID NO: 10141 - RNA, 90 nt, Human
gggcccaggcuucuuccuuggugguggagacccccguugacucacgaacguuuuucgggccgggucucggccgccggauugggagggucc

SEQ ID NO: 10142 - RNA, 60 nt, Human
ccgugguccgguuucgcguccccguuggggucccgagggggguucggaggcgucuggcgg

SEQ ID NO: 10143 - RNA, 64 nt, Human
gcaugcugaugaucuugaggcugugucuacucucauggucgcacccugaggaacugcggcucgc

SEQ ID NO: 10144 - RNA, 78 nt, Human
aggucauuuuauauguccauaccuagaagacagugcaauacuuugagagcaccugggucuacaggacauauugcaucu

SEQ ID NO: 10145 - RNA, 65 nt, Human
ucaucuacuaaaguacaacaggaauucuucugaagcagauuauucuagucuuaugcuagagauga

SEQ ID NO: 10146 - RNA, 75 nt, Human
uguagcaugaaucaaauguauuuauuaauagcacuuaugacuauagaauauaauuggcauaugauucauauuaca

SEQ ID NO: 10147 - RNA, 87 nt, Human
ucuaucuggucuuugcaagcagucuucagguuaaagauacuucuaacagguuacaguacauuuccucuguauguaaauucagauggg

SEQ ID NO: 10148 - RNA, 64 nt, Human
uuuaguuuguuucuguacuuuuaaauuccaacuuaaaauuaugagguuucagaaauauauugaa

SEQ ID NO: 10149 - RNA, 89 nt, Human
gcuugaugacagacaguuucccucuccauuacucuccugggaauucugauucucugacggugguauagaccucuccuggcuguucaagu

SEQ ID NO: 10150 - RNA, 69 nt, Human
uugccaaaugcaucaaagguauuauauggucagaggauaauugugcacuaugucgccuuuggguagcaa

SEQ ID NO: 10151 - RNA, 71 nt, Human
ugcauucaaaguuaucgguauuaccagcuaucauuguuuugggguuucucugcuaauucuauuggcaugca

SEQ ID NO: 10152 - RNA, 105 nt, Human
guucucacguaaccuguaacauaagcauuucccaaguugcuauuaucuguuaauaacagugguuugauuaauuggauuggcuguguggauguggaacggaagagc

SEQ ID NO: 10153 - RNA, 70 nt, Human
uuuuuguuuuuaaaauguuuuauuauaaaaguaauauaugaucuuuauagaaaaauaaagaaaauaaaaa

SEQ ID NO: 10154 - RNA, 64 nt, Human; identical to SEQ ID NO: 6321

SEQ ID NO: 10155 - RNA, 78 nt, Human
uccuagguuuucuuauggcagcugacagcgugggcaaggcugcccacauguaccucgccacaacaggaagggcugaga

SEQ ID NO: 10156 - RNA, 106 nt, Human; identical to SEQ ID NO: 6411

SEQ ID NO: 10157 - RNA, 77 nt, Human; identical to SEQ ID NO: 2332

SEQ ID NO: 10158 - RNA, 80 nt, Human; identical to SEQ ID NO: 367

SEQ ID NO: 10159 - RNA, 71 nt, Human
uguguguguguguacaguguguauauauauacauacauacauauauauauacacacacacacacacacaca

SEQ ID NO: 10160 - RNA, 77 nt, Human
agagcaagaugaacagaaucuguauucucaaagagcacauagccaaacccuuugccgaugccugucauuuugucucu

SEQ ID NO: 10161 - RNA, 64 nt, Human
agaugaggucucagaugcgagaucaacucuaauacgaaauccaucugcaaucugggccccauuu

SEQ ID NO: 10162 - RNA, 68 nt, Human
uuaaauuuuucuuuauuaacagaacgcaugacucugaguuuucuccccaugaguucagaauuauuuaa

SEQ ID NO: 10163 - RNA, 104 nt, Human
gugcacagccccacaaccaggucagcgaugaagguaucuucagucucccccgaaccgaugaagacaccauugacgccccaaccauuggccugggcagcuugcac

SEQ ID NO: 10164 - RNA, 60 nt, Human
ugcacgccugaagagacucggucacggagccaaucuggguugacuuuugagcaggaggca

SEQ ID NO: 10165 - RNA, 60 nt, Human
cccucuuggugacccccccaucuggaguuaaggcuccaagcagcaagugacagaggaggg

SEQ ID NO: 10166 - RNA, 63 nt, Human
cugugaaaauauagaaaaacuccuuacuguaauuacugggaaccacaaaguuaauuuuuacag

SEQ ID NO: 10167 - RNA, 64 nt, Human
gccauuuuaagcaauaaaaauuggcaugugggugcaugccuguaaucccugcuacuuaggaggc

SEQ ID NO: 10168 - RNA, 71 nt, Human
gagucuaaagguuggaguguggggguggugggggaucccccaccugggucuggacugcaugaggaagacuc

SEQ ID NO: 10169 - RNA, 60 nt, Human
gcagcgcggagccugggcggcggcuuuucuccgaaggugcagacgcccggcccgugcugc

SEQ ID NO: 10170 - RNA, 87 nt, Human
gucgguggggcggggacgcgagguguggauggggggucgccuugaccucugccucagccaguagcgcagucucggccucgccguuac

SEQ ID NO: 10171 - RNA, 63 nt, Human
gaaauuucagaccuuugacaucagugugguugugcugauugccagguucauaauugugauuuc

SEQ ID NO: 10172 - RNA, 66 nt, Human
gccuugcacacucauuacauuuguaagguuucucuccaguaugaauuuuccgaugucgugcaaggu

SEQ ID NO: 10173 - RNA, 63 nt, Human
guugcauuuguaguuucuaucccauaugaauuguccaauguugugcuagguaugaaaugcgac

SEQ ID NO: 10174 - RNA, 90 nt, Human
aagguguuugucaguuguuucauaaaccagauugaggaggacaaacugcucugccaauuucuggauuucuuuauuuucagcaaacacuuu

SEQ ID NO: 10175 - RNA, 78 nt, Human
aagucucaaggccugacagacagaagggcuuggagauuuuuuuucuuuacaauucagucuucagcaacuugagagcuu

SEQ ID NO: 10176 - RNA, 73 nt, Human
gacugugaggagggugcuaucgaggaaaucagcuugaaccacagucgcuguaccucugcaccccuggaaaguc

SEQ ID NO: 10177 - RNA, 77 nt, Human
gcauguaggggguccggcaugggcguccuggcacuugacgcuuaccucguccguagucuggugggccucuguagugc

SEQ ID NO: 10178 - RNA, 61 nt, Human
aagaauuaaacuaaugagaaccgaggcaggcggacugacucagauuuuaauuuugauuuuu

SEQ ID NO: 10179 - RNA, 72 nt, Human
auagguaucacuacuacauuuuacauaaaagggaaguaucaauaaacuuuagaaaguaguaaauucaccugu

SEQ ID NO: 10180 - RNA, 72 nt, Human; identical to SEQ ID NO: 4169

SEQ ID NO: 10181 - RNA, 129 nt, Human
cacacccagcuaauucuucuauuuuugguagagaugggguuucaccauguuggccaggcuggucucaaacuccugaacucaagugaucuucccgccucagccucccaaagugcugggauuacaggugug

SEQ ID NO: 10182 - RNA, 119 nt, Human
gcaaggcgaggggucauugggauuuaccagguuuagaggcugcccgucccccuggaugcucagcaggcagaacccagaaggguagcccacacagagccugucccugagcaccgccaggc

SEQ ID NO: 10183 - RNA, 104 nt, Human
ggugaaauagauuaugaagcaaugugugaagcuuucggauggcuuaaugggagcagaucugagaaauauguucgcaauucgugcugaucaugauuuguaguacc

SEQ ID NO: 10184 - RNA, 72 nt, Human
guaccaggaagacuucaugaaagcagucagaaaaaguggugauucuagaaggcuggagucuaaauuggguac

SEQ ID NO: 10185 - RNA, 82 nt, Human
caaagugcagcuggccaugcagaccuacgagaugguggauaaaccacauucgaaggcuugaugcagaccuggcgcgcuugug

SEQ ID NO: 10186 - RNA, 62 nt, Human
cugcagaguacaucuccacggugaagacgcugucuccagaccagcgcguggagcgccugcag

SEQ ID NO: 10187 - RNA, 73 nt, Human
caugggaaagcgggaccaccagaaggagugaugaucaacgaucucaugauaaaucuggaugcucgcucucaug

SEQ ID NO: 10188 - RNA, 89 nt, Human
gguagcaucgagucucugcgaacauuccuuuuaaccuaugucuuacaaaggcccaaccuucaaaaguauguucgggaacagauucuacu

SEQ ID NO: 10189 - RNA, 60 nt, Human
cccggaggccaaagcagaugcugcaccagaggcuggucagaacccgggagggccugcggg

SEQ ID NO: 10190 - RNA, 71 nt, Human
ugggguccucaugagcaagugcggggugcuggaggucagcagcugccugggcugggaggcaaggacaccca

SEQ ID NO: 10191 - RNA, 86 nt, Human
aggaacgauucacaggacaaacaaacccaauuuuuaagaaguuuauuugaaacucuuccuggucgaguccagugugaaauguuacu

SEQ ID NO: 10192 - RNA, 75 nt, Human
gcugcuguacgacauguuugugaauuucccagaccagccggugguguggagagaaaucagcauuauuacaucagc

SEQ ID NO: 10193 - RNA, 112 nt, Human
ggccgcuucgggcuggcggcuggagagcgcucgggucaugucugcccagggggacugcgaguuccuggugcagcgagcccgggaguuggugccgcaagaccugugggcagcc

SEQ ID NO: 10194 - RNA, 66 nt, Human; identical to SEQ ID NO: 3294

SEQ ID NO: 10195 - RNA, 71 nt, Human; identical to SEQ ID NO: 3295

SEQ ID NO: 10196 - RNA, 76 nt, Human
aucuguaaaugggauucguaauccuugcagugcuugguaggggacaaagaggauucauucaaacccuaggacagau

SEQ ID NO: 10197 - RNA, 97 nt, Human
gaggaagggagcuggggcuucgaggggaccugcacauucaguccugugcugggugcuggagacucgucccuccccacugcccccucugcccauccuc

SEQ ID NO: 10198 - RNA, 61 nt, Human
ggccagcugaucgcucccuccuagccccagagggguggcugggcagggccaugucacggcu

SEQ ID NO: 10199 - RNA, 80 nt, Human
gcucugagcaggcagcagggagcagcucuggugacgcuucaugugguagccucacucuccauucucugccccucucgugc

SEQ ID NO: 10200 - RNA, 78 nt, Human
agcggaagauggagaaccgugauuaccgggaugcacaggaguuugcugcugauguacggcuuauguucuccaacugcu

SEQ ID NO: 10201 - RNA, 65 nt, Human
gaugaaccacuagaaccagggccuuuaccagucucuacugccaugcccccuggcuuggucaaauc

SEQ ID NO: 10202 - RNA, 69 nt, Human
gcuauaaguacaaucccccagaucacgauguuguggcaauggcacgaaagcuacaggauguauuugagu

SEQ ID NO: 10203 - RNA, 67 nt, Human
accaucccauauauauaaccauauccauauauauauauauauauaucccacauauauaugggauggu

SEQ ID NO: 10204 - RNA, 94 nt, Human
cauguauauguauguguguguguauauauguguauauauguauacacacacacacauauauauauauauauacacacacacacauauauauaug

SEQ ID NO: 10205 - RNA, 72 nt, Human
ugucagguuucaauguucuuggaccucagggccuucguccucuccaaucuaaaugcagagagacauuugaca

SEQ ID NO: 10206 - RNA, 63 nt, Human
uuuuuuuuuuuuuugcaagaaccggucacuuaucaguaaccauuuuuauuuaaaaagaugaaa

SEQ ID NO: 10207 - RNA, 69 nt, Human
cccgcccagggcaggccagucucgugggccugggccugggcauggacauggcccagcucugagggcggg

SEQ ID NO: 10208 - RNA, 60 nt, Human
gagaggcgugugucccagugccuccaguucacaagggagccugggucgacaugcucuuuc

SEQ ID NO: 10209 - RNA, 71 nt, Human
guggagccagcccaguaguacguaacguggcauggucuuccacgcaaccgggcgacugcugggugauucac

SEQ ID NO: 10210 - RNA, 65 nt, Human
uggugaguggggcucaaacaaaacauaagggaagagacugagacaaaugugggcccuccugauca

SEQ ID NO: 10211 - RNA, 60 nt, Human
gccgugcgcgggccucggacccucagagaggcgaggguucgaagggcacgaguucgaggc

SEQ ID NO: 10212 - RNA, 61 nt, Human
guaacuuagagaaauagccacauucaaugcacuuaaugaaauccuguuuucuuuggaguac

SEQ ID NO: 10213 - RNA, 93 nt, Human
uagcauaaacacagcuaaacauaguguuaaacacugauagcaucaguaccuguucuaauugcaucaguguuuaccucucagucuagcaugcua

SEQ ID NO: 10214 - RNA, 85 nt, Human
cagugguauuuguggcguaucuggcgcuugucaguguggggcccaggccugaugagccaccagcccagcacccgaaugccugcug

SEQ ID NO: 10215 - RNA, 68 nt, Human
ucagacugcgggucacguugagagccaacaccaugggcucgguuccggcugaaaacccgccaguguga

SEQ ID NO: 10216 - RNA, 106 nt, Human
gccaguucuuugugacccucgcccccacccaguggcuugacggcaaacacaccauuuuuggccgagugugucagggcauaggaauggugaaucgcgugggaauggu

SEQ ID NO: 10217 - RNA, 77 nt, Human
cuuggacucuuccgugucugcuacagagcaagugcgcacucagugucugcuauaacgcgucacuggagaaacccaag

SEQ ID NO: 10218 - RNA, 71 nt, Human
uuuuuucaugcauuacugcguuuauuucucucuaaaaccuuaugaaguaaaaacuaacuagcaaggggaaa

SEQ ID NO: 10219 - RNA, 92 nt, Human
aaaaguuauuuuauaaauaaagggaacuuccaggcuuucagucuuuaagaaaagcuaaggcuuguuuggcuuuuuguuuauuuuuagguuuu

SEQ ID NO: 10220 - RNA, 100 nt, Human
agccccagggcucgacgccugucccguuccuggucaaugagaccccaggcccaauaggcuuauaggccagugagcccaggccccuacaagcccugaagcu

SEQ ID NO: 10221 - RNA, 83 nt, Human
gcuauuuuugcuguuuggcagauggugaggggucacucuggcuguccucuggcuccuccuccugcagcggcagcuuggguggc

SEQ ID NO: 10222 - RNA, 74 nt, Human; identical to SEQ ID NO: 365

SEQ ID NO: 10223 - RNA, 102 nt, Human; identical to SEQ ID NO: 2172

SEQ ID NO: 10224 - RNA, 77 nt, Human; identical to SEQ ID NO: 3082

SEQ ID NO: 10225 - RNA, 80 nt, Human; identical to SEQ ID NO: 367

SEQ ID NO: 10226 - RNA, 64 nt, Human; identical to SEQ ID NO: 3889

SEQ ID NO: 10227 - RNA, 64 nt, Human; identical to SEQ ID NO: 3890

SEQ ID NO: 10228 - RNA, 69 nt, Human
uuugacuuuuuuuuuauuuggaaaagagacaguugaaucccuuuucuuuaccagcauaaggcagucagg

SEQ ID NO: 10229 - RNA, 83 nt, Human; identical to SEQ ID NO: 2490

SEQ ID NO: 10230 - RNA, 81 nt, Human
gaugccuugcagggugagccggcgcucugcagcuugguccucacacaccagcgggccuccggaaucacccuggcacgcauc

SEQ ID NO: 10231 - RNA, 74 nt, Human
gggacacaaucuugccuuccaugccccagccacucucucacugcggaaucaccaaggagggaaagaugaguccc

SEQ ID NO: 10232 - RNA, 84 nt, Human; identical to SEQ ID NO: 286

SEQ ID NO: 10233 - RNA, 64 nt, Human; identical to SEQ ID NO: 287

SEQ ID NO: 10234 - RNA, 89 nt, Human; identical to SEQ ID NO: 288

SEQ ID NO: 10235 - RNA, 71 nt, Human
gggguuauauuucuaagugauuuacaauuucuguuucuaaaauuguugggauuuagaaauguuucaauucc

SEQ ID NO: 10236 - RNA, 78 nt, Human
auaucccaaaugcugcuugcuucaaacaggcacccucggugcugccuccucugaggcuggcaguuccuuccuggauau

SEQ ID NO: 10237 - RNA, 67 nt, Human
gagcuggcuccugggcccacagcugugccugggaauaguccaggcugugccugcagaggagcugcuc

SEQ ID NO: 10238 - RNA, 75 nt, Human
caccugauuuuuaagcuuugacaccugcacauuuuaaguuuccaugucuaguauuuguacaaacuaaaugaggug

SEQ ID NO: 10239 - RNA, 69 nt, Human
cauuaaaguuaacugguccaacucugucauuuuacagaugaagaaaccaagacccugaaaaguuuaaug

SEQ ID NO: 10240 - RNA, 60 nt, Human; identical to SEQ ID NO: 7400

SEQ ID NO: 10241 - RNA, 62 nt, Human; identical to SEQ ID NO: 9119

SEQ ID NO: 10242 - RNA, 64 nt, Human; identical to SEQ ID NO: 8200

SEQ ID NO: 10243 - RNA, 66 nt, Human; identical to SEQ ID NO: 2189

SEQ ID NO: 10244 - RNA, 73 nt, Human; identical to SEQ ID NO: 9122

SEQ ID NO: 10245 - RNA, 62 nt, Human
cacgggccauacggagacuagcgaagguuugaaauucuucucuuccucagugaugacucgag

SEQ ID NO: 10246 - RNA, 67 nt, Human; identical to SEQ ID NO: 6606

SEQ ID NO: 10247 - RNA, 74 nt, Human; identical to SEQ ID NO: 365

SEQ ID NO: 10248 - RNA, 104 nt, Human
ugaaacagacugggccaauguccacaaagaauuccuggucagcaccaccgauguccaaaggugcaauaucaaggaagggcaggcgugauggcuuauuuguuuug

SEQ ID NO: 10249 - RNA, 77 nt, Human; identical to SEQ ID NO: 3082

SEQ ID NO: 10250 - RNA, 119 nt, Human
cucuuuagguauuagagccucuuagaugagguaucguuuacugcaaagaaaaaaaauuguuauaauuuugccauaaguuaugccuauuuagauggcuguauaacugguacuuugaagag

SEQ ID NO: 10251 - RNA, 106 nt, Human
aaauggaaggauucagcuuucaguuaaaaaagaagaagaagaaauggcaaagagaaaguuuuuucaaauuucuuucuuuuuuaauuuaaauugaguucauuuauuu

SEQ ID NO: 10252 - RNA, 63 nt, Human
auccuucuuuuucucuuuugcccacaauuuaagcaaguagaugugcaaaagaaauggaaggau

SEQ ID NO: 10253 - RNA, 94 nt, Human
guccucugccuccaccgccccgggaucuccuugcgcucgguccucuacguggagucaccuaugcagaggaauuccacggggcgggggcgaggac

SEQ ID NO: 10254 - RNA, 81 nt, Human
ugcgggggucuuuauggcagacaauccccggcugagcgcuuggccagaguuucugugaugcuagaaucuggacugccugcg

SEQ ID NO: 10255 - RNA, 84 nt, Human; identical to SEQ ID NO: 286

SEQ ID NO: 10256 - RNA, 89 nt, Human; identical to SEQ ID NO: 288

SEQ ID NO: 10257 - RNA, 94 nt, Human; identical to SEQ ID NO: 5398

SEQ ID NO: 10258 - RNA, 84 nt, Human
cauuuagaaaauuacuacaaaguaaaacaugugaggaauagaaauguuuuuuucaugaacauuuuguaccaauucaucauuaug

SEQ ID NO: 10259 - RNA, 66 nt, Human
gaauggaucuguuuuccaagagauucugagaaauuuuguauucagcaguuggaaagcucucuauuc

SEQ ID NO: 10260 - RNA, 81 nt, Human
aggucuggaggggccauggggcaguccugggugugggacaccgucgggguuugacccaggguugucuccccuccagagccu

SEQ ID NO: 10261 - RNA, 89 nt, Human
gagguggagugacugagaagagaaaaccaggucuuaagcgugagaaucgcggacaagaaguacuaccccagcucccaggacuccagcuc

SEQ ID NO: 10262 - RNA, 76 nt, Human
guuuucgcugugaacauucccuugaucucaucaaguucugagcgggucaauggggcaacacgguuagcgggagagc

SEQ ID NO: 10263 - RNA, 130 nt, Human
ccucuaagggguauaccuggcccggggcguggccaccacuggugucauacauugcgcguucauucuccuuggcaauuuggacaacaauacgugguggcauuucucuuguccacuggguaaccuuuuggug

SEQ ID NO: 10264 - RNA, 80 nt, Human
guagagaggguguuucaccauguuggccagguuggucucgaauuccugaccucaagugauccgcucgcucgccucucuac

SEQ ID NO: 10265 - RNA, 75 nt, Human
gaaacaaaugcuuccaggugaaaaaacugaucagcuauauagagucacucaguuuuuaauaaaggccauuuguuc

SEQ ID NO: 10266 - RNA, 75 nt, Human; identical to SEQ ID NO: 8223

SEQ ID NO: 10267 - RNA, 79 nt, Human; identical to SEQ ID NO: 8224

SEQ ID NO: 10268 - RNA, 81 nt, Human
gcugacuccuauggaaggccuaccaaaugaggaaauuucaggaauuugcuaaugcgugggaggauugaaaauguaggcagc

SEQ ID NO: 10269 - RNA, 79 nt, Human
cauuuguuucacuguguucaauuuugaguuuccuaacauccauucuacaggucaaucaaaauacaaaggcgugcaaaug

SEQ ID NO: 10270 - RNA, 66 nt, Human; identical to SEQ ID NO: 2266

SEQ ID NO: 10271 - RNA, 72 nt, Human; identical to SEQ ID NO: 5861

SEQ ID NO: 10272 - RNA, 99 nt, Human
augugcuuaaauaacgcugaauuauaauuagccacacaaauaaugagaguuuuauuuuuuuuuuucuggcucacuccaaaucagccuguuaagguauau

SEQ ID NO: 10273 - RNA, 75 nt, Human
gacauacuacaaagagauuuuuuuaaguuuaaaaaaaguuuggaucuuuuggauuucuuuuuuuuuuuuuugguc

SEQ ID NO: 10274 - RNA, 72 nt, Human; identical to SEQ ID NO: 5861

SEQ ID NO: 10275 - RNA, 67 nt, Human
gggcacauggauugggauaaauucaucagcagcuuggucaggcugggaugccaauguucucgugccc

SEQ ID NO: 10276 - RNA, 74 nt, Human
cacugccaccacuuggccuggcguggccacguucuuacucaucuggagccaggcaaggcaaagugaugguggug

SEQ ID NO: 10277 - RNA, 62 nt, Human
ggcgcuccgaggccgcugguguggugcgaggacggcagcccgggccgaggcgucaggucgcc

SEQ ID NO: 10278 - RNA, 61 nt, Human
gugugugcguccggacucuggagcccagcgggaagcuagcaccagccugggccgcacacac

SEQ ID NO: 10279 - RNA, 61 nt, Human
cuaauuuaguuggcccuucuuucagcacuucuauuaacauuucucugaaauagcuauuuag

SEQ ID NO: 10280 - RNA, 64 nt, Human
uuguauaacuuuuauucuuagauuauauuacaaugugucagucucaaguauaacuacaauauaa

SEQ ID NO: 10281 - RNA, 70 nt, Human
ucaggccaucugggcguauacgugcaagucacagggaaugcgauggcuuggcuugggcucagaggccuga

SEQ ID NO: 10282 - RNA, 76 nt, Human
aagcuuuccugacaagaaaaaaacauguuugguaaacaaaagaucauguguauuucuccuugcagguuaaaaguuu

SEQ ID NO: 10283 - RNA, 101 nt, Human
gaucacuacucuuggaaucaaagauaaauccaaauacugcauaucagaaacaacaggcaaguaguuguuuaucuuuaauuugaaagacuucaucugugauc

SEQ ID NO: 10284 - RNA, 71 nt, Human
ucaggccaucugggcguauacgugcaagucacagggaaugccgauggcuuggcuugggcucagaggccuga

SEQ ID NO: 10285 - RNA, 96 nt, Human
gccccccuacuuccgcuuccugacacucauggccuuccacgucuuccuccaagagaagguggaccuggcagugguggaggugggcauuggcggggc

SEQ ID NO: 10286 - RNA, 69 nt, Human
gucagguuaaaaggcuuugcacagcuauuguucacauuuacagccuuggcucaaacccuggucucugac

SEQ ID NO: 10287 - RNA, 92 nt, Human
gacuguccgucaagcaggcagcggggauguagcucucucugcccugggcaagaauagcacuucccguuaaaagccagcagccggcgucaguc

SEQ ID NO: 10288 - RNA, 85 nt, Human
ucucucucagguuuuaaauguugcaaauguaauuguggcucaucaaugcagcuaucaaugcaacuuuauauuccuugaggggaga

SEQ ID NO: 10289 - RNA, 88 nt, Human
aaaucuagccagagcccuucacugccaugauagcuggggcuucaccagucugucuacuguggugaucuguagacuucugguuguauuu

SEQ ID NO: 10290 - RNA, 70 nt, Human
uaauaaaaauuuaauucacauucaauuaaaaaaaaaacaauaugaguaaugugaaauugaguuuuuguua

SEQ ID NO: 10291 - RNA, 61 nt, Human
caggcagguuugccaagcugcugugcgccuccagcucugcguccauugguugaaaugccug

SEQ ID NO: 10292 - RNA, 65 nt, Human
gcugugacuugaaccagccagggcccuuuccccuacccuuggaaggaagauggugaucagacagc

SEQ ID NO: 10293 - RNA, 65 nt, Human
uccccagguauuaauuuucaaugguacuaauaacuuaucccaaugguaaaaaaugcagccgggga

SEQ ID NO: 10294 - RNA, 62 nt, Human
gccgcaggagggcucggccgugcugcgggaaaugcucucggucggccuaggcuuucugcugc

SEQ ID NO: 10295 - RNA, 77 nt, Human
gcgcgagggacgugcgcgaugcgcucggucugaggguuacccgggcucucggcccguuccucgcguucccucgacgu

SEQ ID NO: 10296 - RNA, 78 nt, Human
gacuuaauauuuuuuccuugauaagguaauuuuaguuucccccacuuugauaacuguagcaaugaacuuuuagaaguc

SEQ ID NO: 10297 - RNA, 62 nt, Human
uuuauuuuuuuaauacaauagcugccagcaauacacugguguugauguuccagagaaaagaa

SEQ ID NO: 10298 - RNA, 76 nt, Human
acccgugccggccagcgcaccagguucaaggcauuuguugcuaucggggacuacaaugugccacgucggucugggu

SEQ ID NO: 10299 - RNA, 98 nt, Human
ccgcguguggcuuccgcggagguuucggcaguggcauccggggccggggucgcuggccguggacgguggccuggggccgaggccugcggagcucgcgg

SEQ ID NO: 10300 - RNA, 68 nt, Human
cucccuuccuuuuuucaccguguucaggauaaauuaucuugguuuuguuucuggagggaaaagggcag

SEQ ID NO: 10301 - RNA, 69 nt, Human
ggcccugacuugaaucucaaucacauuucugcacacaguaccuuggacagaagucaugaugauggggcc

SEQ ID NO: 10302 - RNA, 93 nt, Human
auaccauauugagauuauaauauucuugcagucuaaauuuaagcuauuguuuaaacuuuugcauuguaaaaagaaaaguucaugugugugugu

SEQ ID NO: 10303 - RNA, 75 nt, Human
cuuuauuaaagugaaacuacuacuucaauauaugcagaaaacaacauauuggauauuuucaccucugggauaaag

SEQ ID NO: 10304 - RNA, 103 nt, Human
guguaucauagauaauccuaaaacaauauaacaaucauuuaacccaaagucaaugcccuuuaaauggaauguaucuuugucauuauuuggcuaugaaauauac

SEQ ID NO: 10305 - RNA, 81 nt, Human
uggugugacuuuauuuggggucuguuuggaucuuucuauauuccccuggucccuuuguuuauccuacauaugucuucacua

SEQ ID NO: 10306 - RNA, 65 nt, Human
gaaaauugccuuaauaucauuguuggcuaaauagaauaggggacaugcauauuaaggaaaagguc

SEQ ID NO: 10307 - RNA, 95 nt, Human; identical to SEQ ID NO: 3838

SEQ ID NO: 10308 - RNA, 61 nt, Human
ugcuccuucaucagcuuugccaacucucggagcucggaggacacgaagcaaaugaugagua

SEQ ID NO: 10309 - RNA, 63 nt, Human
aguuucucagaaugcuucuuucuugucuuuaugugaagauauuuccuuuuccauucagaaacu

SEQ ID NO: 10310 - RNA, 85 nt, Human
ggcccugggcguggcugucauaggcaucgacgaggggcaguuuuucccugacaucguggaguucugcgaggccauggccaacgcc

SEQ ID NO: 10311 - RNA, 63 nt, Human
cccagguugugggggcagcccugaauuuuuuuuuaagcaaauucccccuuuccccaaccuggg

SEQ ID NO: 10312 - RNA, 76 nt, Human
ugcuacgaggaggucaaggaccgcugcacccuggcagagaagcuggggggcagugccgucaucucccuggagggca

SEQ ID NO: 10313 - RNA, 75 nt, Human
aaguucauucuagcaguaauuuaucagaggucacucauccucuauuaaauuauuaaucuaaucaccuuugaacuu

SEQ ID NO: 10314 - RNA, 93 nt, Human; identical to SEQ ID NO: 6421

SEQ ID NO: 10315 - RNA, 68 nt, Human
guuuugcaauucuucugcacuuucccaccaagcugggaucugggugagucuagagauauuugugaaau

SEQ ID NO: 10316 - RNA, 65 nt, Human
gcuggaucucccccgcuguugaucauacucaaaguguuucaccgcccugccuagaucuauaccgc

SEQ ID NO: 10317 - RNA, 79 nt, Human
uguauaaaccgcgcaccauacagacagcacauuaccccacccccguauuuccacacuuauaugugcacggacuuguaua

SEQ ID NO: 10318 - RNA, 69 nt, Human
ggagggacuuccagcuccuagucguguggguugcaggccguccugucccagggcugggggacuuccuuc

SEQ ID NO: 10319 - RNA, 60 nt, Human
aagacuccuuuucagaagcagccuguugcugauugccuccuuccuucuguaaggcuucuu

SEQ ID NO: 10320 - RNA, 66 nt, Human
ucuguuacaagacuuucaauaucagccuucaugcucuuaauuugauuuucuuuuucuucuaacuga

SEQ ID NO: 10321 - RNA, 75 nt, Human
cuuggggcuucacuguggcugacaagaguauuauuacuaccuacaccucguacagcacacaaccagaaccuagag

SEQ ID NO: 10322 - RNA, 66 nt, Human
gucuuuguccacuuucaguuugcaauaccacuaggagagaaaaggucuggaugaagggaugaagau

SEQ ID NO: 10323 - RNA, 66 nt, Human
gugaacucugcccuaaaguccuccuuccagcauuuggaagcauuccaccaugaggagcagguuuac

SEQ ID NO: 10324 - RNA, 63 nt, Human
caauuugaaauuuuacaggaaccaagauucaagcuccuuaggugcuacuguauuuuuauguug

SEQ ID NO: 10325 - RNA, 81 nt, Human
uuuuuuuuuuuuuuuuuuuacgaccaaacaucacaaacacuuuauuugugguuaccaguuauuuuuacagagaauaaagaa

SEQ ID NO: 10326 - RNA, 67 nt, Human
auacuuuaaaauuauaggaauaaucucagugaauucagugaaugugcaaccuaaaucaaccaaguau

SEQ ID NO: 10327 - RNA, 62 nt, Human
aagaacuugauuuugcuagcagaaauuuuuaccccauucucaagcuucuauaaacaguucuu

SEQ ID NO: 10328 - RNA, 77 nt, Human
uguucugagaaagcaggcaaagucccugccuacaggguucccccacguaccugcaggacaccgucugucuuacggca

SEQ ID NO: 10329 - RNA, 61 nt, Human
gugcccuggggcuuuccaaaggcaccucgcaugccuguuuggagccugucagccccagcac

SEQ ID NO: 10330 - RNA, 61 nt, Human
guguuugauacuaguuuguuuauguacccccaccaggggaaaaacaaaacccaccaaaaac

SEQ ID NO: 10331 - RNA, 68 nt, Human
accgcgucggacgucgaaguguuuaaggcggguuucccaggccuggaaugcuaaaccaacggcccggu

SEQ ID NO: 10332 - RNA, 68 nt, Human; identical to SEQ ID NO: 6567

SEQ ID NO: 10333 - RNA, 81 nt, Human
aguaguucuuugaugugaaaggggcagcacagucauuuaaacuugauccaaccucuuugcaucuuacaaaguuaaacagcu

SEQ ID NO: 10334 - RNA, 84 nt, Human
auccuuaaacacugugcugaagacuacugugacucuguccuuuuuagacucaacauacauggucucaucaucccuauaauggau

SEQ ID NO: 10335 - RNA, 66 nt, Human
cccacagcggcgucugugucuuucagcuccagaggagguucccuguggcuaaagaggaccuguggg

SEQ ID NO: 10336 - RNA, 87 nt, Human
accaguaagggguucccugacaccuacacaaaauguggaaauaaagaguuuggcaauugguagaguaaaucccuuuggaaagcuggu

SEQ ID NO: 10337 - RNA, 68 nt, Human
cuucuacccugacuucucccgccuccgagaguccuuuggggaccccaagggagagagucagguggagg

SEQ ID NO: 10338 - RNA, 61 nt, Human
gagccugaagacauacagcacuucaccuggagaagccuacugcgcgagauucucugggcuc

SEQ ID NO: 10339 - RNA, 66 nt, Human
gcugguacgccugcagguaccgguccggaauucccgggucgacccacgcguccgacagcaaccagc

SEQ ID NO: 10340 - RNA, 77 nt, Human
auugcuuucaguuucuucuuuagguucuugauuuuuuugucuaucucaggguccccagaaauugacugagagacagu

SEQ ID NO: 10341 - RNA, 89 nt, Human
cguggugugcucuguggggcaggaguaggugccaaaucuggacucuugucacuucuugcuuccugcuuugcagcuuucuuagcuucaug

SEQ ID NO: 10342 - RNA, 65 nt, Human
uaucguuuccugauugugguuucauauucugaggugguuccucuucaugcaauuuggaauuggug

SEQ ID NO: 10343 - RNA, 63 nt, Human
gguauuuuaaauauacaguaggaacauuuauuuuaacacuucuaaaagauauuucuccaugcc

SEQ ID NO: 10344 - RNA, 80 nt, Human
agguaucugugacucuugggccucugcucuggugggaacuuacuucucuauagcccacugagccccgagacagagaaccu

SEQ ID NO: 10345 - RNA, 62 nt, Human
cuccaggcuuucagaauaauuguuuguucccaaauuccuguucccugaucaacuuccuggag

SEQ ID NO: 10346 - RNA, 67 nt, Human
gaguggguggcagugagguggcccagacccucgccauggagacuuugcauccaccgccucccagcuc

SEQ ID NO: 10347 - RNA, 67 nt, Human
uggaaguuaugacagacuucgaacuacauguacuuuguaaacaguaccgacacauuaauaacuuuca

SEQ ID NO: 10348 - RNA, 61 nt, Human
ucuuccagaagugugauugggaauaaauaugccucuccuuuuuauauuauuucuaggaaga

SEQ ID NO: 10349 - RNA, 76 nt, Human; identical to SEQ ID NO: 5154

SEQ ID NO: 10350 - RNA, 74 nt, Human
gagcggcacgaggguuacggcagcacuuuuauuuuuccuuacacaaugacguguugcuggggccuaauguucuc

SEQ ID NO: 10351 - RNA, 79 nt, Human
uagcaugaggugugugcauuugccaggggcaaauuucuauucucaauuaacccaugcagcaaaugcuacgcaucugcug

SEQ ID NO: 10352 - RNA, 64 nt, Human; identical to SEQ ID NO: 1642

SEQ ID NO: 10353 - RNA, 68 nt, Human
cgggcgugguggugcgugccuguagucccagcuacucaggaggcugaggcaugaaucgcuugaaccug

SEQ ID NO: 10354 - RNA, 102 nt, Human
cuucauggcacugaacuugucguggucggggccaauccaugagccccaggugccaaggcuggugggagagcccccgaccacgacaaguucagugccaugaag

SEQ ID NO: 10355 - RNA, 66 nt, Human
gugauucuggcacaggaaauggucuccaaaaucucaaaauaucagaucucuaccuugucaagucau

SEQ ID NO: 10356 - RNA, 67 nt, Human; identical to SEQ ID NO: 3353

SEQ ID NO: 10357 - RNA, 64 nt, Human
ccuaaucgacuucuuccaugcgagacgcauccucaucgcccucgagaggggggaucucaucagg

SEQ ID NO: 10358 - RNA, 65 nt, Human
uucacaaugggguggucaagggugaucuucagguggcuuuugggcaucauauaccccauggugga

SEQ ID NO: 10359 - RNA, 84 nt, Human; identical to SEQ ID NO: 286

SEQ ID NO: 10360 - RNA, 64 nt, Human; identical to SEQ ID NO: 287

SEQ ID NO: 10361 - RNA, 103 nt, Human; identical to SEQ ID NO: 294

SEQ ID NO: 10362 - RNA, 65 nt, Human
gcaaacuugcaugccaugugacccgugugcaaauccauacaagggcauugccggcgcuuauuugc

SEQ ID NO: 10363 - RNA, 60 nt, Human
ccugggugcuguggaagguaguagauucuggacaagggaugauggugugguacugccagg

SEQ ID NO: 10364 - RNA, 75 nt, Human
gcgggcaggugagaguguacugucuggugaucuggggcuacuguagaaggugguagauuucucacucaggccugc

SEQ ID NO: 10365 - RNA, 63 nt, Human
ccagacaaccuuagccaaaccauuuacccaaauaaaguauaggcgauagaaauugaaaccugg

SEQ ID NO: 10366 - RNA, 65 nt, Human
ccaaccaaaaggaggccccaugugggcuggaaaacagcccccagaaagggucaauugaagggugg

SEQ ID NO: 10367 - RNA, 93 nt, Human
ggcagagggcucuccuaauggguucacagugagauuucuuugaagaaaaagcuucaguugagcucaguaacaucuuagcgagaaccaagugcc

SEQ ID NO: 10368 - RNA, 60 nt, Human
uuggaaaagguucuagggcagggaaaaugcacccauuuccccuuuucccuuuuuuuccaa

SEQ ID NO: 10369 - RNA, 67 nt, Human
gcugugggcaaggucaucccugagcugaacgggaagcucacuggcaugggcuuucgugucccacugc

SEQ ID NO: 10370 - RNA, 61 nt, Human
agcucgccuucugguccagguucgggaagcgcucgcgggccgucaagccacgcggcgagcu

SEQ ID NO: 10371 - RNA, 91 nt, Human
gccaccaggcgguggucugugaugaaggucagggccacgcagggguagguucacagaggccaggagucgcagacggcaacuucuggugggc

SEQ ID NO: 10372 - RNA, 64 nt, Human
uuuuuuuuuucaauaaaggaaagcuuuaagaaaagggcacguauuccuggaauagguaagaaaa

SEQ ID NO: 10373 - RNA, 63 nt, Human
aucauguccaccccugcagauccuuggaaaagaaaauguuuauguugcaggguauugcauggu

SEQ ID NO: 10374 - RNA, 63 nt, Human
gcgggggagcagagaugauccgagccgcgccgccgccgcuguuccugcugcugcugcugcugc

SEQ ID NO: 10375 - RNA, 94 nt, Human
gucuacuuuggcuacuaccaugggcuucugggggaacagggcuauggccuucucuuccagaaaccacugggugguccucaaaaccaaagugggc

SEQ ID NO: 10376 - RNA, 62 nt, Human
ggccgaagcggacaggggaguauccuucgaaggugcaucucagccgcuagaagccuugagcc

SEQ ID NO: 10377 - RNA, 90 nt, Human
aucuuagccauucaugauagcuauaaacccgaauuccacagugaugacucugggguugaauuuauugagcuagauauugaugagccagau

SEQ ID NO: 10378 - RNA, 66 nt, Human
ccggguuccccccuguuaaccaccugggcaaaauuucacuucccuuccuaacagggaggggcgcgg

SEQ ID NO: 10379 - RNA, 61 nt, Human
acauaaaugggauggauaauuaucguauauaagaugugauucucuuuuuuauccuuaaugu

SEQ ID NO: 10380 - RNA, 76 nt, Human
gugugcauaaacuucuaucuccauguugguggccuauacgggcacccaugugaccaaggaacguugccuugcacac

SEQ ID NO: 10381 - RNA, 79 nt, Human
auguuaugaaaaagcaauagugugguccuggcuaugacaauccuauaaaagccagagaacacugugauuaagggaacau

SEQ ID NO: 10382 - RNA, 69 nt, Human
uggauaacaguauaauagcauuuacaauauuucacucuuuguucucuuaaugucuuauauaguuauuua

SEQ ID NO: 10383 - RNA, 70 nt, Human
caugguaaacugaccaauugcagugagucuuuauagcccucccugcuccuugcagucauuuauugccaug

SEQ ID NO: 10384 - RNA, 67 nt, Human
cuuuuaaaaucccaugccaaacugucacuuuuucccuuaaaaaguggauaaacccaucuuuugaaag

SEQ ID NO: 10385 - RNA, 62 nt, Human
gaagcacagaagcaaagcccaggcagaaccaugcuaaccuuacagcuuagccucuguccuuu

SEQ ID NO: 10386 - RNA, 60 nt, Human
uuaaaucugguuauaugugggacuucaacagcucaauuuuuccacaauuuccacuuuuaa

SEQ ID NO: 10387 - RNA, 66 nt, Human
auuuuuuuuggauaguuuaaaacauuuugaucacagauuucaacagaguuuuaggcugaaaaaaau

SEQ ID NO: 10388 - RNA, 97 nt, Human
ucuuccaaugacuguaaaucuuuuucuauucuguaguauuuuucugauucucagggcaugaaaacauuaugggaaaaaaaaggauuuucuacgaaga

SEQ ID NO: 10389 - RNA, 64 nt, Human
gaaggacauauacauaauuagccugagcuaggguugaggaagaaaauugaguugaagugccuuu

SEQ ID NO: 10390 - RNA, 62 nt, Human; identical to SEQ ID NO: 1277

SEQ ID NO: 10391 - RNA, 62 nt, Human; identical to SEQ ID NO: 4194

SEQ ID NO: 10392 - RNA, 67 nt, Human; identical to SEQ ID NO: 4195

SEQ ID NO: 10393 - RNA, 61 nt, Human
cccagugucaggaugguaauucuuauucuuucguucaguuaaguuuuucccuucaucuggg

SEQ ID NO: 10394 - RNA, 69 nt, Human
acccuuuccaacauuucuccaaaaguuauccuucucccaguuuaacugcuaaaaugccauugguagggu

SEQ ID NO: 10395 - RNA, 60 nt, Human
auucaucuguacuucaauaucuaguuuccauagcaacugagaugcaguuugcaggugggu

SEQ ID NO: 10396 - RNA, 78 nt, Human
cagaguauaugggggccucugccaccccccaggcugggacuggggccugugaccuugagaaccucaucucacauucug

SEQ ID NO: 10397 - RNA, 60 nt, Human
gggagggggcaggcacaugcuccucguagaacaagaguggguuucuucccugacccuccc

SEQ ID NO: 10398 - RNA, 70 nt, Human
ccaauggcacauggacugguguuagcaaggaagggacccuuuguuuagaacgggucagaugggccguggg

SEQ ID NO: 10399 - RNA, 70 nt, Human
cuggauuuucuuugguuggcaauauuuuuuauacaauuuuaaucuuguugcuuguuaucagucuguucag

SEQ ID NO: 10400 - RNA, 65 nt, Human
ggcugcacccagucauuuuggccuccauuguggacagcuacgagagacgcaacgagggugcugcc

SEQ ID NO: 10401 - RNA, 73 nt, Human
gucccggcggcggcccagccucaguuccagcgccaacgccagcaccggcugcggcuccgguucccgcugcggc

SEQ ID NO: 10402 - RNA, 85 nt, Human
gcgaccacaacuaccaagagcuacauccuuagagcgcucgggcagcugaugcucuuuguggauggaaugcugggggugguggcgc

SEQ ID NO: 10403 - RNA, 83 nt, Human
uccgugcuccaaguuuauaauugcuauaggaaauaaugcaguagcauuucugucaucauuuguuaugaauucaggagucuggg

SEQ ID NO: 10404 - RNA, 103 nt, Human
gauuuucaguacuguaguugcccuggacauugaguacaguucagccuuacucuguuuuuaaguaguuguguugucaauuucaugcuuuuaaguccugaugauc

SEQ ID NO: 10405 - RNA, 71 nt, Human
ggagaugggagaaaaaagauaccagggauaauuaaaauccacagcaguuucaucaguuuccucauccaucc

SEQ ID NO: 10406 - RNA, 82 nt, Human
cggguacucaggaggcugaggcaggaggaucauuugaauccgggagguguccucucuaccuuaguaggcacagaguacacug

SEQ ID NO: 10407 - RNA, 82 nt, Human
cuccaggccgggugugguggcucacacuuguaaucccagaacuuugggaggccaagacgagcagaucaccugaggccaggag

SEQ ID NO: 10408 - RNA, 77 nt, Human
ugcguagagguguuuguaguauucucugauggaaguuuguauuuccugugggauugguggugauauccccuuuauca

SEQ ID NO: 10409 - RNA, 75 nt, Human
gcauaauuugcuauaaaauguacuuauuggaauacuauuuauauaggagguaagagaacacuguggggaauaugc

SEQ ID NO: 10410 - RNA, 64 nt, Human
ggaaaggccaguuagcuauccaaccaccgucuaccccuacgcuucauccuggcuccuggauucc

SEQ ID NO: 10411 - RNA, 63 nt, Human
ggcaagggaguggugccuggguuuucugacaaaaucuauacucagaccaacauguccccugcc

SEQ ID NO: 10412 - RNA, 60 nt, Human
uuauugagguauaauuuacauaccauaaaacccacagguuguaaguuuacauuuuaauga

SEQ ID NO: 10413 - RNA, 82 nt, Human
cagcuggaagauggacgcaccgugucuggcuaucgaauccguaaugaugguacuauguagcuggugugcugacuuguaguug

SEQ ID NO: 10414 - RNA, 78 nt, Human
cggaaaacagcuggaagauggucguacccugucugacuacaacauccagaaagaguccaccuugcagcuggugcuccg

SEQ ID NO: 10415 - RNA, 84 nt, Human
gcccggccgugcacccagccugcggcagagagggcggcgucccccacaaagccugccaggcugagcccuugcaauggccguggc

SEQ ID NO: 10416 - RNA, 79 nt, Human
aguuuauuacauuuggaaaaucuacuguacagggaaaaacccauuggauuaaguagaguuuugccaaaagcaaaagacu

SEQ ID NO: 10417 - RNA, 64 nt, Human
ccuggccuuggauggaggcgcucagagccagcucugcccaagacaccccucgucaauuuccagg

SEQ ID NO: 10418 - RNA, 60 nt, Human
cagugagagggggcucugcuccaggcucagggaaugggguugggggccccaccucaucug

SEQ ID NO: 10419 - RNA, 86 nt, Human; identical to SEQ ID NO: 3434

SEQ ID NO: 10420 - RNA, 62 nt, Human
uauguauauauuuaacacacacaucuuaaaaauagcuccagaugaccgaacaguauugcaua

SEQ ID NO: 10421 - RNA, 66 nt, Human; identical to SEQ ID NO: 98

SEQ ID NO: 10422 - RNA, 70 nt, Human
gggcagugcacagaugacagcccucccucacugcccugugugcuggcuaccgcauguccugugccagccu

SEQ ID NO: 10423 - RNA, 102 nt, Human
augucaauucuauuuacugcaggagccuaguaccuggcacagaguagguacucauaauauuuacucaggccgggugugguggcucaugccuuguuauugcau

SEQ ID NO: 10424 - RNA, 69 nt, Human
gcuuuguuucuguugaguguggguuuucuuaauaucugccuccuccacucaguauaaguuccacaaggc

SEQ ID NO: 10425 - RNA, 112 nt, Human
uccaguuuuauccugacugauucuuuucuguuguccuuuguuuucuuucuccucuucuagaucucuaaaugaucuuugggggugggagugagagaacgacgucaguccugga

SEQ ID NO: 10426 - RNA, 65 nt, Human
guucaaucagggguuucucacucucuuccuucagggagagcccagcgaguuuccuucguaugagc

SEQ ID NO: 10427 - RNA, 81 nt, Human
ucugagauguacagucauccuggauccucuuuagcuccuccucaaaugaugcuaaauauuucagguacacagcaucucggg

SEQ ID NO: 10428 - RNA, 78 nt, Human; identical to SEQ ID NO: 566

SEQ ID NO: 10429 - RNA, 95 nt, Human
uucuuucucuugugcuuauucuucuugggagugguguaagacuucuucuuccuuuucuuaagcaccaccacgaagucucaacacaagaugaagag

SEQ ID NO: 10430 - RNA, 67 nt, Human
cagcaucugguccuuuugcugugacccaccccaucccggagcuggucgggucuggcuggaugugcug

SEQ ID NO: 10431 - RNA, 66 nt, Human
gagugccucgcucgguaacugcuugguccugaacauucucucguuucaggaacugaugagguucuc

SEQ ID NO: 10432 - RNA, 74 nt, Human; identical to SEQ ID NO: 4231

SEQ ID NO: 10433 - RNA, 60 nt, Human
aggaccuugugguagcagggaccaugcuucauucguggcuguguccccaucugagggccu

SEQ ID NO: 10434 - RNA, 69 nt, Human
ggcucaacaguuuucucgggggaguucagugaccuuuugguggccacccucuguucucaccugugaguu

SEQ ID NO: 10435 - RNA, 73 nt, Human
ucacuuacauagccccacucagcugcuucggaaagcgugacgaagcaguaguccucaguguguguguaaguga

SEQ ID NO: 10436 - RNA, 111 nt, Human
gucgucguuguagucuuuuugcccaaggcuguuguguuuuuagaggugcuaucuccaguuccuugcacuccuguuaacaagcaccucagcgagagcagcagcagcgauagc

SEQ ID NO: 10437 - RNA, 62 nt, Human
caccucuuaucaagucagcacacaccuuuuccaaggauuuuacguugcggcuuguuagggug

SEQ ID NO: 10438 - RNA, 71 nt, Human
gcgcgcgggcuuccugaccgacuuguuccucggcgagagcgaacagcggugagucaggagcaggagcgugc

SEQ ID NO: 10439 - RNA, 62 nt, Human
guagugauucucaaagucuugguacgcauuccaacugguccuuucacuuugagauucuuuac

SEQ ID NO: 10440 - RNA, 65 nt, Human
gggccccucugcggauggagccccaggugcaacagggcccauggucaucuguggagggacagccc

SEQ ID NO: 10441 - RNA, 65 nt, Human
gaacuagaagaagaaugggucaaacugccaacaagugcuccuagaccuacucgauuucuucguuc

SEQ ID NO: 10442 - RNA, 65 nt, Human
ucuuugagucucgacagaacgcuguucuauaugaagccaaacuaauugcuguggagauuuacaga

SEQ ID NO: 10443 - RNA, 75 nt, Human
gaagauggucgugaauuaggcuacgcuuacagagcccuuucuggagacguggccuuaaauauacacagagucuuc

SEQ ID NO: 10444 - RNA, 74 nt, Human; identical to SEQ ID NO: 1690

SEQ ID NO: 10445 - RNA, 70 nt, Human; identical to SEQ ID NO: 6639

SEQ ID NO: 10446 - RNA, 92 nt, Human
guaugcacagacagaguugggacaugggacauaucuucagggccuggagacugaagccaccuaugacgcagccacccaggaguuugugauac

SEQ ID NO: 10447 - RNA, 99 nt, Human
uggagacuugggacggucagccacccaugcccugguccaggcccagcugaucugcucaggagccaggcggggcaugcacgcuuuuauugugccaauccg

SEQ ID NO: 10448 - RNA, 89 nt, Human
agcuauauccuccuuuugaaaaaugguaaauaacucuuaaaacuucugagaguugcauuuuuauuuuuuagaagguuaaauguguaguu

SEQ ID NO: 10449 - RNA, 84 nt, Human; identical to SEQ ID NO: 286

SEQ ID NO: 10450 - RNA, 89 nt, Human; identical to SEQ ID NO: 288

SEQ ID NO: 10451 - RNA, 94 nt, Human; identical to SEQ ID NO: 5398

SEQ ID NO: 10452 - RNA, 82 nt, Human
ugcacaugauauuaugaacaauacaaaugcauuauuuuuaucauuaauaguuuaaucauuaauuaucucauaagucaaugca

SEQ ID NO: 10453 - RNA, 78 nt, Human
uggauuuuuauggacucuuuauuaggguauuaagauauugaaaauaauacacguaaaccacaaaagaguagcauucca

SEQ ID NO: 10454 - RNA, 64 nt, Human; identical to SEQ ID NO: 7818

SEQ ID NO: 10455 - RNA, 83 nt, Human
uagccucaaaauuuuaauauaaaaaaguguaugcauauauacacacacaaacaugcacaaauuauuuaacuuauuuuggguua

SEQ ID NO: 10456 - RNA, 74 nt, Human
ucacaggucuguaaguuaaggcuaugguugcucuauuaccauaugccaaucaauacuuuaacugcauucuguga

SEQ ID NO: 10457 - RNA, 67 nt, Human
uuuugaaugacaauauauggaguagcaaaaacaguuaaaaugacuucucuuuaagaguuauucagaa

SEQ ID NO: 10458 - RNA, 67 nt, Human
gggaggcuggagccaggugagugugacaggucacagauggcucucaggccaccugccuucagcuccu

SEQ ID NO: 10459 - RNA, 94 nt, Human
uucggguucuagccagaagcccuggggccugucucuugccucuucuuguagcaugagacacccuuggcagguguggcugugaagauguaucgaa

SEQ ID NO: 10460 - RNA, 83 nt, Human
guaacagcaguggaaauaagaaucguccuuucauuuccugaguuggccucaggaaaggaggaugaaauuagauuugcaguuac

SEQ ID NO: 10461 - RNA, 85 nt, Human
ugcuaguuguauauaaaauuuaaucucaccgaauguacaguuuucaaauuucacguguauauuaaggaacugaugcaucugagca

SEQ ID NO: 10462 - RNA, 70 nt, Human
gcagaugaguuacuagaaagcuuccuggaggguuuucacgaugaaagcacccaggugcagcucacucugc

SEQ ID NO: 10463 - RNA, 64 nt, Human
aacaugguaauuacuaaauuaugaggcuuugcuuauaguuugcuuuuaaguagaaaaacauguu

SEQ ID NO: 10464 - RNA, 103 nt, Human
aagacuaagguuucgagagcauuccuacucacaguaguaagaaaucugucagauaggaaucuaacuauugauagugagauugugaaagcaaccuuaaaguuuu

SEQ ID NO: 10465 - RNA, 76 nt, Human
cuuaaaguuuugaagaagacugaugagacuaggugcuuugcuuccuuucaucagguaucuuucuguggcauuugag

SEQ ID NO: 10466 - RNA, 100 nt, Human
uggccauggcaucuccucaugagaaaacuucugagugcagcauggccuggggugacauguugggcuucagcaaggugcuuccagguagauguggugguca

SEQ ID NO: 10467 - RNA, 72 nt, Human
cuguucaccuugucacagggcuaugucuuggcucuuggcuaagacuuuaagggcccacacagcagagaacag

SEQ ID NO: 10468 - RNA, 93 nt, Human
ggagaggcaccacucagaggcaggcccggcugcacaaguccucccugcugggccuggucacugcagcugccccucccuggcuggcuccucucu

SEQ ID NO: 10469 - RNA, 71 nt, Human
uuuuuuuuuuuuuucacacucagaauuuaauuucuccaaaaguuguuucuguguuugauucauguagaaaa

SEQ ID NO: 10470 - RNA, 120 nt, Human
gaaagucuacagucugugaauauaccaauuccccuuuacaacugaugcagaucauuaugaaauacuggaaggcauaaccuacaauuuaggaauugguguggcugccacuguuacgcucuc

SEQ ID NO: 10471 - RNA, 82 nt, Human
aauucgagguugccugaaaagcuggguguccuugcuccuuuuccuggaagccaauauacccaguuuuuacucaguuugaauu

SEQ ID NO: 10472 - RNA, 73 nt, Human
gacagaacucugcuuccagcgcugugugccagcuugcaccaccgagcucuggacgcugaggaggaggccuguc

SEQ ID NO: 10473 - RNA, 65 nt, Human
accacgccuggcuaauuuuugaauuuuugguagagacgggguuuuaccguguuggccaggcuggu

SEQ ID NO: 10474 - RNA, 71 nt, Human
gaccucaagugaucugcaugccucaccucccagaguguugggaauacaggcaugagccaccacacccgguc

SEQ ID NO: 10475 - RNA, 60 nt, Human
gcuccgccccucucuggguucaggcgauucucuugccucagccuuccgaguagcuggagc

SEQ ID NO: 10476 - RNA, 71 nt, Human
cauguugaaugcacaaaagcaacagguccaguuuaugcuaaaggaauuugaagcacgcaggcaacagcaug

SEQ ID NO: 10477 - RNA, 80 nt, Human
cugagguuacuguggcucggcaaaggcagcuagaggaaucugcaagucaucuggccugcuuccaggcugcagaaucccag

SEQ ID NO: 10478 - RNA, 66 nt, Human
aaggauaccaggaugguuaccaggaugacuaccgucaucaugagaguuaucaccauggauacccuu

SEQ ID NO: 10479 - RNA, 68 nt, Human
cacacggcuggguaccgggguccgggaauucuucgggaugucaaauccugguauccuuccccaaugug

SEQ ID NO: 10480 - RNA, 70 nt, Human
gagcagaaauauguaaccuuagacucagccaguuuccucugcagcugcuaaaacuacauguggccagcuc

SEQ ID NO: 10481 - RNA, 70 nt, Human
gaggaguuuccuaaaaguucauaacagugccauugucuuuauaugaacauagacuagagaaaccguccuc

SEQ ID NO: 10482 - RNA, 66 nt, Human
uccaucauaauucuaaucuaacaauggaagauuugcccauuuacacuuuugagacuuuuuggugga

SEQ ID NO: 10483 - RNA, 61 nt, Human
caaauuauauucuggaaauugcaguauuaagugccuuuuccucuccaugaauauuaaauug

SEQ ID NO: 10484 - RNA, 88 nt, Human
uuaagacccacucuguuuaaaaauauauauucuauguaugcguauauggaauugaaaugucauuauuguaaccuagaaagugccuuga

SEQ ID NO: 10485 - RNA, 63 nt, Human
cagagagauaguauauauuuuaacaacuugaaauucauagguguuaauagauuccucuuuuug

SEQ ID NO: 10486 - RNA, 84 nt, Human
gaugauuauguguucaguuguuuuaccuauuagacuguaaacuccuuauaaucuaguaaaggcauagauuauauuuuauucauc

SEQ ID NO: 10487 - RNA, 75 nt, Human
cgcgagcgaaagacgccagccgagucagagcggacauacucgcucccguccggcccggguccccaaccccucgug

SEQ ID NO: 10488 - RNA, 64 nt, Human
gccagagaauccagaaccacaugaguccgcugaagaacucgcucuggaacaccugggaucuggu

SEQ ID NO: 10489 - RNA, 91 nt, Human
uaacccuacaauugauaaaucuuauaccauuuuagguauuuaaugagauacuuagaaauacuaagaaaaaaaaucaguauucaaaggguua

SEQ ID NO: 10490 - RNA, 94 nt, Human
uagaaaggaaucuccuaaaccucaaaaagaacauuuauguuagccuacugcuaacaucaugcuuaaugggagaaaacuggaugguuccuuccua

SEQ ID NO: 10491 - RNA, 78 nt, Human
cuguguaauuuuuggccuaaauagcccugugaaguagauauuauuccaacuuuacagguuagaaaauuugaggcacag

SEQ ID NO: 10492 - RNA, 73 nt, Human
uuuagauuucuggugguaaauauaaaugaguuucauuuuaaguaaacucauuuugugggauuugagauuuaaa

SEQ ID NO: 10493 - RNA, 65 nt, Human; identical to SEQ ID NO: 2198

SEQ ID NO: 10494 - RNA, 99 nt, Human
ugcugcucuuugucagaauaugucagaaaacaaaacaaaaaaguuuuaaaugcuaaagauuuuaaaaauuaguucucugaaauuucuguaaagccagua

SEQ ID NO: 10495 - RNA, 80 nt, Human
auagcccaaaggcucugcaguauucccuccaauggccaaggauuccgugugucaucugcaggagugaguaggccugcugu

SEQ ID NO: 10496 - RNA, 98 nt, Human
ucucccaaucaugucucauuacguaaagacagguacaugcaaacacuuuuaguuuacaucccucauucacaguguaaagcaggaaauggugugggaga

SEQ ID NO: 10497 - RNA, 70 nt, Human
uguguugaugcauuuucacuucuguggucauaggaaauggacuggucuaaagagagugaggcgcaacaca

SEQ ID NO: 10498 - RNA, 80 nt, Human; identical to SEQ ID NO: 10495

SEQ ID NO: 10499 - RNA, 85 nt, Human
guccuauaguguugaugcauuuucacuucugugguccuaggaaauggacuggucuaaagagagugaggcacaacacaagcagggc

SEQ ID NO: 10500 - RNA, 98 nt, Human
ucucccaaucaugucucuuuacguaaagacaguaacaugcaaacacuuuuaguuuacaucccucauucacaguguaaagcaggaaauggugugggaga

SEQ ID NO: 10501 - RNA, 62 nt, Human; identical to SEQ ID NO: 3062

SEQ ID NO: 10502 - RNA, 72 nt, Human
uccaaauauguuauauuaaaaccuuguuccuuggcaauuucacuaagcagcuggauguaaucuguauuugga

SEQ ID NO: 10503 - RNA, 66 nt, Human
cucaucgucguggugauugugggagcccugcucaugggucuccacaugagccagaaacacacggag

SEQ ID NO: 10504 - RNA, 72 nt, Human
ugguucuggagaugagcauuggggcgccggaagcccagcaacgccuggcccugagugagcaccugguuacca

SEQ ID NO: 10505 - RNA, 84 nt, Human; identical to SEQ ID NO: 286

SEQ ID NO: 10506 - RNA, 67 nt, Human
agcaggagcauccaugaaauugaacgcaggaccuuccaugauccuggcacagauuucagcuccuacu

SEQ ID NO: 10507 - RNA, 65 nt, Human
ugaugucuuugaccugagguauagaguuguccucuaaaaucuuugcauaaggcauagggacauca

SEQ ID NO: 10508 - RNA, 84 nt, Human
ugcagugccagcaaguauuucaaauaaauuucaacgacuugauauucaaguccaaacuaaauauuuaauguuuucuuuauugca

SEQ ID NO: 10509 - RNA, 68 nt, Human
uguacaaaaauaccugcuguugcuuuagaaaucguuuuccuuuaugaauagucaggucuugcaguaca

SEQ ID NO: 10510 - RNA, 80 nt, Human; identical to SEQ ID NO: 8216

SEQ ID NO: 10511 - RNA, 131 nt, Human; identical to SEQ ID NO: 7801

SEQ ID NO: 10512 - RNA, 63 nt, Human
uuuuuuuuuuuuuuuugaaaguugaauauuuuauuauuuacacauauaaagugagaaugaaaa

SEQ ID NO: 10513 - RNA, 60 nt, Human; identical to SEQ ID NO: 7400

SEQ ID NO: 10514 - RNA, 62 nt, Human; identical to SEQ ID NO: 9119

SEQ ID NO: 10515 - RNA, 64 nt, Human; identical to SEQ ID NO: 8200

SEQ ID NO: 10516 - RNA, 66 nt, Human; identical to SEQ ID NO: 2189

SEQ ID NO: 10517 - RNA, 73 nt, Human; identical to SEQ ID NO: 9122

SEQ ID NO: 10518 - RNA, 101 nt, Human
uucaucccucaguagcugcgaccaaauaagguguaguacuuggcaggguucuugccacagacacauuuggcuccaggcugcaguucacagagugguuugaa

SEQ ID NO: 10519 - RNA, 80 nt, Human
cauccccaaggagaacuucaguugcuugacucguuggaucacaacgagcuaaagcucaaauugcucuuaaacuuggugug

SEQ ID NO: 10520 - RNA, 94 nt, Human; identical to SEQ ID NO: 6534

SEQ ID NO: 10521 - RNA, 60 nt, Human; identical to SEQ ID NO: 6535

SEQ ID NO: 10522 - RNA, 62 nt, Human
acagucuucagggauacacuuguccaggggcuuaaugaggcuggugaugaccuugaagcugu

SEQ ID NO: 10523 - RNA, 64 nt, Human
ggcauuugcgggcucauuugcugucaagcuuuuucaaagcaugggauggcaggagaaagaugcc

SEQ ID NO: 10524 - RNA, 68 nt, Human
guauuggagaaggcauuugaagaugaaaugaaaaagcuucuccucuuccuuaaagccuuuuccgaaac

SEQ ID NO: 10525 - RNA, 88 nt, Human
uuggcgaugcugucggggauucugcugggcaacugggcacccugcccgccaccauccucaccagucucuucaccgacagcuuagucaa

SEQ ID NO: 10526 - RNA, 73 nt, Human
aggcuuuguccccuguccuuuggcgaaggaguggaguuugaccccuuaccaccaaaggaaguaagguacaccu

SEQ ID NO: 10527 - RNA, 92 nt, Human
gcggcacgagggcagcggccccggcccgcgucugcgccccucgcugucccgcgaccccggcgcgggugccucgggccccccucgcgcgccgc

SEQ ID NO: 10528 - RNA, 69 nt, Human
ggcugagccuacaggaugugcccgagcucguggacgcgaagaagaagggcgacggcguccuggacagcc

SEQ ID NO: 10529 - RNA, 72 nt, Human; identical to SEQ ID NO: 2728

SEQ ID NO: 10530 - RNA, 130 nt, Human; identical to SEQ ID NO: 2385

SEQ ID NO: 10531 - RNA, 80 nt, Human
gccgacaaggagcgccuggccauccugggcauccacaaugagguguccaagauuguccagaccuaccacgucaauauggc

SEQ ID NO: 10532 - RNA, 74 nt, Human
ggcaccaaccccuacacaaccaucacgccucaggagaucaauggcaaaugggaccacgugcggcagugggugcc

SEQ ID NO: 10533 - RNA, 75 nt, Human
ggggguggaguucgaugugcugccugccuuugaugcccugggaucaguugacuggcggcuauaaaccuaaccccc

SEQ ID NO: 10534 - RNA, 62 nt, Human
ggggcucauuugcaggggggagccaaaagggucaucaucucugcccccucugcugaugcccc

SEQ ID NO: 10535 - RNA, 60 nt, Human; identical to SEQ ID NO: 890

SEQ ID NO: 10536 - RNA, 74 nt, Human
ugagcucaagcaaucugcccaccuuagccucccaaagugcugggauuacaggcgugagcaccaugccgagccca

SEQ ID NO: 10537 - RNA, 89 nt, Human; identical to SEQ ID NO: 288

SEQ ID NO: 10538 - RNA, 61 nt, Human; identical to SEQ ID NO: 776

SEQ ID NO: 10539 - RNA, 64 nt, Human
aaugcaauccuaagagcuaauguggacuuuucuuuuuccaugaaaugucuuuaaaggaugaauu

SEQ ID NO: 10540 - RNA, 130 nt, Human
aaguggacaaggccgagcaggagcuccgcguggcccagacagaguuugaccggcaagcagaagugacccgucucuugcuggagggaaucaguagcacucacgugaaccaccugcgcugccuccacgaguu

SEQ ID NO: 10541 - RNA, 78 nt, Human
gcccugcuggcugaugagcucaucacugucuacagccugccuggcauggacccugacuggcucauuggcgagagaggc

SEQ ID NO: 10542 - RNA, 68 nt, Human
guuggugacacguuguuccaagugggggagaaucacccccauucugucccugccccuagucaccuaac

SEQ ID NO: 10543 - RNA, 72 nt, Human
gagaaccuagagaggaucgggacggcuugugauuucucucccgagacaacgaucucucucuucuccuaucuc

SEQ ID NO: 10544 - RNA, 63 nt, Human
gggcgacgaccccaaaaagaggagggccccagaauuuaacuccuuuuuaccauuuuacagucc

SEQ ID NO: 10545 - RNA, 65 nt, Human
aggacaugugggguuucuugcucacccccacucuugugggacgcggccugugcccugauuuuccu

SEQ ID NO: 10546 - RNA, 103 nt, Human
gcaauacucccaccccagccucucgaguagcugggauuacaggcgugugccaccaugccuggcuaauuuuuguauuuguagagaugggguuuugccauguugc

SEQ ID NO: 10547 - RNA, 62 nt, Human
ucccaaaguacugggaucacgggcaugagcuaucaucacgcccggccccaucucuuugaggg

SEQ ID NO: 10548 - RNA, 70 nt, Human
agcuaagcaauaggguaggccuaauuccacccguuaguaccuuaaaaaauacacccuauaugugagagcu

SEQ ID NO: 10549 - RNA, 75 nt, Human
ggaagggugacaggaauagagaugugacauuaacuaguuggaacuaaaugcauacaugauuuugguuacucuucu

SEQ ID NO: 10550 - RNA, 71 nt, Human
uuccccggcaagguuuuauguacauauguagucuuucuuuauccuacuuuaauacucauuuugcuacagaa

SEQ ID NO: 10551 - RNA, 77 nt, Human
aggaauauaggcagauguacagaacugaaauucgaauggcgaggauggcaagaaaagcuggcaacuucuauguaccu

SEQ ID NO: 10552 - RNA, 60 nt, Human
gaacccaaaugggcguugucaucagaaucagagguaucaauggagugagcccaaagguuc

SEQ ID NO: 10553 - RNA, 63 nt, Human
uuguacaugaccuaaagaguauauucccagaagcugcuggucagacacauuuagggaugacag

SEQ ID NO: 10554 - RNA, 91 nt, Human
gcgucaguugcggggagcccuucggagaugaggguuuccacgagcgcgagggccgccccuacugccgccgggacuuccugcagcuguucgc

SEQ ID NO: 10555 - RNA, 66 nt, Human
cauuuacauuucuaaguaguuguauaguagaagcaggaagcucuuauugcuuauuuggucguaaug

SEQ ID NO: 10556 - RNA, 91 nt, Human
uaauuuguaaaaugucuaaaaguuuaaugauacuucugauguuucggaacagucauuucaccuacuauuucugaauauauuuugcaaauug

SEQ ID NO: 10557 - RNA, 62 nt, Human
uauuuauuuccuauguguuaauaugaagaucagaaauuauuuuuugcacuuuggcauaaaua

SEQ ID NO: 10558 - RNA, 68 nt, Human
gagaugggauuucaccauguuggccaggccugucuugaacucuugaccucaagugauccacccaccuc

SEQ ID NO: 10559 - RNA, 75 nt, Human
ucagugugugguauuugaaauuuaauaaguuauuuccaucgugggaauuuuuagacuuaaagauagcaucacuga

SEQ ID NO: 10560 - RNA, 78 nt, Human
acucuuccgcgccucgaggaacccgaucagcuguugccaacauugcccuggcugaaggccuuacucgaguggaggagu

SEQ ID NO: 10561 - RNA, 64 nt, Human
aggagcgccucuaugccuaccaccugucccgugccgccugguacggaggccuggcugugcugcu

SEQ ID NO: 10562 - RNA, 66 nt, Human
auugcuccuaacuggaagaucucacuuuccccuugugggguaggaaccgaugccagugggagggau

SEQ ID NO: 10563 - RNA, 60 nt, Human
cguuuugguugcauuucauuuuuggagaacuuaauuaacgugagauuggcaauugaaaug

SEQ ID NO: 10564 - RNA, 75 nt, Human
gaaaaaaauguagaaccauuuggaaaaaugaaauuuaguaguuccaaguuucaaagaaaugucaacauuuuauuc

SEQ ID NO: 10565 - RNA, 102 nt, Human
gugguuaaguuaaugaauaguuuuuguuuuaucagaauggcaacagacagaaguacuuuguagagauugacuuccuaagcuacuuaagacaacuugcaccac

SEQ ID NO: 10566 - RNA, 67 nt, Human; identical to SEQ ID NO: 7380

SEQ ID NO: 10567 - RNA, 73 nt, Human; identical to SEQ ID NO: 7381

SEQ ID NO: 10568 - RNA, 61 nt, Human
agaagauuccuguaucuggcuauguagcugcuggcuauauguguccuguggcauuccuucu

SEQ ID NO: 10569 - RNA, 67 nt, Human
cagauuugucaaacuccuucaguucagauugcagagguaacugaucugaagaaugugcuuguauuug

SEQ ID NO: 10570 - RNA, 68 nt, Human
ugcugcuccauaagcaccauaucuuccacaauacuaucuuguguaaguucaucaucaaaaggaaagua

SEQ ID NO: 10571 - RNA, 68 nt, Human
gccgaagcucugugcccugggugugcagugauaucaaacacaugcuccuagguagacggaaaauuggu

SEQ ID NO: 10572 - RNA, 66 nt, Human
gugcuggucaugugagggucucugugagugacuggaggucuggacaggacccacgaggagacagac

SEQ ID NO: 10573 - RNA, 68 nt, Human
ucuuaguauaguguuaggucagacacggcuaccaacgauuccaccuguccugacccauuucuauagga

SEQ ID NO: 10574 - RNA, 90 nt, Human
aagcgcaggaagaguccuggggggaccgcggcgggcgggagaccguuggcgccggcgcuuccucuuaaucccggcuuguucccgacgcuu

SEQ ID NO: 10575 - RNA, 89 nt, Human
ggcgucaugucucccgaugggcgcugcuccguggcgcgcucuguugaggcgccggccggcuggcgcaguccugugggcggcguggcgcu

SEQ ID NO: 10576 - RNA, 66 nt, Human
acuagaacgacugagcgugagaguugagagucccugcuguguacuagaacgacugagcgugagagu

SEQ ID NO: 10577 - RNA, 68 nt, Human
agucccugcuguguacuagaacgacugagcgugagaguugagagucccugcuguguacuagaacgacu

SEQ ID NO: 10578 - RNA, 66 nt, Human
cccugcuguguacuagaacgacugagcgugagaguugagagucccugcuguguacuagaacgaggg

SEQ ID NO: 10579 - RNA, 81 nt, Human
cuccaggcaugggaacuuaacagaugagguuaagaaccguagacaguuuaaaauccauuuauguugcuuucacagcuggag

SEQ ID NO: 10580 - RNA, 77 nt, Human
gccaguacacaguucauucuaccugugagaguauaagaguugaaauauuuuuuaauaccagugaacugguauugcgc

SEQ ID NO: 10581 - RNA, 81 nt, Human
ggggcugagcaaugauagaauuucuagggcugggaagcagaacccuuaagucucugcccucccaauucuauuacucucccu

SEQ ID NO: 10582 - RNA, 60 nt, Human
uucuuugccucuccauucccucagacuaaaaggcuccugaguugaccaagagaaagagaa

SEQ ID NO: 10583 - RNA, 106 nt, Human
ucguaucccucgguccggcggcggcggcggcggcggcgguagcggaggagacgguuucaggccuccggugcggcugcaaugcugagcucccgggccgaggcggcga

SEQ ID NO: 10584 - RNA, 77 nt, Human
ucucucccauccccuugacacucuucccuucaguuuccaucuugaacuucgugguuuuaagcacagaccuggggaga

SEQ ID NO: 10585 - RNA, 82 nt, Human
ggaccggaagccuggaacuuggagagcugaggcaacagagaggcugcgugcagaagugagccaucaucgcaggaagccggcc

SEQ ID NO: 10586 - RNA, 77 nt, Human
cuguacuguauuuauguugcuauggggcaaaagagauccacuguugcccaguugggugaagagacuuacagaugcag

SEQ ID NO: 10587 - RNA, 75 nt, Human; identical to SEQ ID NO: 74

SEQ ID NO: 10588 - RNA, 87 nt, Human; identical to SEQ ID NO: 76

SEQ ID NO: 10589 - RNA, 71 nt, Human; identical to SEQ ID NO: 77

SEQ ID NO: 10590 - RNA, 77 nt, Human
acaucugacaucaccugcagcuuccuuauaacaugcccacugggcagagaggaugagaggcaggagagcaccagugu

SEQ ID NO: 10591 - RNA, 71 nt, Human
ucacaacuggggacauggcccaaauugcacuagcauuuacucugugccaaggcaaccagcuuccagaguga

SEQ ID NO: 10592 - RNA, 78 nt, Human; identical to SEQ ID NO: 99

SEQ ID NO: 10593 - RNA, 65 nt, Human; identical to SEQ ID NO: 247

SEQ ID NO: 10594 - RNA, 80 nt, Human; identical to SEQ ID NO: 100

SEQ ID NO: 10595 - RNA, 84 nt, Human
caugggauggggaaguacggcaggugucuaagcaugccuucagccucaagcaguuggacaacccugcucgaaucccucccugug

SEQ ID NO: 10596 - RNA, 81 nt, Human
ggcuuuuucuuagugccucugugcauuugggugauguucuauuuacauggccuguguaaaucuccauugggaagucaugcc

SEQ ID NO: 10597 - RNA, 65 nt, Human
cgcccaccgagcgcugcaaccgccgcaagugccgcaaggcccugcgccaguucuucgaccgggug

SEQ ID NO: 10598 - RNA, 80 nt, Human
ucagggacaggggcagacccgguggucagcgccaagagcaaccauugccuggaugcugccaaggccugcaaccugaauga

SEQ ID NO: 10599 - RNA, 102 nt, Human
uggagcauccaccuggggcugaccgagggugaggaguucuacgaagccucccccuaugagccggugaccucccgccucucggacaucuucaggcuugcuuca

SEQ ID NO: 10600 - RNA, 75 nt, Human
guaguuauguauuagaggcagaaggccauagggaugaccccaccuggcuuuuggucuucauuuuugcauaucagc

SEQ ID NO: 10601 - RNA, 69 nt, Human
ucugugucuccaccugguucgugaacagcucgggucuuccagaauccagccagccaguccaagugcaga

SEQ ID NO: 10602 - RNA, 89 nt, Human
agggucuugcucuguagcccaggcugaagugcaguggugggcacgaucauagcucacugcagccuugaacucugggcuucagugauccu

SEQ ID NO: 10603 - RNA, 75 nt, Human; identical to SEQ ID NO: 74

SEQ ID NO: 10604 - RNA, 67 nt, Human; identical to SEQ ID NO: 836

SEQ ID NO: 10605 - RNA, 87 nt, Human
guccuugaacuuggaaccugacaauguugguguugucguguuuggaaaugauuaacuaauuaaggaaggagauauagugaagaggac

SEQ ID NO: 10606 - RNA, 71 nt, Human; identical to SEQ ID NO: 77

SEQ ID NO: 10607 - RNA, 92 nt, Human
uccaggucggcuggagucagggcaccuucuaaccuuacacuuuuaaaggacacaugguccuugguuucuuccagcuucaaucgagccugaga

SEQ ID NO: 10608 - RNA, 60 nt, Human
cugugagaucugcaaugucaaggucaacucggagguccaacugaaacagcacaucuccag

SEQ ID NO: 10609 - RNA, 70 nt, Human
ugugcucugugcaagguggcugugaacucccugucccagcuugaggcacauaacaaagguacuaagcaca

SEQ ID NO: 10610 - RNA, 69 nt, Human
gggguggagcaggugggcgacaugaucgaucgccuuuucgacaccucugccugagccugcugcuagccc

SEQ ID NO: 10611 - RNA, 63 nt, Human
cuuguuguuggcugaauugaucccuagggcacacuuugcaauuuuacuugagccacugacuag

SEQ ID NO: 10612 - RNA, 69 nt, Human
acacuuuauuuucaacuagaaaggugcaaacauguaacuuuuuggucacacucucaacaaauaaacugu

SEQ ID NO: 10613 - RNA, 88 nt, Human; identical to SEQ ID NO: 4936

SEQ ID NO: 10614 - RNA, 115 nt, Human
gggcugccuggggcgugcaaaagcugcugugugagcaaaacgcugccgugaagacauuccaggcggcuuccaggaagcggcuguaugugcugacacgcauguggacaggcagucu

SEQ ID NO: 10615 - RNA, 72 nt, Human
ucaagacugguguuuccuagagcuuuccauuggcaaaugcugccuccuggaacugagggacaaagguuuuga

SEQ ID NO: 10616 - RNA, 74 nt, Human; identical to SEQ ID NO: 6796

SEQ ID NO: 10617 - RNA, 91 nt, Human
uguaguacuuaaaauucaacauauguaacguuauucucaaacuucauuaaaauaauaaauauacaaguuauguuuaauaugaguaacugca

SEQ ID NO: 10618 - RNA, 84 nt, Human; identical to SEQ ID NO: 286

SEQ ID NO: 10619 - RNA, 89 nt, Human; identical to SEQ ID NO: 288

SEQ ID NO: 10620 - RNA, 94 nt, Human; identical to SEQ ID NO: 5398

SEQ ID NO: 10621 - RNA, 68 nt, Human; identical to SEQ ID NO: 6247

SEQ ID NO: 10622 - RNA, 88 nt, Human; identical to SEQ ID NO: 2733

SEQ ID NO: 10623 - RNA, 68 nt, Human; identical to SEQ ID NO: 2734

SEQ ID NO: 10624 - RNA, 75 nt, Human; identical to SEQ ID NO: 5842

SEQ ID NO: 10625 - RNA, 92 nt, Human
cgacucacuauagggaaagcugguacgccugcagguaccgguccggaauucccgggucgacccacgcguccgguuuuccugcgcaggagccg

SEQ ID NO: 10626 - RNA, 91 nt, Human
gguucgguaccacacgaaggugcgcgccggccgcggcuucagccuggaggagcucaggguggccggcauucacaagaagguggcccggacc

SEQ ID NO: 10627 - RNA, 65 nt, Human
cuuguagcuccacuccggggaacggacucgccgggacugacaguugccggaagugaggcugcggg

SEQ ID NO: 10628 - RNA, 65 nt, Human
gcguccggggagaagagcggagcgugugagcaguacugcggccuccucuccucuccuaaccucgc

SEQ ID NO: 10629 - RNA, 69 nt, Human
guccaggccauguauaucuggaucgaugguacuggagaaggacugcgcugcaagacccggacccuggac

SEQ ID NO: 10630 - RNA, 63 nt, Human
caaaagaaaaccuagguucuuuuuauuacucuauucuaguaagaacagaaagguuaucuuuug

SEQ ID NO: 10631 - RNA, 83 nt, Human
cacagcaggcuuuuacggugauugcugauugggaagaucucuuucucccuuacggcgucauucaugucaaggcccggucugug

SEQ ID NO: 10632 - RNA, 65 nt, Human
ccuaguucuaaagccugauuuaguauugucagugggcaacaggcauuaggcucuaucaagcuggg

SEQ ID NO: 10633 - RNA, 77 nt, Human; identical to SEQ ID NO: 3082

SEQ ID NO: 10634 - RNA, 80 nt, Human; identical to SEQ ID NO: 367

SEQ ID NO: 10635 - RNA, 102 nt, Human; identical to SEQ ID NO: 2701

SEQ ID NO: 10636 - RNA, 69 nt, Human
augggccucuguucuaaacugaaguucuuuuaaugagaagauagagaacagauuagaaauacggcccau

SEQ ID NO: 10637 - RNA, 62 nt, Human
agaggaucccgguuuuacaauagucagaguuauucuguuuguuuaaaaaauaagaaaccucu

SEQ ID NO: 10638 - RNA, 63 nt, Human
gccuagucuuuuccauaaaaugaauaagaaguacauuugguggaguuugagaccagccugggc

SEQ ID NO: 10639 - RNA, 82 nt, Human
uuagagauguuggaaguuguuguuuuuccugucuaaugucuuguauaucauuaggaaguuguccagaaacuugcgucucuga

SEQ ID NO: 10640 - RNA, 91 nt, Human
gauuugaugauuauguugugauagaguuggcuuucugagucccauugauggcagugaaggcuauauuucagucaaaaacauccauuauauc

SEQ ID NO: 10641 - RNA, 69 nt, Human
cucacggaucuugcugaugagcagcgugcccaugccugagcccgugccgccgcccagcgagugcgugag

SEQ ID NO: 10642 - RNA, 73 nt, Human
ggagguggugaccccacucauggcggcggacaccaggugguugagguccccguaggugggcguugucagcuuc

SEQ ID NO: 10643 - RNA, 61 nt, Human
gcugccaaggggaugccgcacugcaggaggaccugggguggugcuauaccuucacagcagc

SEQ ID NO: 10644 - RNA, 68 nt, Human; identical to SEQ ID NO: 4262

SEQ ID NO: 10645 - RNA, 78 nt, Human; identical to SEQ ID NO: 2308

SEQ ID NO: 10646 - RNA, 66 nt, Human
guugagguggcugcugacccugggucucaucuccugaauuccuuaaccuccucaugccgccucggc

SEQ ID NO: 10647 - RNA, 75 nt, Human
cugaccuugcagcuucuccuucucuccagaccagcgauugccgguugaggaaaaacgcuugaagggcaaggacag

SEQ ID NO: 10648 - RNA, 70 nt, Human
cuucagguccucuuccuucugcaucagaauguccucagagucagaacaggauuaaagagagggccaggag

SEQ ID NO: 10649 - RNA, 61 nt, Human
gagacuguuucgaaacaccuguguuaggacccacccuacaccuacuggaucagaaugucuc

SEQ ID NO: 10650 - RNA, 66 nt, Human
agaggggccacggggcgcccauguacaaaacuacguguucccgccauagccccuuggauucccucu

SEQ ID NO: 10651 - RNA, 62 nt, Human
cuucucagaaaaccaaaccaaaggcagccaugaaaacccguguucuguacgugguugagaag

SEQ ID NO: 10652 - RNA, 75 nt, Human
accacguuuguuucgacgccggaccgcguaagagacgaugauguugggcacggaagguggagagggauucguggu

SEQ ID NO: 10653 - RNA, 95 nt, Human
cagagaaacuaugggacacagauauguugaaguauucaagucaaacaacguugaaauggauuggguguugaagcauacugguccaaauaguccug

SEQ ID NO: 10654 - RNA, 64 nt, Human
ucuucucaggguuggaaaucgugccaaaugggauaacauugccggugugacuuccaggggagga

SEQ ID NO: 10655 - RNA, 84 nt, Human
gcccucugccugccccuaacgcccaacuccaugccugccucagucaugguuuguuuuugcuucuggaagggguagauggagggu

SEQ ID NO: 10656 - RNA, 63 nt, Human
uggagagccugugguccucagggaugggagaggcacccacaggacccgagggcagcaggacca

SEQ ID NO: 10657 - RNA, 76 nt, Human
uuuauuuguguuucuaaugagaaaggaagguuagagguccacugaucuaaaccagcggucucaauggacagaugaa

SEQ ID NO: 10658 - RNA, 61 nt, Human
ggcaucucucggggaggaucagccucggcauuaugagcaacaggggauccuaaagagugcc

SEQ ID NO: 10659 - RNA, 63 nt, Human
gguauaacauuaucuuaccuugcuagauuuagacucuaucuuagguauggaaauguauggacc

SEQ ID NO: 10660 - RNA, 68 nt, Human
gucuggaucauucaauuuaguaguuacauauccaccaccuuauguugcuaaauaacuguuucuagcac

SEQ ID NO: 10661 - RNA, 89 nt, Human
gggccgagauuagagcucgaaugggcauugggcucggcucggagaaugcugccgggcccugcaacugggacgaagcugauaucggaccc

SEQ ID NO: 10662 - RNA, 79 nt, Human
uuuggugaaguaccuuuuggcuaaagaccagacgaagauucccaucaagcgcucggacaugcugaaggacaucaucaaa

SEQ ID NO: 10663 - RNA, 73 nt, Human; identical to SEQ ID NO: 2833

SEQ ID NO: 10664 - RNA, 99 nt, Human
accugggaagggcccuccucacccuugguucucucaguuucacucuuaguccuccugagggccacaggaccacuggugucaggcaggcucuuggcaggu

SEQ ID NO: 10665 - RNA, 67 nt, Human
ggaccacuguucuggaguuaugcaauuaaacacuggacaauugcaauuaaacauggacagaaaaucc

SEQ ID NO: 10666 - RNA, 73 nt, Human
gucaugugaugcucaaucagcaaaccagggauuggcuucauccugggaaaaagcuaucugggugcaacaagac

SEQ ID NO: 10667 - RNA, 61 nt, Human
cuagagcaagccucaauaaguuuauuuuauuaccuuggaauucuuugaugguggugucuag

SEQ ID NO: 10668 - RNA, 103 nt, Human
uuucugagaugaagucuugcucuuucacccaugcuguagugcaguggcgccaucucggcucacugcacuccagccugggugacagagugagacuccuuaaaaa

SEQ ID NO: 10669 - RNA, 64 nt, Human; identical to SEQ ID NO: 7119

SEQ ID NO: 10670 - RNA, 77 nt, Human
gggggaaagccugguuuuggcugcuuugaggcuuucauugaaagcaaaugaggcagaaaggucccggcaccaccccc

SEQ ID NO: 10671 - RNA, 69 nt, Human
aagaguacugaaacaaggacuucuugucagaaacagcuucuggaaucuuggguuuuguuuuuguuuuuu

SEQ ID NO: 10672 - RNA, 87 nt, Human
auucuucaaauguucccucagugauccuuuuacucuccuugucacuuauuugggagaaauaggggcacaugagauaagaagaagaau

SEQ ID NO: 10673 - RNA, 67 nt, Human
gccggcuuuuucgcggggggaaagaaacaaaggccugcauuccccccuucuaaaagggaaagccggc

SEQ ID NO: 10674 - RNA, 68 nt, Human
ggguuuccaucuaacuuuagcuccaggguaaaaucccgaacaguccaaauaaagucuggaagaaacuc

SEQ ID NO: 10675 - RNA, 79 nt, Human
ugggugaagauauaagaacagaaguugucugauugcauaaggaaaugccuuuccagauuuucuucuggcacuucgccca

SEQ ID NO: 10676 - RNA, 82 nt, Human
gcuugcacugguuggccagguccuccauccuguuggaugguaaagccucgggauugauggacggacauggcccaguggaggc

SEQ ID NO: 10677 - RNA, 65 nt, Human
gaaaggauucugcuuguagauugcuuauuucuugcuccaaauuuauaaauuaacccauuucuuuc

SEQ ID NO: 10678 - RNA, 62 nt, Human
caguuacaauauuugaucuaagaacauucacuuuccaacugaucagaaaguaaaggugacug

SEQ ID NO: 10679 - RNA, 65 nt, Human
ggccccggguucccguggcuaccgggcgcggcgcccccgcgccgcaggccgggaccccgguggcc

SEQ ID NO: 10680 - RNA, 79 nt, Human; identical to SEQ ID NO: 1810

SEQ ID NO: 10681 - RNA, 63 nt, Human
gauacuaccauccuggcuggacuguccaagaccagaggaugaucgagacaggacaaugggauc

SEQ ID NO: 10682 - RNA, 60 nt, Human
auuaguauaaagccugcccuguugugugaagaagcauuuggacugcuuaaguuggcuaau

SEQ ID NO: 10683 - RNA, 75 nt, Human
ggugcucagcagcgagaggacgcgucacucugccguucugcagggugacgcccuccccguaccucgcugagagcc

SEQ ID NO: 10684 - RNA, 129 nt, Human
gagccacacguugcuucuucccuguguucccagcuggagggacaugagugucccugggccgucgucuccggacggggcccugacacggccacccuacugccuggaggccggggagccgacgccugguuu

SEQ ID NO: 10685 - RNA, 64 nt, Human
ucacaguuggguuuaacagaugacuuuggauuuucaaaaaaguguggguggccgugacuugugg

SEQ ID NO: 10686 - RNA, 75 nt, Human
cuucgcauuaguuucucgugacuaugcauaugauccaauaucaaaggaaaugauagcauugaaggacucgugagg

SEQ ID NO: 10687 - RNA, 72 nt, Human; identical to SEQ ID NO: 9079

SEQ ID NO: 10688 - RNA, 98 nt, Human
cacagacgaacaggcaaggggcuagggaagaagaggggacccaugucuucggaaauacaagggacuucugcaauccauggagaaugccaaauaaugug

SEQ ID NO: 10689 - RNA, 71 nt, Human
cgggguuaaccacuggcagaaagaaggguguacauugcgccuggacgccuaccccaguggaaaagaccgcg

SEQ ID NO: 10690 - RNA, 64 nt, Human
gauuuuauggguuuuaaguggggaaguaaucccauguacuuauuucuuaaauaccuaggaaguu

SEQ ID NO: 10691 - RNA, 61 nt, Human
acccaggaggcggaagugugcaagugagccaagaucacaccacgugcacuucagccugggu

SEQ ID NO: 10692 - RNA, 65 nt, Human
cugcuagagccgagcgaagcgaugccuaaaucaaaggaacuuguuucuucaagcucuucuggcag

SEQ ID NO: 10693 - RNA, 61 nt, Human
cuguguucugaccuugcuggggugacuguuauacuccauuagcuuugcaggauggacacag

SEQ ID NO: 10694 - RNA, 104 nt, Human
gaguggcgaauucgggcacgaggggucccgcgggucugucucuugcuucacaguguuuggacggaacagauccggggacucucuuccagccuccgaccgcccuc

SEQ ID NO: 10695 - RNA, 69 nt, Human
gcugggcugggcgaguaucucuucgaaaagcucacucucaagcacgacuaagagccuucugagcccagc

SEQ ID NO: 10696 - RNA, 66 nt, Human
ccuuggagaccugaugcgguuauuaguacgaacgugucacuccauagccagauucaauuuucaagg

SEQ ID NO: 10697 - RNA, 69 nt, Human
gaaucucauuaauccauucaugcgcgucacuaauuagaugacgaggcauuuggcuaccuuaagagaguc

SEQ ID NO: 10698 - RNA, 72 nt, Human
ucuuaauuuuaaagacccaacuugccaaaauguuggcugcguacuccacuggucugucuuuggauaauagga

SEQ ID NO: 10699 - RNA, 90 nt, Human
agaggcaugaccugacugcacuguugcugacuacuacucugccaaucggcuacccucgacucagcaccacauugccucauuucuuccucu

SEQ ID NO: 10700 - RNA, 83 nt, Human
gcuggaaaucccauccuuccgggguggaagugagcugcucccggccuuggagcucauacccgugccggcaggaauacaccagc

SEQ ID NO: 10701 - RNA, 96 nt, Human
ggccuccagguucaugccagggaugcugucacaagacucaaagucuucagggaauuugccgacuuggaaggcauccaugggcacccuggugaggcc

SEQ ID NO: 10702 - RNA, 67 nt, Human
ggcagcauuggaaccaucgauggaaaaaauauuuaaaauugaucagaugggaagaugguuuguugcu

SEQ ID NO: 10703 - RNA, 69 nt, Human; identical to SEQ ID NO: 8302

SEQ ID NO: 10704 - RNA, 60 nt, Human; identical to SEQ ID NO: 5040

SEQ ID NO: 10705 - RNA, 127 nt, Human
ggaagccgucagccaagucgccacauuucucugcaaaaugucauagcuuauauuaauguacaguauuccaugguaugcugccuuccguuguaaguagcagaucucuccgugacuugacacggcuacu

SEQ ID NO: 10706 - RNA, 71 nt, Human; identical to SEQ ID NO: 5378

SEQ ID NO: 10707 - RNA, 102 nt, Human
gcgcgcucguucgggaucgccgagggggcugagauagugaauuccuaagaagaaaauaauggaugcauauuaguuguucucuaaguggacucaacagugugc

SEQ ID NO: 10708 - RNA, 61 nt, Human
cucucgggggggccgggaacaacugggugcgccuccgacgugugacuuuuucccccggggg

SEQ ID NO: 10709 - RNA, 74 nt, Human
guacuggagagacauuaagaagacuggagugguguuuggugccagccuauuccugcugcuuucauugacaguau

SEQ ID NO: 10710 - RNA, 62 nt, Human
cuggaugaagagccgaauagcaagcuguucaaagauacguaucuugcuaucucuauuuccag

SEQ ID NO: 10711 - RNA, 69 nt, Human
gcgucugaggcaccggguggucgggcugugauagaccaaggcugaucacgcggcaccaccucaagaagc

SEQ ID NO: 10712 - RNA, 81 nt, Human
gcuccgggggaaagaucaaccggccccgaacggagcugaagaagaagcuguucaaacgccggcggguguugaaucgggagc

SEQ ID NO: 10713 - RNA, 60 nt, Human
cugguguggguuuuuacuguggcacgagaguggggccagagugagaguuuccacacucag

SEQ ID NO: 10714 - RNA, 77 nt, Human
ggcuuauuaguuauauaagugaaauuucuagggagcagagcaggcuucucacacaauuccagaaugacuagagagcc

SEQ ID NO: 10715 - RNA, 81 nt, Human
caacggucagacgagucgacacguggcagaaaucaucaucuccucguggaggugaugguugucaugugugggucaccguug

SEQ ID NO: 10716 - RNA, 67 nt, Human
gcagggcagccccauccugggucuggagcuucccuagacccaggcaccaugcacaggcauucccugc

SEQ ID NO: 10717 - RNA, 60 nt, Human
agcuccaguggacaaaagaaggaauccacguucuagauuuggccauuugaugauggagcu

SEQ ID NO: 10718 - RNA, 95 nt, Human
ccaaauuucgugaagaaccagguugcuguguugcagugcuguguugcccggauggggcagggcccugugcugguugccucgcuugaugaaugugg

SEQ ID NO: 10719 - RNA, 84 nt, Human
guucacagaggaacuuaagaaguauggagugacgacuugugguucgaguugugugaugcuacauaugauaaagcuccaguggac

SEQ ID NO: 10720 - RNA, 91 nt, Human; identical to SEQ ID NO: 7954

SEQ ID NO: 10721 - RNA, 84 nt, Human; identical to SEQ ID NO: 286

SEQ ID NO: 10722 - RNA, 64 nt, Human; identical to SEQ ID NO: 287

SEQ ID NO: 10723 - RNA, 89 nt, Human; identical to SEQ ID NO: 288

SEQ ID NO: 10724 - RNA, 83 nt, Human
guagaguaguuacuggggagugcugaaggcuccaugugagacaaguuaaaauggguauguagguuucuccaguuacauucugc

SEQ ID NO: 10725 - RNA, 77 nt, Human
gcugacaauuaaugcuaguccucaggauuuaaaaaauaaucuuaacucaaaguccaaugcaaaaacauuaagucggu

SEQ ID NO: 10726 - RNA, 65 nt, Human; identical to SEQ ID NO: 1727

SEQ ID NO: 10727 - RNA, 71 nt, Human; identical to SEQ ID NO: 8959

SEQ ID NO: 10728 - RNA, 76 nt, Human
ucaguuaaaaaagaagaagaagaaauggcaaagagaaaguuuuuucaaauuucuuucuuuuuuuaauuuagauuga

SEQ ID NO: 10729 - RNA, 84 nt, Human; identical to SEQ ID NO: 286

SEQ ID NO: 10730 - RNA, 64 nt, Human; identical to SEQ ID NO: 287

SEQ ID NO: 10731 - RNA, 89 nt, Human
ggccaauugaaacaaacaguucugauaccguucuuccaccacugauuaagagugggguggcagguauuagggauaauauucauuuagcc

SEQ ID NO: 10732 - RNA, 84 nt, Human; identical to SEQ ID NO: 286

SEQ ID NO: 10733 - RNA, 64 nt, Human; identical to SEQ ID NO: 287

SEQ ID NO: 10734 - RNA, 89 nt, Human; identical to SEQ ID NO: 288

SEQ ID NO: 10735 - RNA, 81 nt, Human
gccacggugaugggcagcccaaaggcuacguaugugcaagcugccucaguggucuccuugagcugguucuucaccuguggc

SEQ ID NO: 10736 - RNA, 60 nt, Human
cccaacuggaagcccgagaagucugucccaucauugacuucuuauacugcuucuucuggg

SEQ ID NO: 10737 - RNA, 66 nt, Human
ggaucauacgaaaucaauuuacacacggucuguaauugacccuguuccugcaccaguuggugauuc

SEQ ID NO: 10738 - RNA, 69 nt, Human
cgguggggauagcgaugauuaugguagcggaggugaaauaugcucgugugucuacgucuauuccuacug

SEQ ID NO: 10739 - RNA, 80 nt, Human
ggacauaguggaagugagcuacaacguuaguacgugucguguaguacgaugucuagugaugaguuugcuaauacaaugcc

SEQ ID NO: 10740 - RNA, 93 nt, Human
ggacugcauccuaccaccaacucguccaacugacaagcccuugcggcugccucuccaggaugucuacgaaauuggugguauuggaacuguucc

SEQ ID NO: 10741 - RNA, 74 nt, Human; identical to SEQ ID NO: 365

SEQ ID NO: 10742 - RNA, 77 nt, Human; identical to SEQ ID NO: 3082

SEQ ID NO: 10743 - RNA, 80 nt, Human; identical to SEQ ID NO: 367

SEQ ID NO: 10744 - RNA, 101 nt, Human
cugcucaucagacagguccgucaaaaucuuugaugugcgcaauggagggcagauccuuaucgccgaccucaggggucaugaggguccuguguggcaagugg

SEQ ID NO: 10745 - RNA, 67 nt, Human
ggccugauccuggccugugggagcucggauggggccaucucccugcugacuuacaccggggaaggcc

SEQ ID NO: 10746 - RNA, 67 nt, Human
ugcugaggacucccaagcguacugcucaucaucguuauguuuggugaucacaguuacuuucucagca

SEQ ID NO: 10747 - RNA, 69 nt, Human
cggcucaccugcaaaacaaaacaccagcaauaucagauggauggcagugaugcaggcacaaugcagcug

SEQ ID NO: 10748 - RNA, 62 nt, Human
gcucaggaauguuaaguggcuucaggagucguguggacagcacgauuaccuggguuccuggc

SEQ ID NO: 10749 - RNA, 75 nt, Human; identical to SEQ ID NO: 345

SEQ ID NO: 10750 - RNA, 60 nt, Human
uuguacaaaaccuaauuuguugucaaaaguaucaagcaauaaauuuuaacuauuguacag

SEQ ID NO: 10751 - RNA, 109 nt, Human
uacuauuucuagcaucugagauccaggucaguugugauuaauuuuucucuguauuaugcaauguauuuuccugcuuuucaugccucucuacuggaugcuagacauugua

SEQ ID NO: 10752 - RNA, 81 nt, Human
ugagguuuuccagcuaggguggugggaacaggcccuacccuagguccugugucagcaccacuguuccuucuaaucuucuca

SEQ ID NO: 10753 - RNA, 99 nt, Human
gaggcaaggacuugcucuguuacccaggcuaaagugcaguggcgcaaucauagcucacugcagccuugaacuccugggcucaagagcucuucccgccuc

SEQ ID NO: 10754 - RNA, 60 nt, Human
ugucggguagcuggaacuacacagguguguaccaccacaucugguaccaccacacccaca

SEQ ID NO: 10755 - RNA, 67 nt, Human
gugccuugcagggcgcugugagguccaggccggucuuggcgccgagagccccugcacuccaggccac

SEQ ID NO: 10756 - RNA, 60 nt, Human
ccuaccgcgugcucaaugggcucugcuugagcaagggcaccccugagugugacgggaagg

SEQ ID NO: 10757 - RNA, 84 nt, Human
gggggcacggaugcggaugagggcgaguggcccuggcagguaagccugcaugcucugggccagggccacaucugcggugcuucc

SEQ ID NO: 10758 - RNA, 82 nt, Human
uuaucuuauuagggaguuguaugucaguguauaaaacauacugugugguauaacaggcuuaauaaauucuuuaaaaggauaa

SEQ ID NO: 10759 - RNA, 86 nt, Human
aaguuaguuuccuuucuucaucuuuuuuuuuuuauuaaguaaucagugacuugaaaaauagcagauugguauaaggauuguaacuu

SEQ ID NO: 10760 - RNA, 84 nt, Human
gagauuaagcauucauccugaaauguacacuugaauaguuugaaauucaacacaaguguauauuuuuagugaagacauuuucuc

SEQ ID NO: 10761 - RNA, 64 nt, Human
accuugguggagggguggugaccaucgaaaggagcaagagcaagaucaccgugacauccgaggu

SEQ ID NO: 10762 - RNA, 90 nt, Human
auuaaccaggacgaagaagaggaggaagacgaggauuaaauuucauuuaucuggaaaauuucguaugaguucugaauaaaacuggggaau

SEQ ID NO: 10763 - RNA, 71 nt, Human
acauuuggauccaccagcaugaaaauaggggauuuugccuuccaugcuuaugcacugggggucccaggugu

SEQ ID NO: 10764 - RNA, 82 nt, Human
gccugggguuccucacacuuuucagacaaaagggaagggcugucacagcucccccggccugagucagugucaggauccaggu

SEQ ID NO: 10765 - RNA, 77 nt, Human
caugcugguuuaaauucagaaggaaauagauuaaggaaauauauauauuuucuucuaaaacuuauuaaauuagugug

SEQ ID NO: 10766 - RNA, 79 nt, Human
ccaguuccuacaacgugcaguagggcggcgguagcucuugugucuguggacucugcucagcuguguccguaggagucgg

SEQ ID NO: 10767 - RNA, 63 nt, Human
gucugugcuuuauuauggccuuguuuauauaucacugagguauacuaugccauguaaauagac

SEQ ID NO: 10768 - RNA, 61 nt, Human
acugaaacugaaagggaaaacccacaaucuugggugaaacuccuuccucagcugguucagu

SEQ ID NO: 10769 - RNA, 87 nt, Human
agaggaagcgggaggagcugagcaacguacuggccgccaugaggaaagcugcgugccaagaaagacugagccccuccccugcccucu

SEQ ID NO: 10770 - RNA, 76 nt, Human; identical to SEQ ID NO: 758

SEQ ID NO: 10771 - RNA, 60 nt, Human
ggugcccucaauagccuccuugggugucuugaagccccagaccgauguucuuguaguacc

SEQ ID NO: 10772 - RNA, 71 nt, Human; identical to SEQ ID NO: 1764

SEQ ID NO: 10773 - RNA, 93 nt, Human
cuaucuacaaacagaauauaacaaaaggaaaaugugacuuaagaagugaucucagguccauagcucuucgguucuuccaaauuuguagaucag

SEQ ID NO: 10774 - RNA, 61 nt, Human
guguuuggguaacauaugcaccaaaaagaauccacauggaagcaauaagugacccaaacau

SEQ ID NO: 10775 - RNA, 75 nt, Human
uuuuuuuuuuuuuccaauucauauagucuuguauuauauacauauuaacagucuaugcaaugaaaaauaaagaaa

SEQ ID NO: 10776 - RNA, 108 nt, Human
gcauccuugagccauuucucuguguaauacaggcuuuagauuagugccuuauauugguuuugguuuggggcacuggaugucgcagcuacugcuaugguuucaggaggc

SEQ ID NO: 10777 - RNA, 73 nt, Human
guucuguuuuguuucuguuuucugugucuagugccaauuagcuaaaucagggagaaagaaaugaucacaugac

SEQ ID NO: 10778 - RNA, 84 nt, Human
uucauccuguaaaaguaagcauguagaaggaggaaguugugcuaaaaugccuuuguuuuuuuguuauuauuuucuuagccagaa

SEQ ID NO: 10779 - RNA, 64 nt, Human
acacuggcugaaggaaaauuuguauuauuucaauuauuuuuauguacagaaaacucaacagugu

SEQ ID NO: 10780 - RNA, 97 nt, Human
aagggacuuuauuuuggagagccagcaaaccaagaagaugguggacuaauguccuaaagaaccgucuuaaaauuaugcgggcuuugccuugucuuuu

SEQ ID NO: 10781 - RNA, 77 nt, Human
caaaaacaguuagcuguuuacaugcuuccccuuuaaucccagaguuaguuuugcaaacggcaugauuccuguuuuug

SEQ ID NO: 10782 - RNA, 101 nt, Human
uguuuaggucgggggaaaggaaggggcugacaaccgcagacaucuggacaccagcaaggguccaggggagguuugcagaacuucuuuguccuuggcuaaca

SEQ ID NO: 10783 - RNA, 66 nt, Human
aaaggcaugagaaacagucaucucaauaaaugcaagacaugagcauaaaagagguucucggccuuu

SEQ ID NO: 10784 - RNA, 83 nt, Human; identical to SEQ ID NO: 6433

SEQ ID NO: 10785 - RNA, 63 nt, Human
acccucuacgccugggagggggccugcgucuggauccccugcaccuacagagcccuagauggu

SEQ ID NO: 10786 - RNA, 74 nt, Human; identical to SEQ ID NO: 10013

SEQ ID NO: 10787 - RNA, 94 nt, Human
ggcugaaggaaaauuuguauuauuucaauuauuuuuauguacagaaaacucaacaguguacauuuaacccaguuuaguggcaaguucuuuagcc

SEQ ID NO: 10788 - RNA, 63 nt, Human
ucuugccuuucccuugauaaugcaguaagggacccccauuuuacgacacagggcagggcaaga

SEQ ID NO: 10789 - RNA, 65 nt, Human
guccccuuaacuaauccugaccuuaaccuauauaccaauggaaguucaguuguggagaaugggac

SEQ ID NO: 10790 - RNA, 62 nt, Human
cguaauguggcuacugguaagguaaaacggauaaaugccccagaccaaaacagcucgcaacg

SEQ ID NO: 10791 - RNA, 86 nt, Human
ccugccggcaaacuuagccuugcugcccagcuccucuucaauucugaggagcugguuguacuuggcaagcgcucagaucggcaagg

SEQ ID NO: 10792 - RNA, 71 nt, Human
gcacuagauuguaaagacugggguggaccucuuucuuaauguccaauguccuuugucuuaagauuuggugc

SEQ ID NO: 10793 - RNA, 67 nt, Human
ucucauuagaccuaacagaaugaaguuaauuuuuauaauuucuacguuuugagacuggguuaugaga

SEQ ID NO: 10794 - RNA, 105 nt, Human
uuauuuuaccuucuuguauaagcacugugcuaaaauugcagacacuaggaccaugucuugguuuuugcaauaaugcuagcagaguacacacaagaagaaaaguaa

SEQ ID NO: 10795 - RNA, 61 nt, Human
uuuaaugcagguacuguuacaauacaacugauguguuuuguugucguucccccugcuuaaa

SEQ ID NO: 10796 - RNA, 63 nt, Human
ccagucaccagccucaggacagauacaaagcugucuggcuuaucuucuucaugcugggucugg

SEQ ID NO: 10797 - RNA, 64 nt, Human
cucaguauuucacaaaccgccuggacaugucccagaauguguccuuggucacugcugaacugag

SEQ ID NO: 10798 - RNA, 67 nt, Human
ccacauguacuucugugcuuagaacauuuuuacggaccuaagcgcuggagacguugcugcaugucgg

SEQ ID NO: 10799 - RNA, 119 nt, Human
cagcucaaggggaagaaaguacggacaaguucacugagagcgucuacguccuggccaacgagccauccguggcccuguaccggcugcaggagcaugugcgucgcucccuccccgagcug

SEQ ID NO: 10800 - RNA, 73 nt, Human
ucuacacuguggaguacgccugcagcgccguggagaaccugguggacagcagcgucuacuuccgcagcgugga

SEQ ID NO: 10801 - RNA, 79 nt, Human
aguuucucuggaguauuugcgcuggaaguuucuaaucaaaaccauuagacuuugaguuucacaaacuccucuugaagcu

SEQ ID NO: 10802 - RNA, 62 nt, Human
gggguaaggagcaaauggaauaggggauaaagccuuuucaucuguuuagucauuuuacaccc

SEQ ID NO: 10803 - RNA, 111 nt, Human
agaucggucguuuuugaugcucgaugaaugcugggaauucagaggaaugucuucacuuauacuuggauuugcucucuucccauuucgugaucguaguauagcuuucgauuu

SEQ ID NO: 10804 - RNA, 68 nt, Human
ggcuuacaguaguucccccuuaucuucgggagauacauuccaaggcccccagugaacuccugaaagcu

SEQ ID NO: 10805 - RNA, 72 nt, Human
uauugccgugcuguguaggggcuaacaauggacacccagaaggacguucaaccuccaaagcagcaaccaaug

SEQ ID NO: 10806 - RNA, 111 nt, Human
ugcuagaagggaggguggguagacagccaccagccuuguuuauaaauucaaacaaaauaagaaucugcuagaagggaggguggguagacgccacccgccccgucacaggca

SEQ ID NO: 10807 - RNA, 83 nt, Human
uguuguuaccugucuuccauaaauaccauaguuaaauguuuugugugcauacauguucguauuugucuauaaagguauugaua

SEQ ID NO: 10808 - RNA, 129 nt, Human
uuggaaaugguuuauaaagaggcuuuacagucgcaugucauucagcaggagggaauauacuggucuuuaugauuacaugaaauaugcugugaagcuacagacuccauuauaaguaaacccaugguucaa

SEQ ID NO: 10809 - RNA, 61 nt, Human
uuugguuuguuuggucaugugaguuacccacaaguuguauaguuccaugaaacaagcuaaa

SEQ ID NO: 10810 - RNA, 65 nt, Human
aaugauuacggauacuaguauaagagaucagguucguccuuuaguguaguguaugguuaaucauu

SEQ ID NO: 10811 - RNA, 70 nt, Human
gcccgcucauaaggggauggccauggccagguuuauagauaguugggugguugguguaaaugagugaggc

SEQ ID NO: 10812 - RNA, 77 nt, Human; identical to SEQ ID NO: 9246

SEQ ID NO: 10813 - RNA, 69 nt, Human
guguuuuagaagcauuugcgguggacaauggaaggcccggcuucaucguauuccuguuugcugauccac

SEQ ID NO: 10814 - RNA, 97 nt, Human
uuuuuuuuuuuuuuuuuuaccaguagccuauuucagauuuauuaaaaaacacauagguaacgagucagagcuuuggcuaggaaugauuuggaaaaga

SEQ ID NO: 10815 - RNA, 64 nt, Human
ggggagaagcagccgugcugccaggucacccagaccuccagacagccggcuagccccacugccc

SEQ ID NO: 10816 - RNA, 77 nt, Human
ggugucguuuagaucaggguaaggcagucaggcggguguucaccacugccuuuucuuccucugagcgugagaacacu

SEQ ID NO: 10817 - RNA, 63 nt, Human; identical to SEQ ID NO: 123

SEQ ID NO: 10818 - RNA, 91 nt, Human; identical to SEQ ID NO: 124

SEQ ID NO: 10819 - RNA, 60 nt, Human
guuuuuaaaaauuguuauaauuaaguaaaaauaaagcugaauugugucaaaaaaaaaaac

SEQ ID NO: 10820 - RNA, 88 nt, Human
agcagcaagcagaaagaacuuauuaaaauauccuuucuuuacacaauuagauuaguauuuugcuucaugucuucauugcuuguuagcu

SEQ ID NO: 10821 - RNA, 61 nt, Human
cauuuauucuuaaaaucuacuuguuucauagaaacuuuaguaauaaccagaauaauucaug

SEQ ID NO: 10822 - RNA, 110 nt, Human
aagaaauaguuuuaaguaacuuuuuauagcaagaugauacaaugguaugaguguaaucuaaacuuccuuguuguauuaccuuguaugcuguuacuuuuauuuuauuccuu

SEQ ID NO: 10823 - RNA, 77 nt, Human
gcuucagggaaggggcgggcgugucgccgccucuggcaucgccuccgguugccuuacaccacgccuucaccugcagu

SEQ ID NO: 10824 - RNA, 107 nt, Human
gcccgcccaggccgacaacgacucccggcaugcagugcuuugcgccgggcacgcucugcgccugcgugcugcgcgcugcccgcuggggcucgaaguuccgggagggu

SEQ ID NO: 10825 - RNA, 93 nt, Human
gggccagaggaggcgguccugguagggagugcguaccaggguggagucgcuguccggucgcgcuucacuucugcuccgcccucccugcucccc

SEQ ID NO: 10826 - RNA, 88 nt, Human
gucucacugagccuuagucgucggcaggucccaggcgcgaaguuucucggccuggaggagggggucgcgcgaagugccagaugcaggc

SEQ ID NO: 10827 - RNA, 66 nt, Human; identical to SEQ ID NO: 1526

SEQ ID NO: 10828 - RNA, 69 nt, Human
agacuuggagucaucuggacugcagagaaggaacuccucugaagcaagcuccggagacuucuuagaucu

SEQ ID NO: 10829 - RNA, 82 nt, Human
ggggccuguggcaaaagaacugagcggacugccaucuggacccucugccggaucagguccuccucccccuccaccaggcccc

SEQ ID NO: 10830 - RNA, 66 nt, Human; identical to SEQ ID NO: 3532

SEQ ID NO: 10831 - RNA, 104 nt, Human
cggggacuacaauggccacgucggucuggguguuaagugcuccaaggagguggccaccgccauccguggggccaucauccuggccaagcucuccaucguccccg

SEQ ID NO: 10832 - RNA, 130 nt, Human
ggggaaccgcgguggcuuccgcggagguuucggcaguggcauccggggccggggucgcggccguggacggggccggggccgaggccgcggagcucgcggaggcaaggccgaggauaaggaguggaugccc

SEQ ID NO: 10833 - RNA, 62 nt, Human
aguguagcaaaucgugauguaaauuuuuuacugcuggucauggucaaaaaguaagauacgcu

SEQ ID NO: 10834 - RNA, 112 nt, Human
guauaaggcagguuuuauagaaccauuuagauucaacauuaaugguagaguggcauuuuaccaaaaaaauggguguauuugauuugggugcuguaaggcaauuugcuaggac

SEQ ID NO: 10835 - RNA, 61 nt, Human
uugugggugauugcaauuuuuuaaugaaaugcauuagaacaucuaagcacgucaccuacag

SEQ ID NO: 10836 - RNA, 66 nt, Human; identical to SEQ ID NO: 3532

SEQ ID NO: 10837 - RNA, 60 nt, Human; identical to SEQ ID NO: 1551

SEQ ID NO: 10838 - RNA, 79 nt, Human; identical to SEQ ID NO: 1810

SEQ ID NO: 10839 - RNA, 68 nt, Human
cugguuuugcuggggacgacgcuccccgagccguguuuccuuccaucgucgggcgccccagacaccag

SEQ ID NO: 10840 - RNA, 66 nt, Human; identical to SEQ ID NO: 2802

SEQ ID NO: 10841 - RNA, 102 nt, Human
ugaagauccucacugagcgaggcuacagcuucaccaccacggccgagcgggaaaucgugcgcgacaucaaggagaagcugugcuacgucgcccuggacuucg

SEQ ID NO: 10842 - RNA, 73 nt, Human
ggauccgcugccaguccccacugaggaaggaaacccccuccucaaacacuaucgggggcccgcaggggaugcc

SEQ ID NO: 10843 - RNA, 63 nt, Human
uccccaccgugaccugccuggccuccccugucucagggagcaggucacaggucaccaugggga

SEQ ID NO: 10844 - RNA, 60 nt, Human; identical to SEQ ID NO: 1551

SEQ ID NO: 10845 - RNA, 81 nt, Human
guauggaaucuugcgggauccaaggagaccaccuucaacuccaucaugaagugggacguggacauccggcaaggacuguac

SEQ ID NO: 10846 - RNA, 103 nt, Human
agugguagcaaggacccuucaaaaaaugauacaugcaaaaguugcugggcauauuggauuuuacccaucauaggcgcuguucucuuagguuuccuguaccgcu

SEQ ID NO: 10847 - RNA, 60 nt, Human; identical to SEQ ID NO: 1551

SEQ ID NO: 10848 - RNA, 116 nt, Human
cuguugguucuuucuccugacuccugugguuuugcuaauggcacuuuacagacuccauggagaugucagguggaccaucuucuagggcccagcaggaguagggaaugugccaacag

SEQ ID NO: 10849 - RNA, 92 nt, Human
gcaugcccacugagagccugaaggaggagcuggcuaccugaagaagaacccgaggaggagcauggaaugccugagaggccagugggcggagc

SEQ ID NO: 10850 - RNA, 73 nt, Human
gggcuccugcggcaucgggggcggcaucgggggcggcuccagccgcaucuccuccguccuggccggagggucc

SEQ ID NO: 10851 - RNA, 61 nt, Human
gguggugaugggcuucuggugggcagugagacggugaccaugcagaaccucaacgaccgcc

SEQ ID NO: 10852 - RNA, 103 nt, Human; identical to SEQ ID NO: 5697

SEQ ID NO: 10853 - RNA, 73 nt, Human; identical to SEQ ID NO: 9918

SEQ ID NO: 10854 - RNA, 81 nt, Human
agaagauaaagcaaguugucugacuuaauuuaggauaaauucucagugauuguuucaaagauuucuuuagcuuucucuucu

SEQ ID NO: 10855 - RNA, 81 nt, Human
gccuauuucuaguuuuguauuuuaaaaaguuuucauuaaaauguuguuugaggaucaggaaaaacaacuaagauacuaggc

SEQ ID NO: 10856 - RNA, 62 nt, Human
ggacgagaagaauggccccccuccucccaacaugaccaccaacgagaggagagucaucgucc

SEQ ID NO: 10857 - RNA, 67 nt, Human; identical to SEQ ID NO: 4894

SEQ ID NO: 10858 - RNA, 72 nt, Human; identical to SEQ ID NO: 9079

SEQ ID NO: 10859 - RNA, 62 nt, Human
auggcugccgucccgaucccagucauacaccuccaccuugaugguccgaucguagucgccgu

SEQ ID NO: 10860 - RNA, 88 nt, Human
uuuuuuuggguuuaccaccucauagauguugaauuggcucugcccacgggccagcucccgguaacugguggugaacuccccaaugaag

SEQ ID NO: 10861 - RNA, 69 nt, Human; identical to SEQ ID NO: 6516

SEQ ID NO: 10862 - RNA, 76 nt, Human
uccuaagucuucuuccauccagucaagccagaagaugcccaggggaguagggagguuuggggagggagguuuaggg

SEQ ID NO: 10863 - RNA, 65 nt, Human
uggcacgccugcuguggagcccgcgccggcauauccugcagugggacuccaccggauccuugcca

SEQ ID NO: 10864 - RNA, 65 nt, Human
gccagaacagacuguucucugcagugaaucugagccuucaagauucauguaggacaugauuuggc

SEQ ID NO: 10865 - RNA, 62 nt, Human
guaaaccccacaaaccacaggcuauuccaaaguacagagagcugagaaagaagggauguugc

SEQ ID NO: 10866 - RNA, 64 nt, Human
ucacuuuucaggaguccuugggguuuuccacuaagauuuggaagcuaagaaucuccugggguga

SEQ ID NO: 10867 - RNA, 66 nt, Human
uuucugucucgcccuuuuaguccugaaaucuaugggcuucagucucucaaaggugugagagggaaa

SEQ ID NO: 10868 - RNA, 76 nt, Human
cucgccaaggacuuugcaauauauuuuuccgccuuuucuggaaggauuucgcugcuucccgaaggucuuggacgag

SEQ ID NO: 10869 - RNA, 60 nt, Human
cuggucacgaacccucacacggacgccuggaacgagccacggcuugguggagguggccag

SEQ ID NO: 10870 - RNA, 85 nt, Human
gaauguggacccagacagcgugguccucugccucuuggccauugacgaggaggaggaggaugacaucgcccugcaaauccacuuc

SEQ ID NO: 10871 - RNA, 102 nt, Human
gacaucaacaucgugcgggugucgggcaugcagcgccuggcgcagcuccugggagagccggccgagacccaggcaccaccgaggcccgagaccugcauuguc

SEQ ID NO: 10872 - RNA, 79 nt, Human
cuggcagcgcuucaagucaugguccccaucaugcaggaucucaggcuccacgaugggcacaaugccauucugcuggcag

SEQ ID NO: 10873 - RNA, 89 nt, Human
ugaccauguugggcuucagcaaggugcuuccagguagaugugguggucacucagagccuuguagacagcagccagcaccuucucgguca

SEQ ID NO: 10874 - RNA, 75 nt, Human
agggguguaggugucccuuuugguaaaaaaugggcuagggcauuuuuaaccuuagggcgaaaccuuuuaaucacu

SEQ ID NO: 10875 - RNA, 77 nt, Human
uuaaugguugauauugcuaggguggcgcuuccaauuaggugcaugaguagguggcccgcaguaauguuagcgguuag

SEQ ID NO: 10876 - RNA, 91 nt, Human
gcuuuuuuuaaaaaaauuguaacaaaaaggaguuaucgcauaaacagaucaugaauuauucuuagcaaauuacacuuuuuuuucuuaaagc

SEQ ID NO: 10877 - RNA, 83 nt, Human
uuuuuuuuuuuguacagagccuguauuuagugcaauaaguuuaaaaaauuugcucugaaauauuuacuuuacauuaacaaaaa

SEQ ID NO: 10878 - RNA, 76 nt, Human
aaugaccauuuuuccauuuucuuucuaggaaauuaaacccuuuuaauucuuaucuaccuucuacauaaugguuauu

SEQ ID NO: 10879 - RNA, 105 nt, Human
gagacuuucuaaaguguacuuaaaacauaguaguuuuuuaccuuucacaaaacugaguuacaagaauacuuuuguuuuacagugcaucccuuccgaggaagucuc

SEQ ID NO: 10880 - RNA, 60 nt, Human
gcaguuuugucuaaacuguucaaaaaaaaaacuaugaacagaguucaaauacaggacugu

SEQ ID NO: 10881 - RNA, 78 nt, Human
gggaggaaaagcuaugaaacuguauagggcuguauauauacuugucucagcuuaaugcaggaaauuggcuuacuuucc

SEQ ID NO: 10882 - RNA, 74 nt, Human
ggacgcucuccagaaauuacaucggugugcgugggcacuacgugugcaagagugaaccgggagggacaacgucc

SEQ ID NO: 10883 - RNA, 68 nt, Human
uuagcuccuugguugucgaacguccuguggggaaaaacuuaggggaagaaaugauaaggggggguugg

SEQ ID NO: 10884 - RNA, 65 nt, Human
agcagcuauuaccaaaaaaggcauauacuuccaguccugugcuccaucugccuuaauucuuugcu

SEQ ID NO: 10885 - RNA, 61 nt, Human
ccugagaaacugguggcuuugaacacuugguguggacuacuguguuauccgggauaucagg

SEQ ID NO: 10886 - RNA, 63 nt, Human
ggcaagagcaucuguucgaccuuagacauggcaagaugaaagcuaaguccagugcucgcugcc

SEQ ID NO: 10887 - RNA, 63 nt, Human
ucccucugcuggaccugaaugguacugaugcuguugagagccaucugguccucagacauggga

SEQ ID NO: 10888 - RNA, 72 nt, Human
gaggagcgcagcaccaccaccaucaaggucaucauugucaucuaccuguccguggugggugcccuguugcuc

SEQ ID NO: 10889 - RNA, 90 nt, Human
ggcuuugcuggggcagcaagccugauaagcaugaagcucuuaucuuugguggcuguggucggguguuugcuggugcccccagcugaagcc

SEQ ID NO: 10890 - RNA, 62 nt, Human
gaggcacaaucuaaauacuaaaaaugauuaugaaaucuugaguugagcugauugaugcccuc

SEQ ID NO: 10891 - RNA, 76 nt, Human
guauugcuauuuguuuaaagcacucacauaaauccauuucacccaaaaaggaaacauaaagugcuucuagcaguac

SEQ ID NO: 10892 - RNA, 64 nt, Human
ggaggggccauccacagucuucuggguggcagugauggcauggacuguggucaugaguccuucc

SEQ ID NO: 10893 - RNA, 60 nt, Human
gccccagcagccccugcagccuccaggcccucucgccgggccacagcguagggcuggggu

SEQ ID NO: 10894 - RNA, 101 nt, Human
gggauccacagugucaaggaacuuaaauauaauguaucauaccaacccaaguaaaccaaguacgaaaaauauucauauaaaguuguucacacguagguccu

SEQ ID NO: 10895 - RNA, 69 nt, Human
uggcaaacaggacaguggacucaucucggugauaggcuguagaugcuaacacuggccaauucaaugcca

SEQ ID NO: 10896 - RNA, 92 nt, Human
augauucaauuaucuccaccuggccccacccuugacaccuggggauuauuacaauuaaaggugaaauuugggugggaacacagccaaaucau

SEQ ID NO: 10897 - RNA, 68 nt, Human
uuauuuuuaaccuguagagagaccuuaaggauuuuacuucauaagggguuugauuaugggaaagauaa

SEQ ID NO: 10898 - RNA, 76 nt, Human
ucuggaguccuaaggcugguuggcgagaacuagcaggguccugcaaguuauagguuauucagcccaggauacuggg

SEQ ID NO: 10899 - RNA, 64 nt, Human
uggacuauggccaggaugaagaggcagugaagaagcugacaguaaauccuggcaccaaagucca

SEQ ID NO: 10900 - RNA, 64 nt, Human
cagcagcguuuaacccgugugggcuuugaggauugccaaacgggauaaagacuuuaagcgccug

SEQ ID NO: 10901 - RNA, 61 nt, Human
gaccggggcaagggcacacaggaacggcuuaagguuccuccccuuguaggaccaaccgguc

SEQ ID NO: 10902 - RNA, 95 nt, Human
ccaccaggacuuaucucagaaaauugcugaccgccugggccuggagcuaggcaagguggugacuaagaaauucagcaaccaggagaccugugugg

SEQ ID NO: 10903 - RNA, 71 nt, Human
ucugaguggaggaacugcacuauggucucaccugaugcugguguagcuaagagagugaccuccauugcaga

SEQ ID NO: 10904 - RNA, 85 nt, Human
gccuuguggacuaccugcggucuaggggucggucagugcugggcggagacugucuccucaaguucucgcuagaugucugcgaggc

SEQ ID NO: 10905 - RNA, 80 nt, Human
ggcgggccuuuuuccuugcgucccaagcugcacccuucgggccgucucucuugggaccaccuguuggggccuggggagcc

SEQ ID NO: 10906 - RNA, 79 nt, Human
uccuucucugggaaaucuacuccuuugggcgagugccuuauccaagaauuccccugaaggacgucgucccucgggugga

SEQ ID NO: 10907 - RNA, 63 nt, Human
cagugcugggcagccagggccuaguggugucauuggccaucuccugacugcccuaaggcucug

SEQ ID NO: 10908 - RNA, 83 nt, Human
uuucaggucgugauaaugagcuccuaugaaagaaugcaauauaaugacccgcuuuucuagaaaguucauaaucagcucuggaa

SEQ ID NO: 10909 - RNA, 63 nt, Human
uuucauuaacacauauauuccguccugcaauacuggagagguggaaugugucuggcacagaaa

SEQ ID NO: 10910 - RNA, 68 nt, Human
ggagcuggcccugggcagcaacaagcugggugaugugggcauggcggagcugugcccagggcugcucc

SEQ ID NO: 10911 - RNA, 63 nt, Human
ggcucaggacccuguggaucugggaguguggcaucacugccaagggcugcggggaucugugcc

SEQ ID NO: 10912 - RNA, 100 nt, Human
uagggaaagcugguacgccugcagguaccgguccggaauucccgggucgacccacgcguccgguccgugugcugugccagggccugaaggacucccccug

SEQ ID NO: 10913 - RNA, 69 nt, Human
aguauuccuaagcaugauagaaaaaaaguauggacuacauagaaacaucugacagcaagaggaaccacu

SEQ ID NO: 10914 - RNA, 90 nt, Human
cccacgcguccguggccaucugaucuauaaaugcgguggcaucgacaaaagaaccauugaaaaauuugagaaggaggcugcugagauggg

SEQ ID NO: 10915 - RNA, 74 nt, Human
gcaagcauuucagacaggcauuccuuacauuagaaaaaugugaagaggaguugccauguuuaucagaauuuugc

SEQ ID NO: 10916 - RNA, 60 nt, Human
gaaauuuaaaauauacaugauagacacaaucaccacguuaugaauccuuuuuuuaauuuc

SEQ ID NO: 10917 - RNA, 65 nt, Human
ccuucuguugacucuacagacaccacauggcuugcauccagccagucugucuuguaacauguagg

SEQ ID NO: 10918 - RNA, 88 nt, Human
ggcacccucggcugugccuccucugaggcuggcaguuccuuccuggauaugcaaggucaagagcggagggggaagcagagagagugcc

SEQ ID NO: 10919 - RNA, 67 nt, Human
cuaucaucaucuagcaccuguccgguuccccacgugagccuugggcaggacgcugcaguguugaugg

SEQ ID NO: 10920 - RNA, 73 nt, Human
uggacucugaguaugaggcaggcuguucugagguccccguggggugagccugucuguccucccucagagccca

SEQ ID NO: 10921 - RNA, 68 nt, Human
aauguguccucuuucuuuaauguuagugacaguucuauacagcacagacauaacugaagaaacacauu

SEQ ID NO: 10922 - RNA, 85 nt, Human
uauguauuguacuuuuaaucacuuacugagaauauuucaaauuuauauucucaucaggaaaauguaaaaaagauacugauauaua

SEQ ID NO: 10923 - RNA, 68 nt, Human
cguggucaccuucgaguagagaggcccgcccgcccaccgugggcagugccacccgcagaugacacgcg

SEQ ID NO: 10924 - RNA, 79 nt, Human
guaccaugaaugcgcuaaagcuggacuccaugacuguaccggaggcggcacaggguaccagcgacuaguaugauggugc

SEQ ID NO: 10925 - RNA, 60 nt, Human
guggacccauacgcaugcgccucuuaugccugggaagcaguaugcaagauauggaaccac

SEQ ID NO: 10926 - RNA, 72 nt, Human
gggaagaccugcagugcacgguuucuuccaggcugagguaccuggaucuuggguucuucacugcagggaccc

SEQ ID NO: 10927 - RNA, 67 nt, Human
ggggcgucccgggcacaccacggucuccuggagcacaaaggcggccaaaacagccgcgggcgacccc

SEQ ID NO: 10928 - RNA, 62 nt, Human
gggacaucccgaggaaaggcugcguguacggaucacgggcacagccagccgcggggcguccc

SEQ ID NO: 10929 - RNA, 70 nt, Human
uugucgaucugcuagcucccuaugccaaggguggaaaaauugggcuuuuugguggugcuggagucggcaa

SEQ ID NO: 10930 - RNA, 73 nt, Human
ggggacagcgaccugcagcuggaacgcaucaacguguacuacaaugaggccaccggcggcaaguacgugcccc

SEQ ID NO: 10931 - RNA, 61 nt, Human
ccggcccggggaggacaagucgcugccaccuuugugcugccgacgugauucccugggacgg

SEQ ID NO: 10932 - RNA, 67 nt, Human
ccagacgagacuauuuuucacaagcgcggaguaguugucuccccuuuuguuauguaaaaaugugugg

SEQ ID NO: 10933 - RNA, 91 nt, Human
guuuggccguaaggugccgugcgugaauugugcuugugcccuccacacggguucgugggcacuccggacgugauuaaccagccggccagac

SEQ ID NO: 10934 - RNA, 67 nt, Human
gguaugucgggggaagcaacaaagcaugggcaacuggcuuaaugacgccugcuuuccuuccugugcc

SEQ ID NO: 10935 - RNA, 77 nt, Human
guguuccagugggggacugguuuggcaucauguggacgacgguugugcccugggcagacucuuccauuguuuuucac

SEQ ID NO: 10936 - RNA, 79 nt, Human; identical to SEQ ID NO: 1810

SEQ ID NO: 10937 - RNA, 70 nt, Human
gcagccaagcauuugauacuggagaaaguuucagaagaugaagaacuucggaagagaaugcucauucugc

SEQ ID NO: 10938 - RNA, 125 nt, Human
ggcaccuuggagaacugagaacuugggaccucuauuuuguugacuuuggagauacuggaggauugccacuggaggaccuucaggggucucaggagugaauuccuuaagccuuccauuuccaagcc

SEQ ID NO: 10939 - RNA, 95 nt, Human
cuuccuguggcccuucaaauugucuucuccacgagguggaaugaagaaaaaagaccacccauuugguagaagguggagaugcuggcaacagggag

SEQ ID NO: 10940 - RNA, 67 nt, Human
gaucaacaggcuuauuagaagaaugaauaaggugucuaccaugauuauuuuucuaagcugguggguu

SEQ ID NO: 10941 - RNA, 82 nt, Human
gcagguucacaaggcaggcggucugcguggcacugaagucagggacagucaccaacagcacugucugguccucaggaccugc

SEQ ID NO: 10942 - RNA, 68 nt, Human
guccugccucaaagagaagcugccagaaauaaacaggaguccccauuggcacacaguggggcagugac

SEQ ID NO: 10943 - RNA, 60 nt, Human; identical to SEQ ID NO: 1551

SEQ ID NO: 10944 - RNA, 60 nt, Human; identical to SEQ ID NO: 1551

SEQ ID NO: 10945 - RNA, 70 nt, Human; identical to SEQ ID NO: 2072

SEQ ID NO: 10946 - RNA, 66 nt, Human
ucgguugcacgcagcugagcaggagagccucaagcgcuccaaggagcucaaccuggugcuggacga

SEQ ID NO: 10947 - RNA, 66 nt, Human
uugaguccuuuaugaaauucauaaauaaagaauuguucuuucuuugugguuuuaauaagaguucaa

SEQ ID NO: 10948 - RNA, 108 nt, Human
ccacuugcaauuauuugaggaacuccgccgccuggcgcccauuaccagcgaccccacagaagccaccgccgugggugccguggaggccuccuucaagugcugcagugg

SEQ ID NO: 10949 - RNA, 60 nt, Human
uccuguuagcaagaacaauguacuucaguuuccucaaccuggaaguacagaugcagagga

SEQ ID NO: 10950 - RNA, 62 nt, Human
cugaaacuacggaucuuccgacuucuggauguucguccgucugucuugucugcgguugucag

SEQ ID NO: 10951 - RNA, 69 nt, Human
gagaccuuguaucaaucagcugacuguucugaugccaaugaugccuugauaguguugauacaucuucuc

SEQ ID NO: 10952 - RNA, 68 nt, Human
guguguagacaguauguuagggccuagcucaaaauuuugaagcugagucaauucaagauaaugcgcau

SEQ ID NO: 10953 - RNA, 101 nt, Human
uaccagaaucuuuuauuugcaaagagaaacuaggggaaaauguagccaacauauacaaagaucuucagaaacucucucgccucuuuaaagaccagcuggug

SEQ ID NO: 10954 - RNA, 67 nt, Human
cuuuucucugccuugcuugcuugagcuucagcggaauucgaaauggcuggcgguaaggcuggaaagg

SEQ ID NO: 10955 - RNA, 73 nt, Human; identical to SEQ ID NO: 5567

SEQ ID NO: 10956 - RNA, 74 nt, Human
ccugggacagcaggugccaggcuucccaacagcuccaacccggguggugauugcccggcccacuccuccacagg

SEQ ID NO: 10957 - RNA, 62 nt, Human
cugcagggcgccggucuaggguaccaaugccucguuggcccagauggugagcggccuugugg

SEQ ID NO: 10958 - RNA, 65 nt, Human
ggcgaugccugguguccugccuuucuccaaggcuugacugacuucuugcaggcacaccgcacgcc

SEQ ID NO: 10959 - RNA, 78 nt, Human
agaagaugguaacugggaucucguuggaaauaacacccccauauucuucaucagggaucccauauuguuccaucuuuu

SEQ ID NO: 10960 - RNA, 87 nt, Human
acaccuguccagcugugagcucugcuugguccgaauaaaguccucugggggcucccugggcccugauggcuagccuggcgcgggugu

SEQ ID NO: 10961 - RNA, 61 nt, Human
cccaguggagcagccaucagagcccagugcuaugggcuuugugcuuaguauccagccuggg

SEQ ID NO: 10962 - RNA, 91 nt, Human
gugaggcugcaggaagaggcaggugugaguugaccacguuccucccuccucaggucaugcucugcaagcauuccaucuuuuucagcuccau

SEQ ID NO: 10963 - RNA, 88 nt, Human
ugauagaauuuauccgcuccagacuuuagucacuagguucuaggagugagcuggggccugcugagguggggguggggcugacucugca

SEQ ID NO: 10964 - RNA, 73 nt, Human; identical to SEQ ID NO: 8252

SEQ ID NO: 10965 - RNA, 65 nt, Human
guguauuauuguuuauugaagcauagccuauuaccauguagcuuaguggcucaaaagcagcacac

SEQ ID NO: 10966 - RNA, 62 nt, Human
augggagcuuaauuucguucagcacaccauaaaaguuguggcagaguaaagauuauuccugu

SEQ ID NO: 10967 - RNA, 74 nt, Human
gccuucucucuccuggugcaaaauggcaacucuuaaggagaaaacucauugcaccagcuugcggaagaagaggc

SEQ ID NO: 10968 - RNA, 61 nt, Human
ggcuggacccaauggcacugccacgcuaucgaauuggcagaacccaacgggggcaacagcc

SEQ ID NO: 10969 - RNA, 79 nt, Human
uggcgacgccagugugccuguguggaguggucgugaagcgcgcaguguucacuccaggcuggacccaauggcacugcca

SEQ ID NO: 10970 - RNA, 62 nt, Human
gggcccgcuuagccaaagcguuuugccccgguuucucggguuucucgccuuuggccgggccc

SEQ ID NO: 10971 - RNA, 63 nt, Human; identical to SEQ ID NO: 123

SEQ ID NO: 10972 - RNA, 77 nt, Human
uugacuaguuuucuuucuuuugcuaccucaacaccaaacaauaugggauuagugagaaaugaacuucaacugguuga

SEQ ID NO: 10973 - RNA, 105 nt, Human
gacacucugagcaguugcuagaagucccacacugauaccuagucaugucgcguagacacugucuggguacuguugcagauuagcuugugauuguagagacguguu

SEQ ID NO: 10974 - RNA, 61 nt, Human
caccugcagcgaaaauuaacccuucuggaucaaaagaacagacuggcuuccccugcagaug

SEQ ID NO: 10975 - RNA, 90 nt, Human
gaugagcuugccaucauugcugaauuuaaguccuguccacucacaaguucgaucauacugcaucuuaaagguagcaaauggccucuuauc

SEQ ID NO: 10976 - RNA, 68 nt, Human
agaucgauggaauuucugggguauagcacauucuaaugucaccugagcuuccagguccucaaugaucu

SEQ ID NO: 10977 - RNA, 64 nt, Human
agggcacccgcagcugcccccuuuguuccuuucucggguggggggacagagacuggggggcccu

SEQ ID NO: 10978 - RNA, 75 nt, Human
ggccugagaacaugguucgcaucgcuuugcagcuggacgauggcucgagguugcaggacucuuucuguucaggcc

SEQ ID NO: 10979 - RNA, 62 nt, Human
agcacaggaagcggaugacagaggaauccccuuuccuccaggucaccuuggcuugcugaguu

SEQ ID NO: 10980 - RNA, 89 nt, Human
guauaauuggcuuacagaucugaucgcuaagaaaaaacuuuuuugggguugucucuugugguuuugguccucuauguugcagaucgugc

SEQ ID NO: 10981 - RNA, 70 nt, Human
cccggguuuuauuucucucuuucuugaguggacuguuucccuauaauuaaaagagguggugaguccuggg

SEQ ID NO: 10982 - RNA, 74 nt, Human
guucaagcgcuuguccaaccuccuuagucugacucagugcauucuaacugggggggacaucucgugcaggggac

SEQ ID NO: 10983 - RNA, 74 nt, Human
aggccccuaugcugcgcuuugaggcuccgauucucggaaucgcugggaccggcuucauucccuuuggugggccu

SEQ ID NO: 10984 - RNA, 74 nt, Human
gggcagcucucugcacaguuggagcagguacacuaacuacugccgcaaugaugaaccgcagaacauguugaccc

SEQ ID NO: 10985 - RNA, 74 nt, Human; identical to SEQ ID NO: 8144

SEQ ID NO: 10986 - RNA, 66 nt, Human; identical to SEQ ID NO: 8145

SEQ ID NO: 10987 - RNA, 86 nt, Human
gacaaaggauaauggggacguuugacaggacugcauucagauggugacugacauccagacugcuguacggaccaauccacuuuguc

SEQ ID NO: 10988 - RNA, 89 nt, Human
ucagccaguauucugcaauugcuauccacaugaugaugcacauggaaccaaggagaucugugcgcugggugggucugugaugcgguuga

SEQ ID NO: 10989 - RNA, 71 nt, Human
gcacgcuccugcuccugacucaccgcuguucgcucucgccgaggaacaagucggucaggaagcccgcgcgc

SEQ ID NO: 10990 - RNA, 85 nt, Human
ucuucggcggugggaccaagcugaccguccuaggucagcccaaggcugcccccucggucacucuguucccgcccuccucugagga

SEQ ID NO: 10991 - RNA, 74 nt, Human
ugcccgucuuucuugguucaccuuaucgggggugggccuccggcagggaacggccugggacaacugggggggca

SEQ ID NO: 10992 - RNA, 60 nt, Human
uugcggcauccacgagaccaccuucaacuccaucaugaagugugacguggacauccgcaa

SEQ ID NO: 10993 - RNA, 63 nt, Human
cccgguacccgugugcucccggcggugggugagcccgaacuuucugucuggacgggugugggg

SEQ ID NO: 10994 - RNA, 61 nt, Human
cgcggcuacuacaaccagagcgaggacgggucucacacccuccaguggauguauggcugcg

SEQ ID NO: 10995 - RNA, 64 nt, Human
gcgaucccgcccguggcggggugccagccccccgaagggcgucacgccacccgggcgggcgagc

SEQ ID NO: 10996 - RNA, 64 nt, Human
agcaauuuuugguucugaagauguaggcucuagcuccuacguugcuguggacauauugauugcu

SEQ ID NO: 10997 - RNA, 61 nt, Human
cugcugauugggggaaauaauuuucacacuauccugaauuuugugccugucuaauaagcag

SEQ ID NO: 10998 - RNA, 79 nt, Human
ggaacauacuugccuggagauagccuuugcgauauuuaaauguccguggauacagaaaucucugcaggcaaguugcucc

SEQ ID NO: 10999 - RNA, 70 nt, Human
ugaggaguacaagcuaauuuuucuguagaauguuccucaacauuuuucugauaauucugcuaguuccuca

SEQ ID NO: 11000 - RNA, 67 nt, Human
ccaugguugcuuuuaaaaucuuguauuugguaucuugucauuuacaauaccuugagucuaggccugg

SEQ ID NO: 11001 - RNA, 85 nt, Human
acacucagugggaguggaccggcgaucacaagaggggcagaugaugcaucaccuuucccaccugcacggaaaaaucccagggugu

SEQ ID NO: 11002 - RNA, 77 nt, Human
ggaaacuggggccuucuuugaguacuagugaguaagacauuuugcaacagugcugaguaugaaaggcccuggucucu

SEQ ID NO: 11003 - RNA, 92 nt, Human
uuauuuuugacaggaacuguuuuuaauccaugugguuagucuuuggcaacaagcugacugguggauauagaacgaggguugguuagcgguga

SEQ ID NO: 11004 - RNA, 64 nt, Human; identical to SEQ ID NO: 7119

SEQ ID NO: 11005 - RNA, 71 nt, Human; identical to SEQ ID NO: 3322

SEQ ID NO: 11006 - RNA, 77 nt, Human; identical to SEQ ID NO: 3323

SEQ ID NO: 11007 - RNA, 91 nt, Human
guggucuggagggcugguggugugccgggccccauguuucacuguccggccgggcuguuuuggggccccuuuccccggccuugugggccgc

SEQ ID NO: 11008 - RNA, 67 nt, Human
gcuguaggguaacuuuugaaguagauauauuaccugguucugcuauccuuagucauaacucugcggu

SEQ ID NO: 11009 - RNA, 99 nt, Human
aauguugcuagugcuccuuaggccuuuaagcuauaaacucagcaaggaaugucugcauuuuaucucuuuaagguaccaccagggggguaugacagcauu

SEQ ID NO: 11010 - RNA, 64 nt, Human
aggugaguugugacugauugcuuuuccugcagcgcacgugagcaguaucagccauuuuuuuccu

SEQ ID NO: 11011 - RNA, 83 nt, Human; identical to SEQ ID NO: 3475

SEQ ID NO: 11012 - RNA, 64 nt, Human
gugccugguaauggaauaauagggucggcgaugcccgccaagauuccaaaguaagucaggucgc

SEQ ID NO: 11013 - RNA, 85 nt, Human
gccugcaccguugccaggcguauggggcugccugugcugacugcugccuugcccgggacccuuacugugccugggauggccaggc

SEQ ID NO: 11014 - RNA, 86 nt, Human
ggagcucaugcuggaggagguggaggucuucaaggauccagcacccgucaagaccaugaccaucucuucuaagaggcaacaacucu

SEQ ID NO: 11015 - RNA, 64 nt, Human
uuuccugggcacagaccggggacagugcagaaggucauugugcugcccaaggaugaccaggaga

SEQ ID NO: 11016 - RNA, 66 nt, Human
aacgaaggugauuaaaagaccuugaaauccaugacgcagggagaaugggucauuuaaagccuaguu

SEQ ID NO: 11017 - RNA, 93 nt, Human; identical to SEQ ID NO: 10132

SEQ ID NO: 11018 - RNA, 62 nt, Human; identical to SEQ ID NO: 10420

SEQ ID NO: 11019 - RNA, 62 nt, Human
cagggcuuuauugaaccaaggcccuaacagaugacucagcagggccuucaagcacagcccug

SEQ ID NO: 11020 - RNA, 61 nt, Human; identical to SEQ ID NO: 3057

SEQ ID NO: 11021 - RNA, 72 nt, Human; identical to SEQ ID NO: 7743

SEQ ID NO: 11022 - RNA, 64 nt, Human; identical to SEQ ID NO: 3058

SEQ ID NO: 11023 - RNA, 61 nt, Human
auucuaugccuaauacucacacgcaacauuucuuguacuuuguaaguccguuugcgagaau

SEQ ID NO: 11024 - RNA, 67 nt, Human
ucuucgggaaaggugguggcggggcguccacuagguuuccuguccccgugcugcuccuuccguaaga

SEQ ID NO: 11025 - RNA, 63 nt, Human
uguaaacgguaaagagauuuuuacuuuuggucuccgugagucgcaucucuacuaagguuuaca

SEQ ID NO: 11026 - RNA, 91 nt, Human
ggaguguggcgugcggccggggcauggcgacuuccucuucacuggccacaugcacuucggggaggcgcggcucggcugugccccacgcuuc

SEQ ID NO: 11027 - RNA, 71 nt, Human
cuggggaggugugcucugcucucaaccucugcgagucucuccagaagcaccuagcagagcugaaucaccag

SEQ ID NO: 11028 - RNA, 69 nt, Human
ugcgggacuccuccaggcugccaucagaggggccccggcggcccacgugguagugggagauguucugca

SEQ ID NO: 11029 - RNA, 67 nt, Human
uguugcugggcaccccgcaaugaccucagucccacgacaguuauugucccgaagggcgcccggaaca

SEQ ID NO: 11030 - RNA, 77 nt, Human
ggagaacuuuugugucuagcucagggauuguuaacgcaccaaucagcacccugucaaaacggaccaaucaacucucu

SEQ ID NO: 11031 - RNA, 74 nt, Human
ucagcacucugugucuagcucaggguuuguaaauauaccaaucaacacucugugucuagcuaaucuagugggga

SEQ ID NO: 11032 - RNA, 61 nt, Human
uguuggugaaagugucuguucccuaaguuuaucauacagaaacuccaaacguuugcuggca

SEQ ID NO: 11033 - RNA, 63 nt, Human
cacagcagcagcuucagcgggaaugcguccauccugagcccucugcugcaggugccugaugug

SEQ ID NO: 11034 - RNA, 73 nt, Human; identical to SEQ ID NO: 3872

SEQ ID NO: 11035 - RNA, 99 nt, Human
ccgcuuggugggcaucaucuccuccaugggacauugauuuucucaaagacggaggaacaugagugucugcuuggagagagauaaugacugccggggcgg

SEQ ID NO: 11036 - RNA, 94 nt, Human
gggacucgcgguaccucagagcugccgagcgggcguguggggcccuggcucuggggaagcuuggcgcugcucgccgguggcucuggcgggcccc

SEQ ID NO: 11037 - RNA, 80 nt, Human
ucgcgugcgggauguuuugugagggcaaggcccggcaugguugcugcgguaucccaaucacagacacaggccggaugggg

SEQ ID NO: 11038 - RNA, 61 nt, Human
ccccgacccgacaagggaccaugggcgcgaccuacgcucguggaacccuaggggcaagggg

SEQ ID NO: 11039 - RNA, 108 nt, Human
uguucuugcuaccaaggcucucaaccaccaugauugcgcuagcacagccucgcgauagucacgcuucacggcgcaucguggggaugacugagcacggaggcgaggaca

SEQ ID NO: 11040 - RNA, 81 nt, Human
ccuccuuguggaguaggaaaacauaagcuugaagaaggaagcuuuaaagaaagguggucguucucgcccgcaauuuagagg

SEQ ID NO: 11041 - RNA, 63 nt, Human
caugaaucacgacuguggacgacaaugugccugugguggucaauguuccauucccgauucaug

SEQ ID NO: 11042 - RNA, 121 nt, Human
gaggcuuaaccaacgauaacggcggcgacggcgaaaccucggagcucgcagggcgggggcaauggcccgggccuuggagauggagaauucucaguuguguaagcuguucaucggcggccuc

SEQ ID NO: 11043 - RNA, 67 nt, Human
gcucuuuguacgugauggccauauaauagugagaacuguggcugcagggccgaaccaugaucgaggc

SEQ ID NO: 11044 - RNA, 79 nt, Human
gugaccuacuccaaugugugaggauggcuggacugccugcaugugccugccucgccccaugccuguggacuggaaacac

SEQ ID NO: 11045 - RNA, 62 nt, Human
gugaugcugaagcuguggcuggugucccuguggaggauucggugcuggccccgguugcccac

SEQ ID NO: 11046 - RNA, 60 nt, Human
ggagccuggguccggauagguacucaaagcuggcagcgaagcuuccucuggcucggcucc

SEQ ID NO: 11047 - RNA, 68 nt, Human
gaagguuaacgcuggcuguccugaaauauuauaagguggaugacgaaugggcaaaauuagucgccuuc

SEQ ID NO: 11048 - RNA, 80 nt, Human
ucuuguguugagacuucgugguggugcuaagaaaaggaagaagaaaucuuacaccacucccaagaagaauaagcacaaga

SEQ ID NO: 11049 - RNA, 66 nt, Human
agggcgacuacgcgugcggcccgcacggcuacggcgccauccccgccgcgcccccgccgccgcccu

SEQ ID NO: 11050 - RNA, 77 nt, Human
uacacccagcucucuuuuucuaauguaaauguuguguacaauaguuuuauuugauuaagcuucaggacuguuuugua

SEQ ID NO: 11051 - RNA, 61 nt, Human
ccuggcugcacugaauucuccaggcugggugcagagugguuagcuguccgguugggccagg

SEQ ID NO: 11052 - RNA, 89 nt, Human
gcggccgcgggccaggcugucacucagguuccugucaaggucaggacauucagcagaaccugugucaggccgcugaggccccgcgcagc

SEQ ID NO: 11053 - RNA, 78 nt, Human
gcugccaaagggcugguucagggagcuaaccauggccacaaugaagucaucaggucccaugaucagcaccugggcagc

SEQ ID NO: 11054 - RNA, 66 nt, Human; identical to SEQ ID NO: 1526

SEQ ID NO: 11055 - RNA, 76 nt, Human
caccaugcgggccucagguggcagagaggcccagccucacaggccuguggccccacacaccagucccagcaaggug

SEQ ID NO: 11056 - RNA, 68 nt, Human
cugagucccucugggcagcagcucccuucuccaccccaccccagcacccgucccaaauguggccucag

SEQ ID NO: 11057 - RNA, 72 nt, Human
ccuggggucguuuggaaacuuugaaagcacugguagaacuggauguugauauagaagcuuugaacuuccggg

SEQ ID NO: 11058 - RNA, 64 nt, Human
ggcaaaauauggugugaaucugaaugaaaaaaccaccagaggguacacacucuuacauugugcu

SEQ ID NO: 11059 - RNA, 105 nt, Human
gugucacuugugcuuugcucuugucccacgugucuuccacuuugcauaugagccgugaacugugcauagugcugggauggaggggaguguugggcaugugaucac

SEQ ID NO: 11060 - RNA, 113 nt, Human
uguauuuauuuauuuauuuauuuuauuuguuuuucauucaucccauuaaucauuuccccauaacucaaugggaugaaugaaaaaaaaaaaaaaaaaaaaaaaaaaaaaauagg

SEQ ID NO: 11061 - RNA, 63 nt, Human
gcuaccugaauaaacuaccagugaaaagcgaauaucccucuauaaaacuggugguggaguggc

SEQ ID NO: 11062 - RNA, 61 nt, Human; identical to SEQ ID NO: 347

SEQ ID NO: 11063 - RNA, 80 nt, Human; identical to SEQ ID NO: 788

SEQ ID NO: 11064 - RNA, 77 nt, Human
aaguuguaaauuccuccuccucaaaaccccaaauuaaugacaaucaggggaaaaggcauauacaauauuugcaacuu

SEQ ID NO: 11065 - RNA, 70 nt, Human
auuuguuuacaugggaaagaauuauauacucuaaaaauauuggcuauaguuccucugauguauaauaaau

SEQ ID NO: 11066 - RNA, 91 nt, Human
ucugaccucaacuccaaaggagcuuuggcuucccugggccccagucggugacuucaggcaaaggcaaguuuugcuucugaguucccauaga

SEQ ID NO: 11067 - RNA, 106 nt, Human
aggaggcggagcucgggugguaacgccagcgacggggaguggcuauaaauacagaugaagcuucgcuggcuugccggccccuaaccugcugugcaccccacuuccu

SEQ ID NO: 11068 - RNA, 60 nt, Human
cugagcuuguuuuccugcaacuagacagccccaucugggggugacgggagacagugacag

SEQ ID NO: 11069 - RNA, 90 nt, Human
ggcaucagauucucauaaggagcgugcaaccuacaucccucgugugugcaguucacaauagggcucgugcugcuaugagaaucuaaugcc

SEQ ID NO: 11070 - RNA, 61 nt, Human
cugaguuuggcaucaauauggugaccuuccaggagcaagggacaaccagcggccaagccag

SEQ ID NO: 11071 - RNA, 77 nt, Human
gcaacagagucugucggcgggagcuccccauccccacacuguggcuagacagaguucuuucucagaugcucucuugc

SEQ ID NO: 11072 - RNA, 64 nt, Human
gaaggggugaccacccccuugggccuucugggggaacucucccuuggggguggcuugcccccac

SEQ ID NO: 11073 - RNA, 71 nt, Human
gaggucgaggugauugggggagcagacaaguaccacuccgugugucggcucugcuacuucaagaaggccuc

SEQ ID NO: 11074 - RNA, 67 nt, Human
ccuggcuggagugcccugccuggagggagcccuccuggcugggggcaagagcuccacaauggccagg

SEQ ID NO: 11075 - RNA, 90 nt, Human; identical to SEQ ID NO: 1534

SEQ ID NO: 11076 - RNA, 77 nt, Human
gcgggaggcgugcugggcgcggggcugcggugcccagaggcugcggcauuaggggcucggcgcccccgaccuuccgc

SEQ ID NO: 11077 - RNA, 68 nt, Human
cgccugccugagagaagucgucgcggccgaccccgucgccuccgccggcuaccauguccgcccaggcg

SEQ ID NO: 11078 - RNA, 66 nt, Human
augagucccccccucuugucuccccccccugaaauugggcaugggggugcggugguggggggccau

SEQ ID NO: 11079 - RNA, 97 nt, Human
cgcuguaagcuucugcuggggauaggaauucuggugcuccugaucaucgugauucugggggugcccuugauuaucuucaccaucaaggccaacagcg

SEQ ID NO: 11080 - RNA, 74 nt, Human
ggaguuuuuuuuugcgggggggggguugccuuuuuuucuggggggcccuuuguaccuuccaaaaaauuaaaccc

SEQ ID NO: 11081 - RNA, 71 nt, Human
gauggggcaacggcugagggugggggcaguguguaaggcaccuuuugcggucagcccagccacacuccauc

SEQ ID NO: 11082 - RNA, 67 nt, Human
uugucuccucuccaauccuugagcacccugauaugcaacaugggggguaaucagaaggaggaggcag

SEQ ID NO: 11083 - RNA, 81 nt, Human
cugccauugcccacuuacuacacccugcccaaugccaccguggcuccugaaacgcgggcaguaaucaaguggaugaagcgg

SEQ ID NO: 11084 - RNA, 63 nt, Human
gcuguguuucgcuggcucagcacugucuaugcuggcaguaaucuggccaugcaggacaccagc

SEQ ID NO: 11085 - RNA, 66 nt, Human; identical to SEQ ID NO: 3294

SEQ ID NO: 11086 - RNA, 97 nt, Human
ggcugucuagaagagucaguuguugcaccacuagugucuguuuuauuucuacauggguguuaugggcgaugcaaaccugauuuucuucgaaucggcc

SEQ ID NO: 11087 - RNA, 66 nt, Human
gucguuacaaaaaguuuuuuuuucuuuuaaauaaauucacacaaagaaagagaaauagaaagcgac

SEQ ID NO: 11088 - RNA, 60 nt, Human
uugagaugggcacguggaagucaaaggguuucucuuuuuuuuuuuuuuuuccccuuuuag

SEQ ID NO: 11089 - RNA, 61 nt, Human
accuugaugaugcuuggaagguuccgggaagcucuuggagaugcacaacagucagugaggu

SEQ ID NO: 11090 - RNA, 77 nt, Human
cauggaauaugagaaaauagcagaaacagauuuugagaagcgagauuuucggaagguuguuuucugcauggaccgug

SEQ ID NO: 11091 - RNA, 79 nt, Human
ucguuauccagaagcacagucuguggcuagugacauucuacgaauggauuccaccaaugcagaugcucuguauguacga

SEQ ID NO: 11092 - RNA, 60 nt, Human
aagcuuccuuuugacacagcugggaccauccuuauauaguuaguuuuaaaaaucuugcuu

SEQ ID NO: 11093 - RNA, 77 nt, Human
gggacccucaagagagcauggagaguguggggugugccuggauaggcccccuuugcaggcagucuuuugagagucuc

SEQ ID NO: 11094 - RNA, 94 nt, Human
cuuuuuguuucauuuaaugaaauuuugauguguugaacugcuuuccuggugucagagaaacaugagaccaucgcucaauaauggaaauaaaaag

SEQ ID NO: 11095 - RNA, 71 nt, Human
gguugggggggaaggaacccaguugggaaugaaggaaguuuccagaaaccaaccgggcccaccgucuaacc

SEQ ID NO: 11096 - RNA, 71 nt, Human; identical to SEQ ID NO: 1145

SEQ ID NO: 11097 - RNA, 88 nt, Human; identical to SEQ ID NO: 2733

SEQ ID NO: 11098 - RNA, 74 nt, Human
uccuccaaggaagugauaauaguggcaacauuuaaaagauaaaaugggaguuauuaggagaugauuggugagga

SEQ ID NO: 11099 - RNA, 68 nt, Human; identical to SEQ ID NO: 6891

SEQ ID NO: 11100 - RNA, 73 nt, Human
uuggggaacacgucaccacgguacaacaggcagcaagccauguauuuaccauggcgaggucacauuucaccaa

SEQ ID NO: 11101 - RNA, 107 nt, Human
uuacuguuccauuuugcaacauccugcaacaccauccugggagacaagagcauuaccgagcuuggcuuucacgggggaggguuguauucaguaaaaaagaauaguaa

SEQ ID NO: 11102 - RNA, 83 nt, Human
uuucaauuugacaauguccggcccuugaaauuucauacccggugggaaaauuuuaaauggccgggaccuugguugguuugaga

SEQ ID NO: 11103 - RNA, 64 nt, Human
gcauacauugacaaucuaggguauauaugcuauguauguuucuuauugcuaugucuauauaugu

SEQ ID NO: 11104 - RNA, 83 nt, Human
ccaacgucuguucauggcugugguuuuaaaagagucccucaacagaugcucuauuuaauaaccaguuuguaccucagaugugg

SEQ ID NO: 11105 - RNA, 70 nt, Human; identical to SEQ ID NO: 3612

SEQ ID NO: 11106 - RNA, 65 nt, Human; identical to SEQ ID NO: 3613

SEQ ID NO: 11107 - RNA, 61 nt, Human
gaaaccaaguaauugccaauauucacacaacugguuugugguagaaccaagacuugaauuc

SEQ ID NO: 11108 - RNA, 70 nt, Human
aacacauucccgguggauagaauugcuaaauugugugaaauagguuagaauucuucuuuaaauuaugguu

SEQ ID NO: 11109 - RNA, 93 nt, Human
cuggaccuuuuguccuauguguguggauuccagggcaacucuagcaucagagcaaaagccuuggguuucucgcauucaguggccuaucuccag

SEQ ID NO: 11110 - RNA, 90 nt, Human
gucugauuucugaauguaaaguuguuguguuuuuuuaaauaguaguuuguaguauuuuaaagaaagaacagaucgaguucuaauuaugau

SEQ ID NO: 11111 - RNA, 60 nt, Human
uuugcauagcuguuuaauguuaagucaugacaauuuauuuuucuuggcaugcuauguaaa

SEQ ID NO: 11112 - RNA, 77 nt, Human
aaagcuuuucuuaauguaacuuugaguacauuuuaaugccuucuauuuuuaaaacucaaaaucauuaguugggcuuu

SEQ ID NO: 11113 - RNA, 74 nt, Human
caccuuuuaaauauuuaauucuuauguggacuuauuuccagaaaacuuggugauaauucuugagacaaaaggug

SEQ ID NO: 11114 - RNA, 63 nt, Human
cugccuggauauauuucuacucuugaccaaaguuuguaaagaacaauauaagauuucggguag

SEQ ID NO: 11115 - RNA, 79 nt, Human
cugggguguuuauggcaagucacuuuugacagacauuauuguggcaaauguugucugacuuacuguuucaacaaaccag

SEQ ID NO: 11116 - RNA, 65 nt, Human; identical to SEQ ID NO: 247

SEQ ID NO: 11117 - RNA, 80 nt, Human; identical to SEQ ID NO: 100

SEQ ID NO: 11118 - RNA, 75 nt, Human
ggggagccauaaucugcaacuucauuuucccccauagaagagaaaaaagagcaccaccauuauuaccaccucccc

SEQ ID NO: 11119 - RNA, 68 nt, Human
uccucuuuauuuccuccguuccaaugagaggccuauggcugcucuccaaucccgggaagugaguggga

SEQ ID NO: 11120 - RNA, 118 nt, Human
cuggacagggcuggagagaagcaagggggcuggggagaguggccgguccagcggguagccgccgggggcacgcaucuccagcagcggcaccucaguguggcuugggggucgugucuag

SEQ ID NO: 11121 - RNA, 67 nt, Human
gacuggauggcuuggggaugcagaauuggaucuagaauaaagaaucuguuacuucgaguugcuaguu

SEQ ID NO: 11122 - RNA, 62 nt, Human
gggagucauugaacuucagcucuggaaaggauguuguuaccaaguucaguuugugaauugcc

SEQ ID NO: 11123 - RNA, 66 nt, Human
ggguaaugaguaggugagagggucuggaggaagccucccuacugcuggagccucuacuuauuaccc

SEQ ID NO: 11124 - RNA, 69 nt, Human
ggccguguaggcagaggcacgagacagauaucaguucgggaccgcaccacgccagcguacccaaaggcc

SEQ ID NO: 11125 - RNA, 74 nt, Human
ggggcggcugguggccugagcgggaggccaucaucaaccuggccacccagcccaagaggcccaugugcaucccc

SEQ ID NO: 11126 - RNA, 72 nt, Human
guggggcuggaagaaaagagcaucgacuugauuucuccaaccacucaucccucuuuuucuuucuucccccac

SEQ ID NO: 11127 - RNA, 78 nt, Human; identical to SEQ ID NO: 8274

SEQ ID NO: 11128 - RNA, 60 nt, Human
caguuuuaauucugaagacaaauaucuucauggaaaucuauuuguaagcuucugagauug

SEQ ID NO: 11129 - RNA, 63 nt, Human
ccuuauuugaauacuuagaaaaaaauggccaguggccgauugaaagguauauuaaaauuaagg

SEQ ID NO: 11130 - RNA, 60 nt, Human
gugcacuccagccugugugagcagagcgagacucuggccucacuacagaugagaaugcau

SEQ ID NO: 11131 - RNA, 65 nt, Human
gugguggcacaugccuguagcuccagccauuugggaggcugagguaugauaauugccugaaccau

SEQ ID NO: 11132 - RNA, 85 nt, Human
ggaggguguguuuaaggugcuuuuguccuuccaauugggcacucuucucucuccuuggacauacagcacucucagaucacuuuuu

SEQ ID NO: 11133 - RNA, 65 nt, Human
ccuuucuguuucccccccccagaggguaaaaggcccccuguucggggaacccucccgcuaaaagg

SEQ ID NO: 11134 - RNA, 81 nt, Human
gggcgugggcagcaaacaggucuuuccgugggcugugugaagaagacacaccuuuugacaacacuguuugggcccaacccc

SEQ ID NO: 11135 - RNA, 75 nt, Human
uucguugacgcuugcccccaaggguuccggguaccccaacacagaaggggugcccgucgccgggcacgcagggaa

SEQ ID NO: 11136 - RNA, 78 nt, Human
ggcaaguugguccuugcuggcugauccagcuuccccgucagcauauggugagcaguucggugagaggaccacacuucc

SEQ ID NO: 11137 - RNA, 61 nt, Human
uccucuaugaaguuaaaugacugguucaguguuaacacugcuagugagcgacagagaugga

SEQ ID NO: 11138 - RNA, 61 nt, Human
ugccggaaaggcuucccgugagacuggauaagaaaucaaaaaucuggugaaauugccggca

SEQ ID NO: 11139 - RNA, 112 nt, Human
gcuacugggcauaguccccuggaacuggugggucacuuggaagggaugcccuuugucauggacuugcccuucuggaaauuaccccgagagccagggaaggggcucagugagc

SEQ ID NO: 11140 - RNA, 63 nt, Human
ggaaguguggugcagcugagccacaaagcaaacuuuggugcgagccacagugcaucacuuucc

SEQ ID NO: 11141 - RNA, 62 nt, Human
ugggaagcuuucuaaacuccaacugagucccaccagcuuuaauuauuccucuagcucuccca

SEQ ID NO: 11142 - RNA, 73 nt, Human
caguuucuagagucuguugccaacauguuugcagcugcucagcagcucucgcagaacaucaguucagaaacug

SEQ ID NO: 11143 - RNA, 61 nt, Human
gaagugggucagauugcaguguguaguuuuggagaaucuguaaagcuguuacacccauuuc

SEQ ID NO: 11144 - RNA, 72 nt, Human
uuuucucacgugguuucuagcuucuucagacucagcccaaauuaggaagugcagaagccaugauggugaaaa

SEQ ID NO: 11145 - RNA, 84 nt, Human
acucaauaagaaucuuuuauaucaaguaaaaugaaaguugaugauagaauaucaaauagugaauuugauaugaaaucuaagagu

SEQ ID NO: 11146 - RNA, 72 nt, Human
uuuucaagucucugggaggccaguggcagcagcaggucuguguuucaccuucuucccaugugagcuuggaaa

SEQ ID NO: 11147 - RNA, 129 nt, Human
guuuaaaacuuugcugcuuuuuuuacauaaagccugugccuuuccuagaaaguuaagauguaaauguauucucacauguaaauuugaaaguucaggggucuauuaugaaaugauacacauguuuuaaau

SEQ ID NO: 11148 - RNA, 62 nt, Human
ugacauguugccaacaccuugagaagcauuauuuguuucuaauaaaaguaauggcuuuguca

SEQ ID NO: 11149 - RNA, 62 nt, Human; identical to SEQ ID NO: 5011

SEQ ID NO: 11150 - RNA, 77 nt, Human
gagcaaucaaagcguuaucugucaaagcaauuccgcuucuuauugauuuugccauaaccacgcuuguagauuaguuc

SEQ ID NO: 11151 - RNA, 67 nt, Human
agugacccagaauacaccaucaucaugaaaaaucuuuagguuucccaguggaguaaagaaagucacu

SEQ ID NO: 11152 - RNA, 65 nt, Human
ggcuuguggaccaguaacugucaauggcuaaaaccaccgaauaggagccaaugacuccacaaguc

SEQ ID NO: 11153 - RNA, 80 nt, Human; identical to SEQ ID NO: 9102

SEQ ID NO: 11154 - RNA, 78 nt, Human
auaccaauuccccuuuacaacugaugcagaucauuaugaaauacuggaaggcauacccuacacuuuaggaauuggugu

SEQ ID NO: 11155 - RNA, 62 nt, Human; identical to SEQ ID NO: 7075

SEQ ID NO: 11156 - RNA, 71 nt, Human
ccuuuauguacuaucucuagaaguaaaauaguaaaaacuauauaagauagauauauaugaguagaacaagg

SEQ ID NO: 11157 - RNA, 71 nt, Human
guucaauuguacaaaaccuaauuuguugucaaaaguaucaagcaauaaauuuuaacuauuguacagggaau

SEQ ID NO: 11158 - RNA, 84 nt, Human; identical to SEQ ID NO: 286

SEQ ID NO: 11159 - RNA, 70 nt, Human
cauuucuucuauucuagcaauauuugaagugcuggcacuagagauguugucuggugagcaagcagagaug

SEQ ID NO: 11160 - RNA, 74 nt, Human
ggcgucguuuuucuucuuccagggcucguuuuuuggcuuccauuucccguucccuggauucgagcagccgcguc

SEQ ID NO: 11161 - RNA, 74 nt, Human; identical to SEQ ID NO: 365

SEQ ID NO: 11162 - RNA, 77 nt, Human; identical to SEQ ID NO: 3082

SEQ ID NO: 11163 - RNA, 61 nt, Human
guggcugcuuggauuuaaauuaauucaaauuaaauaaauuuaaauuccauuccucagucac

SEQ ID NO: 11164 - RNA, 70 nt, Human; identical to SEQ ID NO: 6934

SEQ ID NO: 11165 - RNA, 60 nt, Human
guugccgcgcagguagaggcuuacuagaagugugaaaacguaggcuuggauuaaggcgac

SEQ ID NO: 11166 - RNA, 72 nt, Human
ucauuuguuuugagguuaguuugauuagucauugguggguggugauuaagucgguggugaugagauauuugg

SEQ ID NO: 11167 - RNA, 77 nt, Human; identical to SEQ ID NO: 9246

SEQ ID NO: 11168 - RNA, 84 nt, Human; identical to SEQ ID NO: 286

SEQ ID NO: 11169 - RNA, 89 nt, Human; identical to SEQ ID NO: 288

SEQ ID NO: 11170 - RNA, 94 nt, Human; identical to SEQ ID NO: 5398

SEQ ID NO: 11171 - RNA, 87 nt, Human
acaaauacauaaggcauagaaugguuuacuggcaaauagcagugugaauacucuauaggccuaacuucauuuuuacuuauuuuuugu

SEQ ID NO: 11172 - RNA, 90 nt, Human
auuuauguagcaugccacuaaaagaggcagaaaauuuuuccuuuaacuuaaauuugaauuugucuugauguuuguuugcuuuuuguaggu

SEQ ID NO: 11173 - RNA, 71 nt, Human
ucaggaauccuugguaguuuaacucuggaaguuuuagugggacuuugggaaacaaauacuauuuguucugg

SEQ ID NO: 11174 - RNA, 65 nt, Human
aggugaggagguggagagacagcccacccccguguccaccgugaccccuguccccacacugaccu

SEQ ID NO: 11175 - RNA, 81 nt, Human
ucgugcgcaucguugcuggccuggcuguccuggcuguccuagcuguccuaggagcuaugguggcuguugugauguguagga

SEQ ID NO: 11176 - RNA, 86 nt, Human
ugccugugugggacugagaugcaggauuucuucacaccucuccuuugugacuucaagagccucuggcgucucuuucugcaaaggca

SEQ ID NO: 11177 - RNA, 79 nt, Human; identical to SEQ ID NO: 5860

SEQ ID NO: 11178 - RNA, 72 nt, Human; identical to SEQ ID NO: 5861

SEQ ID NO: 11179 - RNA, 61 nt, Human
gaugccgacugggagcuacugggugagcuggacuaccagccuucaggaccaggacagcguc

SEQ ID NO: 11180 - RNA, 61 nt, Human
gccugccuucuucccugcucuguccccuaagcucccuccaggcagggaaaagaggccaggu

SEQ ID NO: 11181 - RNA, 60 nt, Human
acugcgggucacguugagagccaacaccaugggcucgguuccggcugaaaacccgccagu

SEQ ID NO: 11182 - RNA, 85 nt, Human; identical to SEQ ID NO: 10214

SEQ ID NO: 11183 - RNA, 73 nt, Human
cgucuuggcucucuccgcuucguccuuaccagacuucgcacuuugugaggcgguucaauggugaagccaagug

SEQ ID NO: 11184 - RNA, 72 nt, Human
ugaggaagcagggccccggguggccaagcgggcugagcaaugcccuggaggcugaauggggucucguccuca

SEQ ID NO: 11185 - RNA, 76 nt, Human
cccgcuacgacauggaccgcuuuggcguggucuuccgcgccagcccgcgccaguccgacgucaugaucguggccgg

SEQ ID NO: 11186 - RNA, 70 nt, Human
ggccaagcuggaugaccucgucaacugggcccgccggaguucucuguggcccaugaccuucggccuggcc

SEQ ID NO: 11187 - RNA, 85 nt, Human
gagaugagggggcacauuuaaaucuguguauguccagaguccgugaggauugggaaucagucuaaagcugugcucgcuucuccuc

SEQ ID NO: 11188 - RNA, 89 nt, Human
ucuuaguaaccuaauguaguuacuuacuucuuuuauccuacuacauauauaauagaaccauuauaguaacgucaaugugguuauuaaga

SEQ ID NO: 11189 - RNA, 63 nt, Human
gggggggggaaaauuuuuuuuuuuucucucuccgccaaaaaaaaauuuuuuuuuccccccccc

SEQ ID NO: 11190 - RNA, 63 nt, Human
cgaacacagggaaaguuccagauuauggucucuuggugacccuggccauggcccugaugggug

SEQ ID NO: 11191 - RNA, 64 nt, Human
ucauuguggggcucauuuugagauuaccauucuggggacaaccuucagaugagaacugcuuuga

SEQ ID NO: 11192 - RNA, 85 nt, Human
ccaggugcgguggcacacgccuguagucccagcuacucaggaggcagaggcuacagcgaaccaacaucacugcacuccagccugg

SEQ ID NO: 11193 - RNA, 66 nt, Human
gaccaccuuucucaguugugccucuagauccagggauuuuaaggaaaauuaggagaaauaaugauc

SEQ ID NO: 11194 - RNA, 60 nt, Human
ggccgaggcagggugaucacuugaaggcaggaguucgagaccauccuggccaacauaguc

SEQ ID NO: 11195 - RNA, 69 nt, Human
gguguguauaaagauggggggagcuucgcugaacguuaagguguaguaaaggcaccuccuuguauuccc

SEQ ID NO: 11196 - RNA, 69 nt, Human
aacgggagugggcacagaaagccuucuccuggcaacaggacaagggcugcccgcguguccagcccuguu

SEQ ID NO: 11197 - RNA, 77 nt, Human
cucuccuggcgcugauagguggguccaagcagaguugaucagucccugccugcccugccuaggucuagccaggggag

SEQ ID NO: 11198 - RNA, 95 nt, Human
guagaguacauaaucagugccacacagaggcagggcgugucugagagacuaaugccuguccugccucuggccuguguccuggguguguaccauac

SEQ ID NO: 11199 - RNA, 66 nt, Human
auaaacguguucuuuugagaagugucuguucauauccuucgcccacuuuuugaugggguuguuugu

SEQ ID NO: 11200 - RNA, 89 nt, Human
ggcugggucaaaugguauuucuggcucuagauccuugaggaauugccacacugucuuccacaaggguugaacuaauuuacccucccgcc

SEQ ID NO: 11201 - RNA, 78 nt, Human; identical to SEQ ID NO: 99

SEQ ID NO: 11202 - RNA, 65 nt, Human; identical to SEQ ID NO: 247

SEQ ID NO: 11203 - RNA, 80 nt, Human; identical to SEQ ID NO: 100

SEQ ID NO: 11204 - RNA, 129 nt, Human
cacaggugacgacaguagcagggucucagcugggagggucccgucugguucuggaccuccauccucucuuuuagccuccagaggcggcuccucuccacuuggauuauccgggcagagcucguccuugug

SEQ ID NO: 11205 - RNA, 90 nt, Human
gaggguccccucgggcucuggaucuccauccucuccuuuaaccuccacagguggcgggggugguggggccucagcugggaggguccccuc

SEQ ID NO: 11206 - RNA, 66 nt, Human
gccuuguaucucuguccccgggaggcuccuccuugccuucggcacuggcgggcagagagacaaggu

SEQ ID NO: 11207 - RNA, 83 nt, Human
auccagcaagaugcaagccuucagaaucugggauguuaaccagaagaccuucuaucugaggaacaaccaacuaguugcuggau

SEQ ID NO: 11208 - RNA, 64 nt, Human
gaauggaaaucugcagaggccuccggagucaccuaaucacucuccuccucuuccuguuccauuc

SEQ ID NO: 11209 - RNA, 110 nt, Human
gucugcagcagcauggccugccugcacaaacccuaggugcaauguccuaauaccuuguuagggucuuuguauucaaguuugaagcugggagggccuggcuacugaagggc

SEQ ID NO: 11210 - RNA, 84 nt, Human; identical to SEQ ID NO: 286

SEQ ID NO: 11211 - RNA, 89 nt, Human; identical to SEQ ID NO: 288

SEQ ID NO: 11212 - RNA, 94 nt, Human; identical to SEQ ID NO: 5398

SEQ ID NO: 11213 - RNA, 84 nt, Human; identical to SEQ ID NO: 286

SEQ ID NO: 11214 - RNA, 89 nt, Human; identical to SEQ ID NO: 288

SEQ ID NO: 11215 - RNA, 94 nt, Human; identical to SEQ ID NO: 5398

SEQ ID NO: 11216 - RNA, 89 nt, Human; identical to SEQ ID NO: 288

SEQ ID NO: 11217 - RNA, 113 nt, Human
gaaggaggcacuauggccuugucugggaucucagauuuuggcaacaucucagccacagcgggugaaaacuacagugucgucuccugggucccaaggagggccagugcaacuuc

SEQ ID NO: 11218 - RNA, 79 nt, Human
guguuauuuuuauuuucuuugcuuuggucuauacaaaaaaaccaauaaccaaaaacauaaagcgauaauaauaaaacac

SEQ ID NO: 11219 - RNA, 62 nt, Human
ucugcuuggaccucccccagccccccacaccaugugcgggaaaugggggggucugaaacagg

SEQ ID NO: 11220 - RNA, 62 nt, Human; identical to SEQ ID NO: 793

SEQ ID NO: 11221 - RNA, 80 nt, Human; identical to SEQ ID NO: 794

SEQ ID NO: 11222 - RNA, 66 nt, Human
ugcugcuaugaaaucagauagcaacaacgacaacauuauuagguuuugaacuaugauuuaguagca

SEQ ID NO: 11223 - RNA, 66 nt, Human
uuaagacaaagcaauuuuaauacuaggugcacaccacaugcccuugcugcaaacugcuuuucuuga

SEQ ID NO: 11224 - RNA, 74 nt, Human
uuacugaauggugcugguaaauacuacacaaauuuuuuuugucacguugcaaccuuuuguuuccaauuuaguga

SEQ ID NO: 11225 - RNA, 100 nt, Human
cuacggccugagccacggccuuaaccucccgccaagugguggcuggaugugguccugcagaccuuccaccuggcggguguccaggaugcucaggcuguag

SEQ ID NO: 11226 - RNA, 80 nt, Human
gagguggucuuauccagcucagcuuccccugggacccaccgugggaccugaggcagaacugggguggacuuggccuccuc

SEQ ID NO: 11227 - RNA, 65 nt, Human; identical to SEQ ID NO: 1518

SEQ ID NO: 11228 - RNA, 87 nt, Human; identical to SEQ ID NO: 76

SEQ ID NO: 11229 - RNA, 85 nt, Human; identical to SEQ ID NO: 4613

SEQ ID NO: 11230 - RNA, 60 nt, Human
aagcugguacgccugcagguaccgguccggaauucccgggucgacccacgcguccgguuu

SEQ ID NO: 11231 - RNA, 66 nt, Human
gugucuggaaaaauucaccgugagccugaaccacaagcuggacagccaugcggagcuucuagaugc

SEQ ID NO: 11232 - RNA, 102 nt, Human; identical to SEQ ID NO: 3961

SEQ ID NO: 11233 - RNA, 68 nt, Human
aggagcaaccucuggagccaucgcgauugauuccucccaucccaagauggcuucuggguuccacuccu

SEQ ID NO: 11234 - RNA, 65 nt, Human
cccaaacaccacggauaacaccccucccccuuuuuuggaggcugacugauaccuggacuucuggg

SEQ ID NO: 11235 - RNA, 90 nt, Human
cucuguuguucaccuuuugcuuuuugcacuguuuguucucuuaucuggauuuugagcuuagugcuaggacugagaggcugcaccauaggg

SEQ ID NO: 11236 - RNA, 78 nt, Human; identical to SEQ ID NO: 99

SEQ ID NO: 11237 - RNA, 65 nt, Human; identical to SEQ ID NO: 247

SEQ ID NO: 11238 - RNA, 80 nt, Human; identical to SEQ ID NO: 100

SEQ ID NO: 11239 - RNA, 70 nt, Human
gaaauuuuauuacugugauuaagaacauucuguaaaacuugagauacaccauucauuguaggaaaauuuc

SEQ ID NO: 11240 - RNA, 61 nt, Human
ugcugccaccauuuuucucagacuucggaggaguauuuugcugcugagacucaggcaugca

SEQ ID NO: 11241 - RNA, 62 nt, Human
agaucagacuguuacugugucuauguagaaaaaggaagacauaagaaacuccauuuugaucu

SEQ ID NO: 11242 - RNA, 87 nt, Human
agagaaucauacauuuguuauauugucacaucugccuugagucuuucaacuauaagugacagcuauuuccuaaucaauguguucuuu

SEQ ID NO: 11243 - RNA, 82 nt, Human
uucugguagcaggaugggauggagaaagagacuguguuccaaguauugauauguuuguuuucucaucccaaaauuaucagag

SEQ ID NO: 11244 - RNA, 61 nt, Human
gcgcuccugcuggugaggccccagacauaccugacaaagugucugagcgaagcacgagugu

SEQ ID NO: 11245 - RNA, 74 nt, Human
ggggaacgacggaaccacaucuaggccacaaaggagaacagaggagacagauggaggacccagaacgauacacc

SEQ ID NO: 11246 - RNA, 86 nt, Human
auggcaggaugacggauggcaacgaagcagcuggagaaggacuucagccugcaucgaagaaguacugccaaggucauccgugucau

SEQ ID NO: 11247 - RNA, 87 nt, Human
gccgcacagccagaugcgccugacugccgcgugcgccagaagaagggcgcacugauggagauccaggugaacggaggcacugcuggc

SEQ ID NO: 11248 - RNA, 61 nt, Human
cccagcaggcaugacggccgcacgcgcaccggcgcgcuggugcguggccgucaccugcggg

SEQ ID NO: 11249 - RNA, 68 nt, Human
cugagcccccgcuccuccucugcggugagaugccagagccguggcggagcgaggaggagugggcucag

SEQ ID NO: 11250 - RNA, 90 nt, Human
cuggaggucuccacucuggucagcaaguauccagacaaucagggaugaccacaucgggugcgcugcuggcuguugcguggggacccccag

SEQ ID NO: 11251 - RNA, 78 nt, Human
gacaccgccgggacaaagcugauugucucucccugcagccacacaguggcucccuaucacgcugccaccggaccuguc

SEQ ID NO: 11252 - RNA, 64 nt, Human
ggcuccugcacgacagcgcacuuuccuuccggacgcccggcaggcagcgccccggcagggugcc

SEQ ID NO: 11253 - RNA, 99 nt, Human
gaacuugauuuucauuaauccagagcugcagcaccagagauaauuucaaucaacucuuuugugaugacagcuuggcggguacgguugaaugucaauguc

SEQ ID NO: 11254 - RNA, 80 nt, Human
uucuugguaauuuugcagcacgucagcaucaauaucgucauagauacucaugcugucagcacuugcaacgguauuaaggg

SEQ ID NO: 11255 - RNA, 77 nt, Human
gcauugggcaagaagauggaugcagggaggaccaugaagcugcuaguuuucccggacaucgacugaggcccaguugc

SEQ ID NO: 11256 - RNA, 67 nt, Human
gguggaugguauuugacacguguauccacgggucauaaccugaagugcuguaucaauuuaccccacc

SEQ ID NO: 11257 - RNA, 76 nt, Human
agccuuuuaacagcagaaaauuauccgguagcaaauugucuuagggaaauuacuacacuguuguaacaaaagggcu

SEQ ID NO: 11258 - RNA, 77 nt, Human
auguugaacuuucuuccuugaaucagcguuagagucaaauguggguuuaaugugaaugcuaaaugaauaugcgacau

SEQ ID NO: 11259 - RNA, 100 nt, Human
gcaagugacuaaguguucauuaccuuuugguuagcguugcuaucacuguagcugugcugccuuaacaucgagaguugaguuguggacuuagucauugagu

SEQ ID NO: 11260 - RNA, 66 nt, Human
gugugcaguguaaauaguguaauugugcauauauauguguauagcagcauggacuuacuuucacac

SEQ ID NO: 11261 - RNA, 71 nt, Human
gccgccacuuggcucauuacagcaguacuaguaugggggugggaggggugaggcuguggagugaaggcggc

SEQ ID NO: 11262 - RNA, 65 nt, Human
gucugucuagccccaaagagccugguuuucucaguaucaguguagcuccuggggacuucauaggc

SEQ ID NO: 11263 - RNA, 105 nt, Human
uuaugguccccacaaccacggccgucuuguuuucccggccaggaagcuucaucuuccggaucauccgggaaagggacagaggcggccgguuggugcgacucauaa

SEQ ID NO: 11264 - RNA, 72 nt, Human
gcuuucaccagcuuuacccaaacgccuuuugucuuccgaagucaccugugugaaggggacaguggugcaagu

SEQ ID NO: 11265 - RNA, 63 nt, Human; identical to SEQ ID NO: 1366

SEQ ID NO: 11266 - RNA, 86 nt, Human; identical to SEQ ID NO: 1381

SEQ ID NO: 11267 - RNA, 63 nt, Human
aagacuccaugcccaagugccuguaauccccccccucaaggcccuguuuauguugggagucuu

SEQ ID NO: 11268 - RNA, 61 nt, Human
ggagaggggugacccugaguggagcucugagacagaugcucucguugggucacgccuuucc

SEQ ID NO: 11269 - RNA, 72 nt, Human; identical to SEQ ID NO: 3662

SEQ ID NO: 11270 - RNA, 74 nt, Human; identical to SEQ ID NO: 365

SEQ ID NO: 11271 - RNA, 102 nt, Human; identical to SEQ ID NO: 2172

SEQ ID NO: 11272 - RNA, 77 nt, Human; identical to SEQ ID NO: 3082

SEQ ID NO: 11273 - RNA, 81 nt, Human
ggaaugcuccuggcaacuaugggaauacggggugccugaaaggccauccuugaaacaccuuaacccuguugccgccauucc

SEQ ID NO: 11274 - RNA, 63 nt, Human
ccccacaaggaagagguacuguugcagccgcugcagcugcugccacagacaguauugccgggg

SEQ ID NO: 11275 - RNA, 83 nt, Human; identical to SEQ ID NO: 3404

SEQ ID NO: 11276 - RNA, 71 nt, Human
guaccacacuggacguggggguccucccccagcuaugggccgaggagcacccccuccaggcaugauggugc

SEQ ID NO: 11277 - RNA, 73 nt, Human
cugaaucuccccucacccucgcagggacccucugaggaggguauucccccauuuugcaggggagggaauucag

SEQ ID NO: 11278 - RNA, 83 nt, Human
cgcagcgucuccacaaugggguggucaggguugaucuccaggugcuuuuuggccaucauauagcccaugguggaguugucccg

SEQ ID NO: 11279 - RNA, 76 nt, Human
agggucauggcuaagucauuugauucaguagaaaagagauuauaaauacaugaagggcuacuuaacucaugucccu

SEQ ID NO: 11280 - RNA, 86 nt, Human
acguuccccuguugccaccuguuuuuguccacggggagcuugcuguaaaagaaaaaggaccccucggaauccaacacgggaggcgu

SEQ ID NO: 11281 - RNA, 89 nt, Human
cccacuccacggggaugucguugggauaaaagccuuugaccaggcagguaaggcugaccugguuuuuggucaacucaucccgggauggg

SEQ ID NO: 11282 - RNA, 108 nt, Human
ggcaggguguacaccugugguucucggggcugcccuuuggcuuuggagauguuuucucgaugggggcuggaagggcuuuguuggaaaccugcacuuguacuucuugcc

SEQ ID NO: 11283 - RNA, 67 nt, Human
cugaagcuggggcugcagccugggccuugguuugauccuuggccuuggccuuggccuuggccuuugg

SEQ ID NO: 11284 - RNA, 79 nt, Human; identical to SEQ ID NO: 6025

SEQ ID NO: 11285 - RNA, 63 nt, Human
ucccaagcuuggggugggcaauguaggcaagucgaucgagcuugcggcugacacccuuuggga

SEQ ID NO: 11286 - RNA, 75 nt, Human; identical to SEQ ID NO: 74

SEQ ID NO: 11287 - RNA, 87 nt, Human; identical to SEQ ID NO: 76

SEQ ID NO: 11288 - RNA, 71 nt, Human; identical to SEQ ID NO: 77

SEQ ID NO: 11289 - RNA, 66 nt, Human
cugugugagagguauuuuaagaagagaguguguugacgcaccuuuucuaucauacacaauauauag

SEQ ID NO: 11290 - RNA, 72 nt, Human
cagucuccaacuccuggccucaagggauccucacaucuuagccuccagaauagcuaggaguaggaguagcug

SEQ ID NO: 11291 - RNA, 65 nt, Human
ugauucucuuuauaucugauuuuuuuuuuuaaacagcuaaaauguaaguauguaucucagaguca

SEQ ID NO: 11292 - RNA, 70 nt, Human
uguucuggaacuuucccauuaaccuucugcauuuagaaggaauuauagauguugagugcuccaguaaaca

SEQ ID NO: 11293 - RNA, 107 nt, Human
cucccugggucugcguucccucccucugggccugacugagccugcucauuguuuucccuuuauuacacaggacagccaggggaggagggggggccaagcccugggag

SEQ ID NO: 11294 - RNA, 71 nt, Human
gaauguuuucuaccagugugcuuggguuugccaugcaugcgaggcugaguugcuguaggcgucuugcauuc

SEQ ID NO: 11295 - RNA, 103 nt, Human
ggugggcgugagaggauagguggcagggcagaaacugggcagcccugacuugauagcagcagggggagcucccaagcugccaagccccugccuccagccuucc

SEQ ID NO: 11296 - RNA, 65 nt, Human
cauguggggacucaacacugacccagaucacagcugggcuggacccaguggggagaauccagaug

SEQ ID NO: 11297 - RNA, 69 nt, Human
gggaccugguuagucuuggggcagagaguaucuacuugggcacucucuuccaagaaagaccuugucucc

SEQ ID NO: 11298 - RNA, 86 nt, Human
gcuggcgugccugggcagcacccucggggguagcagcuacuccagcugcuacagcuuuggcucuggugguggcuauggcacgcagc

SEQ ID NO: 11299 - RNA, 70 nt, Human
aacugaacaagaggaguauguauucccgugugccagagugccaggucaccacauacuauuauguuggguu

SEQ ID NO: 11300 - RNA, 80 nt, Human
caagcggaggugacccugagaguguggcuggggaguaugggcggcacucccucuacaaaaugcuugguuacuucagccug

SEQ ID NO: 11301 - RNA, 63 nt, Human
cgggucuucgccaacauccuccucuacauccagaggaccaagagcauguuccagaggaccacg

SEQ ID NO: 11302 - RNA, 60 nt, Human
gaggaggcgauagacuuucuucguugcaaucccaaaaucuggaauguucauaguguccuc

SEQ ID NO: 11303 - RNA, 78 nt, Human; identical to SEQ ID NO: 99

SEQ ID NO: 11304 - RNA, 80 nt, Human; identical to SEQ ID NO: 100

SEQ ID NO: 11305 - RNA, 64 nt, Human; identical to SEQ ID NO: 287

SEQ ID NO: 11306 - RNA, 131 nt, Human; identical to SEQ ID NO: 6294

SEQ ID NO: 11307 - RNA, 73 nt, Human
gcaucaauagcaacagaaaugggccccaccagugcaacugccuucaucaaggccuucuucugcuuaaggaugu

SEQ ID NO: 11308 - RNA, 69 nt, Human
cgggugguaaaguggcaacggcgaauuuggguaucuggucucccaaaaguacuugccgcucuaccccug

SEQ ID NO: 11309 - RNA, 84 nt, Human
gcucauucaguucaaugcuguggaaaccgagccuguaggugacagcaucagcuacuggccugguaucagcagcugagccugagc

SEQ ID NO: 11310 - RNA, 87 nt, Human
ucugcaauggcugccaggcggaucacuccuccacuggagccaucccgcuccauggccaaagcgagagcauuggcagugaauugcaga

SEQ ID NO: 11311 - RNA, 85 nt, Human; identical to SEQ ID NO: 5538

SEQ ID NO: 11312 - RNA, 71 nt, Human; identical to SEQ ID NO: 1145

SEQ ID NO: 11313 - RNA, 67 nt, Human; identical to SEQ ID NO: 1146

SEQ ID NO: 11314 - RNA, 79 nt, Human
cucgcuauauggggaacgggugucucaaaggcuguugagcacaucaauaaacacuauugcgccugcccugguuagcaag

SEQ ID NO: 11315 - RNA, 75 nt, Human
ggucucuccccucacagugucucuuuaacaauuuucuuggcacagauaaucgcaucugugaggucaucagugacc

SEQ ID NO: 11316 - RNA, 70 nt, Human
uggcuaaguugguugcuuuuuggugauuagucaaagagaccaaaucccauauccucguccgacuccuccg

SEQ ID NO: 11317 - RNA, 67 nt, Human
gaccuuuguuccuuaaagcaauaacugacaauucuuuguaguucucuguggggaguaacaagggcuc

SEQ ID NO: 11318 - RNA, 118 nt, Human
auguaacauuuuccugggccuugacuacagggggcuuugugacauaacugaaugcccauaaccaugguaauguuacucuucuccugccuggucucugcucacagggaaauugugacau

SEQ ID NO: 11319 - RNA, 90 nt, Human
gacucuccucuuuuucucaggccccacauauuuggguauugugacauacccaaaugugacacugggcucaacaccuaagggacgggaguu

SEQ ID NO: 11320 - RNA, 70 nt, Human
uuggacaccacaaauuguggguauugucaaauauugcuggauccuguacccauguuaugugacucuccaa

SEQ ID NO: 11321 - RNA, 65 nt, Human; identical to SEQ ID NO: 9128

SEQ ID NO: 11322 - RNA, 74 nt, Human
auaagaaaaucaaagacaaugacauccucagcucccucucaccccaaguaugccauugucuuuguaauucuuau

SEQ ID NO: 11323 - RNA, 75 nt, Human; identical to SEQ ID NO: 9129

SEQ ID NO: 11324 - RNA, 106 nt, Human
aaauggaaggauucagcuuucaguuaaaaaagaagaaaaagaaauggcaaagagaaaguuuuuucaaauuucuuucuuuuuuaauuuagauugaguucauuuauuu

SEQ ID NO: 11325 - RNA, 80 nt, Human; identical to SEQ ID NO: 367

SEQ ID NO: 11326 - RNA, 124 nt, Human
ggcugcuagaggggauuaguuccggagacugagacuguuggcuccaccuccaagcugagcuaggguggagggcagggugggcaggaagugacaggaaguuaagcuguuccucucccuggcugcu

SEQ ID NO: 11327 - RNA, 68 nt, Human
ucugcucagccuuaacuucucaacuuugccuuagcacaggguuucuguagggagugggggcugcuaga

SEQ ID NO: 11328 - RNA, 73 nt, Human
acuguguuaguaacucuuuaugaauauugucuaaaaacuaaauaagauauucauguaaagugauuaucacagu

SEQ ID NO: 11329 - RNA, 80 nt, Human
accacggccgucuuguuuucccggccaggaagcuucaucuuccggaucauccgggaaagggacagaggcggccgguuggu

SEQ ID NO: 11330 - RNA, 63 nt, Human
aggguuaguuuuuguagccucggcuggcccgucggccucuggcacgcucgaacuuccggcccu

SEQ ID NO: 11331 - RNA, 60 nt, Human
cagcaagaaucuucaguaccagaggugccugauguugcacauuugccacuugagaagcug

SEQ ID NO: 11332 - RNA, 94 nt, Human
uaccagggaauucauccggugacuuagggugaaguugguguaccuguguugguuaacagauuaauccuaaugguacuggauuaaaguuccggua

SEQ ID NO: 11333 - RNA, 64 nt, Human
gcugggcucagaaggcucuuagucgugcuugagagugagccuuucgaagagauacucgcccagc

SEQ ID NO: 11334 - RNA, 63 nt, Human
ccauccugggcagagcuguaugaggcccaaguaccgggcaccccagggucugcucaggugugg

SEQ ID NO: 11335 - RNA, 97 nt, Human
cgagugugccucggcaggagggcuugacuuucuucggcacagagcuagccccagugcggucaacaggagucgggccucucugcuaagaacauacuug

SEQ ID NO: 11336 - RNA, 78 nt, Human; identical to SEQ ID NO: 376

SEQ ID NO: 11337 - RNA, 85 nt, Human
agagacguuuggcugucugguguugggcgaaacauuuuuuaagcaaaauuuuuaccggcuucagcagaggcgcaagcgcgacucu

SEQ ID NO: 11338 - RNA, 87 nt, Human
ucacacguaaauggguucaaauucuggagaucacgguuacaacaagcgugguccguacagaguaacuugauaaccuguguacugugg

SEQ ID NO: 11339 - RNA, 77 nt, Human
gagucuccucuguuguaacucgugcuacuaguaaauuguuugcuguaacuugaagauuuaccacgggaagggaauuc

SEQ ID NO: 11340 - RNA, 74 nt, Human
gcagugucgaagauagcaacuucaucagggugucuauagcggaacccauccagaguaccuauggaagacaaugu

SEQ ID NO: 11341 - RNA, 60 nt, Human; identical to SEQ ID NO: 1551

SEQ ID NO: 11342 - RNA, 70 nt, Human
ggaauggaagcggagaacgcgggcagcuauucccuucagcaagcucaagcuuuuuauacguuuccauuuc

SEQ ID NO: 11343 - RNA, 81 nt, Human
aacccagcagcucuccauguccacagcugauuuccagaggauggaagaagucaggaaacuugggacaccgcugcugagguu

SEQ ID NO: 11344 - RNA, 67 nt, Human
gcuagcauaaguuugagggugaugcacaggggcucacaccuguaaucccaaccuuugagauagcagc

SEQ ID NO: 11345 - RNA, 100 nt, Human
aaacuuuucacuuuagagguagcuugccaucucucaggagcccucaccauuguguccauucacuguguauagauggcagaacuuuugaggugcaauguuu

SEQ ID NO: 11346 - RNA, 119 nt, Human
uaagaauacgcuuuuccuaacaggcuacuccuuccuguagagcagaaauuguauuuugcacgaacaugcaguuauugaagauuaggaucaaggauagacaagguauaguaguuaucuua

SEQ ID NO: 11347 - RNA, 94 nt, Human
augggaacagcaagauggcaaaagcuugcugagugguacagcgccagccuggguaguggccuccccagcaaguugcaugucacuagcuuccugu

SEQ ID NO: 11348 - RNA, 72 nt, Human
gggugccccucgaggacugcucugagaucaacugcaugauccgggugaagaagcaggucugggugggcagcc

SEQ ID NO: 11349 - RNA, 73 nt, Human
gguagggaaauugguauacauaaaagugaucagacgaaggucauaggucacaagucugauauaagucccuguc

SEQ ID NO: 11350 - RNA, 63 nt, Human
ucuugggcagugcugguaguaggguguaugaauuaucuauugccaaaacaacacugcccgaga

SEQ ID NO: 11351 - RNA, 63 nt, Human; identical to SEQ ID NO: 8208

SEQ ID NO: 11352 - RNA, 81 nt, Human
ucaggcaagcaacuauaccaauaugcugagggccuugaaaauaaucauccucauuuuaaagggaaauaguggaaagccuga

SEQ ID NO: 11353 - RNA, 66 nt, Human
cuguacggccccaccaacuuugcccccguggucacccacguggccaggaaugcagcggccgugcag

SEQ ID NO: 11354 - RNA, 90 nt, Human
gucaacgcugccaagcuccccauguccaucauuaucgucggcgugggccaggcagaguucgacgccaugguggagcuggauggcgacgac

SEQ ID NO: 11355 - RNA, 78 nt, Human
ugcggaucuccucccgggggaagcuggcugaacgcgacaucguccaguuuguacccuuccgggacuacguggaccgca

SEQ ID NO: 11356 - RNA, 72 nt, Human
gccugcucuagagcgcuuccugcggagacuucaggugcugaaguccacaggggauguggccggagggcgggc

SEQ ID NO: 11357 - RNA, 85 nt, Human
gcgugggucucuaccucugucuccacccgcaagugcuggagaucuuuggcuuugagggggcugaugcggaggacgugaucuacgu

SEQ ID NO: 11358 - RNA, 62 nt, Human
gguuugugauccugagagucuugcuggaggcuggcgagggacucguuaccaucacucccacc

SEQ ID NO: 11359 - RNA, 83 nt, Human
uucagagcugguaucggagcggggagaccugggauagcaaguucagcaccaucgccuccagcuacgaagagugccgggcugag

SEQ ID NO: 11360 - RNA, 64 nt, Human
cgaaguagugaucagguauugcuguuagauauccccgaguccuucaaugcuaucauucccuuug

SEQ ID NO: 11361 - RNA, 123 nt, Human
uuggaucauaugcauaguaccgagaaacuagugcgaaguagugaucagguauugcuguuagauauccccgaguccuucaaugcuaucauucccuuugauauuggaccauaugcauaguaccga

SEQ ID NO: 11362 - RNA, 68 nt, Human
uuccacuggccggcggucaccguggggacugggcccuugcgguacccaacuuaaucggccuuguggaa

SEQ ID NO: 11363 - RNA, 70 nt, Human
uuggccaauuccaauuuagacuucgagcaagcuuaugcaugcggucggaauuccagcuuaauuuggccaa

SEQ ID NO: 11364 - RNA, 74 nt, Human
ggauggaccucuuuauaaaguugguugcugcaaaauccaguucuuccaaaagccacuuuauuuaggguuuauuc

SEQ ID NO: 11365 - RNA, 72 nt, Human
gagaaugauagcauugaaggacucggggauaucuaacagcaauaccugaucacuacuucacacuacuuucuc

SEQ ID NO: 11366 - RNA, 71 nt, Human
ggaaaugauagcauugaaggacucggggauaucuaacagcaauaccugaucgcuacuucacacuaguuucu

SEQ ID NO: 11367 - RNA, 72 nt, Human
gggaaugauagcauugaaggacucggggauaucuaacagcaauaccugaucacuacuucacacuaguuucuc

SEQ ID NO: 11368 - RNA, 108 nt, Human
gauuuaaguguauaacaauuaagugaaauccggagaaauugcacuggaaaccgagccagcagugcagucacuuuggggaaaugcacauaacugauuauggucuaaguc

SEQ ID NO: 11369 - RNA, 67 nt, Human
guuaauauuucuuacugguucugcaggggucugugugccuggaguaggucaguaaagaaagguuagc

SEQ ID NO: 11370 - RNA, 73 nt, Human
guucacacauuuuuuuuuuugcuuuuguacuuuggauuauuuucaacaucagcagaaauuaaaacuaaugaac

SEQ ID NO: 11371 - RNA, 70 nt, Human
uuuugucaaaauguaaauucuaccuucugcaaauagauaauucaacauguaaauuuauguauaaacaaga

SEQ ID NO: 11372 - RNA, 106 nt, Human
cauaugguccaauaucaaagggaaugauagcauugaaggacucggggauaucuaacagcaauaccugaucacuacuucgcacuaguuucucgguacuacgcauaug

SEQ ID NO: 11373 - RNA, 75 nt, Human
cuucgcacuaguuucucgguacuaugcauaugauccaauaucaaaggaaaugauagcauugaaggacucgugagg

SEQ ID NO: 11374 - RNA, 72 nt, Human; identical to SEQ ID NO: 9079

SEQ ID NO: 11375 - RNA, 81 nt, Human
cccccaaugcagcucgugauuuggaaacucaccaucgggcaggcaagugguuccgguuuaagagaugggcauuuagagggg

SEQ ID NO: 11376 - RNA, 61 nt, Human
agcagaggcggucccuggacacgccccagucccuggcaucgcuguccucccgcuccucgcu

SEQ ID NO: 11377 - RNA, 82 nt, Human
gcugucgcccccaagcucgccccuggacacgcccuuccucccugccucacgggacucgccgcuggcgcagcuggcggacagc

SEQ ID NO: 11378 - RNA, 69 nt, Human
gcagcuguaccuccaggcuuuggagaaagagggcagccucuugucaaagcaggaagaguccaaagcugc

SEQ ID NO: 11379 - RNA, 62 nt, Human
cuggggggagagccuggccuggcccgcgucauacaacgggguggggucagcccucuucccgg

SEQ ID NO: 11380 - RNA, 78 nt, Human
gcaugucuuaucccgcugaugauuaugagucugaggcggcuuaugaccccuacgcuuaucccagcgacuaugauaugc

SEQ ID NO: 11381 - RNA, 69 nt, Human
uucauucccuuggguagacaaaauccaacauucaacgacaguuggagguauacaccaagcggaggugaa

SEQ ID NO: 11382 - RNA, 67 nt, Human
gugggcgucuuccaugaccuugaccucguagccggugaggaacuucaucucuauggauuucgcccgc

SEQ ID NO: 11383 - RNA, 66 nt, Human
ugagaugccagaaucgaaaaggcucaucagaggcgaaggccucgcccaggaugaggauggcaucca

SEQ ID NO: 11384 - RNA, 60 nt, Human
cugcucugcuucucugcggcgccgccagacauggucgguucgcuggagagaggcgagcgg

SEQ ID NO: 11385 - RNA, 64 nt, Human
ucagcaccgacaagccgcaacgagggacaggcggaccgcugggcccagcugcggcgggggcugg

SEQ ID NO: 11386 - RNA, 68 nt, Human; identical to SEQ ID NO: 9652

SEQ ID NO: 11387 - RNA, 81 nt, Human
gcggcugggguggcagggccgguguuucugugcugauuucaggguacaggacacuguuggcuuuagagaccaccaggcugu

SEQ ID NO: 11388 - RNA, 60 nt, Human; identical to SEQ ID NO: 7596

SEQ ID NO: 11389 - RNA, 69 nt, Human; identical to SEQ ID NO: 7597

SEQ ID NO: 11390 - RNA, 88 nt, Human
uauuuucaauacuguuagagaguucgguuaacuuagcuaccuuagucuguagcuuuuuugcauucucuaauuuaucuucuugaaaaua

SEQ ID NO: 11391 - RNA, 86 nt, Human
acuacugaaguucugcagaacaguaucgagcuugaauuugggggucucgcaguaauuuaugcucuuugcuuuugccuuuucauagu

SEQ ID NO: 11392 - RNA, 79 nt, Human
aguuuaucacucauggugauuugguuuacucuggagaguaaaauauccggugugucaggcaugacaugaaugguggucu

SEQ ID NO: 11393 - RNA, 61 nt, Human
guguauuuguaaucacuggcaaugucucuagaggcucuugcagccuuuauugcaauggcau

SEQ ID NO: 11394 - RNA, 60 nt, Human; identical to SEQ ID NO: 1551

SEQ ID NO: 11395 - RNA, 79 nt, Human; identical to SEQ ID NO: 1810

SEQ ID NO: 11396 - RNA, 64 nt, Human
ccuugggaaccccaggucaaaaagggcccgaaugacaacuugggaaaaacuugggggcccaggg

SEQ ID NO: 11397 - RNA, 65 nt, Human
gaacaggacccgucgccaugggccgugugauccguggacagaggaagggcgccgggucuguguuc

SEQ ID NO: 11398 - RNA, 80 nt, Human
caucuggauuguuaagaccacagcaacuggcacauucgaccaaguucuuagggugaagucucaguaggccaguccaggug

SEQ ID NO: 11399 - RNA, 87 nt, Human
gagggcucacccuccugcacaaggaaugaacuacaggacaugaucucaaacaccuacagaugcaucuugcaggaagcgugcacccuu

SEQ ID NO: 11400 - RNA, 80 nt, Human
ccggaagcagcugcaagacagcagagaagcugccaauauccaguuagcagaugacuuugcuggcaagcagaggaagucgg

SEQ ID NO: 11401 - RNA, 71 nt, Human; identical to SEQ ID NO: 8989

SEQ ID NO: 11402 - RNA, 78 nt, Human; identical to SEQ ID NO: 8991

SEQ ID NO: 11403 - RNA, 98 nt, Human; identical to SEQ ID NO: 8992

SEQ ID NO: 11404 - RNA, 75 nt, Human
ccccugacauugaccuccuacccugaccccugccugaccaagccaugucugaacaggaggcucaagccccagggg

SEQ ID NO: 11405 - RNA, 80 nt, Human
cugagugcagguuaggcaggugaagugucuccccgcaaaccaagcuagagugccccaccugcucggcccugccuucucgg

SEQ ID NO: 11406 - RNA, 95 nt, Human
cuuuaucucuggcuguucgucccaucguccaccguggcaccagcucccucagccagccaggaugggaccagcgacugagagagccagaggcagag

SEQ ID NO: 11407 - RNA, 91 nt, Human
ggauccagcacauccaggcuucuccuccucacgaggaaccaguggugacagcugaggccaugugaguaggauccugaaugaggcuuuaucu

SEQ ID NO: 11408 - RNA, 73 nt, Human
ccaauccccacauuuaaaauggaauguuugguuuauuuaaaguaaauaggcuauuuuuucuuacugggucugg

SEQ ID NO: 11409 - RNA, 66 nt, Human
ccacuggugaauucaacuggaagcuccuucuauagucugaagaauaccaucugaaagaacuagugg

SEQ ID NO: 11410 - RNA, 61 nt, Human
cacaaauugccugaaaacuuccuuaagcagcuucacuuuauugucaggauaucgcuuugug

SEQ ID NO: 11411 - RNA, 75 nt, Human
cagcugucgcugucuucuugcguccgaagaccugcaccgacugcagcggacccuuggacggcagcgcggcggcug

SEQ ID NO: 11412 - RNA, 79 nt, Human
guacuguagcgugcgcggcucaaucaucuccaggggccgcccguucaccuugaugagaccauugccgcguuugcagugc

SEQ ID NO: 11413 - RNA, 89 nt, Human
cuugugggagauuuaucaagcguuuugagcagaaaggauuccgccuuguuggucugaaauucaugcaagcuuccgaagaucuucucaag

SEQ ID NO: 11414 - RNA, 66 nt, Human
gaggcaugcguguucguggcugcacgguugcuccugguuuguagcccagcagacaggacacuccuc

SEQ ID NO: 11415 - RNA, 84 nt, Human
ggacgcagccuccagaugaauguacuccccaugcaguucuuccagcagagcugugggccagcagccagcacuggaggcugcucc

SEQ ID NO: 11416 - RNA, 62 nt, Human
uuuuuuauguuuccucauuuauuauaaacacaaguucgcagguaaauagagggucuaaaaaa

SEQ ID NO: 11417 - RNA, 61 nt, Human
uugcaggagcugggcugcuuggaucagagguuccauggucugaacugcuccacucugguga

SEQ ID NO: 11418 - RNA, 61 nt, Human
ugguccgccuugaacacgcguggaacuaaaauucgcggcacacucgguugaagacggguca

SEQ ID NO: 11419 - RNA, 74 nt, Human; identical to SEQ ID NO: 521

SEQ ID NO: 11420 - RNA, 64 nt, Human
ggggcccaauaugaacgaagcuggcucggagaaccgagaagaagcuaaaacaagaccugguccc

SEQ ID NO: 11421 - RNA, 81 nt, Human
cgaauggaccacuggagggguucaaagguucgcgucccaguacgggaaugagccucuuugaucucuuccggggcuuuuucg

SEQ ID NO: 11422 - RNA, 75 nt, Human
ggagcgcccuuugggguuggaagcaccccccgacagucggugggagggugauauggcgaccuauuuugggcgccc

SEQ ID NO: 11423 - RNA, 65 nt, Human
ggcuaguuuaggcguugucccuuugccgagacagcgguuugcgagaggaaaauuccaaguaggcc

SEQ ID NO: 11424 - RNA, 91 nt, Human
gcccuuuguucccaggacuuuaaggcaaauauuaaaaauuauugcaaaauuaagaauauacuguuugugauuaaauguccuuggaauuugc

SEQ ID NO: 11425 - RNA, 73 nt, Human
uuaggcugaaacauaugaaauugcugcauuuguaguuuaaaaacugucagcaguuucauaugguuccaccuaa

SEQ ID NO: 11426 - RNA, 80 nt, Human
gcgacgauuuucaaguuggaaccggucaauccgggggaaggggugcccccguuuuaaacccguauccaaugauucguugc

SEQ ID NO: 11427 - RNA, 114 nt, Human
ggcgguucucuggaggcugagugccguuugcggugcccuaggaggccgagcucuguugcuucgaacuccaguggucagaccugcucauaucucagcauuucuucaggaccgacc

SEQ ID NO: 11428 - RNA, 76 nt, Human
gggccuuuauuugguuuuggcuuuagcugauaauguuuuagugaugucagcuagugcaguucucaaauggcugccu

SEQ ID NO: 11429 - RNA, 80 nt, Human
cccgauccggcagcucauuuaaauagagcucaucacaacaacaguguugguggugaagugaguagcugcaggacccuggg

SEQ ID NO: 11430 - RNA, 65 nt, Human
ucuucucuguaguggauguacuacagcucccaaauaaaugcuguagaugcaaauggcaaagaaga

SEQ ID NO: 11431 - RNA, 104 nt, Human
aagucugaaacauuuuacuucauauuacacauacuuuucuuuuaaaaaaggcagaaacauugaaggaaacaacacucaacaugaaagaaccuugugccggaguu

SEQ ID NO: 11432 - RNA, 67 nt, Human; identical to SEQ ID NO: 9949

SEQ ID NO: 11433 - RNA, 81 nt, Human; identical to SEQ ID NO: 645

SEQ ID NO: 11434 - RNA, 66 nt, Human; identical to SEQ ID NO: 3532

SEQ ID NO: 11435 - RNA, 65 nt, Human
augcaauuaucuaauacaguagaaucuaccuaccuauucaaugcuguuuaauuauggauuugcau

SEQ ID NO: 11436 - RNA, 73 nt, Human
gcuucauuacugaaguagcuacauuagcgaaaacaguguuauuuuuguugcaguuacaaagcuaccaggaagc

SEQ ID NO: 11437 - RNA, 71 nt, Human
ugcuucuuuauuaaugauuauaaaucaggaucuagcagcaggucuaguaacuucugucguuuugagaagca

SEQ ID NO: 11438 - RNA, 70 nt, Human
uuggcagcagcacccacaggguggcuaucacaggcuuugcaggcccucccguugggugauggcuugccaa

SEQ ID NO: 11439 - RNA, 65 nt, Human; identical to SEQ ID NO: 476

SEQ ID NO: 11440 - RNA, 60 nt, Human
guuuaguaaauacaauuucgcucauacaaaacaacaguuuacaacaaucgagugcuggac

SEQ ID NO: 11441 - RNA, 69 nt, Human; identical to SEQ ID NO: 9236

SEQ ID NO: 11442 - RNA, 60 nt, Human
aucugccacuuugugagcucaucaucagucccaaguggaacuagacucacagaccuagau

SEQ ID NO: 11443 - RNA, 65 nt, Human
ugccaugaccccagcacuuggccagcacugugcuacguugcuggucacagcugggccaucugcca

SEQ ID NO: 11444 - RNA, 82 nt, Human
uuuauucaucuuccaugugccugcugagucucagacucccuuucuuuccaucagcucuggcagccucaucaagaugacugaa

SEQ ID NO: 11445 - RNA, 60 nt, Human
ccggcccggggaggacaagucgcugccaccuuuggcugccgacgugauucccugggacgg

SEQ ID NO: 11446 - RNA, 102 nt, Human
ggaaaugggagaaacucccaggcaggaacaccuuuugcugugauggccgcgucaugauggcccggcaaaagggcauuuucuaccugacccuuuuccucaucc

SEQ ID NO: 11447 - RNA, 63 nt, Human
guugucgugcagguagaggcuuacuaaaagugugaaaacguaggcuuggauuaaggcgacagc

SEQ ID NO: 11448 - RNA, 77 nt, Human
uuaaugguugauauugcuaggguggcgcuuccaauuaggugcaugaauagguggccugcaguaauguuagcgguuag

SEQ ID NO: 11449 - RNA, 61 nt, Human; identical to SEQ ID NO: 1238

SEQ ID NO: 11450 - RNA, 75 nt, Human; identical to SEQ ID NO: 345

SEQ ID NO: 11451 - RNA, 71 nt, Human; identical to SEQ ID NO: 346

SEQ ID NO: 11452 - RNA, 66 nt, Human
cauuccugagggguuggccucaugacccaaagacacccauuaggccccagcuccaacauugggaug

SEQ ID NO: 11453 - RNA, 68 nt, Human
gugccaggcucuuuuucacaaccagcucucaggggaacucuugugggaacucacagagaggacugcac

SEQ ID NO: 11454 - RNA, 70 nt, Human
caaguccccuacaauugucuuacaagugucuuauguccagagaacauguaagaugagugcuagagacuug

SEQ ID NO: 11455 - RNA, 69 nt, Human
cugagcuuguaacuccagagcaggaccauguagucacuacucauuuaugcuuuuaauuacaccacucgg

SEQ ID NO: 11456 - RNA, 61 nt, Human; identical to SEQ ID NO: 823

SEQ ID NO: 11457 - RNA, 60 nt, Human; identical to SEQ ID NO: 1551

SEQ ID NO: 11458 - RNA, 89 nt, Human
ccgaaucaguggugggaacgacaaacaagguuuccccaugaagcagggugucuugacccauggccguguccgccugcuacugaguaagg

SEQ ID NO: 11459 - RNA, 60 nt, Human
gucugaucagucgaacuaagauuuuugaguacacauaauaagaucaggacucugaaagac

SEQ ID NO: 11460 - RNA, 80 nt, Human
cuuagaggcggucagaagcaggagcaggaacggaggcgagcaaguccgucguagaggcuccgugcggagagagccgaagg

SEQ ID NO: 11461 - RNA, 131 nt, Human; identical to SEQ ID NO: 1788

SEQ ID NO: 11462 - RNA, 83 nt, Human
cuuuaucaaaaacaugauuacagggacaucucaggcugacugugcuguccugauuguugcugcugguguuggugaauuugaag

SEQ ID NO: 11463 - RNA, 60 nt, Human; identical to SEQ ID NO: 1551

SEQ ID NO: 11464 - RNA, 60 nt, Human; identical to SEQ ID NO: 1551

SEQ ID NO: 11465 - RNA, 79 nt, Human; identical to SEQ ID NO: 1810

SEQ ID NO: 11466 - RNA, 65 nt, Human; identical to SEQ ID NO: 247

SEQ ID NO: 11467 - RNA, 80 nt, Human; identical to SEQ ID NO: 100

SEQ ID NO: 11468 - RNA, 79 nt, Human; identical to SEQ ID NO: 1810

SEQ ID NO: 11469 - RNA, 63 nt, Human
cgggggagaggggcaaaugccuccgggacugacacuccaggcagcuuugccuucucuccccug

SEQ ID NO: 11470 - RNA, 60 nt, Human
uuugcccuuuuucccuuuucuccaugcuuaauggugugaggcgucaggagagaggccaag

SEQ ID NO: 11471 - RNA, 77 nt, Human
guuccaaauguugaugcaugugguuaauguugcauuagagcacuuugcaauugcauaauucauuaauguuugugagc

SEQ ID NO: 11472 - RNA, 75 nt, Human; identical to SEQ ID NO: 2275

SEQ ID NO: 11473 - RNA, 77 nt, Human
gccaucaaugucaaugacuccgucaccaagagcaguuugacaaccucuauggcugccgggagucccucauagauggc

SEQ ID NO: 11474 - RNA, 73 nt, Human
ggcaucucugaggagaccacgacugggguccacaacucuacaagaugauggccaaugggauccucaaggugcc

SEQ ID NO: 11475 - RNA, 63 nt, Human
gccagagcgauauauucaucuggagaaccuuuuggccaggucuuacuuugauccucgugaggc

SEQ ID NO: 11476 - RNA, 78 nt, Human
uacgggcucugaaauugccagacaaaacccucauugaccucuaugaacagguuguucuggaauugauagagcuccgug

SEQ ID NO: 11477 - RNA, 94 nt, Human
uggacagcauugagagcuuucgugagucugacauuaacagauggccuauuggugauacugugucuccagggcuauacgggcucugaaauugcca

SEQ ID NO: 11478 - RNA, 131 nt, Human; identical to SEQ ID NO: 1788

SEQ ID NO: 11479 - RNA, 60 nt, Human; identical to SEQ ID NO: 1551

SEQ ID NO: 11480 - RNA, 77 nt, Human
ccgugcagacaguggccuuaucacuccgggaggcuuuucaucagugccugcuggaauggagaccccugaacucaugg

SEQ ID NO: 11481 - RNA, 62 nt, Human
ccuaggaagcgaacuuaugaacagauaaagguggaugaaaaugaaaacuguuccucucuggg

SEQ ID NO: 11482 - RNA, 62 nt, Human
gguggggugagggggcgaggccgcagcuagggcggcgaaacucuccuccccucggccccacc

SEQ ID NO: 11483 - RNA, 67 nt, Human
ggggagagcuuguucagcuuuucauccuccuuuucccggaugguagaaccggguacaagcuuuccuc

SEQ ID NO: 11484 - RNA, 80 nt, Human
guuggggcacccaaagacaaccaugcucucggugaaggcgccgagguccuggcauuguuucugguucucuucgucuuggc

SEQ ID NO: 11485 - RNA, 67 nt, Human
ggucugcggcucgggguccaugucagugcagaagcucacgcgcuggcacagcucggucagcagcgcu

SEQ ID NO: 11486 - RNA, 86 nt, Human
auuuaccaugagauugcacauauagauguaauuauaaaacaauguucauaguuacuuaauuaucuaaaaaucacacgaggguaagu

SEQ ID NO: 11487 - RNA, 85 nt, Human
cagaacuguggagaaugaacugaacacaaagugaaagaaaaugaggagaacacuuuguauuuaccccaaaaucuuuucaguugug

SEQ ID NO: 11488 - RNA, 98 nt, Human
ggaggagccuuagcccuggauuccaaggcccauccacccggugaucagcacugagcaccgaggauucaccauggaacuggggcuccacuggguuuucc

SEQ ID NO: 11489 - RNA, 131 nt, Human
agauucgggcaaguccaccacuacuggccaucugaucuauaaaugcgguggcaucgacaaaagaaccauugaaaaguuugagaaggaggcugcugagaugggaaagggcuccuucaaguaugccugggucu

SEQ ID NO: 11490 - RNA, 61 nt, Human
ggugacaacaugcuggagccaagugcuaacaugccuugguucaagggauggaaaagucacc

SEQ ID NO: 11491 - RNA, 70 nt, Human
caccuacacagaggcugugcagacgguggaccccuucaaggccacaggcaagccccacacucugugggug

SEQ ID NO: 11492 - RNA, 62 nt, Human
ugccaaguuucaugaggacaacggacagcuggacgaugcccgugucauccuggagcaaggca

SEQ ID NO: 11493 - RNA, 70 nt, Human; identical to SEQ ID NO: 4086

SEQ ID NO: 11494 - RNA, 68 nt, Human; identical to SEQ ID NO: 6194

SEQ ID NO: 11495 - RNA, 70 nt, Human; identical to SEQ ID NO: 999

SEQ ID NO: 11496 - RNA, 67 nt, Human
uuggaggcagagaggcaugcaggcgggguccuaggagccccugcuucuccaggccucuugccuuuga

SEQ ID NO: 11497 - RNA, 62 nt, Human; identical to SEQ ID NO: 2890

SEQ ID NO: 11498 - RNA, 131 nt, Human; identical to SEQ ID NO: 1788

SEQ ID NO: 11499 - RNA, 60 nt, Human; identical to SEQ ID NO: 1551

SEQ ID NO: 11500 - RNA, 66 nt, Human
cucugagccauggcuucccauagacacucaggucccuccagcuacaaggugggcaccauggcggag

SEQ ID NO: 11501 - RNA, 74 nt, Human
guucugugccaaacaccuguguggaaugccgcaagcccaucggugcggacuccaaggaggugcacuauaagaac

SEQ ID NO: 11502 - RNA, 104 nt, Human
gccgccccggcaucuggaucggcuggggcgucaggggccgccccggagucgggaucggcuggggcgucaggggccgccccggagucuagaucugcuggggcggc

SEQ ID NO: 11503 - RNA, 107 nt, Human
ucuucugugguugcccggagugaggauggugaugaggcuguaugggcuagucugacagugugaugcgguaaugauggccuggacgcuagggaagcgaucaccggaga

SEQ ID NO: 11504 - RNA, 65 nt, Human
agggucuggacugcauucuaacaccaaucggucaacugaaagccuugggcugcucuccggaugcu

SEQ ID NO: 11505 - RNA, 79 nt, Human; identical to SEQ ID NO: 1810

SEQ ID NO: 11506 - RNA, 70 nt, Human
ggccuccaguggaagugcacaggcacucccaauguuguuaaugcucugucuuccauuuguucuggaaucc

SEQ ID NO: 11507 - RNA, 65 nt, Human
uucuguaccagguuuaaauguagucuucuggagaaguauuuuugacauugagcucugggacagga

SEQ ID NO: 11508 - RNA, 87 nt, Human
uuugacguggugcaauuuugaugagaugucucuggggacacgaggaugcccuaaugaugcugacuugucaugguugcagcauuugaa

SEQ ID NO: 11509 - RNA, 82 nt, Human
ucaaggugugcucugcgcaaagacacucucugcucuagcuucuggagcucacguucauguugugccucuguuugcaucuuga

SEQ ID NO: 11510 - RNA, 72 nt, Human; identical to SEQ ID NO: 10467

SEQ ID NO: 11511 - RNA, 91 nt, Human
gagaggcaccacucacaggcaggcccggcugcacaaguccucccugcugggccuggucacugcagcugccccucccuggcuggcuccucuc

SEQ ID NO: 11512 - RNA, 71 nt, Human
uuuuuuucagaagucacacucagaauuuaauuucuccaaaaguuguuucuguguuugauucauguagaaaa

SEQ ID NO: 11513 - RNA, 67 nt, Human
aauaucucucuaucucaugguauagugucucguccaagccucuaugcuagcccucaucauagauguu

SEQ ID NO: 11514 - RNA, 115 nt, Human
accuuggugguaagaacuuuagcuccagggaacuugaggcagaggcccuguuguggucuguguugacagcaaccgcaccuguccacgucaugcuccugaacuugaccaccaaggu

SEQ ID NO: 11515 - RNA, 61 nt, Human
gaugcugaccagagagucuaucccggaccuauucccguccuaugcauucacaguuggcauc

SEQ ID NO: 11516 - RNA, 64 nt, Human
ggggggccacccguuuuccaaaauuucguucaaaguuucaaguuggaauccugguggucccacc

SEQ ID NO: 11517 - RNA, 84 nt, Human; identical to SEQ ID NO: 286

SEQ ID NO: 11518 - RNA, 89 nt, Human; identical to SEQ ID NO: 288

SEQ ID NO: 11519 - RNA, 65 nt, Human
uccagaaagcugauggugugcccgucuaccugaaacgaggcugccugaccaaaugcuuuaccgga

SEQ ID NO: 11520 - RNA, 71 nt, Human
ucggcggcugcacugcggaugagaccggugcgacucaugaagguguucgucacccgcaggauacccgccga

SEQ ID NO: 11521 - RNA, 73 nt, Human; identical to SEQ ID NO: 2360

SEQ ID NO: 11522 - RNA, 90 nt, Human
guaauuuaguuuaaaugaagggaaaucuuuuuaaauguuaugacaacauacucccaagaagaaccuuuucuucaguuaaguuaauuauac

SEQ ID NO: 11523 - RNA, 84 nt, Human; identical to SEQ ID NO: 286

SEQ ID NO: 11524 - RNA, 89 nt, Human; identical to SEQ ID NO: 288

SEQ ID NO: 11525 - RNA, 94 nt, Human; identical to SEQ ID NO: 5398

SEQ ID NO: 11526 - RNA, 66 nt, Human; identical to SEQ ID NO: 8995

SEQ ID NO: 11527 - RNA, 71 nt, Human
ugggaaccacgucaccacgguacaacaggcagcaagccauguauuuaccauggcgaggguacauuucacca

SEQ ID NO: 11528 - RNA, 61 nt, Human
guaccgaagauguuaguuaauagauauuuuaguggauaaucugucaucugacauccaguau

SEQ ID NO: 11529 - RNA, 74 nt, Human
uggcuggguugaauccggugcuugucgguacagguccuuaugacacaaaagcaccguaaaagaggcuccagcua

SEQ ID NO: 11530 - RNA, 66 nt, Human; identical to SEQ ID NO: 1008

SEQ ID NO: 11531 - RNA, 75 nt, Human; identical to SEQ ID NO: 6455

SEQ ID NO: 11532 - RNA, 61 nt, Human; identical to SEQ ID NO: 347

SEQ ID NO: 11533 - RNA, 93 nt, Human
ugcgggucaccacgguggcuucccacacuucugacucggacguuccuuccggugucacugagguggucgugaagcucuuugacucugauccca

SEQ ID NO: 11534 - RNA, 62 nt, Human
uuuuuuaaugggucucaaaauucugugacaaauuuuugggucaaguuguuuccauuaaaaag

SEQ ID NO: 11535 - RNA, 62 nt, Human
uccaguucauauuguuccagagucauguaacaucaagggggggacacaaaauaugauaggga

SEQ ID NO: 11536 - RNA, 98 nt, Human
ugucuucaauagaaaguucaaauauuuccauuuuuuaaaccucuagaauauuauccggacauuuaaaauauugauauuugaguuuacauuaaaggaca

SEQ ID NO: 11537 - RNA, 77 nt, Human
uuuaaauauaguuugacugauuguggggguacuuacggacagauuucuuuaccaaguaccaguuucuuauauuuaaa

SEQ ID NO: 11538 - RNA, 105 nt, Human
agcuggcuaccgacuccaccuucucccuggaccagcccgguggcacccuggaucugacccugauccgugcccgccuccaggagaaguugucaccucccuacagcu

SEQ ID NO: 11539 - RNA, 71 nt, Human
aagugaaguaaguaccugagaaugcuguuacagaugcuguuucugcuauucauugaguaaaguuucaacuu

SEQ ID NO: 11540 - RNA, 60 nt, Human
aaaaugggguuggguuuuuuggucuucgacgcuccggggucuggggggcccucccauuuu

SEQ ID NO: 11541 - RNA, 95 nt, Human; identical to SEQ ID NO: 8737

SEQ ID NO: 11542 - RNA, 94 nt, Human
uauauagggaguaauuagggaccuaaucuaguuucagugaagaaagaucccuuuacguuaauuuaggugcaucuaauaauucuuguucuguaua

SEQ ID NO: 11543 - RNA, 77 nt, Human
cucaugaugcuguugucuuucacccaaaauuuguagggaagacccuagaaacccuggcaggagaagagugugguggg

SEQ ID NO: 11544 - RNA, 84 nt, Human; identical to SEQ ID NO: 286

SEQ ID NO: 11545 - RNA, 89 nt, Human; identical to SEQ ID NO: 288

SEQ ID NO: 11546 - RNA, 61 nt, Human; identical to SEQ ID NO: 776

SEQ ID NO: 11547 - RNA, 67 nt, Human
uauuugaacauuacugauaauguugaacaacuuuucauguuuauuaguuauuagguuucuucaagug

SEQ ID NO: 11548 - RNA, 91 nt, Human
cagggagaggaaaggaggggcaaagaggugagggacaggggggacaauggcuuucccucuguccccugccagcucccccagcugcacccug

SEQ ID NO: 11549 - RNA, 72 nt, Human
ccugacuccugggucucggcuucccguauccagcacaaggauggguucucugucgcagagccuggagucugg

SEQ ID NO: 11550 - RNA, 64 nt, Human
gccuggucuugccccucuggagugacacccagguguacuuagauggagacggguaagcaauggc

SEQ ID NO: 11551 - RNA, 75 nt, Human
ggagucuggccucaccugugccuggucuccugcaggggcuucagcgugacgucuggugggcaaagccggaucuuc

SEQ ID NO: 11552 - RNA, 95 nt, Human
ugagugugacggaugugacggggccugggcaccaggguacaguagaacuuuaggcugggacucuggggccugcucccagcuccacgucagauuca

SEQ ID NO: 11553 - RNA, 87 nt, Human
gaguugggagcuuggauaggcuacaacccauuugccccauugaaggucgacuggguggagcccgcacucaggcugaauucccacuuc

SEQ ID NO: 11554 - RNA, 66 nt, Human
guggcugagacagaagcuccuggugcugggaagccuugccguugggagucuccuguaucuagucgc

SEQ ID NO: 11555 - RNA, 89 nt, Human
guguauauguguauauauauguacguaacacauauacauauauauacacauauauguguguauauauacauauauauacauguacacac

SEQ ID NO: 11556 - RNA, 69 nt, Human
ugcauguugagugccgucugcuuucggucccgucauuaucucuguauagacccaguuggcaaucaugca

SEQ ID NO: 11557 - RNA, 84 nt, Human
caaaggaaauacuguguuagaauuuucuaguaggacucuuuaaaccuuuuggggaaagcuaucagauaauucgcaguaccuuug

SEQ ID NO: 11558 - RNA, 86 nt, Human
gaagaggaacacuucagugaggaccaguacuugguugcagucaggaaaaauucacaaagucaguucucgaucaagguuaccucuuc

SEQ ID NO: 11559 - RNA, 63 nt, Human
gcccuuuguaccccauauggagccgguaaggguuacaggcaggaaggggguaugaucuggggc

SEQ ID NO: 11560 - RNA, 75 nt, Human
ggucucacugaccccacaaggggcucuggagcugggauggccccagaggguuucccaaguuggggugaggaggcc

SEQ ID NO: 11561 - RNA, 62 nt, Human
cgcauccguccgcagcuucaugaacguggccaaguccaugcucacauucugcugacugagcg

SEQ ID NO: 11562 - RNA, 65 nt, Human
gcagggggcauguucccguuuacugagcgcgaguucucuugggguggaacggggaccacccgugc

SEQ ID NO: 11563 - RNA, 63 nt, Human
ccagauuaguccaagaauuuuugugauggaagcuauuuuccacacauccuauguacuaaaugg

SEQ ID NO: 11564 - RNA, 76 nt, Human
uauagggaaagcugguacgccugcagguaccgguccggaauucccgggucgacccacgcguccgguucucgcugug

SEQ ID NO: 11565 - RNA, 74 nt, Human
ggggaaaugacuggcccaaggggacaagacgcaucuuaagaugucaaguccuggacccuucccugcaaggcccc

SEQ ID NO: 11566 - RNA, 78 nt, Human; identical to SEQ ID NO: 99

SEQ ID NO: 11567 - RNA, 80 nt, Human; identical to SEQ ID NO: 100

SEQ ID NO: 11568 - RNA, 110 nt, Human
ccuccccugcugaaucugagccacagugugaucccagcuuuaaaggagaugcaggagaaaauacggcauugcuagaagccggucgaggagugagcucucggucauggagg

SEQ ID NO: 11569 - RNA, 63 nt, Human
cuacuaaaauagaguguguagcaugaacaguguguugcuucagacuauuacaaagacaagugg

SEQ ID NO: 11570 - RNA, 78 nt, Human; identical to SEQ ID NO: 99

SEQ ID NO: 11571 - RNA, 65 nt, Human; identical to SEQ ID NO: 247

SEQ ID NO: 11572 - RNA, 80 nt, Human; identical to SEQ ID NO: 100

SEQ ID NO: 11573 - RNA, 62 nt, Human
auguuuucgaucuugaugcuauagagaacagccauguuccccugauagcaagaaaaagacgu

SEQ ID NO: 11574 - RNA, 60 nt, Human
aucuaaggggggugggaagguuaacaaaaccauuuuuuuuacauguccaucccccugggu

SEQ ID NO: 11575 - RNA, 70 nt, Human
gcuaggcagccagaaaccugcggaaaaugguagcgauggcggcugggccgagugggugucuggugccggc

SEQ ID NO: 11576 - RNA, 85 nt, Human
cuuugccucccgaagaguuaagauuacaggauuugagcaccauacagggcccuacaguuccuugauuagcaucuuaaggggaaag

SEQ ID NO: 11577 - RNA, 60 nt, Human
gcugauagguuuaggauacacucagacucuaaagcagguauuaaacugaacacugucagc

SEQ ID NO: 11578 - RNA, 70 nt, Human
gggggagcucaucggcuacucugaacgcggccaaggugccggccgacaccgaggugguuugugcuccccc

SEQ ID NO: 11579 - RNA, 72 nt, Human
uuggauggguccugugggaggagcaccucaaaccgaauauggaguuuucagccaaaaagagcccacuuucaa

SEQ ID NO: 11580 - RNA, 68 nt, Human
auuaauuauagugcacacaauauauauaaaucaaaaacgauuauauguuauuauaaaagcuaauuagu

SEQ ID NO: 11581 - RNA, 66 nt, Human
uucugaaaacacuucugucccuaacgaaucuaacaagauucuuguuaauaaagauguaccucagaa

SEQ ID NO: 11582 - RNA, 70 nt, Human
ucuuucgagccaauaugaacacuggggacccuucuaagcccaagaguguuauucucaaggcuuuaaaaga

SEQ ID NO: 11583 - RNA, 108 nt, Human
uagucagcauauagcgauccuggaaugagccucuguaucaucuggucacggaaguacgugguaugcaagaagccccggaggcuauccuauccaaagcuguagagauug

SEQ ID NO: 11584 - RNA, 62 nt, Human
gcaggugccagcacggugguuaaaggggagaaguccucuuccuguuuugugguggccccugu

SEQ ID NO: 11585 - RNA, 66 nt, Human
aacucccugugggcucccuuuggggguguggcccaccugcacaucggaggccucacaucgggaguu

SEQ ID NO: 11586 - RNA, 66 nt, Human
aaaauuuuuaaagaaaguuuggacacucauaaagcauuuggguuuuaaacuuauuuuacgaauuuu

SEQ ID NO: 11587 - RNA, 78 nt, Human; identical to SEQ ID NO: 99

SEQ ID NO: 11588 - RNA, 65 nt, Human; identical to SEQ ID NO: 247

SEQ ID NO: 11589 - RNA, 80 nt, Human; identical to SEQ ID NO: 100

SEQ ID NO: 11590 - RNA, 68 nt, Human
ggggugagcuggggaggcuucugcgguucuggagucccggcaauggccccaguuccccagcaaacccc

SEQ ID NO: 11591 - RNA, 65 nt, Human
cucccaaagugcugggauugccggugugagccaccgcgcccggcgauuuagcaaauuuuugguag

SEQ ID NO: 11592 - RNA, 60 nt, Human
gagguuucccguguuggccaggauggucuggaucuccugaccucgugauccacucaucuc

SEQ ID NO: 11593 - RNA, 60 nt, Human
cagggaauuaccucgcgaacacguuuccaaaaaacaaaacaugugcgcgcggauuaacug

SEQ ID NO: 11594 - RNA, 69 nt, Human
ggcuagaugguauugggaauaauaccucacaguucugaaggaccacacuauuuccaagcccagaaugcu

SEQ ID NO: 11595 - RNA, 93 nt, Human
gguaggaggaucgcuugaguccaggagguugagguugcagugagcuugugccacuguacuccagccugagugacagagcgagacccuguugcc

SEQ ID NO: 11596 - RNA, 62 nt, Human
ucaagggggucuccuacggaugacagcuccauagcuggagugggacaaccagacccgauuga

SEQ ID NO: 11597 - RNA, 65 nt, Human
acgaaggugauuaacggaccuggaaauccaugacgcagggagaauggggucauuuaaagccuagu

SEQ ID NO: 11598 - RNA, 69 nt, Human
caaaaaaacugguuggcggccggcaagaaaaacuuuucaaaccacuugugggggcgggccaggggauug

SEQ ID NO: 11599 - RNA, 61 nt, Human
gcagugugagaccuaguugcauuaccccaagaguguagcuguuuucgcuuuuauguacugc

SEQ ID NO: 11600 - RNA, 77 nt, Human
ggugucuguuccagugcucucgcgagggccuucuucuuuucgggguuggcaaggcgagggcacccuggccggacacu

SEQ ID NO: 11601 - RNA, 63 nt, Human; identical to SEQ ID NO: 6096

SEQ ID NO: 11602 - RNA, 60 nt, Human
ucgaagggggagaacccuuggcaaccggcaaggaguagggcaaaggacaucuuccuuuga

SEQ ID NO: 11603 - RNA, 71 nt, Human
ugaagcacuacgggccuggcugggugagcauggccaacgcaggcaaagacaccaacggguccaguucuuca

SEQ ID NO: 11604 - RNA, 77 nt, Human
gacugacaacugugagacaugcacuugcuacgaaacagaaauuucauguugcacccuuguuucuacaccuguggguu

SEQ ID NO: 11605 - RNA, 68 nt, Human
uggccucuaauagucaaugauuguguagccaaugccuuauucagguuaaaacagcauuuuggaggcca

SEQ ID NO: 11606 - RNA, 65 nt, Human; identical to SEQ ID NO: 247

SEQ ID NO: 11607 - RNA, 80 nt, Human; identical to SEQ ID NO: 100

SEQ ID NO: 11608 - RNA, 65 nt, Human; identical to SEQ ID NO: 4540

SEQ ID NO: 11609 - RNA, 71 nt, Human; identical to SEQ ID NO: 4541

SEQ ID NO: 11610 - RNA, 78 nt, Human
ggaauuuggcugaggagcagcuuuagguauggauugaugacuaagucaagcuacuuccugagcuucucucagauuucc

SEQ ID NO: 11611 - RNA, 90 nt, Human
augggcuucgacggggcuuaauagcccuugccccacugaaugcugcuacgcgcagaaucccgggcuugggagcccccaaaaauggcccau

SEQ ID NO: 11612 - RNA, 70 nt, Human
gccagccgagcaccugcagcugcuggaggaagcugccaaggagguagcugaugaggugacccggcccggc

SEQ ID NO: 11613 - RNA, 74 nt, Human; identical to SEQ ID NO: 9061

SEQ ID NO: 11614 - RNA, 66 nt, Human; identical to SEQ ID NO: 2802

SEQ ID NO: 11615 - RNA, 101 nt, Human
ugaagauccucacugagcgaggcuacagcuucaccaccacggccgagcgggaaaucgugcgcgacaucaggagaagcugugcuacgucgcccuggacuucg

SEQ ID NO: 11616 - RNA, 81 nt, Human
cacauugauuuucaguaugacucugauggcucucacgacugccuuugaaccgccugacgagcuaugcauacugaacaagug

SEQ ID NO: 11617 - RNA, 61 nt, Human
gccucuccuggggccacuguugggggugggagugagcccaccacagaggccacaggcaggc

SEQ ID NO: 11618 - RNA, 81 nt, Human
ggcacuggucagcugggagguguccauucaucauggggaagacucagaacacaugggugcaucaucacgcugcccagggcc

SEQ ID NO: 11619 - RNA, 69 nt, Human
cugguuccagaaccgccguuccaaguucaagaaacucuacaagaccggggaggugccgcuggagcacag

SEQ ID NO: 11620 - RNA, 83 nt, Human
augcugauacguuaagcuaugcaucacuuucaguuucauucaaucucaaaguacuguaaucccagcguugcguuaccaagugu

SEQ ID NO: 11621 - RNA, 61 nt, Human
ggugacaacaugcuggagccaagugcuaacauggccuugguucaagggauggaaagucacc

SEQ ID NO: 11622 - RNA, 69 nt, Human
gcuuccuuagcuuaccaaguauucacaaggaaauucucuuguaccucuuuuugguuggcuaggggaagc

SEQ ID NO: 11623 - RNA, 72 nt, Human
gucuagcuuuacuugcuccccgccggcucaggcgcucgggcgcuggggcuuucgccgcugcagaagcuggau

SEQ ID NO: 11624 - RNA, 64 nt, Human
aaaaaaaaagguggcaguuguuugguggacuuccggauggcuucuaaguaauuccaauuuuuuu

SEQ ID NO: 11625 - RNA, 87 nt, Human
ugaguaugggugggcccuucccauaggccugaaauuuuccuccuggaggggagaagccagucuggggcuugggcccauuuggauuca

SEQ ID NO: 11626 - RNA, 80 nt, Human
aucacuaggagccaagagaacagugagaucuggaugucauuacacgaauauacacccuuuuuuuccuucucuuccaggau

SEQ ID NO: 11627 - RNA, 123 nt, Human
ugguuuucuuaaaguuuuugucucaauuugggauuacuguccuuaggguaacguggacucauuccagagaccaaaccuucagcagcugcccaaauucuacucuguccacuuuuccacagacca

SEQ ID NO: 11628 - RNA, 87 nt, Human
agcuguaaauuauguuggagcagggacuguggaguuuauuauggacucaaaacauaauuucuguuucauggagaugaauacaaggcu

SEQ ID NO: 11629 - RNA, 81 nt, Human
gaauuucaagaacaguuagagucagcacggagagaagcuaagaagucuuucaaugaugaugcuaugcugaucgagaaguuu

SEQ ID NO: 11630 - RNA, 62 nt, Human
ccaucugugguccggcuccuggugacagcuggugccagacccauggcgcuggaccgcccugg

SEQ ID NO: 11631 - RNA, 79 nt, Human
ggccggaaagggucagcucgggggaacuguggggaccugcgagccccgcaaguguugaccggcuucucccgccccggcc

SEQ ID NO: 11632 - RNA, 71 nt, Human
guggcaagaggaacacaaggacugcccagaaaaaccggggcaagcuucugggcaaaggccccuguugccgc

SEQ ID NO: 11633 - RNA, 69 nt, Human
uccagcagggggggcgggagcucuacaucuacaacaaccuacggcagacaccgcuccaccuggcuguga

SEQ ID NO: 11634 - RNA, 131 nt, Human; identical to SEQ ID NO: 6294

SEQ ID NO: 11635 - RNA, 61 nt, Human; identical to SEQ ID NO: 776

SEQ ID NO: 11636 - RNA, 76 nt, Human
uccaggaccucaaugaccgcuucgccagcuucaucgagcgcgugcacgagcuggagcagcagaacaagguccugga

SEQ ID NO: 11637 - RNA, 80 nt, Human
ggaggaucuauucuccggucauuccugguagauauuuggaauaaaauaaucaccugacgugauuggguagaucacauucc

SEQ ID NO: 11638 - RNA, 66 nt, Human
uacauaaucaguuuauaagauaaaaguacuaauuaaaagacuauaucuguagaaacuuuauuugua

SEQ ID NO: 11639 - RNA, 60 nt, Human
uauugauugcguggcccaugugaugcugugauauucagcccagcugucgcuuuaucagug

SEQ ID NO: 11640 - RNA, 64 nt, Human; identical to SEQ ID NO: 287

SEQ ID NO: 11641 - RNA, 71 nt, Human
guaccccucucagucugcaguauugaguuguuuaaaguauaugugcagucuugcuuacaaggagggguuac

SEQ ID NO: 11642 - RNA, 65 nt, Human; identical to SEQ ID NO: 1727

SEQ ID NO: 11643 - RNA, 64 nt, Human
caucauuagagcccugguagaaugacagccuuuuucagguugccagucuccucauccauguaug

SEQ ID NO: 11644 - RNA, 71 nt, Human; identical to SEQ ID NO: 8959

SEQ ID NO: 11645 - RNA, 75 nt, Human; identical to SEQ ID NO: 1111

SEQ ID NO: 11646 - RNA, 70 nt, Human
auagaaaaaugagcuuugccaucaucagaaacguaaauuuuaaugccugugcaauugccauuaauuuuau

SEQ ID NO: 11647 - RNA, 67 nt, Human
ggugggcaaugaugagacuguggcacucacagccuuugugaccaucgcccuucaucaugggcuggcc

SEQ ID NO: 11648 - RNA, 67 nt, Human
uggcccaggagcagguacgaggcucgccugagaaacugcaggagacaucuaacuggcuucuguccca

SEQ ID NO: 11649 - RNA, 129 nt, Human
ccaguucacccaggcccuggaccgccaaacagcugcucagcugcuuaagcuggcccacaaguacagaccagagacaaagcaagagaagaagcagagacuguuggcccgggccgagaagaaggcugcugg

SEQ ID NO: 11650 - RNA, 60 nt, Human; identical to SEQ ID NO: 2705

SEQ ID NO: 11651 - RNA, 69 nt, Human; identical to SEQ ID NO: 988

SEQ ID NO: 11652 - RNA, 72 nt, Human; identical to SEQ ID NO: 6340

SEQ ID NO: 11653 - RNA, 72 nt, Human; identical to SEQ ID NO: 990

SEQ ID NO: 11654 - RNA, 81 nt, Human
auaguacugaacccuuuaucaacuauguuuuuucagucuacaaccaaggcggcuacuaagugacuaaggggcagguaguau

SEQ ID NO: 11655 - RNA, 73 nt, Human
ugagauuucaucacucaggauggcuugugauuuauuuuauuuuauucuuuuuuuuuuuugagauggagucuca

SEQ ID NO: 11656 - RNA, 88 nt, Human
cgccccuguugacagauggagauugggcagcagggccuugcugcauuguuaucugcuguuccgacuugguuugucuuguccaagggug

SEQ ID NO: 11657 - RNA, 82 nt, Human
acaccuucgaauuaagcacauuccucgauuccagcaaagcaccgcaacaugaccgaaaugagcuuccugagcagcgaggugu

SEQ ID NO: 11658 - RNA, 79 nt, Human
gccuaggucucuuagaugauuaccuggagguggccaagcacuucaaaccucauggguucuccagcgacaaggcuaaggc

SEQ ID NO: 11659 - RNA, 66 nt, Human
ggcuccuccgaauggcuggcuguggauggguuggucagucccuccaacaacagcaaggaggaugcc

SEQ ID NO: 11660 - RNA, 70 nt, Human
aguaauuuagaggugauucauuaaauuaauagauuauuauuauuuucuacaauaguuauucugaauuacu

SEQ ID NO: 11661 - RNA, 78 nt, Human; identical to SEQ ID NO: 4217

SEQ ID NO: 11662 - RNA, 106 nt, Human; identical to SEQ ID NO: 6411

SEQ ID NO: 11663 - RNA, 63 nt, Human
acauguauugaagcccuguagaaugacacgcuuuugucagaugcgcgggaugcucaugcaugu

SEQ ID NO: 11664 - RNA, 66 nt, Human
auggcucauuuguuuagaauacaaugauugucuguccgcauucauguuggcuuauagagcggccau

SEQ ID NO: 11665 - RNA, 75 nt, Human
gggccaauguccacaaagaauuccuggucagcaccaccgauguccaaaggugcaauaucaaggaagggcaggccu

SEQ ID NO: 11666 - RNA, 77 nt, Human; identical to SEQ ID NO: 2332

SEQ ID NO: 11667 - RNA, 80 nt, Human; identical to SEQ ID NO: 367

SEQ ID NO: 11668 - RNA, 64 nt, Human; identical to SEQ ID NO: 287

SEQ ID NO: 11669 - RNA, 77 nt, Human
cagagcucaacuuaugugcuucgggcugggcacugguguguuucugaagcucugaagcucauucgaaggugagccug

SEQ ID NO: 11670 - RNA, 73 nt, Human
ugcagugcucugggaacucauuacugggucaagacaagaugucaccuggugaugaaaucccaucauauacuca

SEQ ID NO: 11671 - RNA, 73 nt, Human
acauuuauagagguuauaaggaucuuggcucuagaacaaauuuuugaaauuaggaucauuuuaccauggaugu

SEQ ID NO: 11672 - RNA, 65 nt, Human
uacauauacuuaccauacauuuuguaaaaaacacauuuuuuaaagaaauagggauggguauggug

SEQ ID NO: 11673 - RNA, 61 nt, Human
ucuuacagaaauguuuaaacaacccaaaauacaugaauaaaaaugacauuucuuuguagga

SEQ ID NO: 11674 - RNA, 62 nt, Human
uauguucgaugccugucaaguucaugucuagcugucaauuugugaauacggcaucgaggaua

SEQ ID NO: 11675 - RNA, 64 nt, Human
cugcauaguauuugggcuccacuucacugaucugaaaguugaggguguuggaauagaggugcag

SEQ ID NO: 11676 - RNA, 62 nt, Human
gagccaggcccuuuuccucgcgacaggccuuuccugagcucggaggggaauugccuuugcuc

SEQ ID NO: 11677 - RNA, 130 nt, Human
ggggggggaggaggggauggggcaggcuuuaggaggcugagucggaggccucugagcuguccuugacaucugggcucuuuggggucucgcugaccucgcugagguccuugcuguccccaccacuauccuc

SEQ ID NO: 11678 - RNA, 60 nt, Human
guuccgaugaugcaaaaggccaauccaaugggaaagauggccagguggcgaauucgggac

SEQ ID NO: 11679 - RNA, 78 nt, Human
uacagacaauacccagagaugugaauacagcugugauggaguugcucaucauggcuuacgcacugaagacugccugug

SEQ ID NO: 11680 - RNA, 130 nt, Human
ucuuuuacuacuaaacuuaaauggccaauugaaacaaacaguucugagaccguucuuccaccacugauuaagagugggguggcagguauuaggguaauauucauuuagccuucugagcuuucugggcaga

SEQ ID NO: 11681 - RNA, 62 nt, Human
gguacaagaaucgggcuugucgggggaggguuaccucccugugaaaggcaggcucgggugcc

SEQ ID NO: 11682 - RNA, 62 nt, Human
cgggagcuggaagaaugggggcaaaaaccccaggcccccauucuccaacccccaagcucuug

SEQ ID NO: 11683 - RNA, 64 nt, Human
ggcgaagccgggagugugggcgcggcugggguccugggcccgcgcgcugcuccgggacuacgcc

SEQ ID NO: 11684 - RNA, 64 nt, Human
gggaacacuacuguuugaugaucugugauuggaugaacugaucgaucucaguugguaacauccc

SEQ ID NO: 11685 - RNA, 72 nt, Human
guuagaugugguguuuauucaaguuuguugaaucauguuugacauacuguaaauacguuauuugagucuagc

SEQ ID NO: 11686 - RNA, 61 nt, Human
ggugcacuguggucuugccccuuggcacuggccaagagaaugaagcacccagucucguacc

SEQ ID NO: 11687 - RNA, 86 nt, Human
gacagagucccucagacggccuugggccaguaagcacccuggagagcugggcaccucgaggagcgucuggggagccucauacuguc

SEQ ID NO: 11688 - RNA, 92 nt, Human
gccccaucagggauggucacaguccacgccacaggggcugacucugcccaaucaugucccccugguggcagcgaccagauccuggcuggggc

SEQ ID NO: 11689 - RNA, 79 nt, Human
uuacaguagcuucuuaacauaggggucaagauccagggccaccuucugaucccucauuuaugcggcaccaguacuguga

SEQ ID NO: 11690 - RNA, 62 nt, Human
uuccgccggccuguuggcaccgcaacaggggaucccuucccagcgaauuacaggcggcggaa

SEQ ID NO: 11691 - RNA, 86 nt, Human
guaucugccagcagaauggcauggugcccaucguggagccugagauccucccugauggggaccaugacuugaagcgcugccaguau

SEQ ID NO: 11692 - RNA, 84 nt, Human; identical to SEQ ID NO: 6965

SEQ ID NO: 11693 - RNA, 68 nt, Human
gcacacauguccccagcauuuucucaccuggauaaagcccauaagcugcgucucaggcugggcucagc

SEQ ID NO: 11694 - RNA, 84 nt, Human
gcucucuuuaucuuucucucucacucauguaugcauacaugcacagagaugcauacacaggugccuaugcaaguacauuuaagc

SEQ ID NO: 11695 - RNA, 60 nt, Human
cagaagugauuugcuccuuaaaggggcuguuccuugcccagaaaaggugucacacuuuug

SEQ ID NO: 11696 - RNA, 85 nt, Human
gcugacacgauggagaagguaugugcaggggacuccuggagggggacgagguuuucagcacagccuucauguucucgugcucagc

SEQ ID NO: 11697 - RNA, 63 nt, Human
uauuuugguguuguggagacucagucugugaagcuaaucagauugccucauauuaccauaaua

SEQ ID NO: 11698 - RNA, 60 nt, Human; identical to SEQ ID NO: 1551

SEQ ID NO: 11699 - RNA, 62 nt, Human
gaggggcccaucaccauguugacgcugcuggaugacugggugucacugguauugccccccuc

SEQ ID NO: 11700 - RNA, 67 nt, Human
gcucgguggcaucagggggcucacauggcucugagaggugccgaguggccugacuggcagcccuggc

SEQ ID NO: 11701 - RNA, 86 nt, Human
guccggaaaugacuagcucucuggaaaagcuccucuugccgaugaggaagcucaugguggagcugguagaugagcccacgcuggac

SEQ ID NO: 11702 - RNA, 67 nt, Human; identical to SEQ ID NO: 3685

SEQ ID NO: 11703 - RNA, 73 nt, Human; identical to SEQ ID NO: 2833

SEQ ID NO: 11704 - RNA, 85 nt, Human
cuaggacagcuuugcucuuccugccccuuauaggagcccucacaguucaucuuccugguggcgcagaugagugaggcacccuugg

SEQ ID NO: 11705 - RNA, 87 nt, Human
gucacaggggcaggaucauccaugucaccuucuuccacuuccacaucgugucccaguaacacacauggagcugccaccuccugugac

SEQ ID NO: 11706 - RNA, 62 nt, Human; identical to SEQ ID NO: 3849

SEQ ID NO: 11707 - RNA, 63 nt, Human; identical to SEQ ID NO: 7988

SEQ ID NO: 11708 - RNA, 63 nt, Human
agauuccgggugcuguacgucuuuguggacauccggauagacacuacacaccuccuggacucu

SEQ ID NO: 11709 - RNA, 70 nt, Human
cagccacugcccuugcccuggucagcaccauucagguuggugucgaccuugcaggcagcggcaggagcug

SEQ ID NO: 11710 - RNA, 66 nt, Human
gccccuguccccuggagagauucuggggguugacauccccccgacuguccagagaagguuggaggc

SEQ ID NO: 11711 - RNA, 130 nt, Human
uauggcaaaagggaucguuaggaucaaaugccaucagaguuuuggagauugcguagcucuucauggucauuggggggugcaauugacgcagcuugguauggucgcuaaagccagguagggguugccaugg

SEQ ID NO: 11712 - RNA, 66 nt, Human; identical to SEQ ID NO: 3532

SEQ ID NO: 11713 - RNA, 61 nt, Human
ggugacaacaugcuggagccaagugcuaacaugccuugggucacagggauggaaagucacc

SEQ ID NO: 11714 - RNA, 73 nt, Human
cucuaccugguuggaaggcugugucguucggagagccugagcucgcggagaugggggcaggccgccgguaggg

SEQ ID NO: 11715 - RNA, 92 nt, Human
gagcaucacuacuccguguguaccuguuagaugacauguucauaaacccauguaccugauaucgaucgguaccugcgagaugugugucgcuc

SEQ ID NO: 11716 - RNA, 101 nt, Human
ugcgaagccgagcagaacggcaauccagggauuccucuaaugguaggauagagcuuuuugccugaauuuucggcauuggcgucuucuguauccguaucgua

SEQ ID NO: 11717 - RNA, 68 nt, Human; identical to SEQ ID NO: 3588

SEQ ID NO: 11718 - RNA, 74 nt, Human
cucggaguaaucgccugcauuggggagaagcuagaugaaagggaagcuggcaucacugagaagguguuuucgag

SEQ ID NO: 11719 - RNA, 90 nt, Human
gacuucgcccggcagaagcuagaucccaagauugcuguggcugcgcagaacugcuacaaagugacuaauggggcuuuuacuggggagauc

SEQ ID NO: 11720 - RNA, 69 nt, Human
agcuugugcuuauagaguguguauuaucuaagugaaauagaugccaccgcauaccuaccagcauaaucu

SEQ ID NO: 11721 - RNA, 60 nt, Human
aguaaauauuaauaugaucacuuacacuauauucaagaguaguuucauguaguacuuauu

SEQ ID NO: 11722 - RNA, 68 nt, Human
uuuaaaucucagcaaacauauuucuuucuuguggcaaucuuguuuuuaagaaaguacauggauuuaag

SEQ ID NO: 11723 - RNA, 67 nt, Human
gucgguggggacggggguccugggcugggcagagccugggcuggggccacacuaguccccaccaggc

SEQ ID NO: 11724 - RNA, 67 nt, Human
ugggggcagggcuucaaccggcacccagggcucacuccagcgggcagggcugcccuguaacagacca

SEQ ID NO: 11725 - RNA, 63 nt, Human
caggugugggcuguguggucuggcaggaguccuuagggcuauggcccaugugugcacauccug

SEQ ID NO: 11726 - RNA, 69 nt, Human
cgcaggugaucccgcagggauaccucagaguuuccaaagaggcagaccuugagguucccaucagcugug

SEQ ID NO: 11727 - RNA, 74 nt, Human
cuuuauuugugcgcugugagggugaaggcaaucuaucaucaacuuuucuuucccugauaugcuccagaauaaag

SEQ ID NO: 11728 - RNA, 66 nt, Human
ccagaggaagagcgcuucgagcuucuucaaggaacuuagagaagagcggcauugugcuccuucugg

SEQ ID NO: 11729 - RNA, 60 nt, Human
cggacaggacaacggcggcgcccggaaauccaaagaauucgcuccccuuugucaaggccg

SEQ ID NO: 11730 - RNA, 73 nt, Human
uugcugcugcaguuccucccucuucccuaaagaacaauagggaacaaguagaagugguagaauuucacagcaa

SEQ ID NO: 11731 - RNA, 65 nt, Human
gcgagaaggugugcauggaucugccaaauuuuauauuucagauuuguggaagguuacuuuuucgc

SEQ ID NO: 11732 - RNA, 73 nt, Human
gaaaauucuacuucaaaggaaaguuauaucacagaugauauuggaauaucgacuuggaaggagcagacuuuuc

SEQ ID NO: 11733 - RNA, 68 nt, Human
ugaguccugccuucuuuguggaacugguucccaacaaaguuggagaaacaaagggcccgcagguuuca

SEQ ID NO: 11734 - RNA, 64 nt, Human
ggcucuuguguucacuuuaaaacccauuggucuuacagggauucaggugaaauuccaaggugcc

SEQ ID NO: 11735 - RNA, 78 nt, Human
gaggaagauuucggaggcacaggaaacuuuuuaccagcaggugaagcagcugucagaggcuccuguggauuuggccuc

SEQ ID NO: 11736 - RNA, 62 nt, Human
cugagaauuucucuugcaugccuuagcuuuacagcuuuugcauuccuguggauuauucucag

SEQ ID NO: 11737 - RNA, 80 nt, Human
aguuguggaacugagucuauauacuggugaguuuaugggguugccuccccaguucuuauuagacucacagguuuauaacu

SEQ ID NO: 11738 - RNA, 62 nt, Human
caggccuucuucucuuaaucacaagauccuuucaggcauuuacucuugagggaacaggucug

SEQ ID NO: 11739 - RNA, 130 nt, Human
ggaacgagauggcgguucucuggaggcugagugccguuugcggugcccuaggaggccgagcucuguugcuucgaacuccaguggucagaccugcucauaucucagcauuucuucaggaccgaccuauccc

SEQ ID NO: 11740 - RNA, 68 nt, Human
uugccucugcuugucaugccauuaagcucccaaauaaggaagaaacucacagauaaguccauuggugg

SEQ ID NO: 11741 - RNA, 67 nt, Human
agucuucacuucaauaagcacacaauguuguuucauuuuaguggcuuugggguaguuuaugaagacu

SEQ ID NO: 11742 - RNA, 86 nt, Human
ucuuuucaguaauuucauccucuuuaucuaccuguucuauuuugcguuuuuuagaacagguuggaaguguggagucaccagaagga

SEQ ID NO: 11743 - RNA, 73 nt, Human
uucucuucuuccugagcucagaacauuuuggucauaaucaugagcuuagaaauguucugaagggaguacagga

SEQ ID NO: 11744 - RNA, 91 nt, Human
uuuguuucauuauuuggaacucaauaauagagacuuuaaguacaaauugugagucuaggagaauuuuugauuuccacagaugagaaauaaa

SEQ ID NO: 11745 - RNA, 69 nt, Human
cucuucaucaguacaccacugugagccgacugaaaugauaaucacuugaagcuaucauuggugggagag

SEQ ID NO: 11746 - RNA, 75 nt, Human
gugugccagacuuccguugagucacauauagacaggaccaaaacauacgugacucuuguuagccacuggcaacau

SEQ ID NO: 11747 - RNA, 60 nt, Human
ggagcggggaagcgaagugcgagagaccccggaccccagcgcugucucuucccgccgccc

SEQ ID NO: 11748 - RNA, 72 nt, Human
gaauccuucacuccaguuaauggcacugcucacuuccugccucugcugccaccaucacugugugaagcuuuc

SEQ ID NO: 11749 - RNA, 63 nt, Human
caauuaauacuuugaagaauuugacuguuagguuuaaagacaguuuucccaaaguucauauug

SEQ ID NO: 11750 - RNA, 60 nt, Human
guacagggagaucuggaguucuguuuccuccuguuggauucuagaacuccauguuaguac

SEQ ID NO: 11751 - RNA, 66 nt, Human
caccuacagucccagcuacuaggcagguugaaaaucgcuugagccugggaggcagaggcuguagug

SEQ ID NO: 11752 - RNA, 63 nt, Human
ugugcgagugaugggaaggcgggcauuauggcccuaugggcuuuuaaccuguacccgugcaca

SEQ ID NO: 11753 - RNA, 87 nt, Human
ucaaggccccaaggugaggcaaaucccuggaaggcuugaacccugcaguucagucucccgggguaaucacuccccaauaagcaguga

SEQ ID NO: 11754 - RNA, 63 nt, Human
uggggcacugaggcccggggauguaggcacuggacagcagcaacccaggcauucugugcccca

SEQ ID NO: 11755 - RNA, 70 nt, Human
gguuggggauuauggcuucagcacucugccggagcacauuccugagcgcugacaacguggagcccucacc

SEQ ID NO: 11756 - RNA, 87 nt, Human
gcucacaauuuugcuggcuagaagguugggcauccggugaaagccucaggcugcuuccauucauagcaaagggcagccagugugugc

SEQ ID NO: 11757 - RNA, 68 nt, Human
ugcuggcucaagugugauaaggaugagcacaaccacaaagauaucauuuuuaaugacaagagcuagua

SEQ ID NO: 11758 - RNA, 64 nt, Human
guagaauccaggcguuuaguuggaucauaucauaaguauccaugaagaaaacgucaugaucugc

SEQ ID NO: 11759 - RNA, 71 nt, Human
ugcaauccuugguuccagaacccagcaauuccuaucaucacaauuguuucaagucuuauccaagcccugua

SEQ ID NO: 11760 - RNA, 101 nt, Human
gggcugaaauacacccguggucuccggaagcgccucaggguugggaagauggggaaacuccagccgggcauccacuccagaccggggguguggcucaaccc

SEQ ID NO: 11761 - RNA, 62 nt, Human
uuuggcauugaacuaaaugcugagguuuuuccuagccuggaagugagagguuuggugccgaa

SEQ ID NO: 11762 - RNA, 67 nt, Human
cguucagcaaggacccaagagcgcggggcgauaacccaccuaugcucaggggaacccucgcuaaacg

SEQ ID NO: 11763 - RNA, 84 nt, Human
ugcacuggcaccuagacauguacaacaggaaccguguggauacaucccccacaccuguuucuguggcauggucauguguaugca

SEQ ID NO: 11764 - RNA, 60 nt, Human
cugcaggagaagauggcggucuccacaggaguuaaaguuccucguaauuuucgcuugugg

SEQ ID NO: 11765 - RNA, 109 nt, Human
gcaaguuccuuuauuuuugaaugggaaugccuuacagaauuuaaaagaaacuuuaaacguggauguuuugguacaacuuauagaaaagguaaaggaaaccccaacaugc

SEQ ID NO: 11766 - RNA, 60 nt, Human
ccaugacacaguucugucuuggccagggaccuggcugguggagagguggaaguugcaugg

SEQ ID NO: 11767 - RNA, 61 nt, Human
gcuggagccggaggccgggcgcggaguuggucuccgccgcccgaggucagccgcuccgcgc

SEQ ID NO: 11768 - RNA, 64 nt, Human
ugaugcgcaaggccauccgagggcaccuggaaaacaacccagcucuggagaaacugcugccuca

SEQ ID NO: 11769 - RNA, 67 nt, Human
cuccucuggacuuuucgguucccuccccuguuguaacuaggggagggugagugucuguguaggggag

SEQ ID NO: 11770 - RNA, 81 nt, Human
cuuggacuuccccucccagcucguguacggucucccaccucuggagccccauccccgcgcugguggggggauaauucuagg

SEQ ID NO: 11771 - RNA, 71 nt, Human; identical to SEQ ID NO: 1145

SEQ ID NO: 11772 - RNA, 67 nt, Human; identical to SEQ ID NO: 1146

SEQ ID NO: 11773 - RNA, 78 nt, Human; identical to SEQ ID NO: 99

SEQ ID NO: 11774 - RNA, 80 nt, Human; identical to SEQ ID NO: 100

SEQ ID NO: 11775 - RNA, 65 nt, Human
cggagggucugggaaggguggcguuggcccguucugacagaggccucccuggccagguccauccg

SEQ ID NO: 11776 - RNA, 64 nt, Human
guccaagguucacucguuagccccucagcgucagcucaagcugggugguccgguccccuuggac

SEQ ID NO: 11777 - RNA, 113 nt, Human
uuucuaacacuggccucagcacuaguucccugagacuuccuuagguugucauggaaaccagccacaccuggagaggcaucagggcccacugggcuuguggugggaucgagaga

SEQ ID NO: 11778 - RNA, 63 nt, Human; identical to SEQ ID NO: 8208

SEQ ID NO: 11779 - RNA, 81 nt, Human
ucuuguguugagacuucgugguggugcuaagaaaaggaagaagaaagucuuacaccacucccaagaagaauaagcacaaga

SEQ ID NO: 11780 - RNA, 87 nt, Human
ggggcugugaugucagccacugaggguguugugcucacguucgagggcccagcacaaaaauccuuguaugacaucucaugcugaccc

SEQ ID NO: 11781 - RNA, 61 nt, Human
ucuccaacaauaaccacugguccuugguucacuacuuacuccagaaagacauauacggaga

SEQ ID NO: 11782 - RNA, 70 nt, Human
gucucagggacaccauguagagaauuuggucucgauucagaaaagagaaagagccagugguuguugagac

SEQ ID NO: 11783 - RNA, 80 nt, Human
ggccccacguggaguuuuuccgagcucaccguauugggagaggacccguuuguuaguauucgggagaaaaacguggcgcc

SEQ ID NO: 11784 - RNA, 85 nt, Human
gagaaaccuuuuuaaaaaauggagaugaauguuacagaauuggacaacccgaacugcuuuucaaaaccagaggaaggagguucuu

SEQ ID NO: 11785 - RNA, 73 nt, Human
uuuuuugcuuucaggaaagguuuauuguggugagugccuucuguacagucgacugcaaaugaaacgcagagga

SEQ ID NO: 11786 - RNA, 64 nt, Human
ccuccaaagccgaaacagaccagagauaguacuuucauggagaaguuacaugcgguagaugagg

SEQ ID NO: 11787 - RNA, 70 nt, Human
gcccauggaugacagucucauugcauuucgaacgcguucuaagaugccccugaaagauguuccccugggc

SEQ ID NO: 11788 - RNA, 66 nt, Human
agacuuaaaugggucacagugacgacauguuaacaacgucccuguuugguccugaaauuuaagucu

SEQ ID NO: 11789 - RNA, 70 nt, Human
ucaaggagauugucguucauccagaacucuugcagcucuguuagauggcugauauuuucaaucuuuuuga

SEQ ID NO: 11790 - RNA, 90 nt, Human
ggaccuuuguaggagaggcuaauauguuuaaguagaagauauuacugauagcauuuuccccaugcuccuacauaaaaaauaaauauuucc

SEQ ID NO: 11791 - RNA, 65 nt, Human
ggcagaaaugcaggaguguagcaagcaucauuuuagauggcuaugguuccucuuccgcaucuguc

SEQ ID NO: 11792 - RNA, 68 nt, Human
cgucacucgccgagguuccuugggucauggugccagccugacugagaagaggacgcucccgggagacg

SEQ ID NO: 11793 - RNA, 61 nt, Human
ggcaucagcaguccuuaaaggccugagcuugcaacacucaggcaggacucggcugagggcc

SEQ ID NO: 11794 - RNA, 68 nt, Human
cuugaucaugggguggaauuuuguguaucugggcuucaugggaugcauaaaauuuuccaguugguaag

SEQ ID NO: 11795 - RNA, 65 nt, Human
aauggcuagcaaacauggagaacaccacagugaugaauccacagagcuuuucuccaugagcuauu

SEQ ID NO: 11796 - RNA, 61 nt, Human
ggaccuuucucuuuauaggaacgaugcuagaaucaccuauuuaauaaagacgaaaggguuc

SEQ ID NO: 11797 - RNA, 74 nt, Human
uuuucccauucuuggccacuuuaauucagaagaagguuuuuuuuccuuauuuucagggccaaacccggggagga

SEQ ID NO: 11798 - RNA, 62 nt, Human
ggcccgggggaccggggcuucggacaacccaggggcuccggggccacgguccuaaacgggcc

SEQ ID NO: 11799 - RNA, 67 nt, Human
cuuguaugaaagaggaaucauacgugggacaguaguuuuacguaguaaaauuuucuuuaucaucaag

SEQ ID NO: 11800 - RNA, 67 nt, Human
guaugguccuugaggagcgaaggcuagugaagcugaauaaaaugccgaauaucgacgaggaccgugc

SEQ ID NO: 11801 - RNA, 64 nt, Human
cuucccuucaguguccggguugggauacaggaaaaucgggacuuuggccuggcacggggggggg

SEQ ID NO: 11802 - RNA, 78 nt, Human
ucaacucccugccaagaaaaauguagaugcaauucuggaggaguaugcaaauugcaagaaaucgcagggaaauguuga

SEQ ID NO: 11803 - RNA, 109 nt, Human
aagaagaaaaccaaacaagaugucuggacucuuuuaaauggaagcaaagaugacuuccucauauaugauagauguggccgucuuguauaucaucuugguuugccuuuuu

SEQ ID NO: 11804 - RNA, 63 nt, Human
uucuuauauuguuguuaaucaucaaggaaucucuucucgauuaaaauacacacaucuuaagaa

SEQ ID NO: 11805 - RNA, 64 nt, Human
cuuagcucuugggaugcaggcucagcccgcuggagcaugagcucuguguguaccgagaacuggg

SEQ ID NO: 11806 - RNA, 63 nt, Human
ggugaggcaaaucccuggaaggguugaacccugcaguucagucucccgggguuaucacucccc

SEQ ID NO: 11807 - RNA, 61 nt, Human
uggggcacugaggcccgggauguaugcacuggacagcagcaacccaggcauuugugcccca

SEQ ID NO: 11808 - RNA, 64 nt, Human; identical to SEQ ID NO: 287

SEQ ID NO: 11809 - RNA, 75 nt, Human
guaagcuaugugaguuuuacaaugcuuuuaaacugucauauuuccuguugagcacuuuaacuggcacauucuuau

SEQ ID NO: 11810 - RNA, 78 nt, Human
cauuuccagauuuauuuccaauuucaguuucaaaacaaacugaccugaaauuuuuaguauuuacuaucugugacaaug

SEQ ID NO: 11811 - RNA, 76 nt, Human
ugauauuuaaaacauuuaugugguaaaauaaucucauuugauuauggauaucauaaauagaauauaaaagauauua

SEQ ID NO: 11812 - RNA, 60 nt, Human
auauaugcauguguauacacacacgcacauaaaugcauguguauuaucacacacauauau

SEQ ID NO: 11813 - RNA, 61 nt, Human
uuagacacgaagaucugagugcuagguauauucauuucugcugagguguuuuugugucuaa

SEQ ID NO: 11814 - RNA, 74 nt, Human
cuccuuguuccagggaacacucaguuucccuacaggugaucuuggggagagacuguucccaggcaacccuggag

SEQ ID NO: 11815 - RNA, 91 nt, Human
gggcccuucaccucccacuccugugcgcugcuuccggcuucuguauggacuuacucuccaggccaucgaagcucgcgcgccucaccggccc

SEQ ID NO: 11816 - RNA, 63 nt, Human
ucaagccccggacagggucuuacaucaacuauuacgacaugaacgcggccaaugugggcugga

SEQ ID NO: 11817 - RNA, 60 nt, Human; identical to SEQ ID NO: 1551

SEQ ID NO: 11818 - RNA, 68 nt, Human
guucccgcaucuggaguucaggaguauucggggaaaccucaacacccggcuucggaagcuggacgagc

SEQ ID NO: 11819 - RNA, 68 nt, Human; identical to SEQ ID NO: 10839

SEQ ID NO: 11820 - RNA, 74 nt, Human
ggggagcaauuccagagaaggccuaacuuccaacagcccaggcuuuucaugaacuauucuggucguuguuucuc

SEQ ID NO: 11821 - RNA, 82 nt, Human
augcgugacgccaucccgcagcucauccagcuggaccaggcgaagccccuggccgcugugcugaaggaggugugcgacgcgu

SEQ ID NO: 11822 - RNA, 60 nt, Human
ugagagcgucugcuugauaauggauucugaauuaaugcauaguauaguaggaagcuauca

SEQ ID NO: 11823 - RNA, 92 nt, Human
ccaacucguccaacugacaagcccuugcgccugccucuuccgggaugccuacaaaauuggugggauugggacugucucuguuggccgaaugg

SEQ ID NO: 11824 - RNA, 60 nt, Human; identical to SEQ ID NO: 1551

SEQ ID NO: 11825 - RNA, 66 nt, Human; identical to SEQ ID NO: 3532

SEQ ID NO: 11826 - RNA, 60 nt, Human
ggugacaacaugcuggagcccagugcuaacaugccuugguucaagggauggaaagucacc

SEQ ID NO: 11827 - RNA, 60 nt, Human; identical to SEQ ID NO: 1551

SEQ ID NO: 11828 - RNA, 131 nt, Human; identical to SEQ ID NO: 1788

SEQ ID NO: 11829 - RNA, 60 nt, Human; identical to SEQ ID NO: 1551

SEQ ID NO: 11830 - RNA, 60 nt, Human
ccuucuagaugcuuauuuuccaccuuuuccuacagaagguaauauucaguuaccagaagg

SEQ ID NO: 11831 - RNA, 86 nt, Human
agccuggcccauggaggcauguucagggaucagcacuacugugcuucuuggaggaggugggacuugagcuggacccaugggaggcu

SEQ ID NO: 11832 - RNA, 77 nt, Human
cccugcauuccacucaucagcuucacaaguagguuuucaccuggucauagcuaugccuaacuacagggagugcuggg

SEQ ID NO: 11833 - RNA, 72 nt, Human
agccaaagcuuguuuccuuuuucuucccauccugaguucagugugaaguauagggaagaacaacaccaggcu

SEQ ID NO: 11834 - RNA, 68 nt, Human
caucuucucagucacuuaacacaaaucaggacacucuguaugcucaccacgguguaggagaugagaug

SEQ ID NO: 11835 - RNA, 131 nt, Human; identical to SEQ ID NO: 1788

SEQ ID NO: 11836 - RNA, 61 nt, Human; identical to SEQ ID NO: 823

SEQ ID NO: 11837 - RNA, 60 nt, Human; identical to SEQ ID NO: 1551

SEQ ID NO: 11838 - RNA, 60 nt, Human; identical to SEQ ID NO: 1551

SEQ ID NO: 11839 - RNA, 61 nt, Human; identical to SEQ ID NO: 823

SEQ ID NO: 11840 - RNA, 60 nt, Human; identical to SEQ ID NO: 1551

SEQ ID NO: 11841 - RNA, 66 nt, Human; identical to SEQ ID NO: 4461

SEQ ID NO: 11842 - RNA, 102 nt, Human
ggggacuacaauggccacgucggucuggguguuaagugcuccaaggagguggccaccgccauccguggggccaucauccuggccaagcucuccaucgucccc

SEQ ID NO: 11843 - RNA, 62 nt, Human
guggcauucggggccggggucgcggccguggacggggccggggccgaggccgcggagcucgc

SEQ ID NO: 11844 - RNA, 82 nt, Human
aguaccaaggauccuuacucaguucugaaacugugacuacggagaauaugucacuauuugagaauaagaggucccaccugcu

SEQ ID NO: 11845 - RNA, 66 nt, Human
gagguacacugaagauaaagcaaaaggcaacaagcauuuuuacaagcagaucaucccaguuaccuu

SEQ ID NO: 11846 - RNA, 60 nt, Human
gagagaggccagguaggccucauccugcuguugucucagcacuugggucugguuucuuuc

SEQ ID NO: 11847 - RNA, 62 nt, Human
ggguguucucucguaaagccugugagaccccuguuccucagguuuguuuguagagcaugccc

SEQ ID NO: 11848 - RNA, 63 nt, Human
caguaaacauuccaauguccaaaucuggguuagucuuccacuuuauggcugggauguuucuug

SEQ ID NO: 11849 - RNA, 61 nt, Human
guucucagcuggcuggaaaaauugguugacauuuucuuuugguaguuguuucuuaaagaau

SEQ ID NO: 11850 - RNA, 97 nt, Human
cuugagacuuguguagacucugaugcucguaggugacacauaguaaccuuccuggugcucuggcaaccucgcagugucaugguggcaucuuuccaag

SEQ ID NO: 11851 - RNA, 86 nt, Human
ggucgccgacugcucuggggaaggagaaguccugcagggaugugacaguggcuuugguuugcuccuuggucggccccagccugacc

SEQ ID NO: 11852 - RNA, 85 nt, Human
gugcucuucagugcacgaugcugcaccgggaacuucgcuuggcccuggaagcugguuugaugugcacgucggcuugagugagugc

SEQ ID NO: 11853 - RNA, 71 nt, Human
caccucuuugggcgauuugcggggcccaagcccguguugggggcccucgcuguguguugucuucuggggug

SEQ ID NO: 11854 - RNA, 64 nt, Human; identical to SEQ ID NO: 287

SEQ ID NO: 11855 - RNA, 79 nt, Human; identical to SEQ ID NO: 1810

SEQ ID NO: 11856 - RNA, 60 nt, Human; identical to SEQ ID NO: 1551

SEQ ID NO: 11857 - RNA, 60 nt, Human; identical to SEQ ID NO: 1551

SEQ ID NO: 11858 - RNA, 76 nt, Human
uugucgucauuggacacguagauucgggcaaguccaccacuacuggccaucugaucuauaaaugcgguggcgucga

SEQ ID NO: 11859 - RNA, 75 nt, Human
agagaagauucccggagaguaaauccucuuuccaaucccgaggaacaagcauugucucucuggcaagauccaucu

SEQ ID NO: 11860 - RNA, 97 nt, Human
cuggagugauguuagcagacccagcuuagaguucuucuuucuuucuuaagcccuuugcucugggaggaagaucuccagcuucagcucacacucacag

SEQ ID NO: 11861 - RNA, 63 nt, Human
ggcaguccuacaaccaguauucucagagauaccaucagagaacaaaacuaauguuaauaugcc

SEQ ID NO: 11862 - RNA, 66 nt, Human
ggcgcuauauauggauccaauggcaagaucaucaugacagaucugcgcgcgaucgauaucagcgcu

SEQ ID NO: 11863 - RNA, 62 nt, Human
ggguggguggaggcccacaaggaauugacgacaucuuauguguagggcuggaagcauuaccc

SEQ ID NO: 11864 - RNA, 60 nt, Human; identical to SEQ ID NO: 1551

SEQ ID NO: 11865 - RNA, 79 nt, Human; identical to SEQ ID NO: 1810

SEQ ID NO: 11866 - RNA, 63 nt, Human; identical to SEQ ID NO: 1098

SEQ ID NO: 11867 - RNA, 131 nt, Human; identical to SEQ ID NO: 1788

SEQ ID NO: 11868 - RNA, 60 nt, Human; identical to SEQ ID NO: 1551

SEQ ID NO: 11869 - RNA, 81 nt, Human
gggcaaauuaaaaacauaauuuuuuuuauaacuacacagaaaccuguauguuuuuuaaaaaauuaucuuguuuauuuguuu

SEQ ID NO: 11870 - RNA, 89 nt, Human
ugggcagguagguaggggcagugaacuggagugggacagcuggaugaugaggcuccccgacccauacagggccuccccuagccuggcca

SEQ ID NO: 11871 - RNA, 75 nt, Human
gcucggaacugccgacccgagugcuucccgcagagggcugguggugggagcggagugggucgggcggggccgagc

SEQ ID NO: 11872 - RNA, 85 nt, Human
gugcaggccugcuuuggccgcucaagggaauaccagcucaacgacucagcugccuacuaccugaacgaccuggagcguauugcac

SEQ ID NO: 11873 - RNA, 64 nt, Human
gaaggaggcgccuccacuggacgagggcugcuaucucgaccauuuuccgcaccucuccaucuuc

SEQ ID NO: 11874 - RNA, 60 nt, Human
ggugacaacaugcuuggagccaagugcuaacaugccuuggucaagggauggaaagucacc

SEQ ID NO: 11875 - RNA, 79 nt, Human; identical to SEQ ID NO: 1810

SEQ ID NO: 11876 - RNA, 86 nt, Human
caugaagggauguugaauuuuuaucaaaagcuuuuuccucaccuauggagaggaucauauaguuuuuguuuuuaauucuguuuaug

SEQ ID NO: 11877 - RNA, 94 nt, Human
uauuacguugaaugagaguagugagagugggcauccuugucuugucaaaguucucaaggagaaugcuuccaguuuuuacucauucagcaugaug

SEQ ID NO: 11878 - RNA, 64 nt, Human; identical to SEQ ID NO: 287

SEQ ID NO: 11879 - RNA, 76 nt, Human
gcaugcugguggucauccuggcagcugguggguggccugguaugcugcccacucagcuugagacucacccucaugc

SEQ ID NO: 11880 - RNA, 79 nt, Human
gugaccugagaauccauuuaaccucucggucuagaaccuccuucuggaaagugagguauuaauacuugacucauguuau

SEQ ID NO: 11881 - RNA, 80 nt, Human
ccacgugaaggggcguaaaggcccuuauucccacaaauccuccggguaaaguggccccuuuuagaagccccagaaagugg

SEQ ID NO: 11882 - RNA, 95 nt, Human
uggcuacacuaaaaaaugaccugggaagccaaaggucagcucaaaagagaauuugauuaauuccugguuuuccagacgauuguuugguggacaca

SEQ ID NO: 11883 - RNA, 78 nt, Human
accccagaaguuccaaccugugccuuauaucuugaagaaaauuuuccaggaucgcgaggcagcagcgaccacuggggu

SEQ ID NO: 11884 - RNA, 82 nt, Human
gguggugauucucaaacuugaucaggugcaaccuucucggaaacgggaagcagcauuccugucccaaguuucuuguaaaacc

SEQ ID NO: 11885 - RNA, 68 nt, Human
cuuuugaggucagaggguuuguguauccaucauuuugagaaaugcagcugcucggcugucccuaggag

SEQ ID NO: 11886 - RNA, 84 nt, Human
ggccagaggggaguuccugggugcuccacaugccuguccuaggcuuuuggacaugcuggcccccagaucugccccuccauggcu

SEQ ID NO: 11887 - RNA, 89 nt, Human
uggcuuucgccaguagcugaggacgcccuuguccaucauacgguagaguugaacacagagguggaucaggcugagugccaggaagacca

SEQ ID NO: 11888 - RNA, 102 nt, Human
accugacaacuggcccuaauacuucauucaaguucgcuauaguuuuggucccucaaucccagacauaugcauaauuggauaaguagaagggaaguguaaggu

SEQ ID NO: 11889 - RNA, 65 nt, Human
uggucaaagcuuaacauuugaaaccugauuuuaaaauuucaguuuaguaagugacaggcugacca

SEQ ID NO: 11890 - RNA, 130 nt, Human
agcaugcucaguuaaauuugaauuucagacaaacaaugaaugcuuuuacuguaaauauaugccaaauauugcaugaaacauucuuaacgugaaauuguuucucugaaauucaaacuuaacugggcaucuu

SEQ ID NO: 11891 - RNA, 60 nt, Human
agguuaaguuccuugaugcccuccuuuggaaagaaguggagggugagggaaaaaggacuu

SEQ ID NO: 11892 - RNA, 71 nt, Human
gaagucauuuuuuuucuugucauuccuuuuguaguaaguugcuguuuggauaaaaguugaugugugauuuu

SEQ ID NO: 11893 - RNA, 83 nt, Human
uuugcagcuaacuacuauguguagacagguuuuauauuauaaaguaugcauucuuaucaccuaguauauaguuaguuuguaga

SEQ ID NO: 11894 - RNA, 68 nt, Human
uguuuuuuauguuaaacuuguaucccuuuaaaaacugaaggaaauuacaaaaaaaaaacaaaaaaaca

SEQ ID NO: 11895 - RNA, 65 nt, Human
uucugguguaucaaagcacaugacuaaaaugaaaucaugguaucugugaauuuuauaagcuagaa

SEQ ID NO: 11896 - RNA, 62 nt, Human
gcuuuccuuuccaagaggaauccucggcagauaaacguggacuguccucuacagaaggaagc

SEQ ID NO: 11897 - RNA, 67 nt, Human
gaaugcagaaaaugaguaucagacagcaauuagugaaaacuaucaaacaaugucagauaccacauuc

SEQ ID NO: 11898 - RNA, 66 nt, Human
acgaggcgggugaaggcuguggguguccuggcgucccugggccaccugucagccccucguccuggu

SEQ ID NO: 11899 - RNA, 95 nt, Human
acucacggcgugucccucugaccagguggacggcgaguacagguaccgcugcggcacuugugagaagaccuuccgcaucgagagcgcgcuggagu

SEQ ID NO: 11900 - RNA, 97 nt, Human
gggugguggaggucagagucauaacagacacaggcguggagucgcccgggcagcacgucgggggcucggcaucuguggacucugcgcugggccaucu

SEQ ID NO: 11901 - RNA, 77 nt, Human
ccccagccagaaucgacgugagugugaugaccgccccggucgugaagacauaccagcucaacagguucaauuugggg

SEQ ID NO: 11902 - RNA, 70 nt, Human
guucccgagcacggucgggaugaccgggaucaggaagaaccacaccaucacgaucccgugcgcggugaac

SEQ ID NO: 11903 - RNA, 60 nt, Human
guuguauaacucggccgugaccagugccccgcggggcguaaucagguucagccgaacgac

SEQ ID NO: 11904 - RNA, 82 nt, Human
acuaucugacaagagauaaccucugggugguuugucacuauggugaagugacaaaugacuuuggucauugcugaaagguggu

SEQ ID NO: 11905 - RNA, 61 nt, Human
gaucaacaagaagauuuauaagauguggcaggguuaccuuaucaaggacggaagguugauc

SEQ ID NO: 11906 - RNA, 63 nt, Human
gaugaccuaaguucuugaccacucaaguuggcauggcgguucaagacaugaugagaggaaguu

SEQ ID NO: 11907 - RNA, 72 nt, Human
ccggauggaacguacucugugcuuauaucaucacagagcuuggaugaaagagagcgagaagaguucuauagg

SEQ ID NO: 11908 - RNA, 63 nt, Human
aaggggaguuuaaacaaguggaugcuuuuaauguccuguauguugacuuauguaauucccuuu

SEQ ID NO: 11909 - RNA, 63 nt, Human
ccagauaucgguggguggcauuaacagaagacacugaagaacauuaccuaagagauuaucugg

SEQ ID NO: 11910 - RNA, 81 nt, Human
gcgccacugucagcuuagaaggggccuuagggaaccuggcaggaggagucccugaggccaacucuuccugauuuauuuugc

SEQ ID NO: 11911 - RNA, 101 nt, Human
gaggagaaguacuaaaacuuuauaaaaaucugcuguaucuuggacgagacuaucuaaaaggagcagacuauuuuaaaaagcguuugaagaacauuuuccuu

SEQ ID NO: 11912 - RNA, 67 nt, Human
ugcucaauuuugauaccaaaccauagcacauuuagcuauacuaccggaucauacaauuaacugagca

SEQ ID NO: 11913 - RNA, 61 nt, Human
agcacacuguaggaacuguagaccccaaguugaaaacuuguucuauggaaccaaaguagcu

SEQ ID NO: 11914 - RNA, 119 nt, Human
cucuuuagguauuagagccucuuagaugagguauaauuuacugcaaagaaaaaaaauuguuauaauuuugccauaaguuaugccuauuuagauggcuguauaacugguacuuugaagag

SEQ ID NO: 11915 - RNA, 67 nt, Human
guuguagcaguaaaauacauuuuguuaccaugaaucuuugaaaacaaaagaacuucacugagacaau

SEQ ID NO: 11916 - RNA, 79 nt, Human; identical to SEQ ID NO: 1810

SEQ ID NO: 11917 - RNA, 69 nt, Human
uuguuuuuaauuuauuuugucauauuuuuguaaaacggcagaaaugcaauaaaaacuauauuucaacag

SEQ ID NO: 11918 - RNA, 72 nt, Human
ggaucguggcgcgcauggcccuggugccgcgcacccuggaggcgcgcggacuggacgccacgccgcugaucc

SEQ ID NO: 11919 - RNA, 84 nt, Human
acgaggaggucccuagucaggaccgagcaggggaguaggauaggaauccccgccgcaccuuuguacgagccugaccccuuccgu

SEQ ID NO: 11920 - RNA, 76 nt, Human
gccccgagcgcgccuggaagccccgggcaaccggccagggccgggcacaggugggguccgucaggccgcccggggc

SEQ ID NO: 11921 - RNA, 60 nt, Human
guugccaccgaggaggcggcggcccugcgucuggaacgccguugccaccgaggaggcggc

SEQ ID NO: 11922 - RNA, 83 nt, Human
ggccuucuauccugggcugcaacauccuucgaguugaauauuccuuacugaucuauguuagcguuccuggauccaagaagguc

SEQ ID NO: 11923 - RNA, 92 nt, Human
uucucagaugggcgggugucugucucugcucgaauugacagaaaaggauucugugaaggugaugagauuuccauccaugcugacuuugagaa

SEQ ID NO: 11924 - RNA, 82 nt, Human
gaacuugaagaauugaaacaaauuguucccaaagaaucccucguuuacuucuuaauaggaaagguuuacaagaaguuagguc

SEQ ID NO: 11925 - RNA, 108 nt, Human
uuugugaagaugauugggaaaucaaauaaguaaaaacgcugggucaaaacuuuaaaaauuuuggcuacuuuaagguuuuucuuugccuuuuucagucugcuuuacaag

SEQ ID NO: 11926 - RNA, 63 nt, Human
ccagcuuuccugccagaguucugccgaggcccaccagcuggucuuaugguaaaguuaagcugg

SEQ ID NO: 11927 - RNA, 73 nt, Human
gcugccacacagagggcuugcuuccaguugccacaugugagaaaggcugagagagcuuucucgugggcaccgc

SEQ ID NO: 11928 - RNA, 64 nt, Human
gggcaccgcaacgggcaaacaugagccccgcuggcucauacaugugcuccugcaucaggugcuc

SEQ ID NO: 11929 - RNA, 62 nt, Human
ugagcuuggugaauauaacuucagagcuucguuauacaaguuuuuaucuuuuaucaaguuua

SEQ ID NO: 11930 - RNA, 81 nt, Human
aucaacuuccaauaccugcugccugucucccugacccaugaaucuggcaacguuaggcacagucagacauggacaguugau

SEQ ID NO: 11931 - RNA, 106 nt, Human
gcuuggagccucccccagagguguggcaggugcugaagacccaccccggagacccccgcuuccagugcagucucuuggcaucucuauccccuaugaggcaccacgu

SEQ ID NO: 11932 - RNA, 75 nt, Human; identical to SEQ ID NO: 7168

SEQ ID NO: 11933 - RNA, 65 nt, Human
ggccucggugacugccugguuaagaucuacaaaucugaugcggaucaagggccuguaccaaggcu

SEQ ID NO: 11934 - RNA, 64 nt, Human; identical to SEQ ID NO: 7014

SEQ ID NO: 11935 - RNA, 86 nt, Human; identical to SEQ ID NO: 7015

SEQ ID NO: 11936 - RNA, 88 nt, Human
gagggggcaagucacaugggcagagauagccgugugagcagucucagcucaagcugccccccauuucuguaacccuccuagcccccuu

SEQ ID NO: 11937 - RNA, 73 nt, Human
uguugcuauuuccuaaccugcaggcagaaccugaaagggcauuuuggcuccggggcauccuggauuuagaaca

SEQ ID NO: 11938 - RNA, 91 nt, Human
ggagaaucacuugagcccaggaggcggagguugcagugggagccaagauaacgccauugcacuccagccugggcgacaagagugagacucu

SEQ ID NO: 11939 - RNA, 95 nt, Human
ggccgggcaugguggcucacaccuauaaucccagcacuuugggaagccgaggugaguggaucaucugaggucaggaguuugagaccagccuggcc

SEQ ID NO: 11940 - RNA, 66 nt, Human
ggcauguggcagguccauaugacaugaaagagacugaaaaauauuuauacuauguggccacaugcc

SEQ ID NO: 11941 - RNA, 64 nt, Human
uuucugcuguauauuacacuggcuacuacuuaguccuauguaugcuucuaguauauuacagaaa

SEQ ID NO: 11942 - RNA, 69 nt, Human
gagaaugggggaggugugugacagccaugcuggacucagaagcaggugucauaaacugccccagcucuu

SEQ ID NO: 11943 - RNA, 86 nt, Human
ggagaaucacuugaacccaggaggcagagguugcagugggccaagauugcaacacugcacuccagccugggcaagagcgagacucc

SEQ ID NO: 11944 - RNA, 73 nt, Human
aucauaauucuggagggaagcucuuggaggcugugagucucccuguacaguguuaccauccccgacaucugau

SEQ ID NO: 11945 - RNA, 102 nt, Human; identical to SEQ ID NO: 2701

SEQ ID NO: 11946 - RNA, 87 nt, Human; identical to SEQ ID NO: 4680

SEQ ID NO: 11947 - RNA, 90 nt, Human; identical to SEQ ID NO: 2702

SEQ ID NO: 11948 - RNA, 60 nt, Human; identical to SEQ ID NO: 5595

SEQ ID NO: 11949 - RNA, 103 nt, Human
ccuuuccugauuuugcauguucucauucccaaaguagucuaccuuaguuuacacucaaagguagcacuuguugaaacuacaugacagaaacaggcugcaaagg

SEQ ID NO: 11950 - RNA, 70 nt, Human
gcugaauuauaauuagccacacaaauaaugagaguuuuauuuuuuuuuuucuggcucacuccaaaucagc

SEQ ID NO: 11951 - RNA, 64 nt, Human; identical to SEQ ID NO: 3714

SEQ ID NO: 11952 - RNA, 122 nt, Human
gacaucuggagccugggagucauccuguacacccucgucagcggcuccugcccuucgagggcacaaccucaagagcuggggagcgaguacucagagggaaguacgggucccuuccuaauguc

SEQ ID NO: 11953 - RNA, 60 nt, Human
auccaacacuucugucuucagggagaguacagcuuguugugggggauggaagaaugggau

SEQ ID NO: 11954 - RNA, 84 nt, Human
ggaggcauauguggcuuuggcugcucucaccaacagcaauaugacugcuaaaagaaccaacccaggacagagccacaaucuucc

SEQ ID NO: 11955 - RNA, 79 nt, Human
guaucucuguuuacuauccucuuggcucuugguggaauugaauucaucuugugucuuauucaaguaauaaauggagugc

SEQ ID NO: 11956 - RNA, 77 nt, Human
cugggguguuuauggcaagucacuuugacagacauuauuguggcaaaugugucugacuuacuguuucaacaaaccag

SEQ ID NO: 11957 - RNA, 65 nt, Human; identical to SEQ ID NO: 247

SEQ ID NO: 11958 - RNA, 80 nt, Human; identical to SEQ ID NO: 100

SEQ ID NO: 11959 - RNA, 76 nt, Human
ccggagcccccgcccccacgcacacauuacuccaacauuggaggccaacgagagugaggagguccggcaguuccgg

SEQ ID NO: 11960 - RNA, 90 nt, Human
agguuuuucuaagagaaagguccucaaagauucagugugcuugguuacugguauucuuagcaggaucuucuguucuuuuauauuacaccu

SEQ ID NO: 11961 - RNA, 76 nt, Human
uauuggugccuucuuucaucaugccuuuuaaaucuaaggguuacugguauaugcuuuuagaagaauugugucaaua

SEQ ID NO: 11962 - RNA, 61 nt, Human
gguccgucuucuuccugcugcugccgggaccuucugcggccgaugagaagaagaaggggcc

SEQ ID NO: 11963 - RNA, 68 nt, Human
ccgcuuaauuuuuuaccugaaaaaccggauuugauucaagugggguucgcagguagaagaaguaacgg

SEQ ID NO: 11964 - RNA, 71 nt, Human
gaaggccuguguuguuaaucuuuaucugugagaggaucucugugagauacgauaugauaaacaggcacuuu

SEQ ID NO: 11965 - RNA, 80 nt, Human
aacaugaauguguugagucauccucuccugguaauggcaguaaggaggcugggaugaggguggagcaccacucaacuguu

SEQ ID NO: 11966 - RNA, 72 nt, Human
gcuggauugauuguaucauggugauuuaugaucacuauaaucauuaucuauaauugcccaaauccaauuagc

SEQ ID NO: 11967 - RNA, 61 nt, Human
caucuccugugggcuuguuggguauagaagcuacucuaagacccaaccagauaccaugaug

SEQ ID NO: 11968 - RNA, 61 nt, Human
ccaugaugccacuguuaauucuguuugcucuucuaauuaaccuaagcuaguguguaugugg

SEQ ID NO: 11969 - RNA, 101 nt, Human
cuggacaccaguagguagugucaagccagagauucggggcaguagauaaauguucauuuuacugaugcacuuuaguuuuuggucuguuaccuguuuuccag

SEQ ID NO: 11970 - RNA, 65 nt, Human
gauaaggaccuguuuggugcagcagggagcaaaaucuccuuuaacaaccaagcaguuccucauuc

SEQ ID NO: 11971 - RNA, 84 nt, Human
ugucccaagcaaggauagggaaggggaagugguugagccucuggagaucauuguaaccaauccugucagaccugguuuggggca

SEQ ID NO: 11972 - RNA, 84 nt, Human; identical to SEQ ID NO: 286

SEQ ID NO: 11973 - RNA, 89 nt, Human; identical to SEQ ID NO: 288

SEQ ID NO: 11974 - RNA, 61 nt, Human; identical to SEQ ID NO: 776

SEQ ID NO: 11975 - RNA, 76 nt, Human
uggggugguacuguugucaccugccuccaggacuuucccugugauaaacuggugacacgccucacauuucacccca

SEQ ID NO: 11976 - RNA, 87 nt, Human
cugauauuauccugggauaacgauaugugguacaauacucuuauuugagauauuaaacacuucauuauaaaauagguuuuguauuag

SEQ ID NO: 11977 - RNA, 75 nt, Human
gauuuugcccagcuaaaggccaacguuaaguguucagaacacauuuaagauaggcuaggcuaagcugggauguuc

SEQ ID NO: 11978 - RNA, 70 nt, Human
uugacuuaugguuuuucaacuuuauaauggggcaaaagcaauacacauucaguuaaaaacuguacuucaa

SEQ ID NO: 11979 - RNA, 126 nt, Human
agcuggcuucuacacggccauuugggaaccagaagucccuauucuuagauacuuaauccuuuagggggcuguugugaaugggaaugggguauaucauuuugacaugugguuggaugggggcaaguu

SEQ ID NO: 11980 - RNA, 78 nt, Human
cggucuccuacuucauaacuugaguucggggauuucacgggggauaaucugggggcgggguauagggguaggguaccg

SEQ ID NO: 11981 - RNA, 102 nt, Human
uccugggucccaggaagauugagggaggggaugcugcagauguggaaguccaguuuucuuaccaccuugucagaauuuuuucccuucucuggggucccagga

SEQ ID NO: 11982 - RNA, 67 nt, Human
uucugugaccuuacuaaacguugggaauaaguucuaguaggaucaacauuggauaaaggucacggga

SEQ ID NO: 11983 - RNA, 64 nt, Human
auaagaucuaagaguuaccuggguacagaaagaagaugccagaugacacuuaagaacuacuugu

SEQ ID NO: 11984 - RNA, 81 nt, Human; identical to SEQ ID NO: 201

SEQ ID NO: 11985 - RNA, 62 nt, Human
cauccgcaggguucggaugagaccagguguugcuuguucaguaucucaagcccagaaagaug

SEQ ID NO: 11986 - RNA, 63 nt, Human
guggacuggugggggcugggcguggucauguacgagaugaugugcggucgccugcccuucuac

SEQ ID NO: 11987 - RNA, 63 nt, Human
acaacuaaguuaaaauguugaugugaguuuuauuucacauggauggaauaaacuugugguugu

SEQ ID NO: 11988 - RNA, 64 nt, Human
gaggucccagcacauguguuuucaagaggccacuaggcauucuucacugagugcugcugacuuc

SEQ ID NO: 11989 - RNA, 76 nt, Human
gggugugggaugcuucgccaggucaugugcuauauugucucauuuuuguaguacuuuuacacguuguaugacaccc

SEQ ID NO: 11990 - RNA, 65 nt, Human
uccguuauuuuaaugcgcuacacccacagaaauguuuaagugggcacaagggcuuaauuuaugga

SEQ ID NO: 11991 - RNA, 100 nt, Human; identical to SEQ ID NO: 698

SEQ ID NO: 11992 - RNA, 60 nt, Human; identical to SEQ ID NO: 2705

SEQ ID NO: 11993 - RNA, 72 nt, Human; identical to SEQ ID NO: 1989

SEQ ID NO: 11994 - RNA, 76 nt, Human
agcagggcccgagcuggaagcgcaaggcagccgccgccgugccgcuccucccuugcccucaggccaggucccugcu

SEQ ID NO: 11995 - RNA, 88 nt, Human
cgcugggcugugcggugcggagggugaugaggaugucuggugacagccgugcggacaccacuccucucugcagcacugccucccagcg

SEQ ID NO: 11996 - RNA, 99 nt, Human
gaauuagaaacccauccuucaagcacaauaaucaucacagacuugaguuugcuuccuaaagcaaaggcuccggguuuguuuggaaaauuuuucugauuu

SEQ ID NO: 11997 - RNA, 95 nt, Human
gcggcugcaucuuccugucagcccugguuuccauggugacuggcgucacgcagccacccgaguauggcugaccuuccugcagagagaggagccgc

SEQ ID NO: 11998 - RNA, 63 nt, Human
gagagagagagagagagagagagagagagagagauucucucccccagacgugaugucucucuc

SEQ ID NO: 11999 - RNA, 97 nt, Human
guaggccgccgccgaacgagccgccuagucgaccgugauuggagucguccucccucaucccgucagcagcuagcgcucgugcggucggucguccugc

SEQ ID NO: 12000 - RNA, 60 nt, Human
cccugggaugcgaagcuuucuuugagccuuggcacagaguauggaaguagcuccgagagg

SEQ ID NO: 12001 - RNA, 83 nt, Human; identical to SEQ ID NO: 3404

SEQ ID NO: 12002 - RNA, 70 nt, Human
gguaugagaacuccuaugggucccccaauggggauccccccuuggaagagggacuccaauggggcaugcc

SEQ ID NO: 12003 - RNA, 60 nt, Human; identical to SEQ ID NO: 8077

SEQ ID NO: 12004 - RNA, 72 nt, Human
cugccucuucuccugcuggcagguacacuucuucaggcuguguccucugugcagguagguaggggauggcag

SEQ ID NO: 12005 - RNA, 90 nt, Human
ucauggucucagcgaauagcggcccuuagggcuggccccuuacaugugugagugcccagggcugaggguggcuggccaccugaguccuga

SEQ ID NO: 12006 - RNA, 69 nt, Human
cugcucuuugacacugcuuuugguacccuggguggccuauuucaggugguuuuuagugucugcaagcgg

SEQ ID NO: 12007 - RNA, 67 nt, Human
gucacccgcuauccugccaacucuaucguggucguaggaggcuguccugucugcaggguuggggugc

SEQ ID NO: 12008 - RNA, 75 nt, Human
ggaccaguuggggcggaaagggaaaaccgccuggccggccaguugcaaaggccuuuucgccgcgaauaagggucc

SEQ ID NO: 12009 - RNA, 80 nt, Human
uggguccccgggggcccuuggggggaaccaaaaacuugacaagucaccccucccccgaaggaaaaacccccgugggucca

SEQ ID NO: 12010 - RNA, 64 nt, Human
ggggcgggugcuagugacccugggccuggcucucagccgcccagggccccuccacaccagcccc

SEQ ID NO: 12011 - RNA, 67 nt, Human; identical to SEQ ID NO: 1146

SEQ ID NO: 12012 - RNA, 62 nt, Human
gacacaucgcugacuuggcuggcaacucugaagucauccugccagucccggcguucaauguc

SEQ ID NO: 12013 - RNA, 61 nt, Human; identical to SEQ ID NO: 776

SEQ ID NO: 12014 - RNA, 69 nt, Human
cugugaggcuguggccaucuacggcaucaucauggcaauugucauuagcaacauggcugagccuuucag

SEQ ID NO: 12015 - RNA, 97 nt, Human
gccaucggaacuaccaugcaggcuacuccauguuuggggcuggccucaccguaggccugucuaaccucuucuguggagucugcgugggcaucguggc

SEQ ID NO: 12016 - RNA, 76 nt, Human
gcgggacggacgguggacgcugggacgcguuuguagcuccggccccgccguuccgagcccccgccgccgucgccgc

SEQ ID NO: 12017 - RNA, 84 nt, Human; identical to SEQ ID NO: 286

SEQ ID NO: 12018 - RNA, 64 nt, Human; identical to SEQ ID NO: 287

SEQ ID NO: 12019 - RNA, 89 nt, Human; identical to SEQ ID NO: 288

SEQ ID NO: 12020 - RNA, 75 nt, Human
cuggggcuguuaaauuacauuuuauuggcauaagguugcacugcaaucugccaguaucacauaaugauaauccag

SEQ ID NO: 12021 - RNA, 129 nt, Human; identical to SEQ ID NO: 5625

SEQ ID NO: 12022 - RNA, 94 nt, Human
guggggcccgugggcagcugggcaacuggauguccccagcugauuuccagcgagcuguggaugagagguuuccaggcugcaugcagggccgcac

SEQ ID NO: 12023 - RNA, 74 nt, Human
uggcaggacccgcuggugcuggacggagcagcugaccacagacugagauccucaucacgggacaccuuccgcca

SEQ ID NO: 12024 - RNA, 82 nt, Human; identical to SEQ ID NO: 6291

SEQ ID NO: 12025 - RNA, 116 nt, Human
gcuccggcggcccccggcgcccggcuguugcggcucccgguggagcggggccugugcaugugccgcugagcccggagcgcgccggcuggaccgaggcugcugcgggccgccguggc

SEQ ID NO: 12026 - RNA, 68 nt, Human; identical to SEQ ID NO: 813

SEQ ID NO: 12027 - RNA, 81 nt, Human
gguuugaauaugaaggcacaccacugaaauggcauuauccaauugguuugcuauuugaucuucuugcaucaaguucagcuc

SEQ ID NO: 12028 - RNA, 75 nt, Human
gugugguuuggacgaauuccaacuuguuucacgcuauaucaggaugagauaacugaaagggaagcagaaccauac

SEQ ID NO: 12029 - RNA, 91 nt, Human
cuggccacauaugccccugucaucucugcugagaaagccuaccaugaacagcuuucuguagcagagauuaccaaugcuugcuuugagccag

SEQ ID NO: 12030 - RNA, 65 nt, Human
uaggucaaauuguguccuccaucacugcuucccugagauuugauggagcccugaauguugaccug

SEQ ID NO: 12031 - RNA, 72 nt, Human
uggugaaaugugaccucgccaugguaaauacauggcuugcugccuguuguaccguggugacgugguuuccca

SEQ ID NO: 12032 - RNA, 61 nt, Human
gggaggugaagaauaaaaggaugggagguaauucaucacuguccuuccacuaaucacuccc

SEQ ID NO: 12033 - RNA, 74 nt, Human
uuguuacugcuuccauuuuaggacacuuuaagugcaaacccagaugccuaaaauaaggacaaaugcagucacaa

SEQ ID NO: 12034 - RNA, 87 nt, Human
gcccucaccugcuugcuccuaaaugugauccugcuuacuguaacuucuuaagacacuaucagugcguuguuccaugaaggcgagggc

SEQ ID NO: 12035 - RNA, 72 nt, Human
gcuuuucacgggagguuuaaagucagccagagcaagcuggcccuucucuucaucaaaucccaggugaacugc

SEQ ID NO: 12036 - RNA, 71 nt, Human
gaaagaauaguagcaaacaguggcuuauuucuucauuucucaguaaucauuguaaaucuuuuuuuuuuuuc

SEQ ID NO: 12037 - RNA, 68 nt, Human
gauuaucauucuugccucucccuuugucacaguguugucgugaagaucagauauguaugaaugcaguc

SEQ ID NO: 12038 - RNA, 62 nt, Human
aaguaggcuauaggacuggacauuuggauauuucaucaguucaaauaguccugggcgugcuu

SEQ ID NO: 12039 - RNA, 75 nt, Human
gcaccacagcaaggauuaucaugugcccuccagagacauacucucagguggaugcgagaaauauccagcuguugc

SEQ ID NO: 12040 - RNA, 69 nt, Human
ggggagaaggaaggggagcgaggagaggaagcucucucuccucucccugcuuccccuucaccauucccc

SEQ ID NO: 12041 - RNA, 66 nt, Human
ugauuaauuucuuaggccuauuuaagauacauauuuauauaguucuuaacgguuuuucucugauca

SEQ ID NO: 12042 - RNA, 62 nt, Human
acuuugaucucuggucauucggugaccuugaaggaugcuggaagacucagaguccccagagu

SEQ ID NO: 12043 - RNA, 61 nt, Human
cacuggccgaacucucggucucgggucuugaguggggcccgcagccgaagaguugcaggug

SEQ ID NO: 12044 - RNA, 63 nt, Human
ccacggcccgauguucucaaagcccugcucgccgcaggugguucuggagcagccgggcggagg

SEQ ID NO: 12045 - RNA, 61 nt, Human
agugcaauguugauucugcuuuaccacauauguauuuuagaaagaugucagcuuuguugcu

SEQ ID NO: 12046 - RNA, 61 nt, Human
ccuuuauugaaaauauugggauagcacugcauuacauauagucaauauccauaaaugaagg

SEQ ID NO: 12047 - RNA, 62 nt, Human
cugccaguaugcuguuagucaagaguccucaguaggagaacuugagugaaacguacacccag

SEQ ID NO: 12048 - RNA, 64 nt, Human; identical to SEQ ID NO: 9729

SEQ ID NO: 12049 - RNA, 73 nt, Human
uaguaucauggacuaaacuaggucagagugaaguauaugcaaaaugaccauuuuguuuuuuuccauuuuauua

SEQ ID NO: 12050 - RNA, 61 nt, Human
aggcuggacuuggggccgugcggggcccagagugcuccugccgguucccgagggcuggcuu

SEQ ID NO: 12051 - RNA, 107 nt, Human
uuugcugcuucugaacauugaugcuucgugucucuugcggggguggggcauuaggaggccucuuggcgaccgcggggggagggagcacgaaguccaggggcggcggg

SEQ ID NO: 12052 - RNA, 63 nt, Human
ccacuucuuucuucucucuucgguccuccccguggaaccguaauguauacgaaaaucuagugg

SEQ ID NO: 12053 - RNA, 62 nt, Human
guaugaaagggggaaacaaagaacagccuuuuagguaaggcuuuucaguaccugccucgugc

SEQ ID NO: 12054 - RNA, 71 nt, Human
uuguuuuucuauuuuagugguuaaaauguaugcaauuuuagcacccaucuacaaaaguuagauguuaauaa

SEQ ID NO: 12055 - RNA, 61 nt, Human
cuccgaggacagagggcuaaauccaugaaguuuguggauggccugaugauccacagcggag

SEQ ID NO: 12056 - RNA, 67 nt, Human; identical to SEQ ID NO: 1146

SEQ ID NO: 12057 - RNA, 105 nt, Human
gaucacaaugcggccaaagguguagagcugcuucccuucgugucgcuucccaaugacgggcaugaagacaauguugugcuccucagccuuggucucaaugagguc

SEQ ID NO: 12058 - RNA, 61 nt, Human
guuacaucuuggaaccugagccauggagguggcgccaccucccugaggagaaagguguggc

SEQ ID NO: 12059 - RNA, 63 nt, Human
ucagguugagagugagcugcugugagccagugacaacuacugcuacaacuugcuguuacuuga

SEQ ID NO: 12060 - RNA, 74 nt, Human; identical to SEQ ID NO: 521

SEQ ID NO: 12061 - RNA, 75 nt, Human
cagccuacgaggucugcuauggccuggucaacgaugacaaccgaccuauugggcccaugaagaaagugcugguug

SEQ ID NO: 12062 - RNA, 74 nt, Human
ucaucccugacaucccuaucguggacgcccagagcggggcaggacuacgacagcuuccuuauguacagcgauga

SEQ ID NO: 12063 - RNA, 76 nt, Human
ccaucugccgugugacuggugggaugaacgguaaaggcagaccgagaugaauccucaccauaugcugcuauguugg

SEQ ID NO: 12064 - RNA, 77 nt, Human
ggaccucagguggcugaaggagacgaauguauuuggugucugccauaucuuugcauccuucaaugacacuuuugucc

SEQ ID NO: 12065 - RNA, 73 nt, Human
gugucaagccagagauucggggcaguagauaaauguucauuuuacugaugcacuuuaguuuuuggucuguuac

SEQ ID NO: 12066 - RNA, 85 nt, Human
gaagugaaaauguuuuacaaucucuagguuuggcuaguucucuuaacacugguuaaauuaacauugcauaaacacuuuucaaguc

SEQ ID NO: 12067 - RNA, 111 nt, Human
uuguuucuuaagaaaacacacucuuuuuuacaaauuacuuuuaaauauuaacucaaaaguugagauuuuggggugguggugugccaagacauuaauuuuuuuuuuaaacaa

SEQ ID NO: 12068 - RNA, 64 nt, Human
cucagccucaggauuucgugcuuguaccugcccaggugcugguccacguacuccuguagcucag

SEQ ID NO: 12069 - RNA, 85 nt, Human
gcugugcccgcucccguuccagcucugccugggugcugcgggagaagucccggagcuucugguggaucugggcccaggaugcagc

SEQ ID NO: 12070 - RNA, 82 nt, Human
ggcccuguggcucugauguuccccccugggaggcuccaccgggucucuuuuuuggggaugagagcagugccccaggcccgcc

SEQ ID NO: 12071 - RNA, 72 nt, Human
gggcggcugcacgaaggaugaacgguuuguggcagaggugaccugccuggacccccugaggcgcagccgccu

SEQ ID NO: 12072 - RNA, 84 nt, Human
guguuggguggcaaggucuaugugaucggaggcuuugacggcuuacagagaaucaacaacguggagaccuacgaccccuuucac

SEQ ID NO: 12073 - RNA, 75 nt, Human
ggagugcaguggcgugaucucggcucacugcagccucgccuccugggcucaagugauucuccugccucugccucc

SEQ ID NO: 12074 - RNA, 84 nt, Human; identical to SEQ ID NO: 286

SEQ ID NO: 12075 - RNA, 103 nt, Human; identical to SEQ ID NO: 294

SEQ ID NO: 12076 - RNA, 101 nt, Human
ugagacggagucucgcuuugucacccuggcuggagugcaguggcaugaucucagcucacugcaaccucugccucccggguucaagugauucucccgccuca

SEQ ID NO: 12077 - RNA, 65 nt, Human
ccuuccacagugucagagacuucagcuacucuuacaagcaauaguaccacuggcacuucuauagg

SEQ ID NO: 12078 - RNA, 78 nt, Human
guugaugaagaugaaccuacuguaguaccaaccacuucugcaagaauggaaucacaagcuacuagcgcuuccauuaac

SEQ ID NO: 12079 - RNA, 74 nt, Human; identical to SEQ ID NO: 365

SEQ ID NO: 12080 - RNA, 75 nt, Human; identical to SEQ ID NO: 1111

SEQ ID NO: 12081 - RNA, 111 nt, Human
uugaaacagacugggccaauguccacaaagaauuccuggucagcaccaccgauguccaaaggugcaauaucaaggaagggcaggcgugauggcuuauuuguuuguauucaa

SEQ ID NO: 12082 - RNA, 68 nt, Human
uuuuuauuuuggguuucuuacaaagggugacauuuuccauaacagguguaagaguguugaaaaaaaaa

SEQ ID NO: 12083 - RNA, 84 nt, Human; identical to SEQ ID NO: 286

SEQ ID NO: 12084 - RNA, 64 nt, Human; identical to SEQ ID NO: 287

SEQ ID NO: 12085 - RNA, 89 nt, Human; identical to SEQ ID NO: 288

SEQ ID NO: 12086 - RNA, 98 nt, Human; identical to SEQ ID NO: 6333

SEQ ID NO: 12087 - RNA, 74 nt, Human
gugcagucuuugggcuaaggcagggcaggauaugcaaguggagauauugccuugcacagaaguuuuuacuguau

SEQ ID NO: 12088 - RNA, 82 nt, Human
gaaaggcaagcgcuccaaggauuuuuugauuccuuuuggcuuuggccaagaaaaugaaauuauugagaacagccagccuuuc

SEQ ID NO: 12089 - RNA, 102 nt, Human
agcuuuugaucuauucaauccaaacuucaagucuaccugucaacgguuuguggagaaguacacugagcuacagaaacuuggagaaacagaugaagagaaguu

SEQ ID NO: 12090 - RNA, 63 nt, Human
agggagcaucuucucucggacucgggaccugguucgggccggggugcugaaggagaagccccu

SEQ ID NO: 12091 - RNA, 85 nt, Human
ccuguacaaugcugcuggcuucaaagcccggaccaaggcucgaagccgugugcgggacaagcgggcagacauccugugaagcagg

SEQ ID NO: 12092 - RNA, 83 nt, Human
uugguccguauuuuuaacagaagacagugcaacaacuggucuccaccaguauugucacuuuauuuuuuuaaugacaaaaccaa

SEQ ID NO: 12093 - RNA, 99 nt, Human
uuuuuuuugauacagagucucacucugucaccucaggcugagauugaaccguggcacuccagccuggugugacagagcgagacuuuaucucaauaaaaa

SEQ ID NO: 12094 - RNA, 70 nt, Human
gaaauggagaaucugguuugcuuuauuauucccucaaauugaaggaauaaaaauacaacccuuucauuuu

SEQ ID NO: 12095 - RNA, 75 nt, Human
agggcuccugcggcaucgggggcggcaucgggggcggcuccagccgcaucuccuccguccuggccggaggguccu

SEQ ID NO: 12096 - RNA, 84 nt, Human
auuuaggauucucugugugaugaccuuggaugcuguaaagugauucgucauagucucugggguacccauguaguuguagggagu

SEQ ID NO: 12097 - RNA, 89 nt, Human
gggaaugugucuuauucauaucuugaauaacguuggacccucacuguguaggugggauuagcuguaccagggugauuggauggauuucc

SEQ ID NO: 12098 - RNA, 66 nt, Human
uuuuucccaaauuaacuuguguccaaaaaaaaaaaaauuggggggcggaaaaaaaagggggggaga

SEQ ID NO: 12099 - RNA, 102 nt, Human
uauaugccugauucauaguaaaauaccucuaauaaacauuguuuuauagaaaaccugacuucagugaauauuuugguauuuuacagugggccaguuuauaua

SEQ ID NO: 12100 - RNA, 69 nt, Human
uguuaaccuuguaagauggauaauguguauaagaauguaggccuuaacuauuucacaugagucaaaaca

SEQ ID NO: 12101 - RNA, 70 nt, Human
uaagucaacaccguucuucauguaguacuucuccagcuuggccagaaugugcuugccauagguguacuua

SEQ ID NO: 12102 - RNA, 75 nt, Human
aucuagccuugcugaauguaacauguauacuuggucuugaauucauuguacugauauuaaacaugcaugcuggau

SEQ ID NO: 12103 - RNA, 66 nt, Human
caggucaaagguuuacaguacagaugccuacuucucagucuccagcuguaaaagcuucaauuccug

SEQ ID NO: 12104 - RNA, 88 nt, Human
gucaucacaaaauacugccaaugaaucaucaaaugcauugaaaagaaaacgugaagaugaugaugaugacgaugaugaugaugaugac

SEQ ID NO: 12105 - RNA, 66 nt, Human; identical to SEQ ID NO: 4461

SEQ ID NO: 12106 - RNA, 62 nt, Human
ggugacaacaugcuggagccaagugcuaacaugccuugguucaccggcauggacaagucacc

SEQ ID NO: 12107 - RNA, 61 nt, Human
aggaggaaggagaacuggcuugcuagcauaccacacaauagauugucaaauucuucuuacu

SEQ ID NO: 12108 - RNA, 71 nt, Human
cacacauuaaaguguaggcuccauaauagcuagcuauuuuguauucuucauggugcccggcacagugugug

SEQ ID NO: 12109 - RNA, 80 nt, Human; identical to SEQ ID NO: 11429

SEQ ID NO: 12110 - RNA, 65 nt, Human; identical to SEQ ID NO: 11430

SEQ ID NO: 12111 - RNA, 68 nt, Human; identical to SEQ ID NO: 6194

SEQ ID NO: 12112 - RNA, 67 nt, Human
caugaugaagauccugugaacucuggcguggaugcuuggaccccacgcgugguguuccuucuccaug

SEQ ID NO: 12113 - RNA, 102 nt, Human
ggaagcucaugcagagucuggagcucgugggcccucaggcgccuuucuuguccuugguguggagggacucaguggccuccgggacccugucugggcaucucc

SEQ ID NO: 12114 - RNA, 83 nt, Human
gagccaggcacuaaauggacugcucaugucugcugucaugaagcauggcagcagcaucacacgccucuuuguggugucugcuc

SEQ ID NO: 12115 - RNA, 80 nt, Human
gucugcgaaugacugcagauuaauuucacugacugacaggcugccgugggaagucagcuggagaucuggagacagcagac

SEQ ID NO: 12116 - RNA, 108 nt, Human; identical to SEQ ID NO: 851

SEQ ID NO: 12117 - RNA, 67 nt, Human
cuucucguucugccaucguuuccugaacagcagcagcgucccaggcaccaccgcgcagaacaggagg

SEQ ID NO: 12118 - RNA, 66 nt, Human
agaugguguaaaugguaaacgugauaucaugagacauuccugauaucucacaccaacacauuauuu

SEQ ID NO: 12119 - RNA, 61 nt, Human; identical to SEQ ID NO: 12046

SEQ ID NO: 12120 - RNA, 73 nt, Human; identical to SEQ ID NO: 12049

SEQ ID NO: 12121 - RNA, 66 nt, Human
ccugugucacaaugggcaaggagcucagagucucugggccucugauuuccccaucuguauuacagg

SEQ ID NO: 12122 - RNA, 68 nt, Human
cccuccgccccuaucaugggggacacaggcacagggcaaguuucuguaaauuccucugggguagaggg

SEQ ID NO: 12123 - RNA, 87 nt, Human
uucccccgcagcucacggcacucagcuuacuugagaguugaccauagacucccggguggcaucaagugacucaagcaguggugggga

SEQ ID NO: 12124 - RNA, 60 nt, Human
aggaaaaacaaaacaaagaaauaagggucuuuuuuuuuuuuuuuuuuuuuuuuuuuuuuu

SEQ ID NO: 12125 - RNA, 128 nt, Human
ggagagggcaaucuuggccuuuaucucgugaggcuagggaggguccuccuccaucuuucuacagagauuacuuggcugccuuaaugacauuccccucccaccucuccuuuggaggcuucuccuucucc

SEQ ID NO: 12126 - RNA, 61 nt, Human
acaacuacggaccuuggucccggccuuuauggacuauuauuggaccaacuccgaaaguugu

SEQ ID NO: 12127 - RNA, 69 nt, Human
gagaguguguguuaucuucauaacccagggcuuuagcacagggccugggauuuauuacgcaacacucuc

SEQ ID NO: 12128 - RNA, 61 nt, Human
gacuuccuugguccuuuuaguaugaacugggauggguacuucuuaugcuagauaggguguc

SEQ ID NO: 12129 - RNA, 75 nt, Human
gccggugggggguacaccaggggccaaccgggauaaaauugcgggaaacaaaacuggguuuugcccuucacaggu

SEQ ID NO: 12130 - RNA, 79 nt, Human
gucaguauguuaaacauugaaguuagggggagggugcauauguuacuauugcuuucaauuuauccacuguguuucugac

SEQ ID NO: 12131 - RNA, 69 nt, Human
uuuuauuuucuuugcuuuggucuauacaaaaaaaccaauaaccaaaaacauaaagcgauaauaauaaaa

SEQ ID NO: 12132 - RNA, 69 nt, Human
gggugggugggacagagggagagagcaaugcacuccagcuccucccggagcccuuagagagacucacuc

SEQ ID NO: 12133 - RNA, 131 nt, Human
gggaggaagugaagggcaccuaagggcuggaccgcuggggggcagucagggccugcauggccuuuuguguggacacaggggguuccaggccaccccugcccccagcagcugagggaccuugagcaagaccc

SEQ ID NO: 12134 - RNA, 67 nt, Human
cacuggcacucacagucaccaacaggucuggggaacccugggugaugaaggaguggggcugccggug

SEQ ID NO: 12135 - RNA, 101 nt, Human
ggcgugcaaggcgaugggcugcuuccucagcugagagccgaguuggaugugggcuccuucagcagcugacagggagucugcccaaaguugcugauaaugcc

SEQ ID NO: 12136 - RNA, 90 nt, Human
uguacaccaucacugacaaccucugcgaagaaugccuugaguucguccaggugcuggaagaugcuaggugaguuaguguccaggcgugca

SEQ ID NO: 12137 - RNA, 79 nt, Human
ccugaggugguuuuguuuuguuuugucuuugaggauuuguggaccucugaaguagagccauucaaaaugccaguucagg

SEQ ID NO: 12138 - RNA, 86 nt, Human
gagucucgcucuguugcccaggcuggagugcaguggcaugaucucggcucacugcaaccucugccuccuggguucaagcgauucuc

SEQ ID NO: 12139 - RNA, 79 nt, Human
ggucuugaucuccugaccucgugauccacccaccuuggccucccaaagugcuggcguuacagguaugagucaccgcacc

SEQ ID NO: 12140 - RNA, 79 nt, Human; identical to SEQ ID NO: 6903

SEQ ID NO: 12141 - RNA, 85 nt, Human; identical to SEQ ID NO: 6904

SEQ ID NO: 12142 - RNA, 72 nt, Human; identical to SEQ ID NO: 8132

SEQ ID NO: 12143 - RNA, 105 nt, Human
cugugcauuuuaggauguugaguagcaacccuggccucuacccacuagaagcugguagguagcauguccuccuccccuacuugugacaaccaaaaaugucuccag

SEQ ID NO: 12144 - RNA, 95 nt, Human
gccccacccucuccuugaucaucuuccucugcagugguguuucucaaccucagcacuacugacauucggagcuggauaauucuuuggggugaggu

SEQ ID NO: 12145 - RNA, 66 nt, Human
uagagauaacuuuuaaaaacaacagugacaacaacaaaauuucuguucuuagaauuucugucucug

SEQ ID NO: 12146 - RNA, 61 nt, Human
acuuggucccuaagucagcaagaggaacauuaucugucaauucuagcgaugggauucaagu

SEQ ID NO: 12147 - RNA, 95 nt, Human
cagaagucauuuguggaaacgggcauugugagaaggcguuaccauuaguuacaaauguuacugcuagaacggagugaacggcacaggugaaaaug

SEQ ID NO: 12148 - RNA, 77 nt, Human
gagguucuauuguauccuuggccagaaacugggugaaaagaauaagcagacaauuuuuggagauacugaggaauuuc

SEQ ID NO: 12149 - RNA, 82 nt, Human
auccccauguagaaguguugucuucuacugcuugccacguacaagugugaaaugccaaggugagacucguacacuuggggau

SEQ ID NO: 12150 - RNA, 103 nt, Human
ugcaaugguuuuuaccccucaugaaggucagagguggacuauuuguacacauacacacaugcacacccucucacguccuccagaggcugaaagaccaucagca

SEQ ID NO: 12151 - RNA, 74 nt, Human
cugaucaauccuucuuuuucucuuuugcccacaauuuaagcaaguaaaugugcagaagaaauggaaggauucag

SEQ ID NO: 12152 - RNA, 75 nt, Human; identical to SEQ ID NO: 1111

SEQ ID NO: 12153 - RNA, 77 nt, Human
ccuuuguaaucuuauugucuccugaguaaauauacacauaaauguuuggggauucauugcugcuagauuauaucagg

SEQ ID NO: 12154 - RNA, 67 nt, Human
ggcuagcuuuucuuacuucaguuuuuauagaacaccaacuaaauuugaaaguaugaagucucuagcc

SEQ ID NO: 12155 - RNA, 62 nt, Human
aauugaaaauagucauuuugaauccuauugauuauucaaaaauucaggcugauuugucuuuu

SEQ ID NO: 12156 - RNA, 61 nt, Human
gagaaugaaaagaguugauuuuggaccucggaccuugccguggcuaaaucuuuaccuucuc

SEQ ID NO: 12157 - RNA, 93 nt, Human
gccaaaaugucugucaaugucaaccgcagcgugucagaccaguucuaucgcuacaagaugccccgucugauugccaagguugagggcaaaggc

SEQ ID NO: 12158 - RNA, 71 nt, Human
gguugagggcaaaggcaauggaaucaagacaguuauagucaacaugguugacguugcaaaggcgcuuaauc

SEQ ID NO: 12159 - RNA, 75 nt, Human
gucaggccgguuuaaucggccgaggguucagucagagcuagaacauuccagaggucgcccagcuccggcgcugac

SEQ ID NO: 12160 - RNA, 125 nt, Human
cggcuagguacgaggcuggguucacggaggcugcggcugcagaaguaccgccugcggaguaacugcaaagaugcuguccgugcgcguugcugcggccgugguccgcgcccuuccucggcgggccg

SEQ ID NO: 12161 - RNA, 75 nt, Human; identical to SEQ ID NO: 74

SEQ ID NO: 12162 - RNA, 87 nt, Human; identical to SEQ ID NO: 76

SEQ ID NO: 12163 - RNA, 79 nt, Human
aguauacuuuuggacaaucugcagcuauaaaaauauacacauacaaaaguacagcuacagauuguccacacaguauacu

SEQ ID NO: 12164 - RNA, 63 nt, Human
cucccaagagagacuuguuugggccuuuuguggugucaguggaauggauagguaacuugggug

SEQ ID NO: 12165 - RNA, 60 nt, Human
ugucauuuuuguuuuaagaguuggggggaguaucuauaguaaaguugaauaaaggggaca

SEQ ID NO: 12166 - RNA, 79 nt, Human
auaauaguguaaaucagauauaauugagggcuauauggcaguaaaacugcuagugccaguuuucuuguuugccuguuau

SEQ ID NO: 12167 - RNA, 60 nt, Human
uccagaguuuauaaagucaaauauucaguaggcauagacuggaauagauaaauucaugga

SEQ ID NO: 12168 - RNA, 90 nt, Human
cucuaccggcccguugcuguggcucuagacacuaaaggaccugagauccgaacugggcucaucaagggcagcggcacugcagagguggag

SEQ ID NO: 12169 - RNA, 85 nt, Human
cugugucggacgaaggacauccaggaucugaagucggggucgagcaggaugucgacuaugguguuugcgucauucauccgcacag

SEQ ID NO: 12170 - RNA, 61 nt, Human
gguggcuccuugggcagcaacgaacgggugugaaccuuccuggggcugcuguggacuugcc

SEQ ID NO: 12171 - RNA, 72 nt, Human
ucugcaaggugguggaagugggcagcaagaucuacguggaugaugggcuuauuucucuccaggugaagcaga

SEQ ID NO: 12172 - RNA, 74 nt, Human
gaacaacacaucaaagaugcauuuguauguucauauaacacuaauaggacaauacaaaguaucuucacggucuc

SEQ ID NO: 12173 - RNA, 108 nt, Human
cagucgcucccgcaggucauaacuggccgaugggcuccagggccggcuuuucuccccagcgagucgggaggcccgggcccgggggcugggggagcugcuggagugcug

SEQ ID NO: 12174 - RNA, 90 nt, Human
ccucuuccuccucuuccuccucuuccucauccacuccagcuccccccuccuccuggaugggagggguccccucggagggaggagcagagg

SEQ ID NO: 12175 - RNA, 66 nt, Human
ggagaacuuugccuucuguggggucccugagggggggggcuccacagguucugccucagauucucc

SEQ ID NO: 12176 - RNA, 65 nt, Human
guccaggucugcagaacccagcaucugggccuccgccucaucugugggcaccugcugcucuggac

SEQ ID NO: 12177 - RNA, 88 nt, Human
ggugucuccucagaugauaacaguuuucauugacggcuacuaugaggaacccauggaugugguggcacuguuuggucugaggggcauc

SEQ ID NO: 12178 - RNA, 75 nt, Human
accaggauggucgcuuucugucucguucaaugauccucuugcccugaucuuguucagacggugucucuccugugu

SEQ ID NO: 12179 - RNA, 67 nt, Human; identical to SEQ ID NO: 9781

SEQ ID NO: 12180 - RNA, 89 nt, Human
gcauggaauccacugcauucaaucgggaugcauuuuaccacgcuguaugggguauacuguauucaaucacgcugcauggaauucacugc

SEQ ID NO: 12181 - RNA, 60 nt, Human
aggcgacggggaggccugggcucugacucuagcugggccagcuaacccucugugucgccu

SEQ ID NO: 12182 - RNA, 78 nt, Human
cuuccggccgccgguucauuagcgugaagauguuggagcgccgcuuggacugcuuucggauggguguggggguggagg

SEQ ID NO: 12183 - RNA, 86 nt, Human
uggcuaagccuuuguuaaaccaaucacagcgguggguggaaagcaugaauuuuccccucggcagugggguaacggaaaaagagccg

SEQ ID NO: 12184 - RNA, 68 nt, Human
ccuugaugaagggaugggaccugugggcauccuucagcugggacagguaucgguuugucaccucaggg

SEQ ID NO: 12185 - RNA, 95 nt, Human
gggggcuugcccaggugcugggacaggacgaugagguugaccagcgucucuggguagccacuauccuugucuagcgccuccugcagcaggcccuc

SEQ ID NO: 12186 - RNA, 69 nt, Human
acagaaauguuuuuaaagcuguucaugauuuaguagaaagaaucaggagcuugaaacaauuacuucugu

SEQ ID NO: 12187 - RNA, 61 nt, Human
cugugucaaggccuuuugagccacuuggagauguaauuuaaaaaggcaaaacaaugcacag

SEQ ID NO: 12188 - RNA, 101 nt, Human
ucuuuuucugagguuucauuccaaugagaguugcacacugucagcuugguuuuguggcugcugauagucguacuuucuugcuauucacaacaagaaaaaga

SEQ ID NO: 12189 - RNA, 75 nt, Human
cucccucaaugccacccugaccccacggcuggagaacccugugcuuauguggugggcagggcacuguugauggag

SEQ ID NO: 12190 - RNA, 63 nt, Human
cugaauguuuucccaaaucaccuaaauaucgguuugcuuuuuguuuugggggagaggauuuag

SEQ ID NO: 12191 - RNA, 87 nt, Human
gcucaaaggaucuguggugcuggaggucuacacgccucucaggacagcgugucaggaaccucagagcagcuucacaucugccaaagc

SEQ ID NO: 12192 - RNA, 78 nt, Human
aaaaugcggccgcaauucgagcucacuuggccaauucgcccuauagugagucguauuacaauucacuggccgcguuuu

SEQ ID NO: 12193 - RNA, 71 nt, Human
aucaauuucuucaaauagcuugcuuacaugauaaucaauuagccaaccaugagucauuuaggaauagugau

SEQ ID NO: 12194 - RNA, 101 nt, Human
cccaacagccuccugugccugcuucccugugugucgggguccuccagggagcugacccagagguggaggccacggaggcaggcucucuggggacugucggg

SEQ ID NO: 12195 - RNA, 102 nt, Human
cauuacugcagcgggcaugaaaaccggcaggguguuaggcucauggccugaagagaagucacaucaccagccgauguuuucaugcaaaaggcaaucgugaug

SEQ ID NO: 12196 - RNA, 63 nt, Human
cauuuuagaguaucuuggcaaaauggugagaggaucucacuuucccaauaucacucuguaaug

SEQ ID NO: 12197 - RNA, 82 nt, Human
ggcuuuuccuaaucucuuuggucuuuggaagugggcaggguuucucaaaccaagugucuuccaugggccauuggcaaaggcu

SEQ ID NO: 12198 - RNA, 62 nt, Human
gugaauuaaugagcaaucggaaagacucaaagcauuuuguacuccacaguucauuucuucac

SEQ ID NO: 12199 - RNA, 80 nt, Human; identical to SEQ ID NO: 6866

SEQ ID NO: 12200 - RNA, 65 nt, Human
gaguugacaauuuuauuuucacauuucccaauacaaaggaaaacugcaucuuuuuugucccacuu

SEQ ID NO: 12201 - RNA, 72 nt, Human; identical to SEQ ID NO: 8911

SEQ ID NO: 12202 - RNA, 69 nt, Human; identical to SEQ ID NO: 8912

SEQ ID NO: 12203 - RNA, 68 nt, Human; identical to SEQ ID NO: 8913

SEQ ID NO: 12204 - RNA, 67 nt, Human
ccgaaagcugagugccgccggggucccuugggggggccucugguuuaggcgcccgaaaggcuuuggg

SEQ ID NO: 12205 - RNA, 103 nt, Human
gggcgagggugcacacuucggaccucuacaagcugucagccccaaggcagcucuuccuggggggcccagcuugaggaaccuguggcggugcugugcuucuccc

SEQ ID NO: 12206 - RNA, 71 nt, Human; identical to SEQ ID NO: 1145

SEQ ID NO: 12207 - RNA, 67 nt, Human; identical to SEQ ID NO: 1146

SEQ ID NO: 12208 - RNA, 81 nt, Human
cacaagcuaaaucucaaaauaaaacuguuacuuuaauaccuuaauaagucucagaacuuuagauaggauguuggcuuagug

SEQ ID NO: 12209 - RNA, 72 nt, Human
ugaugguaaacugaauggaaguaaggacuuuuuuuuguuuuuuacaguaacuuuccaugaagucucaccuca

SEQ ID NO: 12210 - RNA, 84 nt, Human; identical to SEQ ID NO: 286

SEQ ID NO: 12211 - RNA, 97 nt, Human
ucuggauuaucuacaaguguuugcuauuuacaaugugaaguuugcgaagugccgcguggauuuuuaugugaaacaagcauuucuguuacgguucagg

SEQ ID NO: 12212 - RNA, 81 nt, Human; identical to SEQ ID NO: 8793

SEQ ID NO: 12213 - RNA, 64 nt, Human; identical to SEQ ID NO: 9321

SEQ ID NO: 12214 - RNA, 84 nt, Human
gucagcagaucccagugaaggguuuuguguguuuaggccucauuucuuugucuuuuuccuacuccguuccuggcauuugcugau

SEQ ID NO: 12215 - RNA, 60 nt, Human; identical to SEQ ID NO: 8363

SEQ ID NO: 12216 - RNA, 71 nt, Human
uuuggguggcauagagguuuuguauugagggccagugaugauguuuugauauuuauuuccugcuacuuaaa

SEQ ID NO: 12217 - RNA, 68 nt, Human
gccaugugcucccugaccugaaggaggaggauggcagccucagccuggauggugcagacagcacuggc

SEQ ID NO: 12218 - RNA, 70 nt, Human
ugaagaggcuuugauuucuuucucuuuaucaggauauucuuccaccucugaggagaacauuaacucuuca

SEQ ID NO: 12219 - RNA, 79 nt, Human
cugguaaccuggcguccgguggggccgcuggggccaccucccuuugcuuugucuacccgcuggacuuugcuaggaccag

SEQ ID NO: 12220 - RNA, 92 nt, Human
gggaucauugauuguguggugagaaucccuaaggagcagggcuuccucuccuucuggagggguaaccuggccaacgugauccguuacuuccc

SEQ ID NO: 12221 - RNA, 82 nt, Human
uccgcaugucccuucgcgggaaggcuguggugcugaugggcaagaacaccaugaugcgcaaggccauccgagggcaccugga

SEQ ID NO: 12222 - RNA, 64 nt, Human; identical to SEQ ID NO: 11768

SEQ ID NO: 12223 - RNA, 72 nt, Human
cacagugcaggaugggcacuccgugauggccccugccggccuccugcgcggaccugccagcccugucuugug

SEQ ID NO: 12224 - RNA, 108 nt, Human
guaugccugugagauuaaaggcagagaagugaguugggccacuucugggccuggauuuuaggacuuagguguggcccuuccacaccccuuucccaguccauaggcugc

SEQ ID NO: 12225 - RNA, 66 nt, Human
gugaacaagcauuuggaccgagccucuuucuuucagaaacgggaagucuaacaguuauguuuucac

SEQ ID NO: 12226 - RNA, 95 nt, Human
uuuuuuuuuuuuuuugccuuuugggauggccccaucuguuuauuuuaaaagaaaaaaauuaaaauagagccaacaaaugcaauuaagaaaaaaaa

SEQ ID NO: 12227 - RNA, 80 nt, Human
aaaaugcggccggaauucgagcucacuuggccaauucgcccuauagggaggccggauuacaauucacuggccggcguuuu

SEQ ID NO: 12228 - RNA, 92 nt, Human
ccgguaaauuuuggaaaaaucgcggaaaauuuuugguaaacagucaauuuuuuacccaaagcccgaaucggaaaauccuuuuaauuaaccgg

SEQ ID NO: 12229 - RNA, 61 nt, Human
gucuuccugcucuguucugaauacuucauacucugcuguauaaaugagagagaacgaagac

SEQ ID NO: 12230 - RNA, 60 nt, Human
cuaaccuucgugugcuucguucaauccuggaaaaccugagaagcaaaauacaaaaguuag

SEQ ID NO: 12231 - RNA, 71 nt, Human
ugucucagcucaaauggaauauugucgcaccccaugcacugucaguugcaauauuccuguggugucuggca

SEQ ID NO: 12232 - RNA, 77 nt, Human
caagcacuggacuggaauuuugagagaggcauuuacagacgcugauaacuuuggaauccaguucccuuuagaccuug

SEQ ID NO: 12233 - RNA, 75 nt, Human; identical to SEQ ID NO: 1860

SEQ ID NO: 12234 - RNA, 64 nt, Human
cgcggcgccccuagccggcccugcgccggggucuccgagggccggcccggcggggggcgccgcg

SEQ ID NO: 12235 - RNA, 82 nt, Human
ggccaggacugcgcucaggaucccgccccggagcccccagcccgggggagagggggagggaaguugggacgaagcccaggcc

SEQ ID NO: 12236 - RNA, 99 nt, Human
gccugcugcuguacuucaucagaaaacaccuucagcugcugcaggaagggcucuuugugguaguuggggugcacauuaucauaguugggcacuacaggc

SEQ ID NO: 12237 - RNA, 62 nt, Human
gccaguaugagagccuggaacacaugacccucaccuguuccuccaaggucugcucuuuuggc

SEQ ID NO: 12238 - RNA, 87 nt, Human
uuguguaccgccugcugcgcucgcccaugugcgaguaccuggugaauuucuugcacaaguugcggcagcugccugagcgauacauga

SEQ ID NO: 12239 - RNA, 73 nt, Human
ucacccgcuuugugaaauggccccgcuauaucagguugcagcggcagagagccauuccucuauaagcggguga

SEQ ID NO: 12240 - RNA, 78 nt, Human; identical to SEQ ID NO: 99

SEQ ID NO: 12241 - RNA, 65 nt, Human; identical to SEQ ID NO: 247

SEQ ID NO: 12242 - RNA, 80 nt, Human; identical to SEQ ID NO: 100

SEQ ID NO: 12243 - RNA, 77 nt, Human
cugagcuaggaauucccuuggaagagguuccuccagaaggaauuaauuauuuaacacgaauucacuacaaagcucag

SEQ ID NO: 12244 - RNA, 75 nt, Human
auguuucuugugacacuccccacaauggaaaaauuaccgaauuaaaccuguuuuauggauggcagcuuggagcau

SEQ ID NO: 12245 - RNA, 69 nt, Human
uccuugugauguuuguauggacuuugacaauauguaaauauguguaaagccaguuuuuaugauuaagga

SEQ ID NO: 12246 - RNA, 82 nt, Human
uuaaugugaauagcaaauucugguauaucgugacuaacgcuuaagaaugccugucuuugagaggaagguguuauaauauuaa

SEQ ID NO: 12247 - RNA, 74 nt, Human
gaaauaccuggcaccugauggagcauggacuuuugcuaacuugcaacagaaucaccuaauggggccagguuuuc

SEQ ID NO: 12248 - RNA, 84 nt, Human
ggguuggcugguuucaugguggguugguucaugagcagccuccuguucuaugaggcuuuucaacaguuucacauccagcugccc

SEQ ID NO: 12249 - RNA, 73 nt, Human
cgccccggcccggugcagcaccaccagcguguccaggaagcccucccgggcagcgucgugcacgggucgggug

SEQ ID NO: 12250 - RNA, 88 nt, Human
gcuccaaggccaccuaguacuuugagaaaguuauacagacaaccaagucaggcuuccucaaucuagcagucuauugccaaaaaggagc

SEQ ID NO: 12251 - RNA, 60 nt, Human
gggcucaggcaguucucucaccuuggcccuccaaagugcugagauuacacgcaugagucc

SEQ ID NO: 12252 - RNA, 67 nt, Human
gugucuuggccuucacgagcagccucuggacggccuuguagaggaggcugaagugcuugacaagcac

SEQ ID NO: 12253 - RNA, 72 nt, Human
uccccccccagucucggagagcaacagaaaaaagcucuguaauucaguguuccaaccaccgccggggaggga

SEQ ID NO: 12254 - RNA, 64 nt, Human
cagggacaaccauccucucccuguguccccugccccccacacugagggaaugucuguguccuug

SEQ ID NO: 12255 - RNA, 65 nt, Human
ucccaccccaggaagcuacaagagacaggcuguccuguccccacaacucucccuggguccuggga

SEQ ID NO: 12256 - RNA, 72 nt, Human
acguguauccccucccaagggcuaguuuuuuuguuugaauaaauagggggccaugggagggggauuucacgu

SEQ ID NO: 12257 - RNA, 66 nt, Human
caaaacuguaaaauucauugcuuguggaauucacuuuaucuuucuacauucucagaggcaguuuug

SEQ ID NO: 12258 - RNA, 77 nt, Human
gcuuuuaaugccagaagaaaaguuaccagaauuuauaauuuauaguaauuuuuugaucuuuuuuuugccuuaagagu

SEQ ID NO: 12259 - RNA, 84 nt, Human; identical to SEQ ID NO: 286

SEQ ID NO: 12260 - RNA, 89 nt, Human; identical to SEQ ID NO: 288

SEQ ID NO: 12261 - RNA, 61 nt, Human; identical to SEQ ID NO: 776

SEQ ID NO: 12262 - RNA, 66 nt, Human
ggucgcgggaacaagaggacaucugggcgcaaaauuccccacguuuuccucuucuccucuucggcc

SEQ ID NO: 12263 - RNA, 71 nt, Human
ugaaaaaaaagcacacccuuuuaagacuacuuuaugaggcacuugugguuguagagagugaugcugcuuca

SEQ ID NO: 12264 - RNA, 67 nt, Human
agcaaucaaagguuuucgcaauucuccagugggaguaaaccacagacuacgagggaguuugacagcu

SEQ ID NO: 12265 - RNA, 63 nt, Human
cacacaggggcuuaagagaaggccaaaguuucuugauuuuuuuuauuucuuuugagaugugug

SEQ ID NO: 12266 - RNA, 93 nt, Human
ggacuucuuuccuagguuucuuuacagaacggguuggggucgagaaagauuccgaagaucaguuacgcuguuuuaaaaccuaggugggaguuu

SEQ ID NO: 12267 - RNA, 77 nt, Human
ggagaauccccaaaauuuucagauaguggccuaaaaaaauuuuauuugcucacugguugucauucuggguauucccc

SEQ ID NO: 12268 - RNA, 61 nt, Human
uucugugucgugaauagcauuuuaaugaccucuguggucacauuaagcaaacaacauaggg

SEQ ID NO: 12269 - RNA, 78 nt, Human
gcugcgaauucauggcaucuauuguccauacaguagcgggaauuuccauacagugggcaggcauucccaucucguggc

SEQ ID NO: 12270 - RNA, 73 nt, Human
ggcguugggggcgcccgauauccuguggggggaaggguuucccgguucccuuuugggggccccuuuauuugcc

SEQ ID NO: 12271 - RNA, 62 nt, Human
ggggguccgggcgggguguaaacuggugccgcgguguguuguuugccccccggcugaucucc

SEQ ID NO: 12272 - RNA, 77 nt, Human
aggaucuucggaacugaugaagcaucacauaggucggugagcuagccuaggauguaagcaggagccgguugauaccu

SEQ ID NO: 12273 - RNA, 68 nt, Human
cgaguccuggccuugucuguggagacggauuacaccuuccacuugcugaacaggucaaggccuucuug

SEQ ID NO: 12274 - RNA, 96 nt, Human
gacaauggcagcaucuacaacccugaaguugcuugauaucacagaggaaacucugcauucucgcuuccuggaggguguccgcaaugugccaguguc

SEQ ID NO: 12275 - RNA, 64 nt, Human; identical to SEQ ID NO: 11768

SEQ ID NO: 12276 - RNA, 63 nt, Human
aagaagccgcccugguugcacaugccgucggcaugacuguguaugcucuggugguggugucuu

SEQ ID NO: 12277 - RNA, 61 nt, Human
ucuggugaaaaaccaggaggguauugaagguggacuaaaauuuccuucugggauuaacaga

SEQ ID NO: 12278 - RNA, 83 nt, Human
ggaagccuuccccacacugccaaagccgcacacaggagcugugggagccuguggccacaaggucuguguugaggagggcugcc

SEQ ID NO: 12279 - RNA, 69 nt, Human
aagcagcaucauggagguuggaagaugccgcauuuggaugggaugaauuccaaauucuguugcuugcuu

SEQ ID NO: 12280 - RNA, 66 nt, Human
uaugugauaugcuuauacacuuacacuuuaugcacaaaaauguaggguuauaauaauguuaacaug

SEQ ID NO: 12281 - RNA, 78 nt, Human
gcggaagagauugaugugaaagucucguggcggcgggaccuugcuacgaggggcccuuuugcgggaguuuuugucagc

SEQ ID NO: 12282 - RNA, 65 nt, Human
guggccauggcuagagggguaaaaaauucaggacaucccccaggugcugccucagccagggcugc

SEQ ID NO: 12283 - RNA, 85 nt, Human
gugugcgcugccucuggcauccuagagacccggauuuacucagcuaggagagaggauggaucacagggucuaaggguggccauuc

SEQ ID NO: 12284 - RNA, 67 nt, Human
agagauaauucaaaaaggaaaacuauauauaaaagugguauaucaaguuugucucugaaauauuucu

SEQ ID NO: 12285 - RNA, 113 nt, Human
cugguggucgguggguuugaggccuaugaaggggugcugcaguugguggaggcucgcgggccgcuacgaagggagcucugcaucgucaugugugucaucccaggcaccaucag

SEQ ID NO: 12286 - RNA, 92 nt, Human
agacagugagagaaagauuuauaaaggcaucauucaaaaggauuuuuacauuugggugugccuuacucgauuacaaaaauuucaaaccaucu

SEQ ID NO: 12287 - RNA, 69 nt, Human; identical to SEQ ID NO: 3815

SEQ ID NO: 12288 - RNA, 64 nt, Human; identical to SEQ ID NO: 8200

SEQ ID NO: 12289 - RNA, 66 nt, Human; identical to SEQ ID NO: 2189

SEQ ID NO: 12290 - RNA, 79 nt, Human
uccuggaagauggcuuuggcguacugaugcaagaggcggcucauguaccagugcugccacgggagcagcccuuccagga

SEQ ID NO: 12291 - RNA, 69 nt, Human
gucuuccucacccuguccgugacguggauuggugcugcaccccucauccugucucggauugugggaggc

SEQ ID NO: 12292 - RNA, 62 nt, Human
uucccccuucagaaggugaccaaguuccaugcuguggugcuggacgccuggcacggggggaa

SEQ ID NO: 12293 - RNA, 63 nt, Human
ucacuucuaggaauacuaguauaucgcucacaccucauguccucccuacuaugccuagaagga

SEQ ID NO: 12294 - RNA, 63 nt, Human
ggagacauugugcaucuuaguuugggguuauauaauuacaaagaugacccugugcaaguuuuc

SEQ ID NO: 12295 - RNA, 72 nt, Human
ucaaaucacauuuguaagggaacuauuauguccauguuugcacauacucguccacugugugugaucaccuga

SEQ ID NO: 12296 - RNA, 73 nt, Human
gaggcgcgauauuuggcauuuuuaauuuagguuuguuuuauuuaaguuuaauguuaauuccaugcuguguuuc

SEQ ID NO: 12297 - RNA, 60 nt, Human
gcggccgagggggagggccgggggagcggacgucgccucugcuggucucccaccucccgc

SEQ ID NO: 12298 - RNA, 60 nt, Human
acaggaaggguccuagguagggggagguuccuccucccuugaaacccugggccacucugu

SEQ ID NO: 12299 - RNA, 93 nt, Human
gcaccccacccuccagcccccaggaaugcaggcgcucaaagccuguggcuaggcugcccgaagcgcgugccgcaguucuucuggagugggagc

SEQ ID NO: 12300 - RNA, 103 nt, Human
cagggugcugcuggcaguggagaccugggggugcggguccugggcugagcagggcucccgaggugcaucugcaggagcugggccgucugccaguggcucccug

SEQ ID NO: 12301 - RNA, 61 nt, Human
cugucuccggccgcccuggugcugccuguguccaugagcggugcuggggggucgggggcag

SEQ ID NO: 12302 - RNA, 74 nt, Human
gaccuuucuguccuuguccacgggccugcacucugggucucgcaggcccgagggcaaggguggcccugaagguc

SEQ ID NO: 12303 - RNA, 60 nt, Human
gagcucggaccgaaucggcaggcacaggaugacuggcgaugugggcucuguuuuggguuc

SEQ ID NO: 12304 - RNA, 61 nt, Human
guauuagaggcaccgccugccagugacacauguuuaacggccgcgguacccuaaaccgugc

SEQ ID NO: 12305 - RNA, 70 nt, Human
gcccugagugucucuuuugauuccaaauugauagaugcuaugaguguggcgaaaaaagggacaucuaugc

SEQ ID NO: 12306 - RNA, 82 nt, Human
aucucagccgcccucugccucuuggguuugcgugguuuuucugccucagccuccugaguaccuaagggaggugucuugagau

SEQ ID NO: 12307 - RNA, 66 nt, Human
gcgugacgguuccacaucaccgacccuccgccucuuggguucgggugaugaugguuccacgucagc

SEQ ID NO: 12308 - RNA, 61 nt, Human
ugacgguuccacgucaccgacccucugccucuuggguucgggugaugaugguuccacguca

SEQ ID NO: 12309 - RNA, 60 nt, Human
gaccaaacacugugacaaagcagaguucuucaguucugaaaauguuaaaguguuugaguc

SEQ ID NO: 12310 - RNA, 93 nt, Human
gugaugcuuggaagcauuuucugugcuuugaucacuaugcuaggacacauuaggauuggucauggaaauagaaugcaccaccaugagcaucau

SEQ ID NO: 12311 - RNA, 107 nt, Human
aagauauucagauacucuucuaugccaggaagcacaaaagacuuguugagauugccucaguucaguagaucuuccuuggcagccaggcauaggugguuucuugucuu

SEQ ID NO: 12312 - RNA, 67 nt, Human
gcacagagaaaugagguccccagucuacguaggaagcugcuggaugaggacucuuuuuucgagcggc

SEQ ID NO: 12313 - RNA, 70 nt, Human
ggaaggagcuggcuuuguggggcugcaaaggacuuuuaaguccugccuguacugaaguucacagcccacc

SEQ ID NO: 12314 - RNA, 68 nt, Human
ccgggcgugguggcuccuguaaucccagcuacucggaaggcugaggcaggagaaucacuugaacccgg

SEQ ID NO: 12315 - RNA, 71 nt, Human
gugaacaggacuuguuuuuauccuguacucuagggcacacuguauuacagggaaauaagaacacugaucau

SEQ ID NO: 12316 - RNA, 75 nt, Human
caucucuacagucuucacaugccccacuccagccgugugguagcacgccuugcuugugacccugggauagagaug

SEQ ID NO: 12317 - RNA, 119 nt, Human
gauguuaaguagguuccucucaaccccagcacuaauuugagaggaaaaacuauuaaggauaccguuccuuucucccuuccuguacuuaaauugauguugaaggaaauuacuagaauauu

SEQ ID NO: 12318 - RNA, 66 nt, Human
uggcuuuucaagcuaugucauaccugccucccagagguacuuggaaaauauuggcuugacagcaca

SEQ ID NO: 12319 - RNA, 76 nt, Human
aguagccugcccccaugcccagcuaauuuuuguauuuuuaguagagaugggauuucaccauguuggccaggcugcu

SEQ ID NO: 12320 - RNA, 92 nt, Human
gccacuucuucuuauuggagugugagcacuaggagcagggaccuuuccauggugcuugcuguguuauacccugcacccagaacuuaguaggc

SEQ ID NO: 12321 - RNA, 101 nt, Human
ugagauggagucucacuuugucacccaggcuggagugcaguggugugauaucggcucacugcaaccuccaccucccggguucaagugauucuccugccuca

SEQ ID NO: 12322 - RNA, 76 nt, Human
ccuugcagaugaugaugcuagacuacuacaacuggaaacccagggaaaucaaaguugcuacaacuaucuguauagg

SEQ ID NO: 12323 - RNA, 131 nt, Human
agguuagagagcgggaccuucuucgaguuacuggagaugugcgagaucgagaucuccuucgggugaccggagauguucuggaucuugaucuucugcgagugauaggcgaaguucuugcuucgagaucgccu

SEQ ID NO: 12324 - RNA, 72 nt, Human
ucacuggggaugcucuugaccgggaucuucgucgagucacugaaguccuggaccuugaccgucuccggcuga

SEQ ID NO: 12325 - RNA, 80 nt, Human; identical to SEQ ID NO: 174

SEQ ID NO: 12326 - RNA, 64 nt, Human; identical to SEQ ID NO: 175

SEQ ID NO: 12327 - RNA, 65 nt, Human; identical to SEQ ID NO: 3507

SEQ ID NO: 12328 - RNA, 63 nt, Human
ggugucugucagggugggcacaggguccucuccaaaccugcuucucccucccuggucaggccu

SEQ ID NO: 12329 - RNA, 75 nt, Human
uggcugguccuacuucucugccccaccaaugggggacuugaauguggcagagaauacagucagucagggcagcca

SEQ ID NO: 12330 - RNA, 74 nt, Human
ccuacuucagagugucccugagccaugacugcuugacuccacagauggcuucaggaagacagcacagaagaggg

SEQ ID NO: 12331 - RNA, 65 nt, Human
gcaacuggggaagguauuuauugauccacaccauuuucuuggauuuucuauccuccccagggggc

SEQ ID NO: 12332 - RNA, 63 nt, Human
gaauuacaauuugacaugagauuuggguguggauacagagcugaaccaugucaaggguaguuc

SEQ ID NO: 12333 - RNA, 62 nt, Human
gagagagugaagugggagggcugcaaggcuuuuaaacaaccagaucccacaagcgcucacuc

SEQ ID NO: 12334 - RNA, 131 nt, Human
agcuucacgcucuuugucauccuggacuucuucccgcucaucgcccacuauuaccucaccacucuggaugaggcugaugaggcaggcaagcggauuuuugguccccggguggggaacgagcugugcgaggu

SEQ ID NO: 12335 - RNA, 71 nt, Human; identical to SEQ ID NO: 1764

SEQ ID NO: 12336 - RNA, 101 nt, Human
cgcggcgcuggccgacugggcgucgcccuuccacgagcgccacuuccacuacgaggagcaccuggagcgcaugaagcggcgcagcagcgccagugucagcg

SEQ ID NO: 12337 - RNA, 76 nt, Human
ggagagugcagauucacuugaugggaacagcuacagcuccagcgaugaaaaacugaauucugcaacagacucuacc

SEQ ID NO: 12338 - RNA, 62 nt, Human; identical to SEQ ID NO: 9237

SEQ ID NO: 12339 - RNA, 62 nt, Human
gaaagggcuuugagaaaaggcuuugaauaaaacuagucauccaccuagccaaagauccuuuc

SEQ ID NO: 12340 - RNA, 61 nt, Human
gcaagugccuccggacauguggaucacaggcuacuagaaaccacgaguucccuccauuugu

SEQ ID NO: 12341 - RNA, 76 nt, Human
ggguccacuaucauuuaauuucccuugaaccugcucugcuaguuuaaucugcuaauaugaaaguuaauuaagaccu

SEQ ID NO: 12342 - RNA, 61 nt, Human
uuugcuaacugguaaauacuauuuacaagaagauucaaccuaaucaauaucacuuaucaaa

SEQ ID NO: 12343 - RNA, 65 nt, Human
guggugaagacaggccgagugaugcuuugggagaccaauccagcagauucaaagccaggcaccau

SEQ ID NO: 12344 - RNA, 71 nt, Human
ucccaaccauaggcuucaauguagaaacaguggaauauaagaacaucuguuucacagucugggacguggga

SEQ ID NO: 12345 - RNA, 123 nt, Human
ucgcacaauguuuuuauaguuaccagaguguacagauuuugcacauauuuuauuaaauuuuccccugauuacaaauuuugcuauggucugaaucucuguguacaccccaaauucauauguuga

SEQ ID NO: 12346 - RNA, 65 nt, Human
ugcugugcuuauaaaagaggccccugagagcauguuugcuccuuccuccaugugaggacacagca

SEQ ID NO: 12347 - RNA, 71 nt, Human
ggcggcugaggcggcauggaucucagcgagcuggagagagacaauacaggccgcugucgccugaguucgcc

SEQ ID NO: 12348 - RNA, 118 nt, Human
ggacuaugcauaugguccaauaucaaagggaaugauagcauugaaggacucggggauaucuaacagcaauaccugaucacuacuucgcacuaguuucucgguacuaugcauauggucc

SEQ ID NO: 12349 - RNA, 72 nt, Human
gggaaugauagcauugaaggacucggggauaucuaacagcaauaccugaucacuacuucgcacuaaguucuc

SEQ ID NO: 12350 - RNA, 72 nt, Human
gggaggauagcauucgaaggacucggggauaucuaacagcaauaccugaucacuacuucgcacuaguuucuc

SEQ ID NO: 12351 - RNA, 73 nt, Human
auagcauugaaggacucguggauaucuaacagcaauaccugaucacuacuucgcacuaguuucucgguacuau

SEQ ID NO: 12352 - RNA, 71 nt, Human
gagggauagcauucgaaggacucggggauaucuaacagcaauaccugaucacuacuucgcacuaguuucuc

SEQ ID NO: 12353 - RNA, 72 nt, Human; identical to SEQ ID NO: 9079

SEQ ID NO: 12354 - RNA, 83 nt, Human
cccagcugccggcagugcugguucuccaacagaguggugucuagauuuaucagaguaacgagaagacaaacuccggcacuggg

SEQ ID NO: 12355 - RNA, 63 nt, Human
cugauuaaagugccuucagccaagaccaucucucccuccuggugaagugugacuucgaauuag

SEQ ID NO: 12356 - RNA, 73 nt, Human
gccaagagccaucugaagccaccucucugccuguuccucccaagaggccaggguggccacggguggugagggc

SEQ ID NO: 12357 - RNA, 83 nt, Human
guguagagugggccucuggaguccggcugccuggguucaaguccaggcuccccuacucggggcacaggggugcugcucugggc

SEQ ID NO: 12358 - RNA, 65 nt, Human
guuuccucucuggcaaaauggugauugugaugauuaaguuauauccauuugagagaugaggaaac

SEQ ID NO: 12359 - RNA, 69 nt, Human
uagguaggcacacagagauacauagacagauaggcccagggguucacugccgcucugucugcaaaccug

SEQ ID NO: 12360 - RNA, 66 nt, Human
uuuuugaaggguuugaauacauauaacauaacacauagaauguacucgggauuuuuccuacaaaaa

SEQ ID NO: 12361 - RNA, 67 nt, Human
gccggugggaggaaaagagguaucuucuaaaauagagauaguucacauuauuucccucaucuuaggc

SEQ ID NO: 12362 - RNA, 60 nt, Human
uguacauaguagguugcucaccaauuucugaugacuggugaugcaaaaccugcggaguca

SEQ ID NO: 12363 - RNA, 65 nt, Human
aucuucucucccagcuuugagguuucggggcucuggaaaggccucugggaugcuggccuuaagau

SEQ ID NO: 12364 - RNA, 63 nt, Human
cuggggaacucacacgcugacccccgaggagccuugguuuccucccuggcagauaguccccag

SEQ ID NO: 12365 - RNA, 66 nt, Human
gaugguguuaagcuguacaccccaggacaguuuauccugucugaggaguaaguguacaaugugauc

SEQ ID NO: 12366 - RNA, 86 nt, Human
gggacuuuuucuuuggggauucgguccgggugguuucucccuuggugguuuguucacucguuuuuguuucccuuugggauuuuccc

SEQ ID NO: 12367 - RNA, 66 nt, Human
augaacaaguaugcuuggggagucuucuugcuggaggguucccuucacuguugcgugcuugaccau

SEQ ID NO: 12368 - RNA, 85 nt, Human
uuugaaaagaacacuuuuuggggcagccuucaaaaagguucauacauaccaacgggcuuucuuaaaauuggguucuaauguuaaa

SEQ ID NO: 12369 - RNA, 68 nt, Human
cccgaugcacuuugagggguguuggagaggggacucccccacucgcacuuaacucaacggcucucggg

SEQ ID NO: 12370 - RNA, 72 nt, Human
ccaaggagaacuucaguuugcuugacucguuuggaucacaacgagcuaaagcucagauugucuuaaacuugg

SEQ ID NO: 12371 - RNA, 94 nt, Human; identical to SEQ ID NO: 6534

SEQ ID NO: 12372 - RNA, 60 nt, Human; identical to SEQ ID NO: 6535

SEQ ID NO: 12373 - RNA, 66 nt, Human; identical to SEQ ID NO: 11222

SEQ ID NO: 12374 - RNA, 66 nt, Human; identical to SEQ ID NO: 11223

SEQ ID NO: 12375 - RNA, 130 nt, Human
aucucggcucauugcaagcucugccuccuggguucacgccauucuccugacucagccucccgaguagcugggaggcugaagcaggagaaucacuugaacccaggagguagagguugcagugagucgagau

SEQ ID NO: 12376 - RNA, 67 nt, Human
gcagagaggagcuguaacguguccaaggucacacagccugggaauuggguccuggucuccucugugc

SEQ ID NO: 12377 - RNA, 66 nt, Human
uugucuucuaguacagucugcaggguucaccuuuucccugacucagucuucuccuaagagugacaa

SEQ ID NO: 12378 - RNA, 87 nt, Human
cuaauaauuuuuagacagaagcaggacauugugugcaauauguuguagcaacuguggauuuuguguugcucuucugaagguuguugg

SEQ ID NO: 12379 - RNA, 62 nt, Human
ugcucaauugaauaucugugcuuacuaaguaccugcuuauuaagaccuuuuuuucuugagua

SEQ ID NO: 12380 - RNA, 80 nt, Human
ggauggauauaucacccacuggucagaaaggguuacugucacugauguugcaguuguccaggaucaacgggauaccaucc

SEQ ID NO: 12381 - RNA, 76 nt, Human
agugcgcagccuagaucccucacaugcacaguucacaguaggguuugcgcugcuaugagaaucuaaggcugccacu

SEQ ID NO: 12382 - RNA, 72 nt, Human
gguuccuaauaggccauggacccccacagacggguacuagucugcagccuguggaccccagcccuaggggcc

SEQ ID NO: 12383 - RNA, 66 nt, Human; identical to SEQ ID NO: 11638

SEQ ID NO: 12384 - RNA, 60 nt, Human; identical to SEQ ID NO: 11639

SEQ ID NO: 12385 - RNA, 81 nt, Human
acuuguauuugcugagccagugguauuaacucaugcauaaaacaaauuucgguuugcuauuucuucuagcaaauuucaagu

SEQ ID NO: 12386 - RNA, 118 nt, Human
guaagggagaauguaaaacaucaacucagccaggcuuuuguuuucugcagcaauaauaaagggccuccugcacuuagcaaaaaucugucuuaacuuuguagugcauuucuuccauuac

SEQ ID NO: 12387 - RNA, 95 nt, Human
gcgccuccgcuacuuccagggcuacgcgcgcuccgcgcagcucaggcuggcaccgcuguacgcgagcgcgcgcgcccucuggcugcugguggcgc

SEQ ID NO: 12388 - RNA, 68 nt, Human
gaagaaaauacauaaccagggacaccaaacaguuggauuuuuuguuuagugguuguugauuuggcuuc

SEQ ID NO: 12389 - RNA, 83 nt, Human
uuagggaauauuuugaggguuuuuauugcuucaguaguuucaaacuauuuugugucuauguaaguuggcuuuuauucuccuga

SEQ ID NO: 12390 - RNA, 111 nt, Human
ggagguggcagcggcagcuguuuuggccugugucucccugaucguucaagcucauacaugguuaaugauuaaugaggcagugugguguggcaguauccagcugccacuucc

SEQ ID NO: 12391 - RNA, 70 nt, Human; identical to SEQ ID NO: 5007

SEQ ID NO: 12392 - RNA, 85 nt, Human; identical to SEQ ID NO: 6504

SEQ ID NO: 12393 - RNA, 89 nt, Human; identical to SEQ ID NO: 2239

SEQ ID NO: 12394 - RNA, 60 nt, Human
ggugccagucaagggaugaguggggucuggaaucuagccucacgagggggauguggcacc

SEQ ID NO: 12395 - RNA, 72 nt, Human
ucuugagaagugggugagggcaugcaaauguaaaaaaguaagguguguucugggaucuacuaguucuugaga

SEQ ID NO: 12396 - RNA, 67 nt, Human
ugcuggguggaccagcguguuugcuccaggcuauguugaaauaguaugcagguuggucagggcagua

SEQ ID NO: 12397 - RNA, 84 nt, Human; identical to SEQ ID NO: 286

SEQ ID NO: 12398 - RNA, 89 nt, Human; identical to SEQ ID NO: 288

SEQ ID NO: 12399 - RNA, 94 nt, Human; identical to SEQ ID NO: 5398

SEQ ID NO: 12400 - RNA, 64 nt, Human
gcaucuuucuaagcucuccagacaacauuuccugaugucucccugggcagagcuaggacagggc

SEQ ID NO: 12401 - RNA, 62 nt, Human
gaggccccuaauccagacagguagccaacacuaccuggauuuuaggacuggauuuuagccuc

SEQ ID NO: 12402 - RNA, 64 nt, Human
ggucaguugcuagccucuaauaugauuuguuuaaauuacaguggacucagcccugcaacugcuc

SEQ ID NO: 12403 - RNA, 74 nt, Human
uuguuggauucuuauuggcaucacucaccagagaaggaaaaauggaugaugauucaagacaguggaagagacag

SEQ ID NO: 12404 - RNA, 64 nt, Human; identical to SEQ ID NO: 8200

SEQ ID NO: 12405 - RNA, 66 nt, Human; identical to SEQ ID NO: 2189

SEQ ID NO: 12406 - RNA, 67 nt, Human
accacauuagcuuggcucucugucucagaggguaucucuaagacuaggggcuugguauauauguggu

SEQ ID NO: 12407 - RNA, 80 nt, Human
guauccacagucacuguaagcauccaguaggcaggaagauggcuuugggcaguggcuggaugaaagcagauuugagauac

SEQ ID NO: 12408 - RNA, 61 nt, Human
uggggcugagagaugaagugagauuaaaguacuacucagcuuuugggucaucuggguccca

SEQ ID NO: 12409 - RNA, 63 nt, Human
auugcaagguaauauguaauaguaguguuuguaagauacucuugucuaauauuaacuaguagu

SEQ ID NO: 12410 - RNA, 78 nt, Human
ggauaguuggaacuaauguacagaacuaaauuuuuuaaacuuuauuugcuguuaaauucugugaaguuucaguuaucu

SEQ ID NO: 12411 - RNA, 62 nt, Human
uugauuuguacagucauaauuuguuaaaaugacuucauuuaacauucacugauguagauuaa

SEQ ID NO: 12412 - RNA, 80 nt, Human; identical to SEQ ID NO: 9102

SEQ ID NO: 12413 - RNA, 60 nt, Human
aauuuaaaaauaagucuauguuuucacauugauuuuaaaaaaauauagcauguuugaauu

SEQ ID NO: 12414 - RNA, 68 nt, Human
gaguaaaaaaguguuucauaaguaaugugauccaucacauucugccagccaaaauucuuugccugcuc

SEQ ID NO: 12415 - RNA, 82 nt, Human
aaggcgccagagcugaagaccagccccuagaagccacaccccugcccuucuagcagcuacggguccucuggcuccgggccuu

SEQ ID NO: 12416 - RNA, 66 nt, Human
guagauguaaccggugcccccuccccguugugacugagggcgaguguuauaccuggcugcgugugc

SEQ ID NO: 12417 - RNA, 68 nt, Human
guauuuaagcuaaauugccuuuuaaauuccuucaagcuugguucauugaggugguuaaguauaaaugc

SEQ ID NO: 12418 - RNA, 66 nt, Human; identical to SEQ ID NO: 4249

SEQ ID NO: 12419 - RNA, 74 nt, Human
ggguccggugcggcuccggaaguagucgugcccuuugcuggggcauucagagacagaguuucaccgugguaccc

SEQ ID NO: 12420 - RNA, 78 nt, Human
uaaguacuuucccuucucucacaccugugguugcgugggcuugccuuaugaccaacugaaagagugggaaaaagcuug

SEQ ID NO: 12421 - RNA, 74 nt, Human; identical to SEQ ID NO: 365

SEQ ID NO: 12422 - RNA, 102 nt, Human; identical to SEQ ID NO: 2172

SEQ ID NO: 12423 - RNA, 77 nt, Human; identical to SEQ ID NO: 3082

SEQ ID NO: 12424 - RNA, 96 nt, Human
caguaggccagcaccgugucgcgcagcgccagguucucgggcagugccuuggcccaguagcccggccgcgugaccagguccgggcaggcguacuug

SEQ ID NO: 12425 - RNA, 85 nt, Human
gcgggccgcccacggccacgccgcaguggaagagcaccggcucgccgucguucacgcuguagaacacgcggccguggcggucggc

SEQ ID NO: 12426 - RNA, 69 nt, Human
ucaauuuuuauuuuuuauuuuuuuuauuauuaaaugauguggucuauggaaaaaaaaauaaaaaucuga

SEQ ID NO: 12427 - RNA, 63 nt, Human
gacacccaccgcaacugucugucucauaucacgaacagcaaagcgacccaaagguggauaguc

SEQ ID NO: 12428 - RNA, 64 nt, Human
cagcgguuggaucauuuucauugcugugaaauacaccacaauggauuuaugcauucaaccguug

SEQ ID NO: 12429 - RNA, 84 nt, Human
ugggucguuucccguuuggcaagaugaugaagaaagcugguaugagcauucuuucacacgucuuuucuugggcauauguacuca

SEQ ID NO: 12430 - RNA, 62 nt, Human
gagcccucugagaggcccagguccuaaagcagcuucugccugggcugaggucuugggggcuu

SEQ ID NO: 12431 - RNA, 65 nt, Human
gccucccagucuccucuuccaacucuguccuguuugaugauggccucagggagacaagggauggc

SEQ ID NO: 12432 - RNA, 68 nt, Human
ggggccggggaccccugccgcgcccccguacccggacggugauggggcgaggaggggugcugggcccc

SEQ ID NO: 12433 - RNA, 77 nt, Human
cauuacuuggcaaacacgguauaaaacaaguuuaaacaauuagaaaaaugaaaacgauaccauuaugccucauagug

SEQ ID NO: 12434 - RNA, 77 nt, Human
ggauuguugaacuguuaccagcaccaugcuuucagcaacauuucagcggaguuggaaacauuuuuuacagcaaaacc

SEQ ID NO: 12435 - RNA, 70 nt, Human; identical to SEQ ID NO: 6301

SEQ ID NO: 12436 - RNA, 64 nt, Human
cauagguuauuggggaacaggugguguucaguuacaugagcaaguucuuuaguggggaucugug

SEQ ID NO: 12437 - RNA, 60 nt, Human
ugcucucaggagugcaacgagguaaaagcaagaagcucuauucaacgcauuuuuuaggua

SEQ ID NO: 12438 - RNA, 98 nt, Human
caggggcagcuccgguggcggcccacaggacaccagccccaucuugcagguguaggacaggugguaguugcaagggcaccgucacuccauugucccug

SEQ ID NO: 12439 - RNA, 63 nt, Human
ccccacagacgauucccuguccccugccucaugcuccggcaggguacaggcucgcaccugggg

SEQ ID NO: 12440 - RNA, 77 nt, Human
ggagguggcagguguaggaucaucuggugagcaaguagagucaccaagucuggaugaccacuacccccacuaccccc

SEQ ID NO: 12441 - RNA, 130 nt, Human
agcauggaauuuaaguuuuguauuuugaacaaaaauagcaacaucuguuuucuguauggcaaagaaaaacuaaaucccagacuuuuauuuuuaaccacagaaaccaucacuucuuucuaaauuauuugcu

SEQ ID NO: 12442 - RNA, 64 nt, Human
ucuguuauauagaaaguuaacauuucaggagcacaauuauuuccugauuucaaauaugaacaga

SEQ ID NO: 12443 - RNA, 94 nt, Human
ccgaggaccuccugaccccgcgguggcagcugggaccgcgcuacgcggcuaagcaguucgcgcguuacggcgccgccuccggggugguccccgg

SEQ ID NO: 12444 - RNA, 69 nt, Human
cuggccccggguucccguggcuaccgggcgcggcgcccccgcgccgcaggccgggaccccgguggccag

SEQ ID NO: 12445 - RNA, 67 nt, Human
gcagagaguuggcaggugccucugccccacuggagcagaugauaggcucggccuggucacucucugc

SEQ ID NO: 12446 - RNA, 94 nt, Human
guaggcacuuaggauggcaccaugccagacacggguugaguugaugggcaauuuggaugguugcuggaguggugagcgcauuagaaggcacugc

SEQ ID NO: 12447 - RNA, 84 nt, Human
ccagcgcccaaggaaggccacuucucaacuggcagaacuucugaaguuuagaauuggaauuacuuccuuacuagugucuuuugg

SEQ ID NO: 12448 - RNA, 83 nt, Human
gggaaaggaaugccugggagugggggugcaggcgggcagcacugagggacccugccccgccccuccccccaggccccuuuccc

SEQ ID NO: 12449 - RNA, 93 nt, Human
uccauuguuuaaaaauaagucuuggaaacuauaguauuguagcuguucucuaacagcaccaauuaugacgggaaccaggaacuaugaaguggg

SEQ ID NO: 12450 - RNA, 72 nt, Human
acuccucgcuuacgagcuccacagcacaaagggcaucaaaagacuguugugagaggaacgcaagcgaggggu

SEQ ID NO: 12451 - RNA, 68 nt, Human
cacccacuccacggugcgcacaucaaggacguccacgcccauacucgcuguacaccgugacgugugug

SEQ ID NO: 12452 - RNA, 75 nt, Human
ugggguauuaccagguuaagaggcugcccgucccccuggaugcucagcaggcugaacccagaaggguaagcccca

SEQ ID NO: 12453 - RNA, 64 nt, Human
gcugcacaacucccucauuggcaccaagggccgucugauccgcuccaucauggaggagugcggc

SEQ ID NO: 12454 - RNA, 60 nt, Human
cccauuuuaaucaauuugaaagguuaauuuaaaccucuagaggugaaugagcaacauggg

SEQ ID NO: 12455 - RNA, 104 nt, Human
uguagccauuauguaaauaaaguuucauauguaccuguuuauuugggcagauuaaguccaacauaugaauguauauaucgcauaacuauguuagaauggucaua

SEQ ID NO: 12456 - RNA, 68 nt, Human
gaauccagcagcacaucaaaauccaccaugaucaagucagcuucaucccugggaugcaaggcugguuc

SEQ ID NO: 12457 - RNA, 69 nt, Human
cggcgacgccaaggaccaggaguaggggcacccgcgggccuccgcugcccgacgcuucuguucggcccg

SEQ ID NO: 12458 - RNA, 68 nt, Human
ccgcgccaucaacaucgcgcugcagguggcugccaauaccuccaccguggagcuuguugaugagcugg

SEQ ID NO: 12459 - RNA, 98 nt, Human
ucuucgcaugcuugaguacugggaccucgggaccagagccauuguuaagaaaaaggccuuguuucccugggaagcccaaaggacuuuugcauugaggg

SEQ ID NO: 12460 - RNA, 62 nt, Human
cagucucuaguuagaucgacaugguuuauaaauuccuacacuuuguaaaucuaaagagaaug

SEQ ID NO: 12461 - RNA, 96 nt, Human
gacacuggcaacauugcggacacccuccaggaagcgagaaugcagaguuuccucugugauaucaagcacuucaggguuguagaugcugccauuguc

SEQ ID NO: 12462 - RNA, 63 nt, Human
ggagaagggggagauguugagcauguucagcaacguggcuucgcuggcucccacuuugucucc

SEQ ID NO: 12463 - RNA, 64 nt, Human
agccagauuugcagcuacgaaaucaucacuccagacgugcccuuuacuguugacaaagaugguu

SEQ ID NO: 12464 - RNA, 61 nt, Human
gaggggaagcaguacgacagcauuuugaggguggaggccguggaugccgacugcuccccuc

SEQ ID NO: 12465 - RNA, 66 nt, Human
gcugaccgucacugccuaugacugugggaacgaaaagagccacagaagauguuggugaagaucagc

SEQ ID NO: 12466 - RNA, 60 nt, Human; identical to SEQ ID NO: 7325

SEQ ID NO: 12467 - RNA, 72 nt, Human
guggagcagauaaccauuguuucucggccgcuaucuggucagaggggagcugggccgggaaauucugccuac

SEQ ID NO: 12468 - RNA, 64 nt, Human; identical to SEQ ID NO: 7327

SEQ ID NO: 12469 - RNA, 63 nt, Human
gaaagagacuuguccucuggucccugucucugaaaggacaccagauggcuaaauauuucauuc

SEQ ID NO: 12470 - RNA, 62 nt, Human
ggcuccugugucuucucacucuugguauuccugcuugugcaggagccuguguacacagggcc

SEQ ID NO: 12471 - RNA, 64 nt, Human
gucugccucugccucuugcucacccugcuggcuccugguggguuucaucccaggcagaguugac

SEQ ID NO: 12472 - RNA, 76 nt, Human
gccucacuggcuggguucaaaaagggaggggccaggcacaguggcucacgccuguaaucccggcacuuugggaggc

SEQ ID NO: 12473 - RNA, 67 nt, Human
cucugacaggccucaccagaggugccaccuacaacaucauaguggaggcacugaaagaccagcagag

SEQ ID NO: 12474 - RNA, 75 nt, Human
gacaagaagcucucucucagacaaccaucucaugggccccauuccaggacacuucugaguacaucauuucauguc

SEQ ID NO: 12475 - RNA, 74 nt, Human
gucgugcgugccccaacgaaggggggaaacaacccagacgggaagacccccaauaguggagagggccgcaucac

SEQ ID NO: 12476 - RNA, 106 nt, Human
ccuaagguuuuguuguguucuguugaaggugccauuuuaaauuuuauuuuuauuacuuuuuuuguagaugaacuugagcucuguaacuuacaccuggaauguuagg

SEQ ID NO: 12477 - RNA, 62 nt, Human
uuccgagaaugccgaggaguugucguuuuuagcuuuguguuuacuuuuuggcuggagcggag

SEQ ID NO: 12478 - RNA, 87 nt, Human
uugguagugccccaccucccgcccucaccugcagagaaacgcgcuccuuggcggacacugggggaggagaggaagaagcgcggcuaa

SEQ ID NO: 12479 - RNA, 83 nt, Human
ggagcgccgcccuccucccgaaaccggccggggcgaguggcugcaagaagcugcgguuuggcccgcgggagaggggggcuucc

SEQ ID NO: 12480 - RNA, 65 nt, Human
ucagcgaacuguguuuugaagauuugagggaagggcugaccucaggauuuuauacuaguugcuga

SEQ ID NO: 12481 - RNA, 85 nt, Human
uccauaacagcagacaaaauuggaagcaagagugauuuuggaggagucacacuuagauguuucccuuaccuauuucuguucugga

SEQ ID NO: 12482 - RNA, 76 nt, Human
uuuaaaaaucuuacuucucgugacaguccuacaugaaaaauuaaaaaucacaaggauucauggauggaaaacugag

SEQ ID NO: 12483 - RNA, 82 nt, Human
agagcugcauucagugcaaccagagacccuuucguuccaaccaggagccaguggggcuggugacgaagcuggcuggagcucu

SEQ ID NO: 12484 - RNA, 71 nt, Human
gggcuccuggggugggggccgccugaggcugcccguugcugcaguccgggucggccuuugccuucuucacc

SEQ ID NO: 12485 - RNA, 67 nt, Human
ccugccccgccccaccccacugggcuuagguuaucuucgugccuuaguaucucgggcccacugcagg

SEQ ID NO: 12486 - RNA, 70 nt, Human
ccuucacccucaagcgcugcagaagcaugaggugagggccugcagcgcucuguaccguuuaggguguugg

SEQ ID NO: 12487 - RNA, 84 nt, Human
gggagccuggcaggccuggcccagcggccagggugaguguucucagaccccgggcagcuggugguucuccagggccagguaccc

SEQ ID NO: 12488 - RNA, 65 nt, Human; identical to SEQ ID NO: 5213

SEQ ID NO: 12489 - RNA, 62 nt, Human
gaacauggagagugccaagaucaccaucaggugccgcuuccuuccuguggcuuuccaucuuc

SEQ ID NO: 12490 - RNA, 84 nt, Human; identical to SEQ ID NO: 10334

SEQ ID NO: 12491 - RNA, 66 nt, Human; identical to SEQ ID NO: 10335

SEQ ID NO: 12492 - RNA, 64 nt, Human
ugcccuguucucuccuuccuugcccucuucuuggaauuggaaguauuuuucaaagacagaggca

SEQ ID NO: 12493 - RNA, 95 nt, Human
cucagcucagagccuuccgcuuccagggccaaccccagccccguuugcugcguuguguaagggcuuggggucuuagaagcugcucuuuagcccag

SEQ ID NO: 12494 - RNA, 98 nt, Human
gccgugacucuagcacucucagucgcuguacaguuucuauggugugaaugaacuucccuccuaguugcugauggcgcugguaccugcuggcccauggc

SEQ ID NO: 12495 - RNA, 65 nt, Human
ccaugaacuaagaggccagaaggcaaguauugccuuuccuucauaugguuugaugugguacaugg

SEQ ID NO: 12496 - RNA, 68 nt, Human
cugguagcauucaguguaccauaccuauguggaaagaacuccguaggggacacaugaggugcuggcag

SEQ ID NO: 12497 - RNA, 66 nt, Human; identical to SEQ ID NO: 6380

SEQ ID NO: 12498 - RNA, 80 nt, Human
gaggaucccuugugcuagguggaguggauggaugaucuaggcucacuacaaucuccaccucccagguucaagcgauucuc

SEQ ID NO: 12499 - RNA, 83 nt, Human
gccucagucuccugaguagcugggguuacaggugccugccaccaaguccagcuaauuuuuguauuuuuagguagagauggggu

SEQ ID NO: 12500 - RNA, 69 nt, Human
uuugaaggagaaacagagcagaagcgacaccuguuggggguuguggaucuguuuguuucugcagucaga

SEQ ID NO: 12501 - RNA, 70 nt, Human
ugggugccaggagaggggaaggaccuuugucugggcguuaccaagggcuggaaacuuuaccugguaccua

SEQ ID NO: 12502 - RNA, 98 nt, Human
accauggcguccuccgcggccggcugcguggugaucguuggcaguggagucauugggcgaagcugggccaugcuguuugccaguggaggcuuccaggu

SEQ ID NO: 12503 - RNA, 120 nt, Human
agguucucugaaaggcucccugaguguggaagagcagcugucacucaucagugguugucccaauauccaagaagcaguagagggugccaugcacauucaggaauguguuccagaagaucu

SEQ ID NO: 12504 - RNA, 68 nt, Human
gaacugaagaagaagauuuuggcucaguuagauuccaucauugaugaucgagugaucuuaagcaguuc

SEQ ID NO: 12505 - RNA, 60 nt, Human
cagcaaugugagacuggccagugcuuuuccccuucguccauucccagucacaugauguug

SEQ ID NO: 12506 - RNA, 82 nt, Human
ggacugucuuguccacaugugaggaaagaugaaaaaaaaaacauuaauuccaagcuuagauaggugaaaauaaaaacagucc

SEQ ID NO: 12507 - RNA, 74 nt, Human; identical to SEQ ID NO: 1525

SEQ ID NO: 12508 - RNA, 93 nt, Human
cugugggccagaaagcaggcaccagggcugaccucaaggccguaucagagggccaagcagaguucuuuuggauaccugcuuuucaucccacag

SEQ ID NO: 12509 - RNA, 73 nt, Human
ugcuaaauguuuucuucaagggaaccagauuuaguucuuuacagaauuuuccagugaaauaaaacauguugua

SEQ ID NO: 12510 - RNA, 66 nt, Human
gcagcgugcgucucuggcugcagguguggucuucggcaucuagcggccuggguuguuaccagcugu

SEQ ID NO: 12511 - RNA, 74 nt, Human; identical to SEQ ID NO: 521

SEQ ID NO: 12512 - RNA, 94 nt, Human
ucguucugcagauugacaaugcccgucuugcugcugaugacuuuagagucaaguaugagacagagcugggcaugcgccagucuguggagaacga

SEQ ID NO: 12513 - RNA, 104 nt, Human
ucucuugcccucugucauccuagcaguguggaugguugguugggaucuucgugucccgucucagcacacucgagcucugaagugacagugaggaagggcaggga

SEQ ID NO: 12514 - RNA, 68 nt, Human; identical to SEQ ID NO: 6194

SEQ ID NO: 12515 - RNA, 68 nt, Human
aaggcuuagaggcuggaccagcauuguugggcaaggacugacucuccaaggguuuaguucuuggcuuu

SEQ ID NO: 12516 - RNA, 85 nt, Human
gcagcugaaggcuaggcgccacugggccuggaauucgccacaggacggaucuuacagaggcaaguggucccuggaccucucuugc

SEQ ID NO: 12517 - RNA, 63 nt, Human
gcccaccuggcacgggccagcucggauaucgugucccuggcagggcccagugcugggccgggc

SEQ ID NO: 12518 - RNA, 101 nt, Human
ggcucuguuuccuccuuccuuccuuggcucuguccuuuugcugacuuccucuuccuuagccagcagaacucacccuggggucggggcaguggggaggggcc

SEQ ID NO: 12519 - RNA, 66 nt, Human
agcucuuaucuuugguggcuguggucggguguuugcuggugcccccagcugaagccaacaagaguu

SEQ ID NO: 12520 - RNA, 84 nt, Human; identical to SEQ ID NO: 2448

SEQ ID NO: 12521 - RNA, 63 nt, Human
gcgauccuucaacgugccuggucugaggggcaucgccuuucuauccacuagcguucggaccgc

SEQ ID NO: 12522 - RNA, 84 nt, Human
gaauuuuuuauacaguuacuaguuuaaugggugaaaaauaguauuguuuuaauuuucaugucauuaauagugaaguuaauauuc

SEQ ID NO: 12523 - RNA, 67 nt, Human
gaggugggcggaucaccugaggccgggaguuugggaccagcugggccggcauggagaaacccaucuc

SEQ ID NO: 12524 - RNA, 87 nt, Human
cuggggguguugccacaaaaguagacaugcgggcacuucugggaagaugaacgggucaguuuuuguaagaagggguaacaaaccuag

SEQ ID NO: 12525 - RNA, 60 nt, Human
gccuccaucugggccucucuggucaaaaccacuuuuuugagucaggggcccagccuaggc

SEQ ID NO: 12526 - RNA, 60 nt, Human
cuguuucagacccccccauuucccgcacaugguguggggggcugggggagguccaagcag

SEQ ID NO: 12527 - RNA, 79 nt, Human
guguuuuauuauuaucgcuuuauguuuuugguuauugguuuuuuuguauagaccaaagcaaagaaaauaaaaauaacac

SEQ ID NO: 12528 - RNA, 78 nt, Human
cuggugauuaaggaagauggacacauggucacugcccgacaggagccucgccucgugcucaucuccaucauuuaugag

SEQ ID NO: 12529 - RNA, 74 nt, Human
gcaguggagggggcaggaccuccugcuggugcagcaccagcugcugguagcagguccaccggccccuacauugc

SEQ ID NO: 12530 - RNA, 64 nt, Human; identical to SEQ ID NO: 1642

SEQ ID NO: 12531 - RNA, 70 nt, Human
ggcucccaauguugacguuggccagggcuuuugcaaacaagccaggccaaaaaggcucaacauuuacacc

SEQ ID NO: 12532 - RNA, 70 nt, Human
uuacuuuucaccagcaucuuuacuauaauuaccaaaaacauguauauaaaagaaugaaauggaaaaauaa

SEQ ID NO: 12533 - RNA, 89 nt, Human
gugugugcagacagagaagaagccuuuaaagaaaaagauguucaaagacuuaugcgacagauuuuagaagguguucacuuuuuacacac

SEQ ID NO: 12534 - RNA, 78 nt, Human
guuaugauccuauaagcauggcaacagauauguggagcauuggaguguuaacauaugucaugcuuacaggaauaucac

SEQ ID NO: 12535 - RNA, 97 nt, Human
uuacacacucgugauguaguucaucugugauugugaagccucagaauauucugguugacaagugaaucuccaugugggugacauuaagauuguguga

SEQ ID NO: 12536 - RNA, 71 nt, Human
ggaagagguauaccugucucuaaaggaagcgcacgucaguuuccaaacagaagcaagagguggaacccucc

SEQ ID NO: 12537 - RNA, 92 nt, Human
uccuguccagcugcucuauccagugucccgauucagcaaugucaaaucccuccagcaccuuugcagauuccggauacgacagcucgucagga

SEQ ID NO: 12538 - RNA, 68 nt, Human; identical to SEQ ID NO: 10215

SEQ ID NO: 12539 - RNA, 64 nt, Human
aaauaugguaauauuacagcccgacacacugcguuucuucaugugauaauaacugcacauauuu

SEQ ID NO: 12540 - RNA, 89 nt, Human; identical to SEQ ID NO: 288

SEQ ID NO: 12541 - RNA, 61 nt, Human; identical to SEQ ID NO: 776

SEQ ID NO: 12542 - RNA, 79 nt, Human
cugaggaugccaaggacuucuucaagaggcagauagauuuucuaaccaagcagauggagaaaaccaaacagcucuucag

SEQ ID NO: 12543 - RNA, 63 nt, Human
ucuuggcuuccacguccauugcucagcucacagugguacagaccaaguauguggaagccaagg

SEQ ID NO: 12544 - RNA, 70 nt, Human
uguaugucccugggaagcugcaugauguggaacacgugcucaucgaugugggaacuggguacuauguaca

SEQ ID NO: 12545 - RNA, 84 nt, Human
gggggguagagauaggaucucacuauguugcccaggcuagccuugaacuccuggccucaagugauccuccugccucagccuccc

SEQ ID NO: 12546 - RNA, 63 nt, Human
ccgcaucagcuccucgagcuucucccgagugggcagcagcaacuuucgcgguggccugugcgg

SEQ ID NO: 12547 - RNA, 88 nt, Human
uccaggccgugcgcacccaggagaaggagcagaucaagacccucaacaacaaguuugccuccuucauagacaagguacgguuccugga

SEQ ID NO: 12548 - RNA, 71 nt, Human
ccucgggacacaugguuaucucagugauaccuugaagaagcugaagauaacagcuguggacaagacugagg

SEQ ID NO: 12549 - RNA, 67 nt, Human
ugcuuggauggucugcuucaagcccgugguucaaaauaauacggaaacaagugaaaaaguccaagca

SEQ ID NO: 12550 - RNA, 74 nt, Human
ccgaggagaagcgcgagggcuacgagcgucuccugaagaugcaaaaccagcguggcggcgcgcucucuuccagg

SEQ ID NO: 12551 - RNA, 65 nt, Human
ucugggaccugccagcaccguuuugugguuagcuccuucuugccaaccaaccaugagcucccaga

SEQ ID NO: 12552 - RNA, 67 nt, Human
aaaggucguuuuguguuuugaguugaaauggguuguuccuugcccagaaacuggaagaagggucuuu

SEQ ID NO: 12553 - RNA, 96 nt, Human
cuagagcuuuuguugaugauaugaaugaucuggauucagugaguucaguggucauuuaauccaguccuaccucucauacagcagacagauagauag

SEQ ID NO: 12554 - RNA, 89 nt, Human; identical to SEQ ID NO: 288

SEQ ID NO: 12555 - RNA, 85 nt, Human; identical to SEQ ID NO: 11784

SEQ ID NO: 12556 - RNA, 62 nt, Human
guguugcaauuuuacuguaaguuugaaacugucaauacaaaaaguuacaaagaauuguuuau

SEQ ID NO: 12557 - RNA, 129 nt, Human
cuaccuuuaagaugcaguaugaucgaacuugugaguggacaggacuuaaauucagcaaugauggcaagcucauccucauuuccaccaacggcagcuucauucgucugauugaugcauucaaaggagugg

SEQ ID NO: 12558 - RNA, 64 nt, Human
ggaucccagcgagcgcagguaucauacgagaaggcgagauaccggacugugugccgggggaucc

SEQ ID NO: 12559 - RNA, 88 nt, Human
agugagaaaugggacccugccuuacugccaaccuacuguuugaggagccagaaguugacaugaaguugcaaggucaccuuuucaagcu

SEQ ID NO: 12560 - RNA, 89 nt, Human
gacaucuugauuauugugacaacucuagaccugccugcuuuaucuaauguaaucaugcucaaugucuacagguuguuuaauaaucaguc

SEQ ID NO: 12561 - RNA, 78 nt, Human
guuaagcagcacuuauguagacugcauuuccaaauguguugagcacucagaguguagucaacaguaaguucuuuuaau

SEQ ID NO: 12562 - RNA, 60 nt, Human
uugcuucuaugauacagagaugucuaaaaacuucaaauggacauguuuguaguuuagcga

SEQ ID NO: 12563 - RNA, 84 nt, Human
gggaccuggcauggggcuggaaggggggauggaacagcgccuuccagcgucccaguagccuccccugacguccuucuggguccu

SEQ ID NO: 12564 - RNA, 83 nt, Human
auggccgaggagaagcgcgagggcuacgagcgucuccugaagaugcaaaaccagcguggcggccgcgcucucuuccaggacau

SEQ ID NO: 12565 - RNA, 63 nt, Human
ccaucucugugacuuccuggagacucacuuccuagaugagaagugagcuuucagaagaggugg

SEQ ID NO: 12566 - RNA, 72 nt, Human
cccagagccaugaaagcugcauggccuggagaaaaagcugaaccaggccuuuguggaucuucaugcccuggg

SEQ ID NO: 12567 - RNA, 61 nt, Human
uccccgaaggucccaccauccccgcaggaacucccuggauggagggggccgaucccgggga

SEQ ID NO: 12568 - RNA, 100 nt, Human
guuccucucccagcuccaucucuuucccuagggaccaggcacucauauggcggggugggguccuagccucaguuugaagaagugggggcuggagcggggu

SEQ ID NO: 12569 - RNA, 66 nt, Human
cccagccgagauguccagauguugcuuuagaccugaagggcagcucgggagguccaguaggcuggg

SEQ ID NO: 12570 - RNA, 81 nt, Human
ccugcccagugcugaguugucuucgagguuggcgcuccuccaggaaagcgauuggcugcguggaguuuagaaugggaaagg

SEQ ID NO: 12571 - RNA, 63 nt, Human
ccucccacuaccacccaaucugccugccacagaaaagugcaggccccuuggccccccuggagg

SEQ ID NO: 12572 - RNA, 60 nt, Human
gcgggcaggggcuacagggcauccagaauguggucaaucuuggugaccaguuccugccgc

SEQ ID NO: 12573 - RNA, 62 nt, Human
gcuccuugaccugugcauacagcuucugcauuuucguucacucugucgcaaagaucaagagc

SEQ ID NO: 12574 - RNA, 69 nt, Human; identical to SEQ ID NO: 3814

SEQ ID NO: 12575 - RNA, 69 nt, Human
guuuuguauaacuuuauugcaagucacauaaucuugguuuagacuugacgcaacgggagguuacagagc

SEQ ID NO: 12576 - RNA, 60 nt, Human
acuucggaacccagggcaggcucuaccacuagccuagggcuugucgugugucccugaagu

SEQ ID NO: 12577 - RNA, 63 nt, Human
cguugaagccacgcccucuuucccaccaacccucuggucucauccacacaggguggcucuuug

SEQ ID NO: 12578 - RNA, 75 nt, Human
gggggcggcugggggccugagcgggaggccaucaucaaccuggccacccagcccaagaggcccauguccaucccc

SEQ ID NO: 12579 - RNA, 66 nt, Human
uccaucgggcagccagaggcccagcgucuccgaugacacugagcaccuggugaauggccggaugga

SEQ ID NO: 12580 - RNA, 72 nt, Human
ucuuaacuugauuauauuugcaaagacccuauuuccaaauaaggucacaugcacagguacugaaaauuagga

SEQ ID NO: 12581 - RNA, 67 nt, Human
uucauguggcauuuuccucuccuuauaagaacaccaguuauacuagguuagagcucacccucaugaa

SEQ ID NO: 12582 - RNA, 65 nt, Human
ggugagcuugcuggacuugcuugucggacuggcugagaagcccggucacguuguccagcuccacc

SEQ ID NO: 12583 - RNA, 79 nt, Human
gccaggccuccucauccaaguacauccuggauccucuuucucucugguuuccagguacucaggaacuaggccauuuggc

SEQ ID NO: 12584 - RNA, 74 nt, Human
gguacaguugguggcuaucaaauuaggacucaguaauuacuugugucacugagugaaagcugcucauugcugcc

SEQ ID NO: 12585 - RNA, 71 nt, Human
ccauugagcagucacaucgcugggaucaaguaagccuucaaaaauaugcucccagagauacaagccaaugg

SEQ ID NO: 12586 - RNA, 65 nt, Human
ucaucuccuucccaaggauuccauucuucacuuuccaaaguggacuguucuugcggcgauuuuga

SEQ ID NO: 12587 - RNA, 88 nt, Human
caucacauguaaacccagcuaacagaaaaauacauucacaagcguuguugguggugguguguauggugugcuaugggucaaugugcug

SEQ ID NO: 12588 - RNA, 65 nt, Human
gaaggaaggguguuauuacggaaaaagcuaacggcacgacguuuauuuuucccccacaaucuuuc

SEQ ID NO: 12589 - RNA, 65 nt, Human
ucuguagcaaguuaauaccauaauuuaauuacaaauggauaaauaugguaacggguauuuacaga

SEQ ID NO: 12590 - RNA, 86 nt, Human
cagggcagccuggcccagcaggucaaggcgccacagggggccaucagguccagcuggcgcaggccggcaggggagggucugcucug

SEQ ID NO: 12591 - RNA, 98 nt, Human; identical to SEQ ID NO: 1212

SEQ ID NO: 12592 - RNA, 82 nt, Human
uuucuauagagaggcuuucacuuuugaguucuuugaguuuaaagauugcuuuucuugaaaugcucuuuuuuuaauguagaaa

SEQ ID NO: 12593 - RNA, 78 nt, Human
aaguuuacuuuguaaacaaacaacugugaggcaaucuagaggguuagcgagccucacuuuaguuuccggagugggcuu

SEQ ID NO: 12594 - RNA, 63 nt, Human
cacucauuaaaaacacuuaacacauccaauuaaagguucugcaaagucuucugcuggugggug

SEQ ID NO: 12595 - RNA, 62 nt, Human
guaggaauggcaguacaauacaaaguaaucucuccuaauuuauuucuuguacaucuuucuac

SEQ ID NO: 12596 - RNA, 102 nt, Human
ucuugcuuugcacaucaaugguucaaaauuuauagcugcagaauauucucaagucaugaauauuaggugucugucaaucuuggccuaaaacguaaaauaaga

SEQ ID NO: 12597 - RNA, 63 nt, Human; identical to SEQ ID NO: 1366

SEQ ID NO: 12598 - RNA, 86 nt, Human; identical to SEQ ID NO: 1381

SEQ ID NO: 12599 - RNA, 60 nt, Human
aguggacagggggaucuuccaagucuggaaaguugaacaggagaugaccuucaggccauu

SEQ ID NO: 12600 - RNA, 86 nt, Human
ggcaaucuuuucgaaguauggcgaaaugugggcugcucuguucauaagggcuugccuucguucaguauguuaaugagagaaaugcc

SEQ ID NO: 12601 - RNA, 66 nt, Human
guggccgcuucaguaggcagcgagcaucugugguggggggagcugcugcaguuccugaacggccac

SEQ ID NO: 12602 - RNA, 66 nt, Human
accauuggccauuucuacauguuauucgcuuguuacccucaaguugauacaaguucuggcauuggu

SEQ ID NO: 12603 - RNA, 72 nt, Human; identical to SEQ ID NO: 1696

SEQ ID NO: 12604 - RNA, 82 nt, Human
guuugaguucaaagauggagcgaggguggauauggugggaaggggcacacggguucucacgcaacaacggaggaaggcaggc

SEQ ID NO: 12605 - RNA, 81 nt, Human
cugccgugcccggaauuccaccagcucucggaagaagacucugaagucgaagaugggggugucacaguuccgaggcagcag

SEQ ID NO: 12606 - RNA, 64 nt, Human
cugcuccagcuccauaaggaagcacucgaugucgucauagaggcuguuggcgcuggacaggcag

SEQ ID NO: 12607 - RNA, 85 nt, Human
gccaggguuccagcuucaccaggaccaggcucuucuccuugggccucccagcugacagguccugcccgaagcccagguagauggu

SEQ ID NO: 12608 - RNA, 77 nt, Human; identical to SEQ ID NO: 3082

SEQ ID NO: 12609 - RNA, 81 nt, Human
auugcacuguggauacauaucuauguuuacgcgcuauuagaacagaaggcgcuguauauagaaauguugcuuugaagcaau

SEQ ID NO: 12610 - RNA, 83 nt, Human
cccuuucgccagcuggcguaauagcgaagaggcccgcaccgaucgcccuucccaacaguugcgcagccugaauggcgaauggg

SEQ ID NO: 12611 - RNA, 93 nt, Human; identical to SEQ ID NO: 11109

SEQ ID NO: 12612 - RNA, 89 nt, Human
gauuucugaauguaaaguuguuguguuuuuuuuuaaauaguaguuuguaguauuuuaaagaaagaacagaucgaguucuaauuaugauc

SEQ ID NO: 12613 - RNA, 71 nt, Human; identical to SEQ ID NO: 1145

SEQ ID NO: 12614 - RNA, 67 nt, Human; identical to SEQ ID NO: 1146

SEQ ID NO: 12615 - RNA, 69 nt, Human
cgcucacucuucuauagugggucaccauuaggucaagccacagagaguuacccguacagagagugugcg

SEQ ID NO: 12616 - RNA, 82 nt, Human
gcguaauaguaguagauugucguccuaguuagucgcuggugguaagcgauagcucagagagaggucacuacuacuaguuagu

SEQ ID NO: 12617 - RNA, 69 nt, Human
gcccuacagcucccaggauguguucgggaaccuacagcgggaacacggacugggcaaggcggugguggu

SEQ ID NO: 12618 - RNA, 79 nt, Human
ggcgcggggaagacccgggagggcagugggugaggaggucgguugaguggcccccuccccugccuuucucuccguagcc

SEQ ID NO: 12619 - RNA, 63 nt, Human
uuugcggaucaggaccaguuugacauggugagugaugcugaccuucaaguccuagauggcaaa

SEQ ID NO: 12620 - RNA, 82 nt, Human
cccuuucgccagcuggcguaauagcgaagaggccgcaccgaucgcccuucccaacaguugcgcagccugaauggcgaauggg

SEQ ID NO: 12621 - RNA, 60 nt, Human
guguuggaaaaucuacuacagggaacaaaagcaacacaucuuucucagugguuccaacac

SEQ ID NO: 12622 - RNA, 125 nt, Human
gccuucuaauuauuuuggugggugggaguggguagauaaugauagcacauaacauaagaccaucuuuaacuuuaauuagauuagaauaaaccaaauccaagcucacauguaauuaagcagaaagc

SEQ ID NO: 12623 - RNA, 74 nt, Human
ugugauagaauauucauuugguuuugaugugcuagagaaacugguacacauuauaaaauguaucagaugacaca

SEQ ID NO: 12624 - RNA, 78 nt, Human
uuucaagauuuuaaaagauguauaagguuaaguuugcaaauauaauggaaaugcuguauaucuuuugaagugaugaaa

SEQ ID NO: 12625 - RNA, 61 nt, Human
agcucugcacucaugauucuguggcucucuguccaucuggccacaguucagaagccaggcu

SEQ ID NO: 12626 - RNA, 67 nt, Human
cagguaugucaaggggucaguguaggguaggugcuaaaagugaaacuggucccucugaggucaccug

SEQ ID NO: 12627 - RNA, 63 nt, Human
guggcuguuucacaguuuggugagauguuuggggucaucucaccaaagaacaaaccagaccac

SEQ ID NO: 12628 - RNA, 61 nt, Human
gugggaaaucaggggucucacagccuucagagcugagagcccugaacagagauuuacccac

SEQ ID NO: 12629 - RNA, 62 nt, Human
aggccccugaaggcaaggccagggagacgguggagaaucugccuccccugccuuuggacccu

SEQ ID NO: 12630 - RNA, 76 nt, Human
ccugcuggcccuccugacggcggcccugacacagagccucgggcagcccagggcaagcugagagauggccagaagg

SEQ ID NO: 12631 - RNA, 61 nt, Human
cugcuccaucccaggaccuuaaccagcgcucccuggagcacucugaggggccugugggcag

SEQ ID NO: 12632 - RNA, 60 nt, Human
gccuaggucuggugucuucaaauuggauucacuuuuuauacauacagacacucccuuggc

SEQ ID NO: 12633 - RNA, 74 nt, Human
gggcgagaugggcggaucacaaggucaggagauggagaccauccuggcuaacauggugaaaccccgucucuacu

SEQ ID NO: 12634 - RNA, 62 nt, Human
augaaaaucuuucugauguugugucuauaagcagccuugaugggauauguuagaagugucau

SEQ ID NO: 12635 - RNA, 75 nt, Human; identical to SEQ ID NO: 1470

SEQ ID NO: 12636 - RNA, 83 nt, Human; identical to SEQ ID NO: 1471

SEQ ID NO: 12637 - RNA, 83 nt, Human
uuacccauuuguaacucuaaaaacaggaaaaauaucaguuggcaaaugcaaucuuuuuuuuuuuuuaagcuaaagguggguga

SEQ ID NO: 12638 - RNA, 72 nt, Human
ggaacagggagggccugugucuggccaggcugagguuccagaucuguugccaucauggccccuucagggucc

SEQ ID NO: 12639 - RNA, 69 nt, Human
uauagaauuaucuaaauguuucuugagggagaaaaagccagccgaucaagacauucggauaauuuuuua

SEQ ID NO: 12640 - RNA, 68 nt, Human
uuguacagaccuuaguaaagucuucaauuuaauaaaaaucaaaaagccaaaacuaaaaggucaagcaa

SEQ ID NO: 12641 - RNA, 103 nt, Human
aagucucuauuuauaauccucccaccuccaccucccaaguagcugggacuauaggcacaugcuaccacaccuggcuuaaaggugcaguuuuaauggcagauuu

SEQ ID NO: 12642 - RNA, 64 nt, Human
auagccacugcuaauuguaucgaucauuuugcccuguuacaacuuuagaauuuuaguagucuau

SEQ ID NO: 12643 - RNA, 64 nt, Human
gggccaucuucaaguucaguccauguguccucucauuucuggaccuaggcugauggaguggccc

SEQ ID NO: 12644 - RNA, 81 nt, Human
cuuucacucagcuucggagcuguggcugccggugugugcccagucuggcuucggcucccacggguccugggcgggugggag

SEQ ID NO: 12645 - RNA, 90 nt, Human
ggcaauggacgcuaccccagaugggucagcuucggaggccugcccaaggcuccugaucaggcggccgucugguccaaucagcaucuugcc

SEQ ID NO: 12646 - RNA, 65 nt, Human
ggcaccccucccgucgaccccacaguucagugugaacaccgagcgcucguccagggaaggcugcc

SEQ ID NO: 12647 - RNA, 99 nt, Human
ggcuugagccagccucaggucucgaacauggcacagcuggugcacagcacuuucucguacaugucacugcaguccacgaggccacacaggguacaggcc

SEQ ID NO: 12648 - RNA, 131 nt, Human
cagcuggagcugagacccccaccaggcucauggcccuucccuacucaguuccugaaacuccacccucaagccgagcucgggaggcugaggcggggaggaucgcuugaggccaggaguucaagaucagccug

SEQ ID NO: 12649 - RNA, 67 nt, Human
cuggggagugggcgccaucaucccuauucuacagagggaaacugaggcagagaggcccacugucugg

SEQ ID NO: 12650 - RNA, 65 nt, Human
uuugaacuggggaugccuggcuccugucuguuuucuuagccacuccccacacaccccaggucaga

SEQ ID NO: 12651 - RNA, 66 nt, Human
aguaaugacuuccagaaguauuuuggcaaucccaucuucuauugagggaccaagaugucuauuacu

SEQ ID NO: 12652 - RNA, 72 nt, Human
gagaagcagguagcucaguauugcugaugagaguggcuguuccaagcaucaguaggccuggaaucucuucuc

SEQ ID NO: 12653 - RNA, 131 nt, Human; identical to SEQ ID NO: 12648

SEQ ID NO: 12654 - RNA, 67 nt, Human; identical to SEQ ID NO: 12649

SEQ ID NO: 12655 - RNA, 65 nt, Human; identical to SEQ ID NO: 12650

SEQ ID NO: 12656 - RNA, 77 nt, Human
ucaugaaguucaagccugacuguguaaacguugaagagguccuuccacacaugguugucuuggcuuccacuacauga

SEQ ID NO: 12657 - RNA, 111 nt, Human
cagcuuuucuaauuuacaaccaguuaagaauuacaauauccaaagaaaguauuuuaaaauauauaugcucacugguaagugauuuucuacucaaauaaauaggaaaauuug

SEQ ID NO: 12658 - RNA, 81 nt, Human; identical to SEQ ID NO: 9222

SEQ ID NO: 12659 - RNA, 61 nt, Human; identical to SEQ ID NO: 9223

SEQ ID NO: 12660 - RNA, 72 nt, Human
ccaaguucauugagguaucuaaagaggcccggaagcgguuccugggcccccugcaccccuccuucaaccugg

SEQ ID NO: 12661 - RNA, 63 nt, Human
ccgcgagaagacguggaacaucucguucgcgggcugcggcuuccucggcgucuacuacgucgg

SEQ ID NO: 12662 - RNA, 84 nt, Human
ggcgucuacuacgucggcguggccuccugccuccgcgagcacgcgcccuuccugguggccaacgccacgcacaucuacggcgcc

SEQ ID NO: 12663 - RNA, 76 nt, Human
gaacgcauuaucauuuagauauuaugggcauuacucaucuauuuucauaauuuucagcuacaaaauauaugccuuc

SEQ ID NO: 12664 - RNA, 73 nt, Human
gugccacuuuaugauggggauaugagaaaugcauuguuaggcaguuucaucaugcaaacaucauagaguguac

SEQ ID NO: 12665 - RNA, 69 nt, Human
ugauacuauuauaaaugguauuguuuuaaauuuuuauuuucuaauuauagcaacuuguauguagaguca

SEQ ID NO: 12666 - RNA, 67 nt, Human
cgggugugcugcucggcuagcggcggcggcggcggcccagucgguguaugccuucucggcgcgcccg

SEQ ID NO: 12667 - RNA, 81 nt, Human
cugacauugaaagaccugcugucucaaagggucaaguugugcuaaggcgccccuucuaccccggugguuuggcaauugcag

SEQ ID NO: 12668 - RNA, 60 nt, Human
ggcuaugggaggugcuaugggcauaaacaacagaggugccaugcccccugcuccugugcc

SEQ ID NO: 12669 - RNA, 65 nt, Human
cauuuaagccugaaauuguccugugaagugaaguaugaucggacagccucuuuucagcuuuuaug

SEQ ID NO: 12670 - RNA, 130 nt, Human
gaagccccgguggcaagagucugaagcaggaaggaugacuguagccuguggauuguacugcaguaggaaacuguccuagcaaggcuccacuuugccccagcaucucuccccucagcccugucuccucuuc

SEQ ID NO: 12671 - RNA, 70 nt, Human
uuguggcucuugcaaggucacaggauuggaauacagagccaagccaccccaggacaugcaagagccucag

SEQ ID NO: 12672 - RNA, 131 nt, Human
cugucaccucaucgucgugcagaaugagggccgaguagaugcaggcgagcucggagacagaggccauggcgcgggccaguguagggcuggcgcugccggacgcggugcuagucgccgggaugaagugaggg

SEQ ID NO: 12673 - RNA, 74 nt, Human; identical to SEQ ID NO: 1641

SEQ ID NO: 12674 - RNA, 75 nt, Human
gcucccaauguugacguuggccagggccuuugcaaacaagccaggccaaaaaggcucaacauuuacaccggcugc

SEQ ID NO: 12675 - RNA, 119 nt, Human
ggccaccuccugguccagucaccaccugcagccucggcagggcagguacaggggccaccucggaugggagccugggucccugccuccgcucugccccuggguggcugggaggagaggcc

SEQ ID NO: 12676 - RNA, 106 nt, Human; identical to SEQ ID NO: 6411

SEQ ID NO: 12677 - RNA, 74 nt, Human; identical to SEQ ID NO: 365

SEQ ID NO: 12678 - RNA, 103 nt, Human
gaaacagacugggccaauguccacaaagaauuccuggucagcaccacccgauguccaaaggugcaauaucaaggaagggcaggcgugauggcuuauuuguuuu

SEQ ID NO: 12679 - RNA, 62 nt, Human
auauauuuuuuaauuuuacaccugaacacaaagaaauguggucacuaaaaauaaaaguauau

SEQ ID NO: 12680 - RNA, 61 nt, Human
guacccaucucauacccaaggugugacacaucgaauuauauugucuuacaucacuugguac

SEQ ID NO: 12681 - RNA, 131 nt, Human
ugcuuauuuguuuuacaaccuguaucaucaaacucucucucuaaacuuuaaaaugcuguauaaauaugauacuuuugaggagagagugugcucagaacuuagacgggauuugguaggccaaguaugcuaag

SEQ ID NO: 12682 - RNA, 92 nt, Human
gagauguggccgagacugcgcuggcauccagcaggucgcugggugacuucugggcagcuggcuugccugcgaguaucucucuguuauuccuc

SEQ ID NO: 12683 - RNA, 73 nt, Human
gcauccagcaugaugcccugcucguccagcucuucuccaacgcggccggacaugugcuucagaaccuggaugc

SEQ ID NO: 12684 - RNA, 81 nt, Human
cagcuaugccgacuuugucugguuuuugaucucugaggaagacaaaaaaacaccgaccagcaucgaguacugguuccgcug

SEQ ID NO: 12685 - RNA, 68 nt, Human
cccugacaugcaucuucgucucuccauccuggcuuggaucuagaggcagaaaagugcagaaggaaggg

SEQ ID NO: 12686 - RNA, 61 nt, Human
gcagugccgaaggcuggacagcauggccaucgaggcccugcccuuccaggacugccucugc

SEQ ID NO: 12687 - RNA, 64 nt, Human
aacauucguccagaucccauuuuacagaaaagaaacuacaggaguggccauuugcaccuauguu

SEQ ID NO: 12688 - RNA, 60 nt, Human
cuccggaaaaccauuggccgccuggcaagucaagugcaagaacgcggcagguggcuggag

SEQ ID NO: 12689 - RNA, 60 nt, Human
cuccucucuguguugucugggcccuuguuuacaagcacgcguuacccuuccugaggggag

SEQ ID NO: 12690 - RNA, 67 nt, Human
gucugcagugugccugggcacagcucacgggcaguggguggaccuaacugcccaggcaggcgaugac

SEQ ID NO: 12691 - RNA, 80 nt, Human
accugaaccucugucuucgaccaacugaagcaacuugggauuaauugcuugauuagcuucacgaagcacagagauaaggu

SEQ ID NO: 12692 - RNA, 66 nt, Human
agguggguggaucaccugaggucaggagcucgagaccagccuggccaacauggugaaaccccaucu

SEQ ID NO: 12693 - RNA, 74 nt, Human
gugcuuuccuacaaaauggaauuggaggccgggcgcaguggcucacgccuguaaucccagcacuuugggaggcc

SEQ ID NO: 12694 - RNA, 64 nt, Human; identical to SEQ ID NO: 7119

SEQ ID NO: 12695 - RNA, 71 nt, Human; identical to SEQ ID NO: 3322

SEQ ID NO: 12696 - RNA, 77 nt, Human
gggggaaagccugguuuuggcugcuuugaggcuuucauugaaagcaaaugaggcagaaaggccccggucccaccccc

SEQ ID NO: 12697 - RNA, 90 nt, Human
agagaucgagcaaucaaagcguuaucugucaaagcaauucggcuccuacugauuuugccaaaaccacgcuuguagauuaguucaauuacu

SEQ ID NO: 12698 - RNA, 62 nt, Human; identical to SEQ ID NO: 5011

SEQ ID NO: 12699 - RNA, 77 nt, Human; identical to SEQ ID NO: 4287

SEQ ID NO: 12700 - RNA, 65 nt, Human
cccucuuccggcaacuugucugugcaccuuaaauuccagccucacaaauauucagcugggaaggg

SEQ ID NO: 12701 - RNA, 72 nt, Human
gcagaacuugggucucuauggggcaguggaccaaccggcccagaacuuuguccucagagcccaguuugaugc

SEQ ID NO: 12702 - RNA, 102 nt, Human
ggugaggcagacgccugaacagggacuugaguggauuggauggauuuuuccuggagaggggaguacugaauacaaugagaaguucaagggcagggccacacu

SEQ ID NO: 12703 - RNA, 62 nt, Human
guagacaaguccuccagcacagccuauauggagcucacuaggcugacaucugaggacucugc

SEQ ID NO: 12704 - RNA, 74 nt, Human
guccuacaaggcuucuggcuacaucuucacaaguuaugauauagacugggugaggcagacgccugaacagggac

SEQ ID NO: 12705 - RNA, 104 nt, Human
caucaacgagaagcugugcuacguugcccugggauucgagcaggagaugggcaacgccggaucuccucuccucugggggacgacgcuacgcagcuugccggaug

SEQ ID NO: 12706 - RNA, 66 nt, Human; identical to SEQ ID NO: 2802

SEQ ID NO: 12707 - RNA, 74 nt, Human
agccgcaccaacgagacagguggagcugcaggagcugaaugaccgcuucgccaacuacaucgacaaggugcgcu

SEQ ID NO: 12708 - RNA, 80 nt, Human
uguuggagcaguaugacaagcuacaagauggcagcaucaaaaugaagccucugaugggggugauauacgugccuuuaaca

SEQ ID NO: 12709 - RNA, 74 nt, Human
ccggucccggugcucgcgggggagcggcccaggcucgguuguucugggccgucgcccgguguucaccgggcugg

SEQ ID NO: 12710 - RNA, 67 nt, Human
cuacuugagcacgagcauggccucugugccauccuuggcggucaaguagaggccaugugugagguag

SEQ ID NO: 12711 - RNA, 72 nt, Human
cuggcuggagggcuuggcccagcuucuggccccacuagcccccugagguccaugcagcccugugccagccag

SEQ ID NO: 12712 - RNA, 67 nt, Human
gcaggaucugcccaacguugaaggucagugugauggcauaaaagaaauuagaguuggcacuuccugc

SEQ ID NO: 12713 - RNA, 70 nt, Human
agcugucuugcgcacaaucaaagcugccacaggguuccucgcagcagcucugccaguagcgcaagcagcu

SEQ ID NO: 12714 - RNA, 82 nt, Human
ggagucccggacgaagacgcugccauuggacuugacugccaugaaauacgucagccaucggcuccguaaccguguggccucc

SEQ ID NO: 12715 - RNA, 65 nt, Human
gugcagcaggauguugccugauaugguccuauaugugacgcuguugggcuugaacuuccccugcc

SEQ ID NO: 12716 - RNA, 64 nt, Human
cuagugccugggcuugcucacguucuuggucacuuuguggcccuuguugaggcccacggcauag

SEQ ID NO: 12717 - RNA, 65 nt, Human; identical to SEQ ID NO: 4540

SEQ ID NO: 12718 - RNA, 71 nt, Human; identical to SEQ ID NO: 4541

SEQ ID NO: 12719 - RNA, 71 nt, Human
ccugucaagaaagacguuuuccaaaaugcuuuaguuuugcaaauauuuacgauguccuuguuagggacagg

SEQ ID NO: 12720 - RNA, 71 nt, Human
cuucagaugagcuccucucuuuccaaaggcagguuaacacggguuaggaaggagauuaggagacucugaag

SEQ ID NO: 12721 - RNA, 79 nt, Human
gauuggcagacccgggaccucuuacagcccccaggcauguggaucuugccgaauccugaagagguccaucuuggcaguc

SEQ ID NO: 12722 - RNA, 68 nt, Human
gcagcagguggcgcagaugcagcugaaguacuacaacuccgacgugcaccgcgccgccuuggugcugc

SEQ ID NO: 12723 - RNA, 74 nt, Human
ggcucuucgcccaccaaccagguguuacaagccccagaaugcugcccggccugcccugguuggggcggacuguc

SEQ ID NO: 12724 - RNA, 66 nt, Human
accaaugcauuuccuggagaauauaucccuacugucuuugacaauuauucugccaaaugucauggu

SEQ ID NO: 12725 - RNA, 75 nt, Human
gcggagggcgaggcggcguggacagcggccccggcacccagcgccccgccgcccgcaagccgcgcgcccguccgc

SEQ ID NO: 12726 - RNA, 101 nt, Human
gcuuccuaucucagcgcccugccgccgccgccgcggccagcgagcggcccuguaugcaggccaucaagugugugguggugggagacggagcuguaggguac

SEQ ID NO: 12727 - RNA, 75 nt, Human
ggaaaaccggugaaucugggcuuaugggauacagcuggacaagaagauucaugaccagauuacgcccccuaaucc

SEQ ID NO: 12728 - RNA, 67 nt, Human
agagacugcuugcaauccuugacuagugguaccuccuuccaucuccaaaaccagcaaggcagccucu

SEQ ID NO: 12729 - RNA, 60 nt, Human; identical to SEQ ID NO: 11068

SEQ ID NO: 12730 - RNA, 90 nt, Human; identical to SEQ ID NO: 11069

SEQ ID NO: 12731 - RNA, 73 nt, Human
ggggaguggcuauaaauacagaugaagcuucgcuggcuugccggccccuaaccugcugugcaccccacuuccu

SEQ ID NO: 12732 - RNA, 131 nt, Human
uaguuaucagucaccaccagaccauuauuggcgguuagaauuccagaaacggugaauagaaguucaucuucuauuuugucuucauggaauauaucacucugguaaacagcugguucuaaauaugaugguua

SEQ ID NO: 12733 - RNA, 67 nt, Human; identical to SEQ ID NO: 1379

SEQ ID NO: 12734 - RNA, 63 nt, Human; identical to SEQ ID NO: 1366

SEQ ID NO: 12735 - RNA, 61 nt, Human; identical to SEQ ID NO: 2204

SEQ ID NO: 12736 - RNA, 125 nt, Human
cccaggcuagacugcaguggugcaaucucagcucacugcaaucucugucuccuggguuccagcgauucuccugggaggcggagguugcagugagcugagaccgcagcacugcacgcuaggcuggg

SEQ ID NO: 12737 - RNA, 74 nt, Human; identical to SEQ ID NO: 365

SEQ ID NO: 12738 - RNA, 77 nt, Human; identical to SEQ ID NO: 3082

SEQ ID NO: 12739 - RNA, 80 nt, Human; identical to SEQ ID NO: 367

SEQ ID NO: 12740 - RNA, 83 nt, Human; identical to SEQ ID NO: 1471

SEQ ID NO: 12741 - RNA, 64 nt, Human; identical to SEQ ID NO: 8239

SEQ ID NO: 12742 - RNA, 70 nt, Human
cucauggcuuugagaagccccuagacagugccaugagugcugaggaggauaccgaugucagaggcaggag

SEQ ID NO: 12743 - RNA, 103 nt, Human
cucaucaugaacugucggccacaguucuuuaccacagauuccaugaccuccagggcauacaaggcgacguguggguucugucguugacuuucuucuugauggg

SEQ ID NO: 12744 - RNA, 60 nt, Human
cuaugacaccuauguucgcuacugggacuucacgcaccagcguccggaaaugugucaugg

SEQ ID NO: 12745 - RNA, 68 nt, Human
gguguuguacggcugugggaccggcgucaaagggccugccugcacgccuucccgcugacgucgacucc

SEQ ID NO: 12746 - RNA, 80 nt, Human
gcccagggucccagaaccuugagucagggcuuagcugggagcugaccuaucuccagagaguccauucuggucccucaggc

SEQ ID NO: 12747 - RNA, 63 nt, Human; identical to SEQ ID NO: 3039

SEQ ID NO: 12748 - RNA, 78 nt, Human
cuacaugaugagccgucacugagaugaugcuggcaugcaaucgcuucugucaacaggugggauggguucaaagugugg

SEQ ID NO: 12749 - RNA, 85 nt, Human
gcacacauugagacuaugauucucuuuuuaguuacuucaauucuucugcuuaugauaacgacaggagaaaguuucaauccagugc

SEQ ID NO: 12750 - RNA, 92 nt, Human; identical to SEQ ID NO: 8126

SEQ ID NO: 12751 - RNA, 68 nt, Human
gcaggcggcgcgaauucacuagugauugugagcugagaucgcacccaaacaauccuagugaagccugu

SEQ ID NO: 12752 - RNA, 74 nt, Human
ggcaaggauugaagccagaggcuugggaaaaagagcaaaccucugauacuccaaguucaaacugcuuccuagcu

SEQ ID NO: 12753 - RNA, 64 nt, Human
gugagaggccacgucuauucugauuuuaucaagacaaagacccaaaauaccuagaccuucacac

SEQ ID NO: 12754 - RNA, 63 nt, Human
auggacagcaggcuaaaagggcacacuguaacacacccccacuuaggcuccugcacuguccau

SEQ ID NO: 12755 - RNA, 67 nt, Human
gccaucaaaagugcaauucaggccgggugugguggcucacaccuguaaucccagcacuuugggaggc

SEQ ID NO: 12756 - RNA, 74 nt, Human
gcuggcugggcgggacugaccgauaccucaugaagauccucacugagcgagguacaguucacaccacggcgagc

SEQ ID NO: 12757 - RNA, 78 nt, Human
gaguauggggugacaaaaauuaguuccuggugcuuaaugaaacuuucugccacugauuuuauauauuaccccgugcuu

SEQ ID NO: 12758 - RNA, 89 nt, Human
uugagggcuacacaaaacauuuacauuucauucuaacauaaugaauauaauagguuguggaaaguggguaaacuaaauguagccuucag

SEQ ID NO: 12759 - RNA, 68 nt, Human
uuugucaauaaguauucauuggaauauauguaaaugugccuugccgguuauugaaacuuaucuacaaa

SEQ ID NO: 12760 - RNA, 104 nt, Human
gccuugagauugugccauaucaaaccuagcuccugagagucuuuccagcuuaaagucacauccuagagcuucccaggagcaggucugggaucuaaauuucgggc

SEQ ID NO: 12761 - RNA, 60 nt, Human
gguagguacuacuccucucauuauauaugugaauaaauggaggaagauaaguaacuugcc

SEQ ID NO: 12762 - RNA, 81 nt, Human
cuccucaccugcuccuugaaugacagcgccacagaggucacagggcaccgcuggcugaaggggggcguggugcugaaggag

SEQ ID NO: 12763 - RNA, 91 nt, Human; identical to SEQ ID NO: 4623

SEQ ID NO: 12764 - RNA, 78 nt, Human
gcucuggagagguuccugcaggauuacuuugauggcaaucugaagagauaccugaagucugaaccuaucccagagagc

SEQ ID NO: 12765 - RNA, 69 nt, Human
gcugauugaacuuuaugccccuugguguggucauuguaagaaccuggagcccaaguauaaagaauuggc

SEQ ID NO: 12766 - RNA, 94 nt, Human
gcagccggggccuucucaacgccucaguaccucggcgggaccgccaugguucugcugcacgugaagcggggcgacgagagccaguuccugcugc

SEQ ID NO: 12767 - RNA, 61 nt, Human; identical to SEQ ID NO: 1988

SEQ ID NO: 12768 - RNA, 60 nt, Human; identical to SEQ ID NO: 2705

SEQ ID NO: 12769 - RNA, 72 nt, Human; identical to SEQ ID NO: 1989

SEQ ID NO: 12770 - RNA, 62 nt, Human
guggcugggacaagcuggucaagguauggaaccuggcuaacugcaagcugaagaccaaccac

SEQ ID NO: 12771 - RNA, 78 nt, Human; identical to SEQ ID NO: 10541

SEQ ID NO: 12772 - RNA, 63 nt, Human
ggcaggugcccccaucccccccgcauucuggccuaggcaggagaggaugggcgcagcccugcc

SEQ ID NO: 12773 - RNA, 78 nt, Human
gaggggugacaaguguguuugagcuggaagugccugcgcgcaggccuuuucucauggcaugaccuugacucaccuuuu

SEQ ID NO: 12774 - RNA, 70 nt, Human
ugccuguuccgugcauguggucauaaaucaaaaccauaaucaggguccaugagcauaacacgcacgggca

SEQ ID NO: 12775 - RNA, 62 nt, Human
gacuuagagguuuuaacguaaagaaaaugguuccgcuaauuguauagaaccucucagcaguc

SEQ ID NO: 12776 - RNA, 61 nt, Human
ggccuaguuuucuucuguggugaucuauuaaauaaaaacacuauauuaagauaaauuggcc

SEQ ID NO: 12777 - RNA, 90 nt, Human
uaggaguagaaaugugacuaagauguuugaacaaauaacauauggaaugcuaaacauauggaaugcuaaacguaugccauuuuucuccug

SEQ ID NO: 12778 - RNA, 110 nt, Human
cgucggcggccggcugcaggucggccaggagcuccugcucuaccuuggcgcccccggcgccaucucggaccuggaggaggaccugggccgccuaggcaagacagucgacg

SEQ ID NO: 12779 - RNA, 68 nt, Human
cuuuaauagacagagugggagaugccaaagacaagguucgagaugaagcucagacucugauauugaag

SEQ ID NO: 12780 - RNA, 65 nt, Human
uuuaagugccuuuguggacagauuaucaacacgcuuuaaauccuauguagcaauggguauuugaa

SEQ ID NO: 12781 - RNA, 60 nt, Human
cggcgcauucgucuuccgagcgcuacugccagcugaugccgggagcuaacuaccgcgccg

SEQ ID NO: 12782 - RNA, 91 nt, Human
ggccggggccggggccggggcccugacguccccgcggggcccugggaccgcgaggaggacggcuuggggccuggagcccgcggcuguggcc

SEQ ID NO: 12783 - RNA, 61 nt, Human
cugagaucucuugacaugaaccggaacaucaagccgggucccaggguugacgaauucgcag

SEQ ID NO: 12784 - RNA, 71 nt, Human
gcagccgggccugaggcugagagcauguaccagaucaaguaugaggagcugcagagccugggcugggaagc

SEQ ID NO: 12785 - RNA, 77 nt, Human
cugcuaggcccccgcuuucaggagugggguggugccaaugcuccacucagaaccuggacugcggggucccugagcag

SEQ ID NO: 12786 - RNA, 69 nt, Human
gcuggaggcgaggugcacgcgaggcucuccacagcccaggaaggcagacugucacccugcucuccgagc

SEQ ID NO: 12787 - RNA, 100 nt, Human
cauguauaaaggucgauuguaagacugggguauuaaaucaguggucaaggggucaugaacuuuuuaauaacuaugguugggccaguugacuaauauuuug

SEQ ID NO: 12788 - RNA, 97 nt, Human
ucuccauguuugccucuaaauucagaacagcucccaucaagauccuagcaggacuuuuguguaacugcugguucugaagugaggguggagguggaga

SEQ ID NO: 12789 - RNA, 78 nt, Human
ccugcuggcccuccugacggcggcccugacacagagccucguggcagcccaggccaagcugagcagauggccagaagg

SEQ ID NO: 12790 - RNA, 61 nt, Human; identical to SEQ ID NO: 12631

SEQ ID NO: 12791 - RNA, 100 nt, Human
gcacugugcaaggagcuccccaagggcccggagcaggugcccgugccaagaucccgccagggcaaugccugggggcccaugaggagcgccucgcagaggc

SEQ ID NO: 12792 - RNA, 105 nt, Human
ggcagguggaggugcaucaagagcccggggcagcggugcccagaggccaggaggccccugaaggcaaggccacgggagacugguggagaaucugccuccccugcc

SEQ ID NO: 12793 - RNA, 72 nt, Human
augcugauaaaguuauaaaaguugcaagucacuguacuauuuaaguggcaacugccaaaagugauucagcgu

SEQ ID NO: 12794 - RNA, 66 nt, Human
ccgggcaugguggcaggugcugcagucccagcuacugggagaucacgccacugcacuccagccugg

SEQ ID NO: 12795 - RNA, 71 nt, Human
uauaucuauuuaaucuauuuauaauauccugcuaaacagagagaaaacaguaaguuggaaaauaacauaua

SEQ ID NO: 12796 - RNA, 93 nt, Human
agccgggcaugguggcucacaccuguaaucccagcacuuugggaggccaagguggguggaucacaaggucaggagaucgagaccauccuggcu

SEQ ID NO: 12797 - RNA, 63 nt, Human
uuguuuuaaugauuaauguaaagggucugaaauaucugcauauuuaaaaauuauuagaagcaa

SEQ ID NO: 12798 - RNA, 102 nt, Human
aggggagguucuugcaaauucccaaggaaaugucaaaaaggcaaaauggccagcauuauccauuugcuuuuuuggguuuacugggugaauagcacuuuccuu

SEQ ID NO: 12799 - RNA, 95 nt, Human; identical to SEQ ID NO: 806

SEQ ID NO: 12800 - RNA, 77 nt, Human
uaggcaugugauuucagguuuuucuuucugagaacauugagauuucacuuggaagacucccugaaaucuuaugagua

SEQ ID NO: 12801 - RNA, 83 nt, Human
aaagauauggcuuuauugauauguaaugugcauaccauaaauucuuugauuuaaaguguacaauucaguguuguuguuucuuu

SEQ ID NO: 12802 - RNA, 76 nt, Human
gugaucugagucuggcuucuuucauuuacauguuuauuuuguuuuguuuuuuugaaauggagucucacucugucac

SEQ ID NO: 12803 - RNA, 78 nt, Human
gugcuggaauuacaggccaucuaaaucuuuuaucucagguuugccuugugacaaaaggagggguacuuuuucuggcau

SEQ ID NO: 12804 - RNA, 69 nt, Human
guuacccuggcuggagugcagugacgugaucacggcucacugcggccacaaccuuccagcuuaggugau

SEQ ID NO: 12805 - RNA, 61 nt, Human; identical to SEQ ID NO: 9580

SEQ ID NO: 12806 - RNA, 102 nt, Human
gaaacagacugggccaauguccacaaagaauuccuggucagcaccaccgauguccuaaggugcaauaucaaggaagggcaggcgugauggcuuauuuguuuc

SEQ ID NO: 12807 - RNA, 75 nt, Human; identical to SEQ ID NO: 1111

SEQ ID NO: 12808 - RNA, 77 nt, Human; identical to SEQ ID NO: 2332

SEQ ID NO: 12809 - RNA, 80 nt, Human; identical to SEQ ID NO: 367

SEQ ID NO: 12810 - RNA, 74 nt, Human
guguugggcugugacuggccugccagguguuugccucccucugcaacaccagccuguuacuaacagccuagugc

SEQ ID NO: 12811 - RNA, 61 nt, Human; identical to SEQ ID NO: 776

SEQ ID NO: 12812 - RNA, 62 nt, Human
auucagaguccugcaccaagccccagagaugguuuuggugggucuugguggggcccaggaau

SEQ ID NO: 12813 - RNA, 70 nt, Human
gcauggccagggagggcaaauggaaaggcaaccacucucugccgguccugggcuuaucccugcaaugugc

SEQ ID NO: 12814 - RNA, 67 nt, Human
cuuucaauagacaguguugaggaccaucuugccuggagcaaggauaucaaugcuuacaauugugaag

SEQ ID NO: 12815 - RNA, 60 nt, Human
gugguguuguuuugguccugauaggaagcugaagcugucuauccucuacccagcuaccac

SEQ ID NO: 12816 - RNA, 77 nt, Human
cuaugccuuaaacugugcaaucugccacaagugagcucaagaaaagaaaacuugucacauguaugguuuucccauag

SEQ ID NO: 12817 - RNA, 79 nt, Human
cagcacccaccucggacuuggcuguggacgguuggugcaagugcauccugcagggcuggcugugcgcagcugugggcug

SEQ ID NO: 12818 - RNA, 67 nt, Human
uucaaguaaaaacccuuucuccuuccuggggccucggcuccuggagggcuggagggucucgucugag

SEQ ID NO: 12819 - RNA, 95 nt, Human
gggaacggaaggaggaaugcuggacuggaggccccuggagccagauggcaagagggugacagcuuccuuuccuguguguacucuguccaguuccu

SEQ ID NO: 12820 - RNA, 69 nt, Human
ugcccagaggacucccaaaccuggcuuggggucaagaaacagccagcaagaguuaggggccuuagggca

SEQ ID NO: 12821 - RNA, 63 nt, Human; identical to SEQ ID NO: 123

SEQ ID NO: 12822 - RNA, 66 nt, Human
ccccacgcucaguccuggucaaaggcugccagaccuuucugagugcccccagggagggugcugggg

SEQ ID NO: 12823 - RNA, 91 nt, Human; identical to SEQ ID NO: 124

SEQ ID NO: 12824 - RNA, 73 nt, Human
guuaaacugaauauacaauuguucccuaggcaaccaacuuuugcuuauaacuacaauuuaauuucacguugac

SEQ ID NO: 12825 - RNA, 60 nt, Human
ugcuuuuucuuuaaggagcugauguugcaccuaaacauuccaacccuuaaagcuaaaaca

SEQ ID NO: 12826 - RNA, 68 nt, Human
gaauuggugaacggaagaguccuuauguugcaguaugcuguauaguaauggccuucagcauccucuuc

SEQ ID NO: 12827 - RNA, 65 nt, Human
ggaacaggauguuuaacucuuuuaucuccgaacauugaaugagauaaauuuccagaugcuguucu

SEQ ID NO: 12828 - RNA, 60 nt, Human
aaaaaagacugaauuuccuggcuuacuugcauauacagacugggauuuuuuuuuuuuuuu

SEQ ID NO: 12829 - RNA, 83 nt, Human
gugggggcgcucaauaacuuggauaccggucggcauggucacaacacccgacagugcucuucgccagaaguuggcggcccuac

SEQ ID NO: 12830 - RNA, 60 nt, Human
guguacaugugguuugcgguaacaccacccaaaggcaaaaauucccaaacccaguuacac

SEQ ID NO: 12831 - RNA, 64 nt, Human
ucacccugucgcacuucaccguggggauaacggggucuaccauggucuagaagugcacugguga

SEQ ID NO: 12832 - RNA, 63 nt, Human
ucccuuuccugaccuuuagucuuucacuuccaauuuguggaaugauauuuuaggaauaacgga

SEQ ID NO: 12833 - RNA, 69 nt, Human
acuucgggcugugcaaggaggggaucaaggacggugccaccaugaagaccuuuugcggcacaccugagu

SEQ ID NO: 12834 - RNA, 60 nt, Human
gagacugaugugcgggucgccugccuucuaaaaccaaggacagagaagcaaacagagcuc

SEQ ID NO: 12835 - RNA, 70 nt, Human
ggccacaggccgcuacuacgccaugaagauccucaagaaggaagucaucguggccaaggacgagguggcc

SEQ ID NO: 12836 - RNA, 103 nt, Human
cuguccugcggccaggucgaggugauugggggagcagacaaguaccacuccgugugucggcucugcuacuucaacgaaggccucaggccagccugccgggcgg

SEQ ID NO: 12837 - RNA, 97 nt, Human
gagaacugccagugcaggaaagccaggggacgccgugguggcaggaagcucuuugccccacacagauucugcauggccccugcaacugacggaccuc

SEQ ID NO: 12838 - RNA, 63 nt, Human
ggaagaccguaauuguggcugcacuggaugggaccuuccagaggaagccauuuggggccaucc

SEQ ID NO: 12839 - RNA, 85 nt, Human; identical to SEQ ID NO: 10310

SEQ ID NO: 12840 - RNA, 70 nt, Human
cugccuuuuaauauuugcauugaauucuagauaauuucuucuaucuuugguucacaaauucucucugcgg

SEQ ID NO: 12841 - RNA, 66 nt, Human
gcauuaauuaguuuuggucaucguauuuuuucacaucuugaaguauuucauucaacucugcuaugu

SEQ ID NO: 12842 - RNA, 78 nt, Human
ugcaugggauuugaauuucuuaaaucuaaggauggugggcuuucaucaauccuagaaaauugugucauuaucucauca

SEQ ID NO: 12843 - RNA, 60 nt, Human
caccaggaguccacauuccaggagcugugcgacggggcugcuggaggagucggacuggug

SEQ ID NO: 12844 - RNA, 63 nt, Human
gcgagccgggcacaaagagacacguagcacagagcaugccacguacaagcaaagacccgacgu

SEQ ID NO: 12845 - RNA, 74 nt, Human
ggagccaggacagggcgaggggccggaggcucggggaugccgaggucaguaccacgcccgacccgccuggcacc

SEQ ID NO: 12846 - RNA, 103 nt, Human
gcggccucauuugcugucaagcuuuucaaagcauggauggcagaaaacagaugccaacucugucacucgucuaugagaaaagccaacuuagacaagaggcugc

SEQ ID NO: 12847 - RNA, 76 nt, Human; identical to SEQ ID NO: 1089

SEQ ID NO: 12848 - RNA, 114 nt, Human; identical to SEQ ID NO: 3164

SEQ ID NO: 12849 - RNA, 90 nt, Human; identical to SEQ ID NO: 3165

SEQ ID NO: 12850 - RNA, 66 nt, Human
ccauccauucacuguucagcuguacugugauuuaguuuuuacaccguuaaaacccugaguggaugg

SEQ ID NO: 12851 - RNA, 84 nt, Human
uugugaacagauuaaggauaaauauaugcagaaucgguuggugcgucuuguguguguguuucuccaauccuugauccguaacaa

SEQ ID NO: 12852 - RNA, 80 nt, Human
aucacuaggagccaagagaacggugagaucuguaugucauuacacgaauauacacccuuuuuuuccuucucuuccaggau

SEQ ID NO: 12853 - RNA, 78 nt, Human
ggaggauacugcugcagucuugggaguuauaauagcagccacuugcaugggccuuacuucuauaacaggcaauccacu

SEQ ID NO: 12854 - RNA, 77 nt, Human
gcuuuuggguaggaccccacgauuuaggguaacuguuaucaucagcugccauuucugauagggucuaccacaucugu

SEQ ID NO: 12855 - RNA, 83 nt, Human
guuugguaggagugcucaugguucugucauucuuggaccucuccuggcugagcucugauucccugugagcacgaugcugaugc

SEQ ID NO: 12856 - RNA, 65 nt, Human
gcaagugaaugucuugcugaaugugucuagggguucaucuucaguaaucgacauuccacuagugc

SEQ ID NO: 12857 - RNA, 66 nt, Human
uuaacuucaugacauguagacauucaaaacuugagccuuggauguuccuguggaccugacaguuaa

SEQ ID NO: 12858 - RNA, 64 nt, Human
auccuggaccucagcaucaucaagcaccucuuuacugguccuuguccucuccaaacaccaggau

SEQ ID NO: 12859 - RNA, 75 nt, Human
cuacacagacuucuauuccucucggagcaugcuaccaacgucggaaucauguucagggacaaggagaaugcgugg

SEQ ID NO: 12860 - RNA, 84 nt, Human
ggccgugggggcgggcagggggcggggccgggccugaccacagcggccgaguucaguccugcucuccgcacgccaccuuaggcc

SEQ ID NO: 12861 - RNA, 63 nt, Human
acuuggcuaaugagccaagcauugagcgaauuaucaguccucgacauggcucuaacgacaggu

SEQ ID NO: 12862 - RNA, 61 nt, Human
auccaaagauguaguagacuacagugaggaaaauuuugcaauuguauuugcugcuaugggu

SEQ ID NO: 12863 - RNA, 74 nt, Human
guccugugaguuuacuggggauauucuccgaacaccggugucugaggauaugcuuggucggguauucaauggau

SEQ ID NO: 12864 - RNA, 101 nt, Human
uucucugcugcugggcuaccacacaaugagauugcagcucagaucugucgccaggcugguuugguaaagaaauccaaagauguaguagacuacagugagga

SEQ ID NO: 12865 - RNA, 77 nt, Human
gaguccuaccgcuucuacucaagcucccugcuggucauuuaugauggcaaggagcggcccgaagugguccuggacuc

SEQ ID NO: 12866 - RNA, 69 nt, Human
uggccaggugguggcuccugcagccuggagcugaugugcaguggccucugugagccccagccugagcca

SEQ ID NO: 12867 - RNA, 69 nt, Human
cgcucgucaccaggacccaaggaaccaaaagugcaucugauggucucaagggucguguguugugaagug

SEQ ID NO: 12868 - RNA, 70 nt, Human
guguuccauggucaaaaaauggcagacaaugauugaagcucacguugaugucaagacuaccgaugguuac

SEQ ID NO: 12869 - RNA, 91 nt, Human
ugcauuuagaaagauucaagcugauuacugaagauguucaggguaaaaacugccugacuaacuuccaugggcauggaucuuacccgugaca

SEQ ID NO: 12870 - RNA, 83 nt, Human
agucucugaccagccugaacgugucuuaugucacuuguuuggaaaugaugugauugaagauuucagagaggucauuggaggcu

SEQ ID NO: 12871 - RNA, 93 nt, Human
ggccccagaaaaauauguacuagguacgagccuggcuuguuuauuuucgagucaccgggcucugcugucgacuguucaacacuucugugggcu

SEQ ID NO: 12872 - RNA, 78 nt, Human
gugugaguggcuuugcaggccugguggugggagagccucaggcucccuccuucuucguuccugaccaugcccuugggc

SEQ ID NO: 12873 - RNA, 86 nt, Human
ucagucugccugcgggcucuguuggcaucccuugcccugacacugggcaccuuguggccccuagcaggcccaccuuggcacaccga

SEQ ID NO: 12874 - RNA, 61 nt, Human
uggcaggugguauuggggucccucagcccaccugggccgugaccucaaguguccacugcug

SEQ ID NO: 12875 - RNA, 72 nt, Human
gcaaggaaugaugcuagccaauaacuaugcccgagggcacuacaccauuggcaaggagaucauugaccuugu

SEQ ID NO: 12876 - RNA, 66 nt, Human
ucgcaaggcuggcugaccaguugcaccggucuucagggcuaucuugguuuuccacagcuauuggga

SEQ ID NO: 12877 - RNA, 104 nt, Human
ugggagggggaacuugguucuuggguuccacgucccugcucauggaacggucucucagaugauuauaggcaggaaauccaagcauggaguucuccaauuacccg

SEQ ID NO: 12878 - RNA, 68 nt, Human
aguuauccaauagcuacugaaauacaagauggaagguauccucucuguaccauagcuaaaggauugcu

SEQ ID NO: 12879 - RNA, 64 nt, Human
cagcuuaaauucucuggguuuuguuuugaaauaccaaauaaauuucuuccuucuuuaaaugcug

SEQ ID NO: 12880 - RNA, 72 nt, Human
gcugaugggguacacacgguggagccaacggaggccggggacuacaagcugugcuuugacaacuccuucagc

SEQ ID NO: 12881 - RNA, 65 nt, Human
ccuuauuucugagaauuugggccccagcuguuuugccuuugacucccugaccuccagagccaagg

SEQ ID NO: 12882 - RNA, 96 nt, Human
cuuccugagcccaaucacgucaugcugaaccaccuauacgcgcugucuaucaaggauggagugauggugcucagcgcaacccaccgguacaagaag

SEQ ID NO: 12883 - RNA, 60 nt, Human
auuaaacugacacucgauucuguagccggcucugccaagagacaguggcgucggggugau

SEQ ID NO: 12884 - RNA, 64 nt, Human
cucugcaauuuaugcugcacgcccggacguaaagugcgucgugcacauucacaccccagcaggg

SEQ ID NO: 12885 - RNA, 74 nt, Human; identical to SEQ ID NO: 365

SEQ ID NO: 12886 - RNA, 77 nt, Human; identical to SEQ ID NO: 3082

SEQ ID NO: 12887 - RNA, 86 nt, Human
accuucgcauucagaauuugaccaucuuggugagaaacauuaagaccuacuaccagagauggggugaugauuaugaugaagaaggu

SEQ ID NO: 12888 - RNA, 70 nt, Human
ccugacuauguacauggauuuaguggacggcaucuuuuugaaccaaauuaugcugcaaauagaucccagg

SEQ ID NO: 12889 - RNA, 63 nt, Human
uccugcagagccgcuggugaccugggugaaaacuuuuggcccguuuggaagcggcacgcagga

SEQ ID NO: 12890 - RNA, 63 nt, Human
gcagucccugucccuuggcaccaggagucccuguagccuggcuagguaaggaaagggaguugc

SEQ ID NO: 12891 - RNA, 79 nt, Human
gguccugguagggagugcguagcaggcuggagucgcuguccggucgcgcuucacuucugcuccgcccucccugcucccc

SEQ ID NO: 12892 - RNA, 113 nt, Human
ccugagggcugugggguggaaugagcuggaaggccgugaugccaucuucaagcaguuucauuucaaagacuucaacagggccuuuggguucaugacaagaguugcccugcagg

SEQ ID NO: 12893 - RNA, 72 nt, Human
ccuuuguuucuaaucuccucucagucuguacuacuacuacuacacuaacaugacuuugguuuuggggaaagg

SEQ ID NO: 12894 - RNA, 65 nt, Human
caucuuucacuggaauugcaaagggauagccauaugaaacagcuccuccucauccaagagagaug

SEQ ID NO: 12895 - RNA, 82 nt, Human; identical to SEQ ID NO: 8961

SEQ ID NO: 12896 - RNA, 77 nt, Human; identical to SEQ ID NO: 8698

SEQ ID NO: 12897 - RNA, 80 nt, Human; identical to SEQ ID NO: 367

SEQ ID NO: 12898 - RNA, 68 nt, Human; identical to SEQ ID NO: 4262

SEQ ID NO: 12899 - RNA, 78 nt, Human; identical to SEQ ID NO: 2308

SEQ ID NO: 12900 - RNA, 130 nt, Human
ugguuguaacauuagcagggggaagacagcugcuuagaagcauggugggaagcagauguggugaagugccguacuguucugcuuacaaagauggggaugucuaagaucguguuuacuaccugauagccua

SEQ ID NO: 12901 - RNA, 65 nt, Human; identical to SEQ ID NO: 247

SEQ ID NO: 12902 - RNA, 79 nt, Human; identical to SEQ ID NO: 4405

SEQ ID NO: 12903 - RNA, 78 nt, Human
ccugaaagaccgaccauucuucccugggcuggugaaguacaugaacucagggccgguuguggccauggucugggaggg

SEQ ID NO: 12904 - RNA, 90 nt, Human
gauucaguaaaaagugcugaaaaagaaaucagccuaugguuuaagccugaagaacugguugacuacaagucuugugcucaugacuggguc

SEQ ID NO: 12905 - RNA, 65 nt, Human
guggugaagacaggccgagugaugcuuggggagaccaauccagcagauucaaagccaggcaccau

SEQ ID NO: 12906 - RNA, 66 nt, Human; identical to SEQ ID NO: 8995

SEQ ID NO: 12907 - RNA, 73 nt, Human
ugggaaccacgucaccacgguacaacaggcagcaaagccauguauuuaccauggcgagggucacauuucacca

SEQ ID NO: 12908 - RNA, 102 nt, Human; identical to SEQ ID NO: 2172

SEQ ID NO: 12909 - RNA, 93 nt, Human
uuuuucaauuuuuauuuugguuuucuuacaaagguugacauuuuccauaacagguguaagaguguugaaaaaaaaauucaaauuuuuggggga

SEQ ID NO: 12910 - RNA, 64 nt, Human; identical to SEQ ID NO: 287

SEQ ID NO: 12911 - RNA, 65 nt, Human; identical to SEQ ID NO: 247

SEQ ID NO: 12912 - RNA, 64 nt, Human
acuuucaggguaaugaugcaccuguugaacaagacauuacagugcagaaacuuacuuugaaagu

SEQ ID NO: 12913 - RNA, 62 nt, Human
gggacugcuucacagaagaaaagccugguucauaaaaacuuugccugaugucuagcagaacc

SEQ ID NO: 12914 - RNA, 72 nt, Human
gcgacaagagcgaauugauugacagaugguagacucuggaccuucugugaaguggauaucaaucauuguggu

SEQ ID NO: 12915 - RNA, 64 nt, Human
gagcacaaauccacauuuauuuauugauuuuucguuaguuuaaauccuugagggguacagcauc

SEQ ID NO: 12916 - RNA, 89 nt, Human
cgagauguguaaucauaagcaucugcgaauggaagcaucaaaacggaugaugaacugaaucgcagggugacuugugcuugguuauuuug

SEQ ID NO: 12917 - RNA, 62 nt, Human
gcuugaaccagagucgugguaaauacagcguaccaucgcagcgcaaacuugaccugcaaagc

SEQ ID NO: 12918 - RNA, 72 nt, Human
ggcuuggccauggcggcuggugcugauaaccauuucuuggcagaagugcccgccaaagcuguggcccuaguc

SEQ ID NO: 12919 - RNA, 65 nt, Human
gugggagugggagcguuuccuaagcuccacugaagauaagagcccaacccaaccccuccccccac

SEQ ID NO: 12920 - RNA, 72 nt, Human
ucaccaccacagagagccagcaaggccuucaggaagucuccggaggugucacccucaauggcuugguggaga

SEQ ID NO: 12921 - RNA, 86 nt, Human
ucagagucuucucaucugugccagcacccuucauggauuuguaaaguuugucggcaaagaagagaggcuuguucuugacacuuuga

SEQ ID NO: 12922 - RNA, 83 nt, Human
ucaucaucaucaucgucaucaucaucaucuucacguuuucuuuucaaugcauuugaugauucauuggcaguauuuugugauga

SEQ ID NO: 12923 - RNA, 68 nt, Human
uaugugguauauuuauguauguguguguauagacacacauauacuccuaaauuaaauauauuuguaua

SEQ ID NO: 12924 - RNA, 80 nt, Human
ugacaaguuuuuguuuguauccaauuacagaguuccauaagacuaugauuugaauauugugguacaacuuaaauuuggca

SEQ ID NO: 12925 - RNA, 65 nt, Human; identical to SEQ ID NO: 12919

SEQ ID NO: 12926 - RNA, 72 nt, Human; identical to SEQ ID NO: 12920

SEQ ID NO: 12927 - RNA, 108 nt, Human
gcucauccuuaguggaguuguuugacgauuuggagaagagcaagauuugaucuuaugaacauuaucacggaaucuuuuccagaguucugaacuuucauuaaugauggc

SEQ ID NO: 12928 - RNA, 63 nt, Human
gcugauauuuuaaaauggcugguaauuauguuuuuaauauccggcauuaugaaauaucucagc

SEQ ID NO: 12929 - RNA, 91 nt, Human
cucuucuucccauggcuuuacuguggcgauaaaagucacaggaauggacuccuggaugcaucacucaagucaaagccuggaaaccugagag

SEQ ID NO: 12930 - RNA, 70 nt, Human
gaaggcgggacccggcagaauggcuccuguggaagacaggugggcagaagaaaaggggcguucugccauc

SEQ ID NO: 12931 - RNA, 93 nt, Human
ggauauuuugugacaucgguggcucgaucauccuuaagcaacugaaguuaaaauuguugacggaaaaggcacuuaaauguuacuuucaugucc

SEQ ID NO: 12932 - RNA, 70 nt, Human
uccaggguuaguuuuuguagccucggcuggcccgucggccuuuggcacgcucgaacuuccggcccuugga

SEQ ID NO: 12933 - RNA, 131 nt, Human
uggcacgcucgaacuuccggcccuuggagcggacguaggguuugguguggcugugcgggguuccuggggccuugccgaaaugccgguacaccuuuuggcccuugcgaggaccggagagcaggacagugcca

SEQ ID NO: 12934 - RNA, 105 nt, Human; identical to SEQ ID NO: 11263

SEQ ID NO: 12935 - RNA, 81 nt, Human
ggcucugaagucagcgguuguaugaagcugugggcacaguacgugggacacagcauggaggacugugacugaugcagagcu

SEQ ID NO: 12936 - RNA, 61 nt, Human
gcgguggagguagagacgcugaccuggcuaagcuuaggagucucaggucuccccgggccgc

SEQ ID NO: 12937 - RNA, 87 nt, Human
gcugacgagcgggucuggcucagagcagcguccacccucggcccucacaggccccgcugcccugccgccagggcuugagcuugcagu

SEQ ID NO: 12938 - RNA, 67 nt, Human
gugucccccaggcuggaaugcaguggcacgaucucggcucacugcaagcuccgccuccuggguucau

SEQ ID NO: 12939 - RNA, 68 nt, Human
cacaggcuggcagccuucagucugauccaccagaucagagcuuucuaaaucugagcucucagccugug

SEQ ID NO: 12940 - RNA, 85 nt, Human
uugaaagcgaugcugaguccuguuuucaaaaguguccuguuuggguuuucuuggugaagagcagaauuucaagugaaguaaucga

SEQ ID NO: 12941 - RNA, 98 nt, Human
ggagcuggaggaccuggagcaccugcagcuggacuucuggcgggggccugcccacccuggcucccccaucgacguccgagugcccuuccccagcaucc

SEQ ID NO: 12942 - RNA, 60 nt, Human
ccacuucuuuguggagagaauauuuaaaauccuuuuuuuuuuuuuggcaaugaauucugg

SEQ ID NO: 12943 - RNA, 72 nt, Human
guuuggcccaggcggaagugcaggguugugaucaagguccagggaacccucgugccucuccgggguucaagc

SEQ ID NO: 12944 - RNA, 60 nt, Human
auauugauuucugcccucagcuucaaauaaaguaaauugaaaugggaacaauaucaauau

SEQ ID NO: 12945 - RNA, 63 nt, Human
gugucuugauauauuuauaaauaugugauuaucauuuauuuuuaaaauaauuuaucaaaaaac

SEQ ID NO: 12946 - RNA, 77 nt, Human
aaucuguuuaccagacauauagcagccgggcagggagucuucauagccuguugcgucaugugauuccauuccagauu

SEQ ID NO: 12947 - RNA, 83 nt, Human
gugggcgagagaggcacagcacaguccuccggcuugguagguuucaagcucuuuugacugggcuggcgcugacauuugcccuc

SEQ ID NO: 12948 - RNA, 65 nt, Human; identical to SEQ ID NO: 247

SEQ ID NO: 12949 - RNA, 80 nt, Human; identical to SEQ ID NO: 100

SEQ ID NO: 12950 - RNA, 64 nt, Human
gugucccugugucuccccagguaguaauaaggauguccuuuuccuccagguauacaguggguac

SEQ ID NO: 12951 - RNA, 64 nt, Human
aaguaguuguuccccuugcucugaaagggccacggcuuuuguggagugauggguaacgaugcuu

SEQ ID NO: 12952 - RNA, 62 nt, Human
uaguguuucagucggugacgucacucacucugagacggugacgucacucacucugagaccua

SEQ ID NO: 12953 - RNA, 66 nt, Human
ggauggcauagucaauccaacaauaagaaaagauuugaaaacuggaccgaaauucuacugcugucc

SEQ ID NO: 12954 - RNA, 121 nt, Human
ccagccaaugaagucuguacucugguggcuuccaguggaaaaggcauuuuggaggcagccugcagguccuggcucuggcauccgagagagacuggagcacccaguguuacacgugagcugg

SEQ ID NO: 12955 - RNA, 100 nt, Human
uucaaggaauacgugccuuugucuuagaauggcuuucauuuauugaacgauaccagaagaaauguggcccccauuaaggcacuauggcgugguucaugaa

SEQ ID NO: 12956 - RNA, 100 nt, Human
gugugaaggcucuaagagacauugaaccuggagaagaaauuucuuguuauuauggagauggguucuuuggagaaaauaaugaguucugcgaguguuacac

SEQ ID NO: 12957 - RNA, 73 nt, Human
ugcgaaagacggggcacuggugcuuuuaaauccagagugggacugccugcgccugcuccuguuaucaauagca

SEQ ID NO: 12958 - RNA, 60 nt, Human
uugaggagaacaugcuacuuagacauggagaaaacgacuucagugucauguacuccacaa

SEQ ID NO: 12959 - RNA, 69 nt, Human
aggcccagggccccggaggagcgggccuguccuccacuuagggucggcucucccaccugccccucuccu

SEQ ID NO: 12960 - RNA, 63 nt, Human
gggucugugucacagugaccucccagagccccaagcucgggccucccacuuaaacacaggccc

SEQ ID NO: 12961 - RNA, 72 nt, Human
agugacuuuauucgacaugguuaguguccuagggaauuaaguuuuuuggggcagaacuagguaccaagcacu

SEQ ID NO: 12962 - RNA, 74 nt, Human
ccuugugaaaguuauaauguaguaggagaugggguaaacaacuaucugauguacauauucaacugucacugagg

SEQ ID NO: 12963 - RNA, 67 nt, Human
cuucucccuggaccagcccgguggcacccuggaucugacccugauccgugcccgccuccaggagaag

SEQ ID NO: 12964 - RNA, 79 nt, Human
gcccaggaugugggccgcauguucaagcaauucaacaaguuaacugaggacaaggcagacgugcaguccaucaucgggu

SEQ ID NO: 12965 - RNA, 112 nt, Human
ggaguggagcugcucacucugccaugugcucccugaccugaaggaggaggauggcagccucagccuggauggugcagacagcacuggcgugguggccaagcucucaccagcc

SEQ ID NO: 12966 - RNA, 61 nt, Human
aggcgggaguuuggggagguccaggaagcugaguucugggcugcagccccacaccucuccu

SEQ ID NO: 12967 - RNA, 73 nt, Human
cggagggcugccgggacgaagaggcuacaucuacacagggcgguguaggggaagcccgucucuucgaccuccg

SEQ ID NO: 12968 - RNA, 105 nt, Human
uccggaagggagaugaauccccgcccaggaggggggaguagggcgggggagaacuuguccuugaccuggucuuuggcgucagggauuuacucccuuaaucccgga

SEQ ID NO: 12969 - RNA, 120 nt, Human
cugaugauauucugaauucucccuauagaaaccaaauagaacuaaaauuuuauaaaucuccccuauaccauaauuuagaguauauuguuugauuuucuucuacuuuucuauuguuguuag

SEQ ID NO: 12970 - RNA, 68 nt, Human
uauauacguguauauguguauauauacauauauacauauauacauauauauacauauacauauauaua

SEQ ID NO: 12971 - RNA, 110 nt, Human
uaucuucuauauauauguauacauauauacauauaaaaauuauauauaccaaaauuuauauauauauaaauuucuucuguguuuuguauacauuauguuaccugaugaua

SEQ ID NO: 12972 - RNA, 77 nt, Human
caagaaucaagcugugaaggagcgagcccagggcguggugcugaaagugcucacaaacuucaagagcagugagauug

SEQ ID NO: 12973 - RNA, 110 nt, Human; identical to SEQ ID NO: 4814

SEQ ID NO: 12974 - RNA, 75 nt, Human; identical to SEQ ID NO: 74

SEQ ID NO: 12975 - RNA, 87 nt, Human; identical to SEQ ID NO: 76

SEQ ID NO: 12976 - RNA, 71 nt, Human; identical to SEQ ID NO: 77

SEQ ID NO: 12977 - RNA, 87 nt, Human
ugguuuuggccaauccuuuaaccgaaaacguucagguuggucucuguaaaaaaacguucgcggauuuuugguuggggcaacaaacca

SEQ ID NO: 12978 - RNA, 64 nt, Human
gaaacaggacaaaggagaauucaugacaugaucaagaaaccccuucuccuaacccccuauguuc

SEQ ID NO: 12979 - RNA, 103 nt, Human
uugagaaggagucucgcucugucacccaggcuggagugcaauggcacgaucucggcucacugcaaccucugccuccuggguucaagcgauucucuugccucag

SEQ ID NO: 12980 - RNA, 84 nt, Human; identical to SEQ ID NO: 286

SEQ ID NO: 12981 - RNA, 89 nt, Human; identical to SEQ ID NO: 288

SEQ ID NO: 12982 - RNA, 61 nt, Human; identical to SEQ ID NO: 776

SEQ ID NO: 12983 - RNA, 131 nt, Human
uuguuuguuuguuuuuuuaaauggagucuuguucugucccccaggcuagagugcaguggugcaaucuuggcucacugcauuccagccugggugacagagugagauucugucucaaauaaauaaauaaauaa

SEQ ID NO: 12984 - RNA, 82 nt, Human
gcuccguggauguucuggaccuguagcguguucccaaaggagagcuuguggaugacaugcgucaugucuggguucugugggu

SEQ ID NO: 12985 - RNA, 94 nt, Human
uacagcggcugcgucucucuguguacuugaccgugauggggcugaggucguagcggaaccagauugcagggaugaugcggcccguguggcugua

SEQ ID NO: 12986 - RNA, 74 nt, Human
caagcaaucccccuguugggguugggaacgggcaagcgcguggcaaagccccccaaagaacaagggaaaaauug

SEQ ID NO: 12987 - RNA, 65 nt, Human
cagauuuugucucuucauuuuggccguuaguauccuaaguggccuugugaucaugaggguuucug

SEQ ID NO: 12988 - RNA, 68 nt, Human
gcuguccugacuuucugcugagcuggcacugcuacuggggcuuccggucuggcuuccaaaaggacugu

SEQ ID NO: 12989 - RNA, 72 nt, Human; identical to SEQ ID NO: 9079

SEQ ID NO: 12990 - RNA, 72 nt, Human; identical to SEQ ID NO: 9079

SEQ ID NO: 12991 - RNA, 60 nt, Human
ggcguuaaaaauugguuucucguguaaauuuuguuaaacccgucaauuuuuaaccuggcc

SEQ ID NO: 12992 - RNA, 66 nt, Human
ggucgcagaggagacaccgccguaguugccgguacaucggggauuucuggcucuuuccucuucgcc

SEQ ID NO: 12993 - RNA, 81 nt, Human
cuuuucucucugcuagauggauguugaugcaccggaggucuuuuagccugcccuugcauggcgccugcuggaggaggagag

SEQ ID NO: 12994 - RNA, 62 nt, Human
uauuguagcauugcugucugcaagggagccccuagccccuggcagacauagcugcuucagug

SEQ ID NO: 12995 - RNA, 63 nt, Human
ggaggguaccggggcacccccagcugcccauggcuggacuugcccuuugacaaggggcccucc

SEQ ID NO: 12996 - RNA, 95 nt, Human
ggccgggcucgguggcucacgccugucauccaacaccuugagaaagccgaggugggcggaucacuugaggucgggaguuugagaccagccuggcc

SEQ ID NO: 12997 - RNA, 67 nt, Human
cugauguuguagaagcauuucucacuguccucaaaaaagggaaaccaggugaaauuuauaacaucgg

SEQ ID NO: 12998 - RNA, 76 nt, Human
gucugaaauggaaaauuggguugauuauguuaaugauagacccaccaaugacaugagauacccaaugccgucagac

SEQ ID NO: 12999 - RNA, 68 nt, Human
cagcugcucaggaucacuguucccagguggggcacacagcucugcauaguacuugauuuugggcucug

SEQ ID NO: 13000 - RNA, 101 nt, Human
auauguauaauauuauaauauacauauaauauauauuauauguauaauauuauaauauacauauaauauauaugauauguauauuaucauauuauacauau

SEQ ID NO: 13001 - RNA, 80 nt, Human
ggcacuuuuguuaaguauuaacuuguacagucacagggucccacaauaggcugucugcaaguugaggagcaaggagagcc

SEQ ID NO: 13002 - RNA, 61 nt, Human
gccgaugugucuacucgaagauucugugaucucacucucaggagaccauugcaucauuggc

SEQ ID NO: 13003 - RNA, 84 nt, Human
cauuuuuuuggcccgcaugaccuaguuucccaggcuauucauaucuacccuguucaacuacuggcuucgggaaugaaggaagug

SEQ ID NO: 13004 - RNA, 62 nt, Human
cuaugcaguacaaagugguuguccccaaaauuggaaacauauuagaucuuuguacagcauag

SEQ ID NO: 13005 - RNA, 79 nt, Human
gauccuuuuaguuacuugacacuuccauugcccaugaaaaaagaacgcaccuuggaaguuuacuuaguuagaauggauc

SEQ ID NO: 13006 - RNA, 111 nt, Human
gaugauaguuacugauauauacaaucauagauuucacagaauauucgcuauggaugaaaaccuuaguaguauuauggaacgggaugauauuuaugugucgaaauuaacauc

SEQ ID NO: 13007 - RNA, 88 nt, Human
gucagccuaagagaaaaauucagacacucgaguuauacccaccauacauggucaucacuuacggucagcccuuucuuaugcgcuguac

SEQ ID NO: 13008 - RNA, 63 nt, Human
ccaaggacagcagcgggcagcauguggacgugagccccaccagccagcgccugcagcuccugg

SEQ ID NO: 13009 - RNA, 63 nt, Human
ccuuuugacaagugggauggcaaggaccuggaggaccugcagauccucaucaaggucaaaggg

SEQ ID NO: 13010 - RNA, 68 nt, Human
ggugccaucaacauugaaaacggcaaggccaacuccgugcgcaaugccgucacucaggaguuuggacc

SEQ ID NO: 13011 - RNA, 60 nt, Human
gucccugacacugcccgcuacuacaagaaacauggcaucagguggguggugaucggagac

SEQ ID NO: 13012 - RNA, 69 nt, Human; identical to SEQ ID NO: 9578

SEQ ID NO: 13013 - RNA, 61 nt, Human; identical to SEQ ID NO: 347

SEQ ID NO: 13014 - RNA, 61 nt, Human; identical to SEQ ID NO: 9580

SEQ ID NO: 13015 - RNA, 77 nt, Human
ccuaggccuggagccccuggcacccagcucagcucccacccugggcccugggugcugcuggcuuuauuuggcuuagg

SEQ ID NO: 13016 - RNA, 76 nt, Human
gccccaggagggccugcccaucucagcccucgccacguccuggugcucauugguacggcgggguuuccugggcugc

SEQ ID NO: 13017 - RNA, 69 nt, Human; identical to SEQ ID NO: 9578

SEQ ID NO: 13018 - RNA, 61 nt, Human; identical to SEQ ID NO: 347

SEQ ID NO: 13019 - RNA, 61 nt, Human; identical to SEQ ID NO: 9580

SEQ ID NO: 13020 - RNA, 64 nt, Human
guagccgcuggccggcgcgcagcaggagcguccguggccacugaacugcgcugccagugcuugc

SEQ ID NO: 13021 - RNA, 62 nt, Human
uaauauuuuagguguaaaauaauuaaggguaugauuaacucuaccugcacacuguccuauua

SEQ ID NO: 13022 - RNA, 65 nt, Human
acacugguuuuccaaucggcgucuaaagaccacguuccuugccuuucgauuggcaacaccggugu

SEQ ID NO: 13023 - RNA, 69 nt, Human
cgguaagcacggcacuagcucacgauggccaguagccaacuggucccccuugaaacggcugucuugccg

SEQ ID NO: 13024 - RNA, 67 nt, Human
auugucuuuggaagcucaaggaucaaagugacguagaaacuguugcagugaagccaacagagacaau

SEQ ID NO: 13025 - RNA, 71 nt, Human
ccggaucgaaguaacacaggaaucucagcgggaauuugagaagaauguaauccaagugaugucgauacugg

SEQ ID NO: 13026 - RNA, 62 nt, Human
guuaucugcuuccuacugcuguauggcccuuugccuaacacucacaacaaaagcuaaguaau

SEQ ID NO: 13027 - RNA, 69 nt, Human
cagacugcuucgggcugccgaggaccuucugggcccccacauuaaugaggcagccaccuggcgagucug

SEQ ID NO: 13028 - RNA, 61 nt, Human
gaggaguucaacgaucuccuggaccuggacuuuauucucuccaauucgcugagccauccuc

SEQ ID NO: 13029 - RNA, 60 nt, Human
uccuccuauggcagggaguccgcaucccccauaccgacggaccccuucaaccugggcgga

SEQ ID NO: 13030 - RNA, 89 nt, Human
augauccaucuguguaguuuccugaacagucagcgauuccagguuuuaacauaguuuguaaacuuuucaguuucuacacacuuuaucau

SEQ ID NO: 13031 - RNA, 62 nt, Human
caucgucaccaaggcacgggggaagaguggaccacucuucaacuuugauguucaugacgaug

SEQ ID NO: 13032 - RNA, 68 nt, Human
cgguugcucagugacgccacuguggagaaggaugagucccaugcaggcaagguggugcugaggagcug

SEQ ID NO: 13033 - RNA, 70 nt, Human
gaaccuccgucacauggcccuggauaugggcaaugagaucgauacacagaaucgccagaucgacagguuc

SEQ ID NO: 13034 - RNA, 75 nt, Human
gcugggaagugguuaagugugcccacccguguucuccuccaaaugcuugucgggcaagauuagcuccuuucaugc

SEQ ID NO: 13035 - RNA, 91 nt, Human
cucuuugaaacacugccaugccuacguccaucagcuacuaaaugauucgcaaauguacugacugcacuuauauaugcaguggccuaccgag

SEQ ID NO: 13036 - RNA, 61 nt, Human
ggggaugaugccucuacucucuaaucuacuucagaucuuggcacugagucacaucauuccc

SEQ ID NO: 13037 - RNA, 61 nt, Human
guuuuguucauucauuuggcccaaaaucacguguaggauuggggauguggauauuuaagac

SEQ ID NO: 13038 - RNA, 90 nt, Human
ugggcggccggacggucguggggcaggguugggggucugugcucagcugauaacugccaugcacuguacugcacacgucccuagagccua

SEQ ID NO: 13039 - RNA, 78 nt, Human
auccuggcuggaauucguguagugcuucacguggcaugucacggacuugccgucugggcacuguguggccggcagggu

SEQ ID NO: 13040 - RNA, 63 nt, Human
ggccggucagugugcacgugagguucgcuucugaaccuaagagcagguccucgagggccgguc

SEQ ID NO: 13041 - RNA, 66 nt, Human
cuacccccaccaccacuuccugagaugagaugucuagguauaggaggauguggcuguugggguuag

SEQ ID NO: 13042 - RNA, 65 nt, Human
cccgaaacacggcacugggggaacuggagccugcugaccaggcuguccuccuagcccugucaggg

SEQ ID NO: 13043 - RNA, 61 nt, Human
gcggcuggggcccucuuucccgaugggcgcaguuuguuucggggcuccgggcccuagaggc

SEQ ID NO: 13044 - RNA, 71 nt, Human
uuguuuguuuuaacaugguaggguucugaccucaaauauuuguuaggucugcuacucaaaugaacuuacag

SEQ ID NO: 13045 - RNA, 67 nt, Human
gcuagccaggaacauggacugaaguauccagcgcucauugggaauuuaguuaagugccagguggagc

SEQ ID NO: 13046 - RNA, 67 nt, Human
cguuaacacugcaaccaaucugggaaaagccccccagcugccacagaacacuugacagugcuaaucg

SEQ ID NO: 13047 - RNA, 90 nt, Human
cgaggcugguguugugaagauccuggugucgcaugggccgcgcccgccguguuaccgguauuguaagaacaagccguacccaaagucucg

SEQ ID NO: 13048 - RNA, 83 nt, Human
ggggucaaguacaucccagucguggcccucuggacaaguggcgggccccugcacuccaugagggcuucccaaugugcugcccc

SEQ ID NO: 13049 - RNA, 66 nt, Human; identical to SEQ ID NO: 5275

SEQ ID NO: 13050 - RNA, 60 nt, Human
gugcuggggcugacaggcuccaaacaggcaugcgaggugccuuuggaaagccccaggcac

SEQ ID NO: 13051 - RNA, 68 nt, Human
gagguuuagucaaaaagaccaaagcccaugucaucaucagacuccucggauucuucuuucuuugcuuc

SEQ ID NO: 13052 - RNA, 71 nt, Human
gcaguggagggggcaggaccuccucuggugcagcaccacuguaggagcagguccaccggccccuacauugc

SEQ ID NO: 13053 - RNA, 70 nt, Human; identical to SEQ ID NO: 3190

SEQ ID NO: 13054 - RNA, 121 nt, Human
caagaggaguugcacccuuccagacuugcggaugaguagcuugccaaccugacccucugucaggucagccaggguacaagcauucucugccaauuuggcuucucggucuuucuccugcuug

SEQ ID NO: 13055 - RNA, 67 nt, Human
ccuguccguccucgcccugcaccucugucuugauaggcuugauguccuggguggguggcuggccagg

SEQ ID NO: 13056 - RNA, 107 nt, Human
ggcuggccagggagggugucuggcagcugcagaaacagcaguuccucuuccuuggugaggcucagcucccucagcagcucugccacagauacauccuucgggaggcc

SEQ ID NO: 13057 - RNA, 82 nt, Human
augacccucacucgcgccaguggaggugacaucccuaggaaagaaacggauuugucuccagcugacgggcuggaggguucau

SEQ ID NO: 13058 - RNA, 91 nt, Human
gggguagauuuucgcugcaguguuccccgagccuguuagacgcagcgcgccgggagacugagagaggaaaggauagaggaagugcugcccu

SEQ ID NO: 13059 - RNA, 65 nt, Human
gauguggaugguggccucacccagauugacaaguaccuguacuccucugaggacuacauuaaguc

SEQ ID NO: 13060 - RNA, 131 nt, Human; identical to SEQ ID NO: 1788

SEQ ID NO: 13061 - RNA, 80 nt, Human
gccgacccccaagaggccauuaacuguuugaugcgagcaaucgagaucuacacagacaugggccgauucacgauugcggc

SEQ ID NO: 13062 - RNA, 77 nt, Human
gugaagaacucgcaguccuucuucucuggccucuuuggaggcucauccaaaauagaggaagcaugcgaaaucuacgc

SEQ ID NO: 13063 - RNA, 83 nt, Human
gggcuuuggccugaauucaggaagugguccccugauuccaaacacaggcuggguccgggggacgauugggauggccagaaucc

SEQ ID NO: 13064 - RNA, 72 nt, Human
ggagcagggccugacugcgcaggauucacagauuaaucucuugagguccuggaugccucaucccuuaguuuc

SEQ ID NO: 13065 - RNA, 62 nt, Human
gccgccccgagguuaauccacuuacacagaccacgugugaguuacagccgggguauucaggc

SEQ ID NO: 13066 - RNA, 67 nt, Human
accgcgggccgccgcuccugcucauagcgcaguuccugcuggcgccucagcuccucgcgcucacggu

SEQ ID NO: 13067 - RNA, 62 nt, Human
ggcggcccgcuuggcuuccggccaauaggcaucaucucgccgguccaggucguagggccgcc

SEQ ID NO: 13068 - RNA, 79 nt, Human; identical to SEQ ID NO: 10269

SEQ ID NO: 13069 - RNA, 114 nt, Human
uagagcaagugcagccauaagugguaagaaaugaaugaguauggcuguguuccaauuacaauuauuauggauggauauacucguauuuccuaugucagauggaaucuugcucug

SEQ ID NO: 13070 - RNA, 62 nt, Human
ugcccaggcuggagugcagugacgccaucuugauucacugcaaccuccgccucccaggguca

SEQ ID NO: 13071 - RNA, 64 nt, Human; identical to SEQ ID NO: 287

SEQ ID NO: 13072 - RNA, 75 nt, Human
augaaucagucacuugcacaauuaauccucuuggcaucauacaaacuggguuuuaauggcaaaugaugacaucau

SEQ ID NO: 13073 - RNA, 76 nt, Human
cuagucaccugggacccaggccuuggcugcaggaacagacuuuuuccaucggcuuuuccagggcccaggugaagag

SEQ ID NO: 13074 - RNA, 80 nt, Human; identical to SEQ ID NO: 174

SEQ ID NO: 13075 - RNA, 64 nt, Human; identical to SEQ ID NO: 175

SEQ ID NO: 13076 - RNA, 72 nt, Human
auuuaaucuuuaacaagcuuaugaaguuaguauuuuuauuuuauuuagacgaggcauagucaaggauuagau

SEQ ID NO: 13077 - RNA, 82 nt, Human
guuuugauagucugaggcugggccucugccuuugugaaguugaagagccaggagcuacucagcaacaauugauuuuugaaac

SEQ ID NO: 13078 - RNA, 60 nt, Human; identical to SEQ ID NO: 9570

SEQ ID NO: 13079 - RNA, 68 nt, Human
ggcggagggaccaagcugaccguccuaagucagcccaaggcugcccccucggucacucucuucccgcc

SEQ ID NO: 13080 - RNA, 83 nt, Human
caguauugggauaauuggcaacaugugaauaaggucugaauauuagauuguaauucuguaucaauguuaauuuccugguuuug

SEQ ID NO: 13081 - RNA, 96 nt, Human
ccuccccucaccccugaggaccaaauagggguggcagagccaaacccucgcugggcgucugugaccaaagccuaagaagccagggguggggccggg

SEQ ID NO: 13082 - RNA, 68 nt, Human
gagguguacugugccguuccccgcuguuugcugccuguggcacuggaccggggggcuggccgacucuc

SEQ ID NO: 13083 - RNA, 87 nt, Human
ggaguuguauaugucaagucauuuccucaguccaggaaggauauuuugaaagauuggguagaaaugugccguggugugcaacaaucc

SEQ ID NO: 13084 - RNA, 60 nt, Human
uucugaugaacugcacuacuuggaggucuaccugacagaugaguuugcuaaaggaaggaa

SEQ ID NO: 13085 - RNA, 62 nt, Human
uuggucugcuagccuagagguuucaguuccaaagggaggaaugcuuccggcaggagacacaa

SEQ ID NO: 13086 - RNA, 108 nt, Human
acagauguaggcagaagaccaggaguagggagagcugagacuagggauaaacaaaggggcaggaauccuggagagaagccccgugcuccacucacugacugcgucugu

SEQ ID NO: 13087 - RNA, 130 nt, Human
ggaacucagauaaucaucccuuuccagaaaguucugagcagccugggagcagcagggaaggagaagucagcucuauuccaggggcuccacagaacuaaugagguuggggagggaagcuuaaaagauagcc

SEQ ID NO: 13088 - RNA, 62 nt, Human
accccagaacauuuaagguguaugagaacucgggacgucaaauauguagaaaugaagagggu

SEQ ID NO: 13089 - RNA, 101 nt, Human
auagacuacgaucagagcugccaucugugguuuuccagggugacgcaagagaacaagcuugugugcuuuuuggacaccauaaaggaguugauacagucugu

SEQ ID NO: 13090 - RNA, 65 nt, Human
ggauuauacuccgagggggacaggggguugaaaacgguucuguccaaacagggggcauauaaucc

SEQ ID NO: 13091 - RNA, 78 nt, Human
cuggggcguuuauggcaagucacuuugacagacauuauuguggcaaauguugucugacuuacuguuucaacaaaccag

SEQ ID NO: 13092 - RNA, 65 nt, Human; identical to SEQ ID NO: 247

SEQ ID NO: 13093 - RNA, 80 nt, Human; identical to SEQ ID NO: 100

SEQ ID NO: 13094 - RNA, 80 nt, Human
caacgucuugauuaacuugcuuaaggaaugucacaaaaaucacaacauucugaaauuuuuugguuauuguaaugauguug

SEQ ID NO: 13095 - RNA, 67 nt, Human
cucccaccucagccuccugaguagcuaggacgacaguaccguagaaaacaggaccaagagcagggag

SEQ ID NO: 13096 - RNA, 84 nt, Human
gcuacccgccuucgucuccgaguuugcgacucgcggaccggguccccggcgcgaagaggcuggacucggauucguugccugagc

SEQ ID NO: 13097 - RNA, 79 nt, Human; identical to SEQ ID NO: 5161

SEQ ID NO: 13098 - RNA, 61 nt, Human
ccugucggcaaugccaggguacaugguggugccgccagacagcacuguguuggcguacagg

SEQ ID NO: 13099 - RNA, 70 nt, Human; identical to SEQ ID NO: 3612

SEQ ID NO: 13100 - RNA, 74 nt, Human
guagcugcuagaggccuuugcuagcugcuacagguagguccacacugucgcaggcugcucugucucuuagcccc

SEQ ID NO: 13101 - RNA, 73 nt, Human
agauagggcuuuccccauccuuuugcuuuuuuuaggcaacccuuucacaaaaccagggaaggggaaccugucu

SEQ ID NO: 13102 - RNA, 75 nt, Human
ucaguuaaaaaagaagaagaagaaauggcaaagagaaagguuuuucaaauuucuuucuuuuuuaauuuagauuga

SEQ ID NO: 13103 - RNA, 80 nt, Human
uuucaauuuuuauuuuggguuucuuacaaagguugacauuuuccauaacagguguaagaguguugaaaaaaaaauucaaa

SEQ ID NO: 13104 - RNA, 78 nt, Human
gccuugaaccugagggggauuccacagcuguuuggaggcaucugcuguugauacugcuggaauccagaguggugaggc

SEQ ID NO: 13105 - RNA, 85 nt, Human
guauaaaaccuccuuuauggguuuguugugaacacagugcagggcacauuuauaauaagagcucagucaaugguagguuucaugc

SEQ ID NO: 13106 - RNA, 87 nt, Human; identical to SEQ ID NO: 2862

SEQ ID NO: 13107 - RNA, 108 nt, Human; identical to SEQ ID NO: 7745

SEQ ID NO: 13108 - RNA, 64 nt, Human
guaauauuugucaugauaauuuugugugacaucaucagagaaaauguuagacguuaaguguugc

SEQ ID NO: 13109 - RNA, 76 nt, Human; identical to SEQ ID NO: 7446

SEQ ID NO: 13110 - RNA, 61 nt, Human
ccuagaagucugcggucugaggcucuuuggguucagacacacuguucuaggcuucuguagg

SEQ ID NO: 13111 - RNA, 62 nt, Human; identical to SEQ ID NO: 4127

SEQ ID NO: 13112 - RNA, 64 nt, Human
agccucccaaagugcugggauuacaggcgugagccacugugcccagcuauuuuuuuggagggcu

SEQ ID NO: 13113 - RNA, 69 nt, Human; identical to SEQ ID NO: 5449

SEQ ID NO: 13114 - RNA, 68 nt, Human
gaccagacuuuuccagaagugccggacgucgggcagcgucuauaucaccuugaagaaguaugacgguc

SEQ ID NO: 13115 - RNA, 63 nt, Human
gggaaaaggguaugaacggcccuggccauggguuccgaccauuuugucagggaaacccggccc

SEQ ID NO: 13116 - RNA, 78 nt, Human
gacacccccccuaagauggcuaucucuuugcucccaaaccacgugugaugaggcaggaugggcagcucaggugguguc

SEQ ID NO: 13117 - RNA, 70 nt, Human
uuacugggcaacuucauacugccagagggguugggaccagcagcuccacuccccacuguaggccaaguag

SEQ ID NO: 13118 - RNA, 73 nt, Human
cuguuuuaugauucuuaauaguuacuugguuuaaaucacauuugauacuauccuucugaaaagucugagacag

SEQ ID NO: 13119 - RNA, 66 nt, Human
guggagacgggguuucaccauguuggccaggauggucucaaucuccugacccugcgaucugcccac

SEQ ID NO: 13120 - RNA, 63 nt, Human; identical to SEQ ID NO: 527

SEQ ID NO: 13121 - RNA, 72 nt, Human
gcuuaccaggaagcauuugaaauuaguaagaaagaaaauugcagcuacacacccaauucgucuuggucuggc

SEQ ID NO: 13122 - RNA, 90 nt, Human; identical to SEQ ID NO: 5735

SEQ ID NO: 13123 - RNA, 74 nt, Human
auaacaugauuuaagguugaaauggcuuuagaaucauuuggguuugaggguguguuauuuugagucaugaaugu

SEQ ID NO: 13124 - RNA, 61 nt, Human
ucauaaccaaauaaaguuuuuugaaggccauggcuuuucacacaguuauuuuauuuuauga

SEQ ID NO: 13125 - RNA, 102 nt, Human; identical to SEQ ID NO: 2701

SEQ ID NO: 13126 - RNA, 90 nt, Human; identical to SEQ ID NO: 2702

SEQ ID NO: 13127 - RNA, 72 nt, Human
gcagagaaggagaucggcuuguggguucacccugaggaacugguagauuacacgagcugugcucagaacugc

SEQ ID NO: 13128 - RNA, 70 nt, Human
gugggugaacacuggaaggcccccggcugaagauccaccaacgacaucaagaaccuuccagcgcacucac

SEQ ID NO: 13129 - RNA, 67 nt, Human; identical to SEQ ID NO: 1146

SEQ ID NO: 13130 - RNA, 61 nt, Human
cugcaaguuugacuggaccggucccaacugcgagcggaagaaaccaccagugauucggcag

SEQ ID NO: 13131 - RNA, 65 nt, Human
gaaucacauaaaauugugugugcacguucauguacacaugugcacacauguaaccucugugauuc

SEQ ID NO: 13132 - RNA, 66 nt, Human
cucugagccuuauagauuacauauccuuagcuaaaaacugcugcauuuggagucuaaggaaaggag

SEQ ID NO: 13133 - RNA, 64 nt, Human
gaugcaauaguuagagaaaaccagguguaauuucagaauucacugucuccauuuguauugcauu

SEQ ID NO: 13134 - RNA, 76 nt, Human
ugugcagaagacuccuuggcuguguggaggauucuuguaauuggucugaguuuucugugucugagauuucuguaua

SEQ ID NO: 13135 - RNA, 69 nt, Human
agcagucuguacuuugugauaaguaagagcagaagagcagcauuuacauccagccuaacaacagacucu

SEQ ID NO: 13136 - RNA, 60 nt, Human
cgguaacuuuauuacacuggaaaaccauuaauauaggaaguuuuccacaaauacuuacug

SEQ ID NO: 13137 - RNA, 81 nt, Human
uaguucuauuuauauuuuugcaaaugucaggaucucauucuuuuuuaugccugaacaguacugcauuguguauauggacua

SEQ ID NO: 13138 - RNA, 62 nt, Human
uuuuacucucuaucuccaugaguucaauuguuuuaauuuuuggcuccuacaaaugagugaaa

SEQ ID NO: 13139 - RNA, 81 nt, Human; identical to SEQ ID NO: 13137

SEQ ID NO: 13140 - RNA, 64 nt, Human
uuuuacucucuaucuccaugagcuucaaguugucuuaauuuuuggcuccuacaaaugagugaaa

SEQ ID NO: 13141 - RNA, 60 nt, Human
ggauauggggugcaagucgaguucgggaccacgcuuggggaagugcgccagaaacuaucc

SEQ ID NO: 13142 - RNA, 65 nt, Human
cuaugagucuuaugagaagaccacccggaccucagauguggguggcuauuacuaugagaagauag

SEQ ID NO: 13143 - RNA, 62 nt, Human
gggaagacaccuggugacuuuagcuaugccuaucaaaagccugaggaaacaaccaggucccc

SEQ ID NO: 13144 - RNA, 85 nt, Human
guggcuacuccuaugagaccauugggaaaacuaccaagaccccugaagauggugacuauuccuaugaaauuauugagaagaccac

SEQ ID NO: 13145 - RNA, 70 nt, Human
uccccacgugccuguggcaaggucuguggugaagcagagauuaucaaggcuuuccagaggcagaggagga

SEQ ID NO: 13146 - RNA, 63 nt, Human
ugaggcagucacagcuugaagugugacgcuuagugugucacugauguuggagcugggcucuca

SEQ ID NO: 13147 - RNA, 69 nt, Human
ccaugaggcugauuccuuccuucuucucuucccuccuucguucauucaugggaaagucagugcguaugg

SEQ ID NO: 13148 - RNA, 63 nt, Human
aguuugcagccaucggccccacuacggcucgcgcgcuggccgcccagggccuuccuguaagcu

SEQ ID NO: 13149 - RNA, 65 nt, Human
ccagccccauggcugcugcugagucagccaccuagcgcuggccccaugcagccucccugggcugg

SEQ ID NO: 13150 - RNA, 64 nt, Human
ccucugguuucuugggagucgggcagggaccugcaggaggcuuucccagcaggugcacagaagg

SEQ ID NO: 13151 - RNA, 72 nt, Human
aacgagaacggguauagaagaagagagaagacuugugcgauaguucacucuuucuagaagaggacucucguu

SEQ ID NO: 13152 - RNA, 63 nt, Human
uggcugaugacagaggcccuagacgugguccugaggaaugauagguucucucgucgugaggca

SEQ ID NO: 13153 - RNA, 84 nt, Human
aauauaucaugccacucuccccuggccugcaagguuucaacugaaaaguguccugccagaaguauuggagcuccaucguauauu

SEQ ID NO: 13154 - RNA, 84 nt, Human
caaacuggaagaaucacauuaccugacuuccuuuagcauuucuuguagaacacgucugguguggauaaaaucacucagcuuuug

SEQ ID NO: 13155 - RNA, 91 nt, Human
ggcugaggggcuccaguuugcaaccucuauaagugaaucucaacauucuuucauaauagguaaagguugucucaacuacagcuauccagcc

SEQ ID NO: 13156 - RNA, 82 nt, Human
ggugcugggucauaauaugauggugacucugauuuccuguggaucugugaaguucaguauuauacuuauuuucuccaguacc

SEQ ID NO: 13157 - RNA, 77 nt, Human; identical to SEQ ID NO: 2550

SEQ ID NO: 13158 - RNA, 68 nt, Human; identical to SEQ ID NO: 2551

SEQ ID NO: 13159 - RNA, 71 nt, Human; identical to SEQ ID NO: 2552

SEQ ID NO: 13160 - RNA, 100 nt, Human
accgagcuccgucgucucguuuccggcggucgcgcgcucuuuucucgggacgggagaggccguguagcgucgccguuacuccgaggagauaccagucggu

SEQ ID NO: 13161 - RNA, 81 nt, Human
cccugcccccagccgucuuucuggggcuugcgcgcaaaaucuacaagcggagaaagugaccuagagauugcaagggcgggg

SEQ ID NO: 13162 - RNA, 92 nt, Human
gugucugcaacgggccacuccagaacaguaccagauccugaaggaaaauuacgggcagaaggaggcugagaaaguggcccgggugaaggcgc

SEQ ID NO: 13163 - RNA, 98 nt, Human
ugccaagaagauccugcuggagaugggggaguucuuucagauucaggaugauuaccuugaccucuuuggggaccccagugugaccggcaaaauuggca

SEQ ID NO: 13164 - RNA, 115 nt, Human
gggcgcgcuggagcugcugcaggcggcggccggcucgggcuuggcagccuacgcggugugggcgcugcugcuccagcccggcuuccggcgcgugccgcugcggcugcaggugccc

SEQ ID NO: 13165 - RNA, 65 nt, Human
ggugaugacgguaagagcaagugucccaugaaugugauuuccuggguucucacugucuuugcacc

SEQ ID NO: 13166 - RNA, 81 nt, Human
gugcuguuagcccgcuccuuggaaguuagacauaugaagaauuggaucagagauuucuaugacagugcgggaaagcagcac

SEQ ID NO: 13167 - RNA, 75 nt, Human
gagguaucucugcauuagccagauuggacauauguaaagggacaucaguauaucuggaucaucagauugugcuuc

SEQ ID NO: 13168 - RNA, 76 nt, Human
uugcugacgcagcaucucagggcucaaagcucacacaacaagccaauauacagagagaaugcucgcggcuuagcgg

SEQ ID NO: 13169 - RNA, 63 nt, Human
gcuggugccugccuugcugcugugagugccaauggugcccaccuugcugcugugagugccagu

SEQ ID NO: 13170 - RNA, 78 nt, Human
uuauuuacaagagcagggugccuuggaagcagcccacggcuguuaguucauagacccugucugcucugaaguagauga

SEQ ID NO: 13171 - RNA, 62 nt, Human
uuccacaccuucacaaucccaucucuagaagcaguuacgaugaagcccuguguggucuggaa

SEQ ID NO: 13172 - RNA, 74 nt, Human
ccggacaagccuaucacccaguauccacaugcgguggggaagaacacccuccucauugcugggcuccaggccgg

SEQ ID NO: 13173 - RNA, 63 nt, Human
guugggaaaucaucucuaaaucccauccucuuucgagguguugggaugguggccgauccugau

SEQ ID NO: 13174 - RNA, 83 nt, Human
gccgcgcccccuuggcgccggguguccugccgcugcuugcgcagcggcccuuguuucuucuuacccguuguuaggggcgcagc

SEQ ID NO: 13175 - RNA, 78 nt, Human
guuuagagaguucggcaugcuuacaggcaguuauuguucuagguguuagcuuucuggguguacggagcagcucuaagc

SEQ ID NO: 13176 - RNA, 85 nt, Human; identical to SEQ ID NO: 5538

SEQ ID NO: 13177 - RNA, 72 nt, Human
uaguaaagaauagaaaugcagcuacacacccaauucgucuuggucuggccuaaaauuucucagucuuuacua

SEQ ID NO: 13178 - RNA, 71 nt, Human
uacuguaccuuuucuguguuuagauacacaaacacuuuguguuacaauugucuacaguauucgguacagua

SEQ ID NO: 13179 - RNA, 70 nt, Human
caugcaggcgagcuggucaucgccucgccggagggccagcuggaggugcagacggucaucgucuagcaug

SEQ ID NO: 13180 - RNA, 70 nt, Human
gccugacagagcagguggccaugacgcuggccucggccaucagcgagggcacugugcuugccgcccgggc

SEQ ID NO: 13181 - RNA, 76 nt, Human
ucugcgggguccuggccgggcagggacagggcagaggacucugagcgccccacccaugccugccuggccugguaga

SEQ ID NO: 13182 - RNA, 95 nt, Human
caggggugagcgcucagagcaggaaggggaugaugggcaugcgcaggggcggguagucccggaacuccuucagguagcugcggugcuugccccug

SEQ ID NO: 13183 - RNA, 87 nt, Human
gaggcaacacagcaguuaagaauugagauaaagugccagucugccaguuagaauccugugucucacuauuuuaacacucugugccuc

SEQ ID NO: 13184 - RNA, 79 nt, Human
gccaaaggauucccagcucaagucaaagugaaauuuaaaacugcaacaucaaaaucaucuugaguuacuccuuuaaggu

SEQ ID NO: 13185 - RNA, 64 nt, Human
gcugcugccguaauagcucauucuuugcugugcccuuagggauccaggugaguuuuguaguagu

SEQ ID NO: 13186 - RNA, 60 nt, Human
gucacccgggagcggagguugcgugagcaggauugugcgacugacuccagccugggugac

SEQ ID NO: 13187 - RNA, 85 nt, Human; identical to SEQ ID NO: 2661

SEQ ID NO: 13188 - RNA, 89 nt, Human
uuagcaugaagucccucuggaucuugagcugguuuauggacucaaucgucucauggaucuuacuguccagagcacugaucuccugcugg

SEQ ID NO: 13189 - RNA, 63 nt, Human
ggcagugcuggguccuuuccaccauggcaccuaagaaagcaaagaagagagccgggggcugcc

SEQ ID NO: 13190 - RNA, 83 nt, Human
ugggcagcccuggggggacaaggggcaccucgaguacagaaacuacaacaggaggaacccaucccgaagagccaggguuacca

SEQ ID NO: 13191 - RNA, 81 nt, Human
uauguguaauuauuuuggauuucucagaaguugaaugcuacguacauacuuuuaauccccacaaaguauaauaaauacaug

SEQ ID NO: 13192 - RNA, 96 nt, Human
ucuugccucuuauuuacauucuccaaacucacuauccauucagcuuguguuagaaggaaugcuaaaaguauggggaguuguaguaugggaccaaga

SEQ ID NO: 13193 - RNA, 69 nt, Human
ucugggucucuaaaagccacccucaguuuauaccaacugaucaggaaauagguggcgacagggccuuga

SEQ ID NO: 13194 - RNA, 85 nt, Human
cgagcggcgcgaggcccggguugagcgggaggcgcgaucgguccggucagguggcuccccgcggcgggccgggcccgacgucucg

SEQ ID NO: 13195 - RNA, 61 nt, Human
auguguguucuuuagauguuacaaacauuaauguuucuucuaucauuuuuguuacauauau

SEQ ID NO: 13196 - RNA, 81 nt, Human
ccggguuauggucggguuucuauugggaaugcucuuugugcuuuugggcaucugaauggaagcuuuacauagaaccuuagg

SEQ ID NO: 13197 - RNA, 73 nt, Human
gggaucuuguuccacugauuacucucucugacgaguccaucaccugcaacuuaaaugaacaagcuuacauccc

SEQ ID NO: 13198 - RNA, 74 nt, Human
ugcuuuagauuagacugucaugucucagugucuaucuguacuauauuacuuugauauucagagaaucuaaagca

SEQ ID NO: 13199 - RNA, 81 nt, Human
uugcuuaaaacuguacucuuuugcaaauuaacaauuuuaucacugauucagaguuaaaaagaagacuaacuuuucaagcaa

SEQ ID NO: 13200 - RNA, 61 nt, Human
cuuauccagagcuuuguuugaguucucauagucaaugagggcuuuggugcgucuguauaag

SEQ ID NO: 13201 - RNA, 62 nt, Human
acaucgauacagugucacgcucgugagugacaggcggagcgcgaggaugaggcgaaugaugu

SEQ ID NO: 13202 - RNA, 63 nt, Human
gcgcggggcggcgaggggggcggagggcaggcagacgccaacggacacgcaaugcgacgcagc

SEQ ID NO: 13203 - RNA, 64 nt, Human
gcucuauuuguauuacccagaugacugaagcuuaagagaaggcagggaaguauacaagcagagc

SEQ ID NO: 13204 - RNA, 67 nt, Human
cuguaaugaacaaggaauauucaaaaucauaauaauaauggguaaacuuugccuggagcguggacag

SEQ ID NO: 13205 - RNA, 91 nt, Human
gugauuuuuuuggucuuauuauguauuuccugaaauaauuaacuuccauauaaguuguuuuagcuaaauaauaagcacuuuaauugagcgc

SEQ ID NO: 13206 - RNA, 64 nt, Human
cuugcgcuuacuuuggagccuucaucaggguuuggugaaaaaggcgguauauaagcugagcaag

SEQ ID NO: 13207 - RNA, 113 nt, Human
aaagacaaacugcuguggccauuguguguaacuuauucucaaaagaacuuuuguuaguuaagauuaguguuuuuuaagaaugagaauaugaaaauugucacaguuuucucuuu

SEQ ID NO: 13208 - RNA, 64 nt, Human
guacauagaaauaaucauuugcacuaagcaugguacuagagcagaagagcaguuuuaaauguau

SEQ ID NO: 13209 - RNA, 74 nt, Human
ugcuuagucuaacucaaaagauccuuuuucauuuguuaccaaaaauguauuaggucccuguugaaggcuaggca

SEQ ID NO: 13210 - RNA, 76 nt, Human
uugaguucauaaucuggucaugugggaauugcuaucuuugugauuuugauuauuucuuccagauuauuuuauucaa

SEQ ID NO: 13211 - RNA, 119 nt, Human
uuuauggcuuagaguccuccugucuucccuuuucaccccucuagucccuccuccguccauuucuugaagggaacuaugagugugauagaagguggaguggggauucccuguggccugaa

SEQ ID NO: 13212 - RNA, 74 nt, Human
ucagugucagucugcuuugcaaucuuuacuuaaguccuagguaaccauuuugucaucuagcaagcuugccuuga

SEQ ID NO: 13213 - RNA, 73 nt, Human
uccauaaucugcuaguuuugcauguacuuauaugaacaacagugcaguaaguugaaaacucaguaucuaugga

SEQ ID NO: 13214 - RNA, 88 nt, Human
uguauugcuauaugggugccaagauugaauaugaagaacccgaguguuuguaguauuauaguuuuaagcaaaucuguguggugauaca

SEQ ID NO: 13215 - RNA, 62 nt, Human
ggugccacagugaauaaaagagaaaguagacagcuuuugcuggaagauucaacuaaagugcc

SEQ ID NO: 13216 - RNA, 94 nt, Human
gugggacaaauauuaacaaagcaugauuuaaauauauauauauuuaaugugugauauguuuguauauauauuuaaacacaugcaauuguucuac

SEQ ID NO: 13217 - RNA, 80 nt, Human
uuucuggaccaugaaagugucaccaaauucaaagaacauuucugaauguacauccagugacaucuguuaugcaaaagagg

SEQ ID NO: 13218 - RNA, 86 nt, Human; identical to SEQ ID NO: 8924

SEQ ID NO: 13219 - RNA, 78 nt, Human; identical to SEQ ID NO: 7184

SEQ ID NO: 13220 - RNA, 63 nt, Human
caugccuuacgaaccaugccuuccucaguauccacacauaaacgggcaguguuuuaaaacaug

SEQ ID NO: 13221 - RNA, 84 nt, Human
auugauuucauguaaucuuugauguacuucuuguaggcuucuuuugugaaacuuguuucccugcagagaugguuccaugacaau

SEQ ID NO: 13222 - RNA, 65 nt, Human
gauuaccuuaacgucagaauucccuaauauuaugaaggaauuagaugaaucaaggcuaggugauu

SEQ ID NO: 13223 - RNA, 69 nt, Human
gucacugcuagcugucaccauugcccuggucccaccagaccagccugagguccagcuguccagcaugac

SEQ ID NO: 13224 - RNA, 73 nt, Human
ggagccugagagguggaggaguucugaucccccguuacuuccuagcauuuucuccucuugccuuaaaaguucc

SEQ ID NO: 13225 - RNA, 60 nt, Human; identical to SEQ ID NO: 1551

SEQ ID NO: 13226 - RNA, 79 nt, Human; identical to SEQ ID NO: 1810

SEQ ID NO: 13227 - RNA, 64 nt, Human
ucgucuuuaaacccugcguggcaaucccugacgcaccgccgugaugcccaggaagacagggcga

SEQ ID NO: 13228 - RNA, 66 nt, Human
ccagcagccgagaagaggcccagcagcugugggaggcugaaaaggucaaaaugcggcaaauccugg

SEQ ID NO: 13229 - RNA, 64 nt, Human
agccagguauucucuacugccgcugauggucaaaccgcaaguggaaauuaaagugugucaggcu

SEQ ID NO: 13230 - RNA, 91 nt, Human; identical to SEQ ID NO: 5566

SEQ ID NO: 13231 - RNA, 72 nt, Human
ggcgggccgguuagcggcgacggggagggugggcucguggugcccccccuuuuguugugguuaacgcucgcc

SEQ ID NO: 13232 - RNA, 78 nt, Human; identical to SEQ ID NO: 8274

SEQ ID NO: 13233 - RNA, 61 nt, Human; identical to SEQ ID NO: 8603

SEQ ID NO: 13234 - RNA, 69 nt, Human
caugcugagaaacugaugaagcugcagaaccaacgagguggccgaaucuuccuucaggauaucaaggug

SEQ ID NO: 13235 - RNA, 74 nt, Human
gcuuaccaucuaaacuaaauuaggcaaauaguaaugucccuuuugccaaaacguggugguuagagaugaugggc

SEQ ID NO: 13236 - RNA, 75 nt, Human
ggcaguguucggguaucagaaaucacuuaaacuagcaauuggccuuauaaagugaugauacacugggcuuuugcc

SEQ ID NO: 13237 - RNA, 80 nt, Human; identical to SEQ ID NO: 788

SEQ ID NO: 13238 - RNA, 128 nt, Human
gccaagguccccaccacggggguccccagugcaccccagcuccggggcagaagaggcagccugcagaucucugcugccgggaaagagcuccugaaguuguggggucuggacuccgcuggggacagggc

SEQ ID NO: 13239 - RNA, 70 nt, Human; identical to SEQ ID NO: 7791

SEQ ID NO: 13240 - RNA, 60 nt, Human
uccugagucagguagugcagugguuguaaagugcagcauauucauuuccaagcuagaggg

SEQ ID NO: 13241 - RNA, 62 nt, Human
aggagaugcuuauuauuuguugaaggauuuugcacucaccauuaaaucuaucaguguuuccu

SEQ ID NO: 13242 - RNA, 65 nt, Human
gaaugugaagacucucaacucguaucucauuugaugagcugcaaggaaggaagaguagcaauuuc

SEQ ID NO: 13243 - RNA, 87 nt, Human
gucugggaacuuugaugaugauuugcuucgacuagaaacuccaaaccauguuacucuaggcacaaucggugucaaucgcucucaggc

SEQ ID NO: 13244 - RNA, 60 nt, Human; identical to SEQ ID NO: 1551

SEQ ID NO: 13245 - RNA, 60 nt, Human
uuuacaguauguacacgcggugacacuccacacaggucgcagacacguggacgcagugag

SEQ ID NO: 13246 - RNA, 61 nt, Human
agcggacagguccagaagccccccggaacggcacuguucaccuuuaucugaccaaaccgcu

SEQ ID NO: 13247 - RNA, 67 nt, Human
uguuucucuuuuuuuaaacaugucucacauagaguaucuccgaaugcagcuauguaaaagagaacca

SEQ ID NO: 13248 - RNA, 106 nt, Human; identical to SEQ ID NO: 6411

SEQ ID NO: 13249 - RNA, 85 nt, Human
ugggccaauguccacaaagaauuccuggucagcaccaccgauguccaaaggugcaauaucaaggaagggcaggcgugauggcuua

SEQ ID NO: 13250 - RNA, 80 nt, Human; identical to SEQ ID NO: 367

SEQ ID NO: 13251 - RNA, 74 nt, Human
acugccauccgcgggucgggggaacugcagggccuccugggaucaggcuuuucugccagcagcgagaugacagu

SEQ ID NO: 13252 - RNA, 85 nt, Human
cagggccacauccacgggggccucccaagggcugcggggccaguggccucucaggcagggaggacucaggacuacaugugcccug

SEQ ID NO: 13253 - RNA, 62 nt, Human
ggucuccucaauggcauacagcagcuucucucucagcuguucguagcucuuguagggugguc

SEQ ID NO: 13254 - RNA, 78 nt, Human; identical to SEQ ID NO: 5666

SEQ ID NO: 13255 - RNA, 69 nt, Human
ucgcgcgggggguaauucggggucuggguucuggugccgcgcagcuuuccccgauggcccacugcguga

SEQ ID NO: 13256 - RNA, 64 nt, Human; identical to SEQ ID NO: 8480

SEQ ID NO: 13257 - RNA, 77 nt, Human
ccaaacaccaauggcucucaguucuuccugacaugugacaagacagacuggcuggauggcaagcaugugguguuugg

SEQ ID NO: 13258 - RNA, 105 nt, Human
ccacaauggcacugggggcaaguccaucuaugggaagaaguucgaugaugaaaacuuuauccucaagcauacgggaccaggucuacuauccauggccaacucugg

SEQ ID NO: 13259 - RNA, 80 nt, Human; identical to SEQ ID NO: 887

SEQ ID NO: 13260 - RNA, 70 nt, Human
cuuccugggcuucguggcugaggugcuggugcuggucaccaucaucuucaucuacgagaagcgccggaag

SEQ ID NO: 13261 - RNA, 69 nt, Human
gucugcaagucagaguccgugccaccugucacugacugggccugguacaagaucacugacucugaggac

SEQ ID NO: 13262 - RNA, 72 nt, Human
cuggggugaggcgggcagcgcuacgcgugggguaggaccaucuuacgcugggaccccgccaaggagccccag

SEQ ID NO: 13263 - RNA, 65 nt, Human
ggcucugcuccgagguguguuuguaguugcugcuaagcgaacgcccuuuggagcuuacggaggcc

SEQ ID NO: 13264 - RNA, 66 nt, Human
cacgugguggacagugggccgcaaagaaccuacguggaugauucgcgguccucuacucuccacgug

SEQ ID NO: 13265 - RNA, 93 nt, Human
ggccaggcuggucuugaacuccugaccuugugauccacccaccucggccucccagagugcugggauuacaggcaugagccaccacgcuuggcu

SEQ ID NO: 13266 - RNA, 62 nt, Human
ggcucaaaaaccaguuccauuucuaauguuguccucacaagaaggcuaauugguggugagac

SEQ ID NO: 13267 - RNA, 80 nt, Human; identical to SEQ ID NO: 367

SEQ ID NO: 13268 - RNA, 60 nt, Human
caccagccuuccuguauagacacuaaauuguuagcaagaguguugagcuaguuccuggug

SEQ ID NO: 13269 - RNA, 103 nt, Human
gccauucauuguacaguugcaggaaugagagugauuuuaugaugugguacauugggaccauguucuaaaaccuuggguuucugagucugcuuuuugaguaggu

SEQ ID NO: 13270 - RNA, 61 nt, Human; identical to SEQ ID NO: 6766

SEQ ID NO: 13271 - RNA, 81 nt, Human
gagcuucuccuugccaguuucucccagcaggacccucuucuuguuuugaaagauggucggcugcuuuugguaggcacgcuc

SEQ ID NO: 13272 - RNA, 76 nt, Human; identical to SEQ ID NO: 758

SEQ ID NO: 13273 - RNA, 66 nt, Human
uguaggugcccucaauagccuccuugggugucuugaagcccagaccgauguucuuguaguaccgcg

SEQ ID NO: 13274 - RNA, 60 nt, Human
ucaaguuuguauucaguacaguugucauucacuucuuagacaaagaauugacaggcuuga

SEQ ID NO: 13275 - RNA, 67 nt, Human
uaauucacauaccacacaauucauguaucuaaaguauacaguucuguaguucugugguuguugguua

SEQ ID NO: 13276 - RNA, 72 nt, Human
uguguuggcaaaggcuguuaauaguaguuaaguguuaagacugcuuuucuuuaacguuuucaugguaaugca

SEQ ID NO: 13277 - RNA, 84 nt, Human; identical to SEQ ID NO: 286

SEQ ID NO: 13278 - RNA, 89 nt, Human; identical to SEQ ID NO: 288

SEQ ID NO: 13279 - RNA, 61 nt, Human
uuuuuuaaugggucucaaaauucugggacaaauuuuuggucaaguuguuuccauuaaaaag

SEQ ID NO: 13280 - RNA, 82 nt, Human
aaaaguaaugugagucugucuaaccauauuuuccuaacucaacaguaggaucaugaugguaaggcaaaugcaaguuauuuuu

SEQ ID NO: 13281 - RNA, 81 nt, Human
gcaaauacuuuugaccucuugugaugagucagaacuaaaacuuaauucuuugacuuucacauuuuuuaaaaaguguauugc

SEQ ID NO: 13282 - RNA, 77 nt, Human
cggcugggagcuugaacuugccuggguuggcuuccacuauaccgauggucucuuccagguccucgaggucccacucg

SEQ ID NO: 13283 - RNA, 70 nt, Human
accacgggguccagugccugugggccaaccaccaggaagcugugcaugcccacagcccgaggccccuggu

SEQ ID NO: 13284 - RNA, 85 nt, Human
ggaaagguccagagcuguggagaaagaaggggcucccugucuccaggguuuguuuaagguuuucuccauggccuagggcccagcc

SEQ ID NO: 13285 - RNA, 73 nt, Human
acuuccuguccuuacucccucuuuaagauugcguacccacugcagagugcugaagacgggguagccacgaggu

SEQ ID NO: 13286 - RNA, 77 nt, Human
cuuggagccaggagccugccaugagguuuugagaacagagugcuguuuuagagcuggcagcagcaucucagcccaag

SEQ ID NO: 13287 - RNA, 115 nt, Human
ggaaacuuaaaccaaagucuauuuuccuauuuaagaaaacuggacucugggccaggugcaguggcucagaguccaguuuucuuaaaugggaaacuuaaaccaaagucuauuuucc

SEQ ID NO: 13288 - RNA, 60 nt, Human
ugguuagaucauauagcuaaugaauuaggcagggagcuauuuuuugaagaugaugaacua

SEQ ID NO: 13289 - RNA, 90 nt, Human
ggggaugaauucuucaaauaggagccgauggaucugugguccuuugggacucaucaaagccuugguuuagcauuugucaguuuuaucuuc

SEQ ID NO: 13290 - RNA, 70 nt, Human
caccaccgccacuucgucauccgcagaggccaggucuugcgggagauugcugaagaguauggcgggggug

SEQ ID NO: 13291 - RNA, 81 nt, Human
gacaaggaccaggaccugaucaccaucauuggaaaggaggacgccguccgagaggcacagaaggagcuggaggccuugauc

SEQ ID NO: 13292 - RNA, 73 nt, Human
ucggcaaggggggcggcaaaauucgcaaggugcgcgacagcacuggagcacgugucaucuucccugcggcuga

SEQ ID NO: 13293 - RNA, 77 nt, Human
ggucaccacgccagagaggauccgcccucgaauggacacauuaccagugaaggggcauuucuuggcaauguggugcc

SEQ ID NO: 13294 - RNA, 64 nt, Human
gcuuacuaaaagggggaaaacguaggcuuggauuaaggcgacagcgauuucuaggauagucagu

SEQ ID NO: 13295 - RNA, 104 nt, Human
ccgacaagaaagccgaggcuggggcugggucagcaaccgaauuccaguuuagaggcggauuuggucguggacguggucagccaccucaguaaaauuggacgagg

SEQ ID NO: 13296 - RNA, 77 nt, Human
gaaggaacaguuugccuggagacauuucuacugguaccuuaccaaugaggguauccaguaucuccgugauuaccuuc

SEQ ID NO: 13297 - RNA, 63 nt, Human
gccacccuacgccguagccguccagagacuggcaggccucggcuaaaggucuggagggugagc

SEQ ID NO: 13298 - RNA, 83 nt, Human; identical to SEQ ID NO: 1377

SEQ ID NO: 13299 - RNA, 73 nt, Human; identical to SEQ ID NO: 1378

SEQ ID NO: 13300 - RNA, 64 nt, Human
caccauugauauuguauuuagaagguuucaggugggugaaaccuccuauuccaugcguaaggug

SEQ ID NO: 13301 - RNA, 68 nt, Human
cuucugcauguuucccauauuacagacuugagacuguccucauucccauauguaauagacauccaaag

SEQ ID NO: 13302 - RNA, 67 nt, Human
agcagggcggcaaugguguagcggcgggggccggagucguuggcugugaauaccaccucugcaugcu

SEQ ID NO: 13303 - RNA, 85 nt, Human
uccuccgaaccagcauccccaccaucaacauggagaacaagaccacgugguucucuguggacauugacucggagcugguggagga

SEQ ID NO: 13304 - RNA, 115 nt, Human
uggcuggugcugguggccgugggugcagggcugcuguugcuggggcugaucauccuccugcuguggaagugcggcuucuucaagcgagcccgcacucgcgcccuguaugaagcua

SEQ ID NO: 13305 - RNA, 64 nt, Human
gcuacuucagcugcuuaagcuggcccacaaguacagaccagagacaaagcaaagaggaagaagc

SEQ ID NO: 13306 - RNA, 72 nt, Human; identical to SEQ ID NO: 1989

SEQ ID NO: 13307 - RNA, 68 nt, Human; identical to SEQ ID NO: 1620

SEQ ID NO: 13308 - RNA, 65 nt, Human; identical to SEQ ID NO: 6942

SEQ ID NO: 13309 - RNA, 63 nt, Human; identical to SEQ ID NO: 12838

SEQ ID NO: 13310 - RNA, 85 nt, Human; identical to SEQ ID NO: 10310

SEQ ID NO: 13311 - RNA, 85 nt, Human; identical to SEQ ID NO: 5547

SEQ ID NO: 13312 - RNA, 99 nt, Human; identical to SEQ ID NO: 1699

SEQ ID NO: 13313 - RNA, 91 nt, Human; identical to SEQ ID NO: 1972

SEQ ID NO: 13314 - RNA, 60 nt, Human; identical to SEQ ID NO: 1701

SEQ ID NO: 13315 - RNA, 93 nt, Human
caguucugggcaaaccagaauuugacuuuuaguaaggaaaaagaagaauuuauucacucaagacuaaaaacuaaaggccugggcugagaacug

SEQ ID NO: 13316 - RNA, 60 nt, Human; identical to SEQ ID NO: 12526

SEQ ID NO: 13317 - RNA, 76 nt, Human; identical to SEQ ID NO: 5199

SEQ ID NO: 13318 - RNA, 78 nt, Human
aggggaugagggggaagaggagcugccuuuuggaggcccccuucaccugcagcuaugaugcccuuccccuucuccccu

SEQ ID NO: 13319 - RNA, 100 nt, Human
cuuauccccauucuacuccccugcuaugcaagugccccuguggcuuguccccaacccccucagcaacaaagcucagcuggggaacgagaguaauuugaag

SEQ ID NO: 13320 - RNA, 77 nt, Human
gcuugaagucagcgucuuccauuccagaaagacccccauucuuccuuuggggguaugauguggaagcugguuucagc

SEQ ID NO: 13321 - RNA, 85 nt, Human
gcuaucuggauuuuaaagugacugaagggagcuuugucuauaaggguggaaaaaucuacaagguuccuuccacugaagcagaagc

SEQ ID NO: 13322 - RNA, 64 nt, Human
ggcaucuagccuaaugggauuguuugaaaaacgucgcuucaggaaauuccuagguguaugugcc

SEQ ID NO: 13323 - RNA, 70 nt, Human
ugcgagauguguauaagaaauucgauugcgggucaagacguuauagauuuuacugguccaugcucuugca

SEQ ID NO: 13324 - RNA, 86 nt, Human
ucugcuggcuucacggccuguucuguucucuuaggcuccacaugagggcacaggggugugggagcggguggggaggucgaggcggg

SEQ ID NO: 13325 - RNA, 71 nt, Human
gcagggaccccugcaaguguuggucgggggccucgagcugccugagcugacacgaggggaggggucugugu

SEQ ID NO: 13326 - RNA, 97 nt, Human
uuuugagcacaaaaccaccggggaucuagccuguggcaccccggagaugacacgaggcucacaugacucuagacacuugguggaaagugaggcgaga

SEQ ID NO: 13327 - RNA, 77 nt, Human; identical to SEQ ID NO: 1216

SEQ ID NO: 13328 - RNA, 68 nt, Human; identical to SEQ ID NO: 813

SEQ ID NO: 13329 - RNA, 74 nt, Human; identical to SEQ ID NO: 4266

SEQ ID NO: 13330 - RNA, 80 nt, Human; identical to SEQ ID NO: 3013

SEQ ID NO: 13331 - RNA, 68 nt, Human
aggguaaugaguaggugagagggucuggaggaagccucccuacugcuggagccucuacuuauuacccu

SEQ ID NO: 13332 - RNA, 61 nt, Human
uggguggccaggcuggucuugaacuccugaucucaggugauccacccgccucagccuccca

SEQ ID NO: 13333 - RNA, 65 nt, Human
ggcagcaggccacagggcagaacugaccaucugggcaccgcguuccagccaccagcccugcuguu

SEQ ID NO: 13334 - RNA, 73 nt, Human
gcuuggaggugaaacuugugcuuguauccccagccacgaagagcuggaccagcuucaaguacauguccacagc

SEQ ID NO: 13335 - RNA, 61 nt, Human
uugcaggaaggccucuucccugauggccgcgucuucauggaaguaggagagaagacuguaa

SEQ ID NO: 13336 - RNA, 71 nt, Human
gacaacauggcugugugcuucagcggcuuccugggcacguaggagcagcuguaagugccauugccguuguc

SEQ ID NO: 13337 - RNA, 62 nt, Human
gggguggcugccagcucccacauucacccugaaggggcuguuggggaugcugacgccucccc

SEQ ID NO: 13338 - RNA, 64 nt, Human
guccacagacuccuuugugcuggaaccugggcuccuccagcugccaggcaggagucgguaggac

SEQ ID NO: 13339 - RNA, 75 nt, Human; identical to SEQ ID NO: 10265

SEQ ID NO: 13340 - RNA, 88 nt, Human
uuucaugcuuugaacgaucagacaagcuuuacauucuaccuaugguguucagaaauugaggcuaacauugaaauaucaaagcguuaaa

SEQ ID NO: 13341 - RNA, 61 nt, Human; identical to SEQ ID NO: 280

SEQ ID NO: 13342 - RNA, 79 nt, Human; identical to SEQ ID NO: 281

SEQ ID NO: 13343 - RNA, 131 nt, Human; identical to SEQ ID NO: 282

SEQ ID NO: 13344 - RNA, 61 nt, Human; identical to SEQ ID NO: 544

SEQ ID NO: 13345 - RNA, 60 nt, Human
gcggccuccuucccaggcucuggggcagcgcaggagggguaggcugggaggggcugccgc

SEQ ID NO: 13346 - RNA, 110 nt, Human
uguagcuggaggcaugggcaagggggguccccagguaguaaacuccccaggugggcugagggcuagggcugagccucaggugggucuccuguucccagugcuacccugca

SEQ ID NO: 13347 - RNA, 61 nt, Human; identical to SEQ ID NO: 6766

SEQ ID NO: 13348 - RNA, 75 nt, Human
aguccuagcccugcugagugugacaugcaaagcuucgacccacagcaggaagucucacaguucugggcuaggacu

SEQ ID NO: 13349 - RNA, 71 nt, Human
gcucuguuuucaggaaaguuaucuggaggcucuucuuccuuuagccucucccauggcuuucaauguggggc

SEQ ID NO: 13350 - RNA, 130 nt, Human
guuaauuauucaagggggugucucugccaagagaaagucaccuguggagaagaguucugugucuggacuuggagcacagccacggaugcugucaucugcuuccucuuggcacacacccuugauccaaggc

SEQ ID NO: 13351 - RNA, 77 nt, Human
ggaaagguucggccccuuucgguuuuuuuuaaaaaaaaaauuuuucaaaagccggggcuagggguuggguaaauucc

SEQ ID NO: 13352 - RNA, 84 nt, Human; identical to SEQ ID NO: 13153

SEQ ID NO: 13353 - RNA, 84 nt, Human; identical to SEQ ID NO: 13154

SEQ ID NO: 13354 - RNA, 62 nt, Human
cuaucagaauaccaaugacauucuucacagaaauagaaaaaagaaucaugaaauuuauaugg

SEQ ID NO: 13355 - RNA, 79 nt, Human
ggcugccagaugggaccucacugacccagacguuccgggcccgggaacagcuggcagcugugaggcucuauguggagcu

SEQ ID NO: 13356 - RNA, 67 nt, Human
ugggacucgugccuucugcuguucucauuguggccaagaaaugucccagcugagggccuuuguccca

SEQ ID NO: 13357 - RNA, 80 nt, Human
cucuugccucagucuuccaaauagcugggacuagaggcacaugccacugggcccagccuauuugcaaaacuuuuguagag

SEQ ID NO: 13358 - RNA, 81 nt, Human
gcuggaguacaggaguucugggcuguagugcgcuauggcacaaucauagcucacugcagccucuaccuccugggcuccagc

SEQ ID NO: 13359 - RNA, 64 nt, Human
cucuagaagcuagcucccggcagcaugucagcaaaugaacaggacagcgagcuggccucuggag

SEQ ID NO: 13360 - RNA, 97 nt, Human
guauuugacucgaccuuggaacacuggcccugagacucagggguuuaacauuucaccucccugaauucccauccagaaaucucaggcgagcagauau

SEQ ID NO: 13361 - RNA, 62 nt, Human
gugcaucagccggcuugaguuuguucaauaucaaagcugaaaacuagcgaggucugcuguac

SEQ ID NO: 13362 - RNA, 66 nt, Human
uaaauaugugcaguuauuaucacaugaagaaacgcagugugucgggcuguaauauuaccauauuug

SEQ ID NO: 13363 - RNA, 68 nt, Human
acccguccgagcgcccgggggccgcuggcgggagccggcggcacgcgggggccccggggcggcugggu

SEQ ID NO: 13364 - RNA, 76 nt, Human
gccgcccucgccgccgccgucgccgccgcggagcagaucaauaggcgaacgcggagcacagcgcagcgcgggcggc

SEQ ID NO: 13365 - RNA, 83 nt, Human
ccuuauuuuuucuguauaugaauuuguuaauauaaaaaaaucuacuuagaaaauuauaaaaacaucacuacagugucauaagg

SEQ ID NO: 13366 - RNA, 62 nt, Human
gugcugcagaugcaucccaauaaucaggguggccucaaaacccugucuguccucuguagcac

SEQ ID NO: 13367 - RNA, 75 nt, Human
acccuggaaacuacaagccccaacgucacucaauacuuucuccggugcuucaugacaaggggcugcuucuggggu

SEQ ID NO: 13368 - RNA, 66 nt, Human; identical to SEQ ID NO: 3532

SEQ ID NO: 13369 - RNA, 70 nt, Human
aucagaaccgcgggccuagacuuguagcggaaguguuuauuucacgccgguuuuagucccgacaacuggu

SEQ ID NO: 13370 - RNA, 61 nt, Human
gccaaucccaugccaacaaaccacggagcucacuccagugggucagacguaggugacaagc

SEQ ID NO: 13371 - RNA, 72 nt, Human
uauagguggcaccaaucuugacuauccagauggaacaguacaucuauacaaggaaaagugauggcaucuaua

SEQ ID NO: 13372 - RNA, 61 nt, Human
ggcucuauuccguucgcugguucgccaccucaggggaacgauggccauggaguccacagcc

SEQ ID NO: 13373 - RNA, 63 nt, Human
caauacccuggcaguucuggcccucccgacgcgggaaccaaacccacgaaccacagggcguug

SEQ ID NO: 13374 - RNA, 62 nt, Human
cgggacaggccacggcagaggcugagugucacaggacucgggagacccugccuccguucccg

SEQ ID NO: 13375 - RNA, 79 nt, Human
uuucugaacguggugggauucccgcugaaccacuucugcaagcagcuggugaagcucuacuacccgccccguccggagg

SEQ ID NO: 13376 - RNA, 65 nt, Human
gaaguuuauuguccauagagacuuaaaggcagaaaaccugcucuuggaugcuugauaugaacauc

SEQ ID NO: 13377 - RNA, 104 nt, Human
gugcacagccccacaaccaggucagcgaugaagguaucuucagucuaccccauaacgaugaguacaccaugacgccccaaccauuggccugggccagcuugcac

SEQ ID NO: 13378 - RNA, 89 nt, Human
guucacggccuuggcgaucaucuuagagaguuggucacugugacgaucgaucccccgacuacacuggauauccugcacuggcugugaac

SEQ ID NO: 13379 - RNA, 62 nt, Human
caggcuugugaaaggaaccaucugguuauaaagugguggcagauuucacgaaaucuagccug

SEQ ID NO: 13380 - RNA, 74 nt, Human
ucagccccagagagucgaugggggacacugacaaaccaaucacaaaguuaggugccauuagcucuuagggagga

SEQ ID NO: 13381 - RNA, 61 nt, Human; identical to SEQ ID NO: 12464

SEQ ID NO: 13382 - RNA, 62 nt, Human
gccagauuugcagcuacgaaaucaucacuccagacgugcccuuuacuguugacaaagauggu

SEQ ID NO: 13383 - RNA, 68 nt, Human
gcugaccgucacugccuaugacugugggaagaacaagagccacagaagauguuucggugaagaucagc

SEQ ID NO: 13384 - RNA, 61 nt, Human
agcagcugcacgccguggagaucagcgcggugcacucgcgcgaccacggccuggaggugcu

SEQ ID NO: 13385 - RNA, 87 nt, Human
cuccccugggccggaagacugggaauuccugcuaaguguggcuucuagagugucagugaguaccccgaucuugacugccuaggggag

SEQ ID NO: 13386 - RNA, 61 nt, Human
uggaucuggcggcgcugcugccgcgccgccucugccgcgguccuagcgccgcucggcuuca

SEQ ID NO: 13387 - RNA, 66 nt, Human
auggugacacacaugcuggagccaagugcuaacaugccuugguucaagggauggaaagucaaccgu

SEQ ID NO: 13388 - RNA, 127 nt, Human
ggcaaaucauaugauggcaaaaauugagggcuuaacagcugaauuugugaacuuagagugccucaguuuaauaaauguaggcuugaucucaguuucaaaucuccccaagcugcuauaugacaaagcu

SEQ ID NO: 13389 - RNA, 81 nt, Human
ggcucgucgcugccgagcgccgcaccaggacgugcgccggcuccgccguacaaaccuuccgaggcccucgcugcgcaagcc

SEQ ID NO: 13390 - RNA, 60 nt, Human
ucccauccuccgugcccccgcuuaccuacucgcgacuggguacgcaccccaggacccgga

SEQ ID NO: 13391 - RNA, 61 nt, Human
uuaucuugaaugagccuaaagaaaagcuguugaaagcuauaauggacucgucccgggauaa

SEQ ID NO: 13392 - RNA, 60 nt, Human; identical to SEQ ID NO: 1551

SEQ ID NO: 13393 - RNA, 79 nt, Human; identical to SEQ ID NO: 1810

SEQ ID NO: 13394 - RNA, 62 nt, Human
ggcggacaacagucuucacggccacugaacggaaccgugauucgacuacgucaagcuccgcc

SEQ ID NO: 13395 - RNA, 79 nt, Human
ucccagaccuaaucuaacacagaacgaaggaacuugagagagacacaguuuuguaucagguggcauagcgucuguugga

SEQ ID NO: 13396 - RNA, 70 nt, Human
accauuuccauucuuaucccuaguuuucagguggaaucacuagaaaguuaagaugggcuugaaauaaggu

SEQ ID NO: 13397 - RNA, 63 nt, Human
agcccagcaggcucguaccaaagucacagcaguaaugcuauguacugcagagucugaugagcu

SEQ ID NO: 13398 - RNA, 89 nt, Human
ugaaaguaugauucaaugugcaaauacagguaggucuucagcauaagcugaaauauaugcauguaaaaacuuugacaucuuuuuuuuua

SEQ ID NO: 13399 - RNA, 64 nt, Human
uaggucaaauguguccuccaucacugcuucccugagauuugauggagcccugaauguugaccug

SEQ ID NO: 13400 - RNA, 60 nt, Human
ugucucuuaucauguugguggagguggccgcagccauugcuggcuauguguuuagagaua

SEQ ID NO: 13401 - RNA, 64 nt, Human
uuuaaaccggauuuauuuuuuucacgaccgaaaacaggagauggucuggagguccggucuuaaa

SEQ ID NO: 13402 - RNA, 131 nt, Human
acgugcacaagagugugacgacuuagggaguggaguggcacagaccuaugggcuuggcuugccaaguggggaccaugacggugucacuucuaucuguggccucccgaacuggcaugcgugaaccaacaugu

SEQ ID NO: 13403 - RNA, 61 nt, Human; identical to SEQ ID NO: 11490

SEQ ID NO: 13404 - RNA, 79 nt, Human; identical to SEQ ID NO: 1810

SEQ ID NO: 13405 - RNA, 77 nt, Human
ggugaugcccaagauggaccagauaacaucacaugaaggccguuucuggaaugaagucugacuccuccaguuucacc

SEQ ID NO: 13406 - RNA, 85 nt, Human
uguacuauuuguuuaaugaaugcauaugagguguuuuuauuccaacaagaaaauuauucguacgcgauuauugaaugaauagaca

SEQ ID NO: 13407 - RNA, 63 nt, Human
guguagacgguacaagugacaauagcaauauagaaaauguaaauccacaauguaccauagcac

SEQ ID NO: 13408 - RNA, 86 nt, Human
ugugcaucccagcaguaagcaacaauggcugauccagaagguacagacggggagggcacggguuguaacggcugguuuuauguaca

SEQ ID NO: 13409 - RNA, 85 nt, Human
cgcacaucguggugagcuggaugaucgcgcagaccgugacggccguggccggcgugguguccuaccccuucgacacggugcggcg

SEQ ID NO: 13410 - RNA, 78 nt, Human
gucagcacuuacauuaagaaaauuggcuacaaccccgacacaguagcauuugugccaauuucugguuggaauggugac

SEQ ID NO: 13411 - RNA, 79 nt, Human; identical to SEQ ID NO: 1810

SEQ ID NO: 13412 - RNA, 79 nt, Human; identical to SEQ ID NO: 1810

SEQ ID NO: 13413 - RNA, 66 nt, Human
guuugauuuuuauaacuuuccugugaucugggauagaauacaaaaagaaaguaaaaaaaaaaaagc

SEQ ID NO: 13414 - RNA, 61 nt, Human
uagcaccacuugaggaaggggauauauuuaaguucaaagucccuaagcaggugguuuacua

SEQ ID NO: 13415 - RNA, 70 nt, Human
ccaugcuccuccuggcaccuuuuacucugcccaagcaguggcagcccaguccaaaaggugccugccaugg

SEQ ID NO: 13416 - RNA, 61 nt, Human
ggcggcugugauacagguacuuggacaccuuucuguccugaugcugguggcauaggcuggc

SEQ ID NO: 13417 - RNA, 79 nt, Human
guuguucucauagcagggccagaauucugauuggcuuugggaugagcucuuuguccauugguguugcggggggaauaac

SEQ ID NO: 13418 - RNA, 67 nt, Human
agcaguuuucucuuaacacaccccuuaauggcccaugaugagguuucagagcugagagacagcuguu

SEQ ID NO: 13419 - RNA, 74 nt, Human
ggugguuaguuucugcgacuugugugggacugcugauaggaagaugucuucaggaaaugcuaaaauugggcacc

SEQ ID NO: 13420 - RNA, 60 nt, Human
uucaggccuuccaguucacugacaaacauggggaacguguguccagcugguggaacugga

SEQ ID NO: 13421 - RNA, 71 nt, Human
cuugaauguugaaugucaccguaugcgugaaauuauauauuucgggguagugugagcuuuuaauguuuaag

SEQ ID NO: 13422 - RNA, 97 nt, Human
ucagaaauagaauugagccaguuuuuaucagcagcaauauuuucagguaauagggguucccaaauucuguuggguuuuaacugguggauguuaauga

SEQ ID NO: 13423 - RNA, 62 nt, Human
gguguuuauuguggguuacagaucauaagugagugaauagauguaauuccuugaugcacacc

SEQ ID NO: 13424 - RNA, 69 nt, Human
gggggacccuggaaaaguuuaccgcaacaccuggguuccaaaccggccgcggugcuaaggagggccccc

SEQ ID NO: 13425 - RNA, 77 nt, Human
ugagaaggcaaacauguucagaagucaaguaacuggaaaaauaaaccuccuuggccugauagaaaugaucuuacuca

SEQ ID NO: 13426 - RNA, 60 nt, Human
uggcucaagcacaaaccaauuuguguuguucugauucaauaauugguuucuggguggcca

SEQ ID NO: 13427 - RNA, 64 nt, Human
uguugguguggugauguuugugcuuuuaugauuucauauuugugcaugcagaucgaaaacaaua

SEQ ID NO: 13428 - RNA, 68 nt, Human
cacccaggauaguaucuuuguacaucauaggacuagucacuugugcuuucauggauacugccugggug

SEQ ID NO: 13429 - RNA, 69 nt, Human
gcggacggaaggcuggauggaugguaccauugacuggguugaguacacguagaccaagcaauccgaagc

SEQ ID NO: 13430 - RNA, 84 nt, Human
cgaaaagcuauggcaaauaucagugagcgugugggaacugagaaacgaagucggggcuguacacucacucuaacaagcgaaucg

SEQ ID NO: 13431 - RNA, 73 nt, Human
gugacuuugaugauuugaaaggagaacuagaugaauauguccaaaaauaccucccuggaaaaauuaaagucau

SEQ ID NO: 13432 - RNA, 60 nt, Human; identical to SEQ ID NO: 1551

SEQ ID NO: 13433 - RNA, 84 nt, Human; identical to SEQ ID NO: 286

SEQ ID NO: 13434 - RNA, 89 nt, Human; identical to SEQ ID NO: 288

SEQ ID NO: 13435 - RNA, 94 nt, Human; identical to SEQ ID NO: 5398

SEQ ID NO: 13436 - RNA, 84 nt, Human; identical to SEQ ID NO: 286

SEQ ID NO: 13437 - RNA, 64 nt, Human; identical to SEQ ID NO: 287

SEQ ID NO: 13438 - RNA, 62 nt, Human
aagggaacucagaguccggcagcauccuccauaugcugaacgcagguacucugggcccccuu

SEQ ID NO: 13439 - RNA, 66 nt, Human
cacuguaggaggcacagggacgcugacuaggaaagccagguauuguccaagguuucuccccaugug

SEQ ID NO: 13440 - RNA, 82 nt, Human
cugcuuuguaaggcauugagauguuuauguguauguguaucuaaagcacagcacuuaauucuuuaccuugucuaugaugcag

SEQ ID NO: 13441 - RNA, 72 nt, Human
ggugcgugacgucucagaagaagggauucacucaguacuacuguacccccacuucgugacuagaauugcacc

SEQ ID NO: 13442 - RNA, 61 nt, Human
gggcagacaggcugcuuaaccugcuucuggaggugagcgagcggguagcggaccuugaccc

SEQ ID NO: 13443 - RNA, 77 nt, Human
aagaaccacuuggccagaagugucccccagaugcuuuuuuuuuuuuuuuuuugggaaacaguuuggcucugguucuu

SEQ ID NO: 13444 - RNA, 64 nt, Human
cagcccacgccuggggagccugccuggggccaugugaccauggccucucccugggaacgggcug

SEQ ID NO: 13445 - RNA, 72 nt, Human
ggguuggaucagaguggacaguuugaacgauaaaccauuuugcauucuucauucccuaucuuuuaacaaccc

SEQ ID NO: 13446 - RNA, 65 nt, Human
gguuuuuauacaauucuuuauuuagguaacaaguugguuauguucacugcauuguaugaaacauc

SEQ ID NO: 13447 - RNA, 65 nt, Human
auucagguuaacucccaauucaugcauuaccaugguaauuuagggaacauggggauaacuuggau

SEQ ID NO: 13448 - RNA, 71 nt, Human
cacuuuaggaggccgaggcgggcaggugaucaccugaggcgggaguugagaccagccuggccaauauggug

SEQ ID NO: 13449 - RNA, 60 nt, Human
gcgagcagucugaaugccagaauggauaaccguuuugcuacagcauuuguaauugcuugu

SEQ ID NO: 13450 - RNA, 85 nt, Human
aaaaauaugguaaauauucagaauguggucgcaggugaguaauauguuuucuguagccaaagugaauuuaguuuauuuuauuuuu

SEQ ID NO: 13451 - RNA, 61 nt, Human
ggcucucugggaauugucucggaugcaucuggugugucugauagucacuucuauuucagcc

SEQ ID NO: 13452 - RNA, 78 nt, Human
ucucuuaaguuguuuuauuaaguuaauuugucuuacugaccauauaauuuagaacaaaaagcagcuguacuaaagagg

SEQ ID NO: 13453 - RNA, 60 nt, Human
ccgccacuucgucauccgcagaggccaggucuugcgggagauugcugaagaguauggcgg

SEQ ID NO: 13454 - RNA, 83 nt, Human
ggacaaggaccaggaccugaucaccaucauuggaaaggaggacgccguccgagaggcacagaaggagcuggaggccuugaucc

SEQ ID NO: 13455 - RNA, 82 nt, Human
uccucaucggcaaggggggcggcaaaauucgcaaggugcgcgacagcacuggagcacgugucaucuucccugcggcugagga

SEQ ID NO: 13456 - RNA, 69 nt, Human
gcucucugaugcaggguaggugcaaccagcucuugugaucggguugggaccugccaugcaucuuggggc

SEQ ID NO: 13457 - RNA, 79 nt, Human; identical to SEQ ID NO: 1810

SEQ ID NO: 13458 - RNA, 79 nt, Human
caccguggugcugcagguugucagcgaugccggcucucuccuggccuguugucugaaugccgccugcauggcauuggug

SEQ ID NO: 13459 - RNA, 63 nt, Human
gcugauguccagcaccaaggggcucuacucagacacugagcuccagcagugccuggcugcggc

SEQ ID NO: 13460 - RNA, 96 nt, Human
cauuaaacauggugcauauuugacugugggacucgaaaaucuguugaucgacugguuuuuugcagcuuaacuucaaaugcaauccuggguuuuuug

SEQ ID NO: 13461 - RNA, 98 nt, Human
ugccuuagaaaucuacuugacaaacagauacugaacacucauccauggcuuaauccacaaauguuagaguguauuucugaaacuagcagacuagggua

SEQ ID NO: 13462 - RNA, 73 nt, Human
uggguagcagggugaucuaacauuauacauccuggaaguuguuugaugcaagaaaggccucucuugcugucca

SEQ ID NO: 13463 - RNA, 80 nt, Human; identical to SEQ ID NO: 4151

SEQ ID NO: 13464 - RNA, 61 nt, Human; identical to SEQ ID NO: 4152

SEQ ID NO: 13465 - RNA, 80 nt, Human
uuagaaugcagauucucagcccccucccagacauggugaagucagaagcucucagggagggacucagcaaaugauucuaa

SEQ ID NO: 13466 - RNA, 68 nt, Human
gauggcugcucuaaaaagacaaaugaauggggaaagacaaucauugaauacaaaacaaauaagccauc

SEQ ID NO: 13467 - RNA, 64 nt, Human
cugcuguucuugcccaagagugugucugacuaugacggcaaacugagcaacuucaaaacagcag

SEQ ID NO: 13468 - RNA, 68 nt, Human
guuugaugaaggccggaacaacuuugaaggggaggucaccaaggagaaccugcuggacuuuaucaaac

SEQ ID NO: 13469 - RNA, 67 nt, Human
ugggaagaacuuugaagacguggcuuucgaugagaaaaaaaacgucuauguggaguucuaugcccca

SEQ ID NO: 13470 - RNA, 71 nt, Human
cacgaaauaaauaaaccggaggaacuccaggaaaacuugggaaucuucaaugcaaucuuuuuauuuuugug

SEQ ID NO: 13471 - RNA, 62 nt, Human
ccuggaauaauuuugggaaauuugcguguagaggacggggguuucaccgggguuagcccagg

SEQ ID NO: 13472 - RNA, 86 nt, Human
cuguaaggaagaaccugcugucugccagagaggauaagcugcccaucucagcagcugucuaaaagaaggcaggugucucuuuaaag

SEQ ID NO: 13473 - RNA, 65 nt, Human
uccaucgggcagccagaggccagcgucuccgaugacacugagcaccuggugaauggccggaugga

SEQ ID NO: 13474 - RNA, 65 nt, Human
ugccuucccgggcagcaccaacucccugcacaggaugaccacgaccagugcugcugccuauggca

SEQ ID NO: 13475 - RNA, 65 nt, Human
cacugcaccgaucagauaucuuuuaagaaacggcucucauugaaaaaguccuggugggaauagug

SEQ ID NO: 13476 - RNA, 77 nt, Human
cugggggcuuuagcuguuggcagcuaugguguucuuaauccauuucacauaguuguagaccuugguguagacuccag

SEQ ID NO: 13477 - RNA, 62 nt, Human
uagacuccaggcuuggucuucugggcacagccaucaccccaggagacaacuccuuggagcug

SEQ ID NO: 13478 - RNA, 73 nt, Human
ugaauccuugccucccucaaggaagcccacacagaacauguugcugguaaucuuuccaggguaggaggcuuca

SEQ ID NO: 13479 - RNA, 62 nt, Human
cauucuguaugugacuauuuauauaacauuagauaauuaaauagugagacauaaauagagug

SEQ ID NO: 13480 - RNA, 64 nt, Human
uucauuucagcaauguuacauauuugauugaaagucuucaauuuguuaacagagcaaauuugaa

SEQ ID NO: 13481 - RNA, 84 nt, Human
cccaagauggugaugcugcugcugcugcuuuccgcacuggcuggccucuucggugcggcagagggacaagcauuucaucuuggg

SEQ ID NO: 13482 - RNA, 65 nt, Human
ggcugauucugcaucuggaaacugccuucaucuugaaagaaaagcuccaggucccuucuccagcc

SEQ ID NO: 13483 - RNA, 68 nt, Human
cgguguccgaggaccuggggcuggugcauuuucgguuguugcugaucugucucaggacucugacacug

SEQ ID NO: 13484 - RNA, 78 nt, Human
gucacgcagggcaaaaaagcuccguuuuagcucguuccuccucuggcgcuccaagacguuguguguucgccucuugac

SEQ ID NO: 13485 - RNA, 74 nt, Human
ugcuguggcuuuuuuaaggauaacuaccuugggggccuuuucauuguuuuccaacuccgggaucuggucacgca

SEQ ID NO: 13486 - RNA, 66 nt, Human
agagucccaaauaugucuuuuuaaaaauguaaacauuaggaaaaaaauauuauaaucaucagcucu

SEQ ID NO: 13487 - RNA, 67 nt, Human
gggaggcauuucucuguacacauagacuuaaguacacauauacuaagcuguaaauagucugccuucc

SEQ ID NO: 13488 - RNA, 86 nt, Human; identical to SEQ ID NO: 7751

SEQ ID NO: 13489 - RNA, 80 nt, Human
gccccucacccaaguggcggcaucuuaacggcauugguggaagcuggggucagaaaagagaaaugaccauuuggaggggc

SEQ ID NO: 13490 - RNA, 97 nt, Human
gcuaggccuacucugguuauggggacacugacgcccgggucaccgcugccauagccaguaacaucugggccgccuacgaccggaacgggaaccaagc

SEQ ID NO: 13491 - RNA, 69 nt, Human; identical to SEQ ID NO: 12457

SEQ ID NO: 13492 - RNA, 71 nt, Human
acacuguguuucugaggguccuggaauggccagaacugaaggauccucuccagguucuucaauaucagugu

SEQ ID NO: 13493 - RNA, 74 nt, Human
ggccugugccuagaguuuaagcuaccucagugccuaggcaguuguugucagcguccacaucacuggcagagguc

SEQ ID NO: 13494 - RNA, 86 nt, Human
gguggucuuuugugcugcugucauccuagucagggcugugcuugggccgcccagccagcauggccaggugccugcaccgcagcccc

SEQ ID NO: 13495 - RNA, 83 nt, Human
ucccauaggggaggcagacugcugugcaucacccugcugagugucaucagugaugcagaguagcagaagcuccucucagggga

SEQ ID NO: 13496 - RNA, 82 nt, Human; identical to SEQ ID NO: 8961

SEQ ID NO: 13497 - RNA, 123 nt, Human; identical to SEQ ID NO: 6745

SEQ ID NO: 13498 - RNA, 100 nt, Human; identical to SEQ ID NO: 3028

SEQ ID NO: 13499 - RNA, 65 nt, Human
ccaccagauggccuaacucacugcucuucaauucugcauaccauagagcaauggaggaggcuagg

SEQ ID NO: 13500 - RNA, 64 nt, Human
gguaguuaaaaguagucaugcagcaacccugaaugcuuugcugccuuagauauuccuaauuacu

SEQ ID NO: 13501 - RNA, 71 nt, Human
cagggagagugauuuguguccuccaggggacauuugguaucgucuggagauauuuuugguuguucuaucug

SEQ ID NO: 13502 - RNA, 78 nt, Human
ggcaggcagggguggggugcuacuggcauuuugugaacagauccuauggugcacaggauagccccccacuccccugcc

SEQ ID NO: 13503 - RNA, 71 nt, Human
ggguauugcugcgaguuaucuaaacaaauguuugcagaaggcguuacagauaaaaaaacaaagcaaaaccu

SEQ ID NO: 13504 - RNA, 74 nt, Human; identical to SEQ ID NO: 365

SEQ ID NO: 13505 - RNA, 68 nt, Human; identical to SEQ ID NO: 8705

SEQ ID NO: 13506 - RNA, 84 nt, Human
auuugucaauuuuuauuuugguuuucuuacaaagguugacauuuuccauaacagguguaagaguguugaaaaaaaaauucaaau

SEQ ID NO: 13507 - RNA, 74 nt, Human; identical to SEQ ID NO: 365

SEQ ID NO: 13508 - RNA, 102 nt, Human; identical to SEQ ID NO: 2172

SEQ ID NO: 13509 - RNA, 77 nt, Human; identical to SEQ ID NO: 3082

SEQ ID NO: 13510 - RNA, 90 nt, Human
ccacgcaggugccccgcgcuccccgcucagccaugucguccuacagccgcguggcgcuggugaccggggccaacaggggcaucggcuugg

SEQ ID NO: 13511 - RNA, 69 nt, Human
gcuucccucugcugugguuggaggagacaccugcuguggauccgucucucuaggcuugucgagggcugc

SEQ ID NO: 13512 - RNA, 89 nt, Human
guguguauguguacucuagacguugucccacgaugagaccccgaaccaugguuccaucaggaugcaucacgaucauuaggcaugcacau

SEQ ID NO: 13513 - RNA, 127 nt, Human
cccaucuguacaguccagccacugacauaagccccacucgguuaccacccccuugacccccuaccuuugaagaggcuucgugcaggacuuugaugcuugggguguuccguguugacucccagguggg

SEQ ID NO: 13514 - RNA, 77 nt, Human
cucucauauuggcacaucugcuguccauuggggguucucaguuuccucccccagacagcccuaccugugccagagag

SEQ ID NO: 13515 - RNA, 79 nt, Human
gagggguucauuugcguggggcuguuggccuggaucauccauccaucuguacaguucagcgcacugccacaagccccuc

SEQ ID NO: 13516 - RNA, 102 nt, Human; identical to SEQ ID NO: 2172

SEQ ID NO: 13517 - RNA, 82 nt, Human; identical to SEQ ID NO: 8961

SEQ ID NO: 13518 - RNA, 77 nt, Human; identical to SEQ ID NO: 8698

SEQ ID NO: 13519 - RNA, 80 nt, Human; identical to SEQ ID NO: 367

SEQ ID NO: 13520 - RNA, 65 nt, Human
ggaccauaugcauaguaccgagaaacuagugcgaaguagugaucagguauugcuguuagauaucc

SEQ ID NO: 13521 - RNA, 93 nt, Human
acuagcuggggcaacauggcaaaaccccacgucuacaaaaaauuuuuaaaaauuagcugggcaugguggugugugccagugguuccagcuacu

SEQ ID NO: 13522 - RNA, 85 nt, Human
caguacggaugugcgggcaggcgucauagauagggaugccuggguggccuggucauggcugauccugcuuguguaugacagacug

SEQ ID NO: 13523 - RNA, 98 nt, Human
agccagcaggagcaguuggagaccgcuguuacgaggagggaauguacgaggcugccaagcugcucuauagcaauguuucuaacuuugcccggcuggcu

SEQ ID NO: 13524 - RNA, 74 nt, Human
gaaagauuuggugaaggaagcuaucaacuccuauaucagaggggacgacccuuccucuuaccuggaaguuguuc

SEQ ID NO: 13525 - RNA, 78 nt, Human
gcuuugccugcauggauggacaagaguuccgcuucgcacagcuguguggucuucacaucgucauucaugcagaugagc

SEQ ID NO: 13526 - RNA, 95 nt, Human
gacugugguuuuauugguaaagauauaagacauauuggcucuauuaaaaacucagguaauaaagcacuaagguugauuuuuguauugcuacaguc

SEQ ID NO: 13527 - RNA, 64 nt, Human
ggaggauauagcaauuuuauagauuacuacauggucaagaaucuacgcaucggauguauucuuu

SEQ ID NO: 13528 - RNA, 64 nt, Human
gcagaagcagcagaggguccggcagggguucuucuccucguacugcacggccuuccgcaccugc

SEQ ID NO: 13529 - RNA, 104 nt, Human
aaaaauccagcugagugauaaaggcugaguguugaggaaauuucugcaguuuuaagcagucguauuugugauugaagcugaguacauuuugcugguguauuuuu

SEQ ID NO: 13530 - RNA, 77 nt, Human
cagacuucacagagaaugcaguugucuugacuucaggucugucuguucuguuggcaaguaaaugcaguacuguucug

SEQ ID NO: 13531 - RNA, 74 nt, Human
cgcugcuauuagaaugcauugugaaacgacuggaguaugauuaaaaguuguguuccccaaugcuuggaguagug

SEQ ID NO: 13532 - RNA, 97 nt, Human
gguaaaaugcuuuuuguucauuucugguggugggaggggacugaagccuuuagucuuuuccagaugcaaccuuaaaaucagugacaagaaacauucc

SEQ ID NO: 13533 - RNA, 76 nt, Human
accccuaacauugaccuugugcaucccugagagagugggcagagaauccaauucucaugaagcgcgaagucggggu

SEQ ID NO: 13534 - RNA, 74 nt, Human
aggccugucucuugagcaugggcaggccccugucccagacauagguacccccaaucucacuuuggacagagccu

SEQ ID NO: 13535 - RNA, 70 nt, Human
uccaauugugcucaaaucuauagcauuuuguugcuuccaacaauuuauggguguuugcgcagugagugga

SEQ ID NO: 13536 - RNA, 94 nt, Human
cgucggcauggcugucauucugaggguggaaaauaacuggauuucggguuaauuggugacauccucaagagcuguggcaagccaugucucggcg

SEQ ID NO: 13537 - RNA, 72 nt, Human
gaagcacauuuaaagcacuuuucuguaaaagcuaguuccuuaccugcuuggaaaucuuuuuguuuguucuuc

SEQ ID NO: 13538 - RNA, 95 nt, Human
ggggcagaaaguguguaagugaaguauuuuucaaagaaugcaguuauuaucugauugcauuugaccuuuugaccuuuguuacauaauucuacccc

SEQ ID NO: 13539 - RNA, 65 nt, Human
ggggacucugggaggcuggugcagccagaaggcauggcucuugacagccuucuaguagaaucucu

SEQ ID NO: 13540 - RNA, 83 nt, Human
ugcaggagucuuggagggucggaugcggcgccggaugaggaugaggcguggcggaagaugcguuuggcucugcagacacugca

SEQ ID NO: 13541 - RNA, 79 nt, Human
caacgggggcuucauaacugaaauaagacacaaugaaaucuacaggguuuauguuuuauauucaaauauaaccuuauug

SEQ ID NO: 13542 - RNA, 71 nt, Human
ggcagugaaaacccugugucugauaagucucagagacaaacugcuacuuagaauuacagggguucacuguu

SEQ ID NO: 13543 - RNA, 63 nt, Human
cagacuguuugcaaaauagagggaggaucacucauaaucuuacauagcacugucagcagucug

SEQ ID NO: 13544 - RNA, 68 nt, Human
uauauuuccguuuccccaagucuucaccuguccccaucuacccagaucauuugggaaauguaaaugug

SEQ ID NO: 13545 - RNA, 87 nt, Human
uauggccacccgaaagcgcuccuccagcagggacagcucacugaugaggucggugauggcguugguaaaggcuuccugggggcugua

SEQ ID NO: 13546 - RNA, 83 nt, Human
cucccauuuuuuggcuuuugaggggguucaguuuggguugcuugucuguuuccggguuggggggaaaguugguugggugggag

SEQ ID NO: 13547 - RNA, 70 nt, Human
agagauuuauaaccaaauucuguaauugggacuuccagucuuuccccaaguagagaauuggacuuacucu

SEQ ID NO: 13548 - RNA, 75 nt, Human
ugaauuaguucuuaagugauuuuuggcuugcauaccauuuuugcaaacacaaauugucauuacucugcucauuua

SEQ ID NO: 13549 - RNA, 62 nt, Human
uugcucauugccauucuguguuuccucuaaaaacugaguuuucacaauuuuggauuuaguaa

SEQ ID NO: 13550 - RNA, 65 nt, Human
cgcuuccgccggguggacaucgacgaauuugacgagaacaaauuguggacgagcaggaggaggcg

SEQ ID NO: 13551 - RNA, 76 nt, Human; identical to SEQ ID NO: 4813

SEQ ID NO: 13552 - RNA, 62 nt, Human
cuacuuccucugagugguucuugugccuagcccaggaggggacgccguugagaaggaaguag

SEQ ID NO: 13553 - RNA, 88 nt, Human
gguccaacgcucauugugaguugaacagaugcuuaaccccacauggguaucagaugauuucuguguacuguguguauaauggugggcc

SEQ ID NO: 13554 - RNA, 76 nt, Human; identical to SEQ ID NO: 12630

SEQ ID NO: 13555 - RNA, 61 nt, Human; identical to SEQ ID NO: 12631

SEQ ID NO: 13556 - RNA, 75 nt, Human
gaggcaggaggccccugaaggcaaggcagguagacgguggagaaucugccuccccugccuuuggacccuguccuc

SEQ ID NO: 13557 - RNA, 62 nt, Human
gugcuguggcuaaauugaugaucgacuucauuugcaguggaggugcaucaagagcccggggc

SEQ ID NO: 13558 - RNA, 79 nt, Human
cuggguauaggaccgucgugagacauggucaguuaaccccuacugaugcauguguugugccaugguacucccugcucag

SEQ ID NO: 13559 - RNA, 73 nt, Human
gcuuggaguucuaugauuuucucagguaccgacauuuacgagcacccguuagaaagagcgugggacccucagc

SEQ ID NO: 13560 - RNA, 68 nt, Human
ggcucguucucccguguucaguucuuccgacggcagccugugggagacaguggcgcgggcucugagcu

SEQ ID NO: 13561 - RNA, 86 nt, Human
guccuugugcuccgcggcacccccaaggucacucaggcccugaacguccugaccacgaccuucgggcgcugccagagccccuggac

SEQ ID NO: 13562 - RNA, 68 nt, Human; identical to SEQ ID NO: 1919

SEQ ID NO: 13563 - RNA, 72 nt, Human; identical to SEQ ID NO: 1920

SEQ ID NO: 13564 - RNA, 61 nt, Human
cgccuagaucucuuucccagggccauggcgaacccgaagcugcugggacuggagcuaagcg

SEQ ID NO: 13565 - RNA, 63 nt, Human
gccagucuuagguuuuugaacaggauaguagguauccggagucgauugagggccagagcaggc

SEQ ID NO: 13566 - RNA, 64 nt, Human
cauuaaacucuucuaacuuucuucuuucugugauaauucagaagauaguuauggaucuucaaug

SEQ ID NO: 13567 - RNA, 74 nt, Human
gcaaauguuucagcccaaugucaacccaguuaaaaaaaaaauuaaugcuguguaaaaugguugaauuaguuugc

SEQ ID NO: 13568 - RNA, 70 nt, Human
gucauuguuauaaaaaaucaguuaucacuauaccaugcuauaggagacugggcaaaaccuguacaaugac

SEQ ID NO: 13569 - RNA, 100 nt, Human
guguucuaaccaauugccuuuucuuguuaucugagcucuccuauauuaucauacucagauaaccaaauuaaaagaauuaggaauaugauuuuuaauacac

SEQ ID NO: 13570 - RNA, 68 nt, Human
agcgguggccccgagguucgagucuugcucuucaaugcuaccggggaccgggacccggcggcccugcu

SEQ ID NO: 13571 - RNA, 66 nt, Human
ccuggcaccuguguuccagcccacaucccacaugcggcucgggcuucggaacacggaguggccggg

SEQ ID NO: 13572 - RNA, 87 nt, Human; identical to SEQ ID NO: 76

SEQ ID NO: 13573 - RNA, 84 nt, Human; identical to SEQ ID NO: 286

SEQ ID NO: 13574 - RNA, 64 nt, Human; identical to SEQ ID NO: 287

SEQ ID NO: 13575 - RNA, 89 nt, Human; identical to SEQ ID NO: 288

SEQ ID NO: 13576 - RNA, 99 nt, Human
aggccacagaaguacuuacggaaauaaaauuuuagaagaucauaguuuaagauacauagaauucuucuuauaaugguacauucaaaacacaucuguccu

SEQ ID NO: 13577 - RNA, 75 nt, Human
gaaguacuuacggaaauaaaauuuuagaagaucauaguuuaagauacauagaauucuucuuauaaugguacauuc

SEQ ID NO: 13578 - RNA, 97 nt, Human
guuugagaaauguuucucaauggcucuuugaagggaaagcugugucacuacugcuuucugcuuucaauggcuaggugaccccaaauauuuauccaac

SEQ ID NO: 13579 - RNA, 88 nt, Human
uggaaauucaauacacugagaaguguuaaaaucauuaaccaaaauuacugaaugguagaauacugucucgaaauguacugaauucaca

SEQ ID NO: 13580 - RNA, 113 nt, Human
accaguacuaucugcgggucaccacgguggcuucccacacuucugacucggacguuccuuccggugucacugagguggucgugaagcucuuugacucugaucccaucacuggu

SEQ ID NO: 13581 - RNA, 67 nt, Human
acugggugucccggcuggcaaaccucacgcaaggcgaagaccaguacuaucugcgggucaccacggu

SEQ ID NO: 13582 - RNA, 61 nt, Human; identical to SEQ ID NO: 347

SEQ ID NO: 13583 - RNA, 61 nt, Human; identical to SEQ ID NO: 9580

SEQ ID NO: 13584 - RNA, 112 nt, Human
gccgggugguggcagcaacagaggguugguggcggcuggggacgcccgaggccgugcugcuccccuggcugguggggucccugccgccgcagaccgcucgcgacuacccggu

SEQ ID NO: 13585 - RNA, 60 nt, Human
ggagcugugucuacucugcgggccugagcccaccccucagccaguuguauccacagcuuc

SEQ ID NO: 13586 - RNA, 71 nt, Human
ggcccagaguuaccacgcugccaggccacauccaggccguguauguucagaacguggucaagcuuuacgcc

SEQ ID NO: 13587 - RNA, 68 nt, Human
gggaucugugaggugcuguacgcugccuccuguaucugcggggaguucuuagagcaucugcaggaacc

SEQ ID NO: 13588 - RNA, 72 nt, Human
uaaaccuguaucccaaggaguccuauacgucagugugaugugcuggacucugaauucugggguacagcuuug

SEQ ID NO: 13589 - RNA, 65 nt, Human
uugauguaaaugaagauaaagugguuucuuggucaauaauugcaauuucuuucuuuuaaagucag

SEQ ID NO: 13590 - RNA, 61 nt, Human
cauuuccuuaagaaacuuuuucugauuagccauggcagaaaacaguuggaaaaggcaagug

SEQ ID NO: 13591 - RNA, 70 nt, Human
gguugcucuucgucgcucuccaccucgaugucaucguuaucgcucauuuccuacggcccagggagcggcc

SEQ ID NO: 13592 - RNA, 68 nt, Human
uuugauguggucccuacguuuucguuccagugcauuaugaugagcccguuugucagccgcagauugaa

SEQ ID NO: 13593 - RNA, 109 nt, Human
gaucucggcguugugcaugucgggcgacugcuccaugaucuugcgccgcucgaucugcgaccacaccaugaaggcguucaugggucgcuugaugugcccacucgggguc

SEQ ID NO: 13594 - RNA, 63 nt, Human
cccucauccucuuaucuaguuuacuuuucuuuauccuugaguauacuauagaccaggauaggg

SEQ ID NO: 13595 - RNA, 128 nt, Human
ucccuuuauaauuucaaagugcccuauacuuccacugucauaguacuuauauuaauuguacacuucucuaaauuaguguaagaguuugugggaguguguguguguguaugugugugugugugaaaaga

SEQ ID NO: 13596 - RNA, 84 nt, Human
gccauaucacaaaaguccuaucauggguaaugaaaagucuuauuuuuaauauauuucuguuuccuuuuucuuuugacauguggc

SEQ ID NO: 13597 - RNA, 81 nt, Human
uucugauaauuuugguguaaacaaaaaugauauuuaauuuuuauuaaaucaaguuuaccuauaucaaauucccuuuuagaa

SEQ ID NO: 13598 - RNA, 69 nt, Human
gcauaauaaaaaaagagguagcaaaugaaaauuaaagcauuuauuuugguaguucuucaauaaugaugc

SEQ ID NO: 13599 - RNA, 72 nt, Human
cagagaugaggcagaguggagagaaacaacucuggcugagccagagucuccagccacuacuucuuauuccug

SEQ ID NO: 13600 - RNA, 68 nt, Human; identical to SEQ ID NO: 1444

SEQ ID NO: 13601 - RNA, 66 nt, Human
ccccacgcucaguccuggucaaaggcgugccagaccuuucugagugcccccagggaggggcugggg

SEQ ID NO: 13602 - RNA, 82 nt, Human
cggauugagugucaucgacccugaagauguggcccuucucuuuaaguccgagggccccaacccagaacgaugccucaucccg

SEQ ID NO: 13603 - RNA, 72 nt, Human
cucucuucguccauggccugacuauauaggcauuggcauaagauccgugguacucauugucauggaagggag

SEQ ID NO: 13604 - RNA, 64 nt, Human; identical to SEQ ID NO: 1777

SEQ ID NO: 13605 - RNA, 65 nt, Human
uuucuuauauuguuguuaaucaucaaggaaucucuucucgauuaaaauacacacaucuuaagaaa

SEQ ID NO: 13606 - RNA, 78 nt, Human
ccccgucguaaacgcugaggaaugauguggccaagaaugccugauguucuuuaaacaaauuccauggaguuuaagggg

SEQ ID NO: 13607 - RNA, 68 nt, Human
ggagugguucuauaucuguuaaaaucauaagacaugauucuagacaggauaguaagaaaaguacuacc

SEQ ID NO: 13608 - RNA, 61 nt, Human; identical to SEQ ID NO: 387

SEQ ID NO: 13609 - RNA, 65 nt, Human
gcugcugcuggaaaugcugacuuuuaacccacacaagcgaaucucugccuuucgagcucugcagc

SEQ ID NO: 13610 - RNA, 60 nt, Human; identical to SEQ ID NO: 1551

SEQ ID NO: 13611 - RNA, 85 nt, Human
ggagacagggagaggcucuucuguguguagugguugugcagagccucaugcaucacggagcaugagaagacguuccccugcugcc

SEQ ID NO: 13612 - RNA, 77 nt, Human
ggguacgugccaagcauccucgcgcgacccgagagccuggggagcggggguuugcuggccguggcacucauuuaccc

SEQ ID NO: 13613 - RNA, 69 nt, Human
ggcaucggggcugggugcagcucuggcagaguccgcaggaccucugcaccagcuggcccagucugugcu

SEQ ID NO: 13614 - RNA, 102 nt, Human; identical to SEQ ID NO: 2172

SEQ ID NO: 13615 - RNA, 74 nt, Human; identical to SEQ ID NO: 365

SEQ ID NO: 13616 - RNA, 102 nt, Human; identical to SEQ ID NO: 2172

SEQ ID NO: 13617 - RNA, 77 nt, Human; identical to SEQ ID NO: 3082

SEQ ID NO: 13618 - RNA, 75 nt, Human
ggacgccuuccagcuucagcuauguuacuuacguuugaugcuacuuaaaguaaugaaugacguuuuaaggaaucc

SEQ ID NO: 13619 - RNA, 88 nt, Human
uguuuucuaugggacugauucugaaauucuuaacuauuaagaauauuuuaauagcagcaugacauuuagcaguaauccauuaagggca

SEQ ID NO: 13620 - RNA, 102 nt, Human; identical to SEQ ID NO: 2172

SEQ ID NO: 13621 - RNA, 113 nt, Human
cagccccagaggugucacaggaaggcaccagcaaggacauuggucuuugauuugauucagcaguccugucaaguauaaaugugauggcugugcugccuggcccucugcagcug

SEQ ID NO: 13622 - RNA, 60 nt, Human
cugaucuuacgugcucaagaagcuguugugaaggcagagcagcaucugcugaagagacag

SEQ ID NO: 13623 - RNA, 63 nt, Human
auggguuuuuaaagcaugagaaugugauaauugugcuacauaaucuuagacuuuugaacuuau

SEQ ID NO: 13624 - RNA, 70 nt, Human; identical to SEQ ID NO: 194

SEQ ID NO: 13625 - RNA, 74 nt, Human; identical to SEQ ID NO: 365

SEQ ID NO: 13626 - RNA, 102 nt, Human; identical to SEQ ID NO: 2172

SEQ ID NO: 13627 - RNA, 77 nt, Human; identical to SEQ ID NO: 3082

SEQ ID NO: 13628 - RNA, 82 nt, Human
cuugaccagccggaaagcauuggggaugacggccgacagcagggugguguggaugucacccaggacuuuccggaaggcaaag

SEQ ID NO: 13629 - RNA, 78 nt, Human
gcugccaucuucccaguauuucuuggacagucccaggaacuugaggcggugcaggguggcucccaggaggacaucagc

SEQ ID NO: 13630 - RNA, 83 nt, Human
cuuuuuuaucagauuuuaguaagccaauuguucucaaguauucuuaaaguacauuacagcuuaccuuaaauucgaugauuagg

SEQ ID NO: 13631 - RNA, 69 nt, Human
gagacaggguuucacuauguugcccaggcuguucucaaaacuccagggcucaagggauccuccugccuc

SEQ ID NO: 13632 - RNA, 92 nt, Human
ccauuugcucaguagaaguuuaauggagaaaucguuguuuaaaacaaucagucaaaaagaacagcucuuuuacaaacaaguuauggcagugg

SEQ ID NO: 13633 - RNA, 61 nt, Human
cuacagcaacaagggcuucuauuccaucuacaacuuggaucgggggaaaagggagauguag

SEQ ID NO: 13634 - RNA, 73 nt, Human
gaguaaugggauauccaauaaacugagaauguuucuucacaaucuccuuuauucuucguuccuccaaguacuc

SEQ ID NO: 13635 - RNA, 67 nt, Human; identical to SEQ ID NO: 10746

SEQ ID NO: 13636 - RNA, 76 nt, Human
cugggguguuuauggcaagucacuuugacagacauuauuguggcaauguugucugacuuacuguuucacaaaccag

SEQ ID NO: 13637 - RNA, 65 nt, Human; identical to SEQ ID NO: 247

SEQ ID NO: 13638 - RNA, 80 nt, Human; identical to SEQ ID NO: 100

SEQ ID NO: 13639 - RNA, 76 nt, Human
gcccacugugacaaugucaccgaucuggacgucccugaagcagggggacagguguacagacauguucuuguggcgc

SEQ ID NO: 13640 - RNA, 71 nt, Human; identical to SEQ ID NO: 1764

SEQ ID NO: 13641 - RNA, 74 nt, Human
cccaaaacuauuguuuguguuucuguguuucauauucagugauuuaauacaguaucauggcugagguggauggg

SEQ ID NO: 13642 - RNA, 82 nt, Human
uuguaauuuuuaauuucaugcguuuaaucauugucucuucauuuuaagacuuuuaauacaaaugucauuuuuaaagaaacaa

SEQ ID NO: 13643 - RNA, 77 nt, Human
cacugcacuccaaccugggugauagaauaagacucuugucucaaggaaagaaaaaaugucuacucaguagagcagug

SEQ ID NO: 13644 - RNA, 83 nt, Human
guuuaguguauaccugucacucuagaauguaggcucccugagauaaaaacuauaauucuuuugauggcaguuacauucccaac

SEQ ID NO: 13645 - RNA, 78 nt, Human
uguuuugggacccaaguuuggccaggucgcggucuauagaacagugacagaagaggccauuagguggguuuuaauaca

SEQ ID NO: 13646 - RNA, 72 nt, Human
acuaagacuggcuugugguuuaaugaauauguucaguuuuugaauuuaauaguaccccaauucaguaauggu

SEQ ID NO: 13647 - RNA, 70 nt, Human
auugauagacuucguaguaugucacucuuccaagaugugagugcucuuaacuacgaaugguuaauucaau

SEQ ID NO: 13648 - RNA, 68 nt, Human
gccucuuugggcggaagacaggucaggccccuggauacucuuacacagccgccaauaagaacaaaggc

SEQ ID NO: 13649 - RNA, 81 nt, Human
uacggggaugguccggcuaccacaauccgguuggucucugcccagcagggaaaaagagagguauuggugcccauuuccgug

SEQ ID NO: 13650 - RNA, 75 nt, Human
guguugggcccgcgggcgcgggcucccgggcgcgcgugccccggggucugcugugcaggcgcgcgggcccggggc

SEQ ID NO: 13651 - RNA, 65 nt, Human
cucuaagcuuuacaaaaaagauucuaacugucacaaggaucauucgaacauuaaaggcuauggag

SEQ ID NO: 13652 - RNA, 66 nt, Human
gcgcgguacaucgcggaagucggugcuuuaguacgccgcuggcaccuuuacucucgccggccgcgc

SEQ ID NO: 13653 - RNA, 66 nt, Human
guggcuccuucuugaagcaucugccagagacugaggcaggcagagcccaagacccaggggagccac

SEQ ID NO: 13654 - RNA, 64 nt, Human
guuagaauugauuuccaagaaucggcauguauacuuaauacugaauuucuuugauuuaacugac

SEQ ID NO: 13655 - RNA, 71 nt, Human
gugguccucaagugucugaaaaaaauucacuuuuagaggaguaucaacguuuuugggacauaagaggcuau

SEQ ID NO: 13656 - RNA, 72 nt, Human
uccauaaugaugggcuuuuagguuguuucuaauguuaugcuauuagcagcuguuuaauuccaauauaaggga

SEQ ID NO: 13657 - RNA, 68 nt, Human
uuagggaauaaugacaagaaaaaagucuguaaauguugaguacagacauaauuuuguuuuuucucuga

SEQ ID NO: 13658 - RNA, 77 nt, Human
accgcuccacgagccuggagagcucggacugcgagucccuggacagcagcaacaguggcuucgggccggaggaaggu

SEQ ID NO: 13659 - RNA, 67 nt, Human
cgccugggcuuccuaucccaucgggacccagauggcuggggggcagggggaaugggaguauaaggug

SEQ ID NO: 13660 - RNA, 67 nt, Human
uucauucucuuaucuaaaucucucuguucucucucagggaauauuuucagagaauagguggaaugaa

SEQ ID NO: 13661 - RNA, 83 nt, Human; identical to SEQ ID NO: 6805

SEQ ID NO: 13662 - RNA, 65 nt, Human; identical to SEQ ID NO: 4539

SEQ ID NO: 13663 - RNA, 69 nt, Human
guaggggcccucguccuucuucucggccgccaccagcaggcugugcuccaggucggccugggccccugc

SEQ ID NO: 13664 - RNA, 101 nt, Human; identical to SEQ ID NO: 11969

SEQ ID NO: 13665 - RNA, 66 nt, Human
gauaaggaccuguuuggggcagcagggagcaaaaucuccuuuaacaaccaagcaguuuccucauuc

SEQ ID NO: 13666 - RNA, 78 nt, Human
gcagguaugugaugacaucagccgacgccuggcacugcugcaggaacagugggcuggaggaaaguugucaauaccugu

SEQ ID NO: 13667 - RNA, 62 nt, Human
ugcuacuauuuuauugcccgagguggggguguaugcaccgcacaccggggcuaugagaagca

SEQ ID NO: 13668 - RNA, 69 nt, Human
cggggggugcugggggcggggcaggggcagguguagccucugugccucguuguccccuggcgcuacccg

SEQ ID NO: 13669 - RNA, 62 nt, Human
gggucauacauuaauucaauugcugagauugaggaacuggcaggcucagcgaagaaggaccc

SEQ ID NO: 13670 - RNA, 71 nt, Human
guugcacagccacagacuucucagcacagaguggggacugccuuccauugugaagucucuuauggugcagc

SEQ ID NO: 13671 - RNA, 66 nt, Human
gaagcuguagagugcugcccgaaaucucuaggaaguugguggcaagggacagcacucacacucuuc

SEQ ID NO: 13672 - RNA, 68 nt, Human
uugcuuuguuuacugcuaguauauuaggaaauccuaggaucucagaauucacaauaguaaauaaacaa

SEQ ID NO: 13673 - RNA, 73 nt, Human; identical to SEQ ID NO: 721

SEQ ID NO: 13674 - RNA, 82 nt, Human
ggggaccggucucaccgaaugcauccugucgggcaucuugucugugaacgggaagaaggugcugcacauggaccggaacccc

SEQ ID NO: 13675 - RNA, 63 nt, Human; identical to SEQ ID NO: 722

SEQ ID NO: 13676 - RNA, 60 nt, Human; identical to SEQ ID NO: 723

SEQ ID NO: 13677 - RNA, 61 nt, Human; identical to SEQ ID NO: 6766

SEQ ID NO: 13678 - RNA, 76 nt, Human; identical to SEQ ID NO: 758

SEQ ID NO: 13679 - RNA, 65 nt, Human
ggugccggcaaccuuggugaccuugagcacguugaagcgcacugucuugcucagaggccggcacu

SEQ ID NO: 13680 - RNA, 109 nt, Human; identical to SEQ ID NO: 831

SEQ ID NO: 13681 - RNA, 75 nt, Human; identical to SEQ ID NO: 74

SEQ ID NO: 13682 - RNA, 87 nt, Human; identical to SEQ ID NO: 76

SEQ ID NO: 13683 - RNA, 71 nt, Human; identical to SEQ ID NO: 77

SEQ ID NO: 13684 - RNA, 60 nt, Human
ggggccagcggcaugggaggcaucaccgcaguuacggucaaccagagccugcugagcccc

SEQ ID NO: 13685 - RNA, 79 nt, Human
ccuggcccaucccuuccccagugcacucugaccuagcuagugccuggugcccagugaccugggggagccuggcugcagg

SEQ ID NO: 13686 - RNA, 67 nt, Human
ggcugaguucuguaguuuccagaguuggcuggcuagagccuucuaagagguuacagaacuauuagcu

SEQ ID NO: 13687 - RNA, 120 nt, Human
ccccggaccugcagucuauggagcagauucggcggaucaugcggccacagaugugccugaccagggccugcugugugaccugcuguggucugacccugacaaggacgugcagggcugggg

SEQ ID NO: 13688 - RNA, 123 nt, Human
gagaacgaccguggcgucucuuuuaccuuuggagccgaggugguggccaaguuccuccacaagcacgacuuggaccucaucugccgagcacaccaggugguagaagacgggcuacgaguucuu

SEQ ID NO: 13689 - RNA, 100 nt, Human; identical to SEQ ID NO: 698

SEQ ID NO: 13690 - RNA, 60 nt, Human; identical to SEQ ID NO: 2705

SEQ ID NO: 13691 - RNA, 83 nt, Human
gcuccugguggacccauguggaaaugggaccuccagaucccauucugggagucacugaagccuuuaagagggacaccaauagc

SEQ ID NO: 13692 - RNA, 131 nt, Human
ucucucuccucggcagcagcgggaggcagaggaaggcggcagaagaugaagagcuuucccauccagggugacuuuuuuaagaacccaccucuugugcuacccaucccgccuccugccggguuucaggggga

SEQ ID NO: 13693 - RNA, 86 nt, Human
aaagagguuaauuuccuuguuuauuccuucuguaggguagacaucauucuauucaacucuuacacuaaacauguauguagcucuuu

SEQ ID NO: 13694 - RNA, 65 nt, Human
uggugauuucugagacugagaugaagauacguuuccaaagagaguauuuacauuugaaucugcca

SEQ ID NO: 13695 - RNA, 83 nt, Human
uaaaaauuccaaauaauuaucucuaaagcaaauccuuuguuaguuacauggcuuuacauauuaauuacucuggaaaguuuuug

SEQ ID NO: 13696 - RNA, 83 nt, Human
uguuuaguagcagaucuccuuucuugauaguuucuugguacugccaguucuugcuaucaggucuguugguuucuacuauuuca

SEQ ID NO: 13697 - RNA, 63 nt, Human
uuuaaaacugaacuaagucaaucugauauguuugaucagagguuacaagucaaaaguuuuaaa

SEQ ID NO: 13698 - RNA, 98 nt, Human; identical to SEQ ID NO: 6333

SEQ ID NO: 13699 - RNA, 73 nt, Human
uuuuaugucaccaguugguccucaucaaauaaaauuuccuuaggagugcagagggcucauugggaaaauaaaa

SEQ ID NO: 13700 - RNA, 71 nt, Human
cccacuuuaacugcgugcagaucaggggugguuuauguggacauuucuagggaagcggcaguaacuuuggg

SEQ ID NO: 13701 - RNA, 64 nt, Human
ucaucaggccaugccauggaaaggggcgguaacucccaggugugccauggugaugguaaacugg

SEQ ID NO: 13702 - RNA, 110 nt, Human
gggugaugccaccuccugggugggugaugccuccucuggguggugauaccuccucuaggugggugaugccuccucuggguggugauaccuccucuaggcgggugaugccc

SEQ ID NO: 13703 - RNA, 75 nt, Human
ugccuccucugggugcgugaugccuccucugggcgggugaugccuccucugggugcgugaugccuccucugggca

SEQ ID NO: 13704 - RNA, 60 nt, Human
gugacaacaugcuggagccaagugcuaacaugccuugguuucaagggauggaaaagucac

SEQ ID NO: 13705 - RNA, 79 nt, Human; identical to SEQ ID NO: 1810

SEQ ID NO: 13706 - RNA, 60 nt, Human
ggugacaacaugcuggagccaagugcuaacaugccuugguucaagggauggcaagucacc

SEQ ID NO: 13707 - RNA, 61 nt, Human; identical to SEQ ID NO: 2067

SEQ ID NO: 13708 - RNA, 61 nt, Human
auggagucagugugacaacgggcuguacccaaaucugagacggcucucuugucuucuccau

SEQ ID NO: 13709 - RNA, 131 nt, Human; identical to SEQ ID NO: 1788

SEQ ID NO: 13710 - RNA, 64 nt, Human
auggugacaacaugcuggagccaagugcuaacaugccuugguucaagggauggcaagucaccgu

SEQ ID NO: 13711 - RNA, 61 nt, Human; identical to SEQ ID NO: 823

SEQ ID NO: 13712 - RNA, 61 nt, Human
cccugguggccaauuggaaccggguguuguaaaaccccggauugggguggccacccuaggg

SEQ ID NO: 13713 - RNA, 73 nt, Human
cugucuuuuuauuguuucuugucuguuuuugcagucuuacaaaaaaaauguugacuaaggaauucugagacag

SEQ ID NO: 13714 - RNA, 66 nt, Human
ggagaggagauuucucaucaaaaguccguggugugugugugugcccguguguggugggaccucuuc

SEQ ID NO: 13715 - RNA, 66 nt, Human
auggugacaacaugcuggaagccaagugcucaacaugccuugguucaggggauggaaagucaccgu

SEQ ID NO: 13716 - RNA, 65 nt, Human
gccaucugaucuauaaaugcgguggcaucgacaaagagaaccauugaaaaauuugagaaggaggc

SEQ ID NO: 13717 - RNA, 76 nt, Human; identical to SEQ ID NO: 2134

SEQ ID NO: 13718 - RNA, 71 nt, Human
cagguuuguuacacguguauacaugugccauguugguguggacagagcacauuuuuguauaaacaaaccug

SEQ ID NO: 13719 - RNA, 80 nt, Human
gaccaugucuuaugaauuaacccauacugcacauuaaaaacuuuacuggguaugcugggaucauuaauucaugacagguc

SEQ ID NO: 13720 - RNA, 61 nt, Human
gaucauuaauucaugacaggucaccauagagaagaaauucccuuguccuauacagaugauc

SEQ ID NO: 13721 - RNA, 69 nt, Human
guauagugcccaauaacuaguuuuguuuuuuuauauauauauacuuuaaguucuaggguacauguguac

SEQ ID NO: 13722 - RNA, 90 nt, Human
cuucugagugugaggaggaugaugaggaugcccagggcaggucucugccugcucccuucguucugguccuuccaccagucacccauggag

SEQ ID NO: 13723 - RNA, 84 nt, Human
uauugugaaugaacucagugucaaauaacuauauacugaaaaaugauucaaaugguaaauuuuauguuguguuuaaucacaaua

SEQ ID NO: 13724 - RNA, 62 nt, Human
gaccagugacccuguuuuguggcauucaugcaaaacaugcugagggcuuuguucaucugguc

SEQ ID NO: 13725 - RNA, 91 nt, Human
gucccugguuuuuaauuuucugucugaugucacagaucauuguugcacacaaacguggcauagaaaagaacauguucagaagccauggggc

SEQ ID NO: 13726 - RNA, 80 nt, Human; identical to SEQ ID NO: 9351

SEQ ID NO: 13727 - RNA, 61 nt, Human
cagacaagaggaagaagccaagcacaggugccauuucaggcaaagucuuggcuucagucug

SEQ ID NO: 13728 - RNA, 63 nt, Human
cucacugagaauucaccaaguggggcaggauuccugcaacuacccgcguaguucaggggagag

SEQ ID NO: 13729 - RNA, 64 nt, Human
caggagaccgggucuugaacagcugguaccaaccuuagaaacuagcucucuaauccggcucgug

SEQ ID NO: 13730 - RNA, 80 nt, Human
uggggccuuccgguucacagcgaauuacugguuaaccaauugacaaaaaguagaaugcuguaaaaacuguuaggugccca

SEQ ID NO: 13731 - RNA, 94 nt, Human
ggggugguucuaggacuggauuuccuggugagguccaagcuguugcuguugucaacaugucuggcccagcaggcucuggaccugcugcugaacc

SEQ ID NO: 13732 - RNA, 94 nt, Human
ggcuguggcuggaaugccgacauguggccuuuccuuguagaugcuugauuuucucacaacuuggaggcauccucguggcauggcuggcgugguc

SEQ ID NO: 13733 - RNA, 70 nt, Human
ggggaggaggugggucgcagaaugggcugacucggagggaguuuuuaauuuuggcuuuaccugcuucucc

SEQ ID NO: 13734 - RNA, 92 nt, Human
gaacacaaguguguuguugucuucuaucuucuucauggcagacucaguggucagcggaaacuugaugauagcauaguggucaagcuuguuuc

SEQ ID NO: 13735 - RNA, 80 nt, Human
ggguguugaccuuggccacaucaaugucauacagcuucuucacagccuguuuaaucuggugcuuguuggcuuuaacaucc

SEQ ID NO: 13736 - RNA, 64 nt, Human
gugucuucggccgccggaagggugggugacgugcggaucuucuucuuuuuguggcuguggacac

SEQ ID NO: 13737 - RNA, 64 nt, Human
gccccacucgcuccgguaguugccuuugcgcagagcgaugcacucgccuaccggaacugaaggc

SEQ ID NO: 13738 - RNA, 70 nt, Human
gcguugcccgccagcuccaggaucucggcggucagauacucgaggaccgcagccauguagacgggcgcgc

SEQ ID NO: 13739 - RNA, 72 nt, Human
ccgggugcgauggugcaugccuguaaucccagcuacucgggaggcugaggcaggagaaucgcuugaaccugg

SEQ ID NO: 13740 - RNA, 60 nt, Human
aaucacaaugguggaaugucaucaguuaaggcaggaacuggcuauuucacguuuaugguu

SEQ ID NO: 13741 - RNA, 62 nt, Human
ucuuaaguuauuuauuucuggguuuuaaacauaaauauguuuacuugggauuuagcuuugga

SEQ ID NO: 13742 - RNA, 87 nt, Human; identical to SEQ ID NO: 76

SEQ ID NO: 13743 - RNA, 77 nt, Human
gggcugcggcugcagaaguaccgccugcggaguaacugcaaagaugcuguccgugcgcguugcugcggccguggucc

SEQ ID NO: 13744 - RNA, 85 nt, Human; identical to SEQ ID NO: 4613

SEQ ID NO: 13745 - RNA, 60 nt, Human
gcuacauccgucguaacguguguccuccgaagaaauacaaagcguucgggcggaaaaugc

SEQ ID NO: 13746 - RNA, 64 nt, Human
ggcgagaggcccaaggcgcagcagugguggcccucgguagggcgacacaccuuugggaaaugcc

SEQ ID NO: 13747 - RNA, 74 nt, Human
ugauccccccaggagggcaacaccacuuggugucaggggcgucccggcagagaaguguggcuaaggggggguca

SEQ ID NO: 13748 - RNA, 82 nt, Human
ggccggcggagaggccagcagcccccgggacaccagugccuucuuccuggagaccaaggagcgccuguaccuccuggcggcc

SEQ ID NO: 13749 - RNA, 64 nt, Human
uuguacagcagcgcagucacagucggcccccacaaggaauuugcugugaccaugagaccuacag

SEQ ID NO: 13750 - RNA, 111 nt, Human
agauuuugguuuuuauaaauauaaauguuuuauuuuuaaauguaggaagauauugaugcagaaucuucguuuucauuaaauaugaacuuuagcaguaaaagaacaaaauuu

SEQ ID NO: 13751 - RNA, 64 nt, Human
augagaguggaggcuuuuuugcuuggucauuaauuuagcagaauugcuugcagcaaacucuuau

SEQ ID NO: 13752 - RNA, 62 nt, Human
gggauaugucuuuucugguuuguuguuggcauuuauuaaccuuacagucaaacagaaaucuc

SEQ ID NO: 13753 - RNA, 99 nt, Human
ucaaugcagaaagacacaccacaaguaagugcuuuuaaugucaaguuuuuuuugagggggaaacauuuaagcauuggacuuuacaaguguuuacauuga

SEQ ID NO: 13754 - RNA, 70 nt, Human
cgggugaaggaggaagagauccacucugccaacaagugccgucucaagcuccugcuuccugggaaacccg

SEQ ID NO: 13755 - RNA, 75 nt, Human
uaggaucugguguggcuuuuggggagccagugugcuguguggugaccucauuggccuccugaacccuagaaccug

SEQ ID NO: 13756 - RNA, 89 nt, Human
gggcaucaaggcuucaaacacagcagagguguucuuugauggaguacgggugccaucggagaacgugcugggugagguugggaguggcu

SEQ ID NO: 13757 - RNA, 130 nt, Human
uugccaugcacauccucaacaauggaagguuuggcauggcugcggcccuggcagguaccaugagaggcaucauugcuaaggcgguagaucaugccacuaaucguacccaguuuggggagaaaauucacaa

SEQ ID NO: 13758 - RNA, 68 nt, Human
ccuucccuuccacagaguuuaguuuccucauuuguaaaaugaagacaaaccucgugagagagggaagg

SEQ ID NO: 13759 - RNA, 65 nt, Human; identical to SEQ ID NO: 1518

SEQ ID NO: 13760 - RNA, 75 nt, Human; identical to SEQ ID NO: 74

SEQ ID NO: 13761 - RNA, 108 nt, Human
ggcuuaaaggguauguccuugaacuuggaaccugacaauguugguguugucguguuuggaaaugauaaacuaauuaaggaaggagauauagugaagaggacaggagcc

SEQ ID NO: 13762 - RNA, 71 nt, Human; identical to SEQ ID NO: 77

SEQ ID NO: 13763 - RNA, 95 nt, Human
cugggaccgugccuucaagcccuaacaacuucuuggcccacgguguccuccccgacagcgugcaccuucacccgcugcucaagguccgcucccag

SEQ ID NO: 13764 - RNA, 60 nt, Human
ggccuggcccagagcgagcuuaugcgacugcccaguggcaaagugggcuucagcaaggcc

SEQ ID NO: 13765 - RNA, 60 nt, Human
cggccgccgcggaggcgcagcaugucggggcgcccgagggcguggaggccgcggaggccg

SEQ ID NO: 13766 - RNA, 82 nt, Human
gucgagcagcagcggcgacucgaggccgcccgggggcugaugguggcccgacgggaagcccgagaagcugaggcuguggugc

SEQ ID NO: 13767 - RNA, 65 nt, Human
ggagaacaaggggucuguggaaaucaugagaaaggacuugaaugacgcccgggaccugcauggcc

SEQ ID NO: 13768 - RNA, 73 nt, Human
aggcccggcucccaauagaggccgcgcaaacuguugugacaucagcggcugcggcugcugcccagaccggccu

SEQ ID NO: 13769 - RNA, 61 nt, Human
gacggcggcggcuguagcggcgugacgaggagccccauggcaccugcccagcacccaccuc

SEQ ID NO: 13770 - RNA, 76 nt, Human
gccaucccgggcagugggcaccgucaaaguauaccugcccaacaagcaacgcacgguggugacuguccgggauggc

SEQ ID NO: 13771 - RNA, 88 nt, Human
ggguccauuggaauggauuuggaacccaccuuggcaagguuaaaccccgaaaacccggccccacagaccaacgcuuuccaguuaaccc

SEQ ID NO: 13772 - RNA, 60 nt, Human
ggcacggcucggggcguggugguggccacgggcgaccgcacugucaugggccguaucgcc

SEQ ID NO: 13773 - RNA, 74 nt, Human
agggaaauuacagugcaaccugaaacaugcuucuuaaugaauucauagugcugucacaguugaauguaaacccu

SEQ ID NO: 13774 - RNA, 60 nt, Human
guaaauaaaacaaccagcaugagcaaucagcuuaugucagauuccauggguuuguauuac

SEQ ID NO: 13775 - RNA, 68 nt, Human
uaggggagggaagagaacuaagaugauacuaacaaaugcuaucacugguuuuguggcugccucccuua

SEQ ID NO: 13776 - RNA, 83 nt, Human
guauuuuucagcauucuuggauaaagcaguucugcauuuuuaaauugggacugcagaagugacugucuauaguugugaaauac

SEQ ID NO: 13777 - RNA, 70 nt, Human
gcgggagagcggcggggccgagagcgugacucgcccgcuccgcgcugcuucccccgcgccgccuccccgc

SEQ ID NO: 13778 - RNA, 85 nt, Human
acugcauuugaacuuuauuacuuuuaggcaucauuuacugaauccuuaugaugugcuaauuacagugcuaggccuuaaacacagu

SEQ ID NO: 13779 - RNA, 65 nt, Human
cuuuuauuuaguuugauauguuucuuuacagaaugcagaaaacacaucuuaaaaucauauagaag

SEQ ID NO: 13780 - RNA, 91 nt, Human
ucaugcgagaccuggcugcuguagcugcugcgggacuaccacugauaggucgucaggcucagguagcugcuggccgcguacuuguugguga

SEQ ID NO: 13781 - RNA, 65 nt, Human
cggaucgauacgaauagggagucuggguucaugauccccugaauccugugaguguguggagacug

SEQ ID NO: 13782 - RNA, 73 nt, Human; identical to SEQ ID NO: 1863

SEQ ID NO: 13783 - RNA, 71 nt, Human; identical to SEQ ID NO: 1145

SEQ ID NO: 13784 - RNA, 67 nt, Human; identical to SEQ ID NO: 1146

SEQ ID NO: 13785 - RNA, 92 nt, Human
gcaccccggagcggauggccgaggcuggcuucauccacugccccacugagaacgagccagacuuggccaguguuucuucugcuucaaggagc

SEQ ID NO: 13786 - RNA, 64 nt, Human
gcagcccuuucucaaggaccaccgcaucucuacauucaagaacuggcccuucuuggagggcugc

SEQ ID NO: 13787 - RNA, 105 nt, Human
uccgguugcgcuuuccuuucugucaagaagcaguuugaagaauuaacccuuggugaauuuuugaaacuggaccagagaaagagccaagaacaaaauugcaaagga

SEQ ID NO: 13788 - RNA, 60 nt, Human
ccgccaaucucucuagcacugguuccagguaucugaaugcuuugguugacagugcggugg

SEQ ID NO: 13789 - RNA, 60 nt, Human
gaggacuugaagcagaaagcaagugaauacgagucagaagccaaguaucuucaagaccuu

SEQ ID NO: 13790 - RNA, 89 nt, Human
agcuccauuuacagaacuguugcuuuuuugcaguugucuuuguucuugaaaaaccaguaacugcuucuggauaccuuuuguguagagcu

SEQ ID NO: 13791 - RNA, 89 nt, Human
uagugaaauauugaggcagcaauccaguacauuaagagucauccucugcucuauuuguuaccuuguuauugcugucucaacauuuacua

SEQ ID NO: 13792 - RNA, 94 nt, Human
gggauaguauuaauuuuuuuugguugggugcugugguugguuaaaaugaccaacuauuuugcagccccuccuuucaauagguugauucuauucu

SEQ ID NO: 13793 - RNA, 60 nt, Human
gguggaagugacguuggagaguucuagacuuaagccucaagaagccuugcagcuuccacc

SEQ ID NO: 13794 - RNA, 78 nt, Human; identical to SEQ ID NO: 932

SEQ ID NO: 13795 - RNA, 73 nt, Human
acccgaacaacaugcacucgucgaugucacggugggcugggaugccguaguugacgauguuguuguccugggu

SEQ ID NO: 13796 - RNA, 72 nt, Human
gaggcgcuguguaugcagggcccggcaguaagcccagcugccuacagccaaggcccagcgacagacauccuc

SEQ ID NO: 13797 - RNA, 66 nt, Human
ggugggagggaaaguguucggcagggcagaaacccugccuggcuguauccaacugucacucccacu

SEQ ID NO: 13798 - RNA, 83 nt, Human
gaguuagacuuuccauuuuauuuacaugucuaguaauuguagauugaaaacuuggcauuguagauaagauguuauagcaacuc

SEQ ID NO: 13799 - RNA, 67 nt, Human
uagccuagcucccuggggucucccaugcuucuguguaaucuggcagacagccaggcgauuuaggcug

SEQ ID NO: 13800 - RNA, 64 nt, Human
ccagaggacggcagaacccaucaucaugcagagccaagcaugucaaccuuucugcauccuuagg

SEQ ID NO: 13801 - RNA, 78 nt, Human
cugaugaauucaaaaucagcaaaggucuucgaaugccauucgaugaaaagauggacccuuggcugucagaauuaguag

SEQ ID NO: 13802 - RNA, 99 nt, Human
gaggcaggaggaucacuugagcccaggagauuaaggcugcagugagcugugaucgugccacugcacuccagccuggaugucauagagagucccugucuc

SEQ ID NO: 13803 - RNA, 79 nt, Human
aggagacccaguuaauguaauuccagaagcaaguugcauuugccaagcagcuuacacgugggcuuaugacuggguuccu

SEQ ID NO: 13804 - RNA, 66 nt, Human
gaugccagaaguccggggagccuuguuggugcaaaugccaacaggaaguuuugggacuaagccuuc

SEQ ID NO: 13805 - RNA, 65 nt, Human
gagacggguggaucacgaggucaggaguucgagacuagcuuggccaacauggagaaacccgucuc

SEQ ID NO: 13806 - RNA, 69 nt, Human
aagggcugaauaguuaugacagagaccauacauggcuugcaaagucuaaauauuuacuaucuggcccuu

SEQ ID NO: 13807 - RNA, 87 nt, Human
ggcuggucucgaacuucugaccucaagugaucugcucucuugggccucccaaagugcuggaauuacaggcaugauucgcacccagcc

SEQ ID NO: 13808 - RNA, 90 nt, Human
ucacccaggcuggagugcaguggagugaccuugguucacuauaaccuccuccucccagguucaagagauucuccugccucagccuccuga

SEQ ID NO: 13809 - RNA, 66 nt, Human
gaugcuuuuuguggccagucuguaaguugugagaagucucuuggcugugggccauuacuguguauu

SEQ ID NO: 13810 - RNA, 60 nt, Human
gaagcccugcuggggucgcgcggcuuuggaaaaacaaauccuggcccuggacucgguuuc

SEQ ID NO: 13811 - RNA, 71 nt, Human
ggaggggacuggaggaaacccccuuguuggaagagauuccaagagaagcacgguuuucucuuucccuugcc

SEQ ID NO: 13812 - RNA, 65 nt, Human
ugacuguuggaguaaaaaaccucuuaaauccauuguaucagagguccuuaccucucugacaguua

SEQ ID NO: 13813 - RNA, 68 nt, Human
ugguguguauauuuguucucgaggaccagcuuacgaggugagagguugaagaauuguaguacauacca

SEQ ID NO: 13814 - RNA, 62 nt, Human
cugggaccgccccugcccguggaaagccacaaggacaaagggagcggcaccucgacccccag

SEQ ID NO: 13815 - RNA, 83 nt, Human
aacaaaauuauagaauuuccagauuucuugccagguauuuuugaaaaccuaucaaggugcuccauuggauuucuguauuuguu

SEQ ID NO: 13816 - RNA, 79 nt, Human
ugagagaaggugaugggaguccuccaccuggcacugauuugagucauucaaggguuaggaugcaggucaucuuuuuuca

SEQ ID NO: 13817 - RNA, 70 nt, Human
uccuguaguguuccuggagaagcuagagccugauuguaggcuacuacucaucaauuaacuucuacagugg

SEQ ID NO: 13818 - RNA, 73 nt, Human
caaaaccaaauuuaaguucacaaggccaugcuacuuccagagagugaaugcccuuguuuagaaugggucucug

SEQ ID NO: 13819 - RNA, 118 nt, Human
ucaucaguuuauuaguuuggaaaaacuguaguuucuagcuuaugaauagcacauucaucaaguuggcucuucaucuauaucacuacuuuccuaaaugaaacaauaagauaucugguga

SEQ ID NO: 13820 - RNA, 94 nt, Human
cagucagccccuggacaaagguccuggcagcaaugaaggcgcggguaaccugaaucuucaguuuccggggcacgucuccaaauggcuugagcug

SEQ ID NO: 13821 - RNA, 100 nt, Human
gaaaaacuucugaauucugcauguacagcauaccauaagucccuacaaacauaucauuuaguaacuuuugugcauucugcaagaacucucgaaaaaauuc

SEQ ID NO: 13822 - RNA, 81 nt, Human
gugauacugaggguuuaucaacugaaacauccguuccaagaaccgagcccaaaaaucauugaacauuuccuccaaauucac

SEQ ID NO: 13823 - RNA, 77 nt, Human
cuuagccccucugcuggguagagaggcacuuucagggacuucccuccagcugccucuucaucugggaaugagcuaag

SEQ ID NO: 13824 - RNA, 85 nt, Human
gugcuugaggucucccugcucuugguggcagugguagcagcaacagcagcagcagcagcagcagcagcagcagagaccucuccac

SEQ ID NO: 13825 - RNA, 79 nt, Human
ggccgcgaugucccccgccugucugcgaaugcugcguagcggguagacauggagggcuuucggcaucgucagaguggcc

SEQ ID NO: 13826 - RNA, 60 nt, Human
gggguucuucaggguugccaugagaaccagggauccggggauugggcagcagagggcccc

SEQ ID NO: 13827 - RNA, 71 nt, Human
cuaaccauugaugagcacuccugauuuuaaucuagaacauucagauuuaccauaauguuccuuagugguag

SEQ ID NO: 13828 - RNA, 63 nt, Human
gagcugaucgccagcaguguauucuuaauugucuucauuugagcacugguaaacaaucugcuu

SEQ ID NO: 13829 - RNA, 75 nt, Human
uagcaucugguaugcaccuagacauaaaauaguucccaaguaugauuauuucuaagugguguauuuacagggcua

SEQ ID NO: 13830 - RNA, 71 nt, Human
ccacguccacuacuugaucaaguggcgggacuuaccuuacgaucaggcuucuugggagagugaggaugugg

SEQ ID NO: 13831 - RNA, 113 nt, Human
ucacagggaguuaaugaggggugaggaaggccgaccaggcaagaagcucaagaaggugaagcuucggaaguuggagaggccuccagaaacgccaacaguugauccaacaguga

SEQ ID NO: 13832 - RNA, 72 nt, Human
gcugucuuggaagacauggcucguccggacagacauggauugucuggacgauguggcuuuucuauggcaugu

SEQ ID NO: 13833 - RNA, 70 nt, Human
gacuccccuuggugguauucgcccuccggaacccaaagacuuugguuucccggaagcugcccgggggguc

SEQ ID NO: 13834 - RNA, 68 nt, Human
cuucuacucauauagacguugcuaccgacgcggguauagcaccaugaucacgcugucgugacuggaag

SEQ ID NO: 13835 - RNA, 86 nt, Human
ggaauguaaguaagugacaaugcuuauggaaagccaguuaguuagaauuggaaaucugucuugucauuuuacaagcauuagauucc

SEQ ID NO: 13836 - RNA, 60 nt, Human; identical to SEQ ID NO: 1551

SEQ ID NO: 13837 - RNA, 64 nt, Human
ggcccuugugcccugucucuucucaggcgucuuuacaccuggguagggauuggcacacggcgcc

SEQ ID NO: 13838 - RNA, 78 nt, Human
gucagcacuuacauuacgaaaauuggcuacaagcccgacacaguagcauuugugccaauuucugguuggaauggugac

SEQ ID NO: 13839 - RNA, 61 nt, Human
agcuugauugaaaagauacuaagaacuaaacugaacccguuacuaaccauuuucaaaggcu

SEQ ID NO: 13840 - RNA, 63 nt, Human
uuuuuuuuuaacauuucgaaugcuuuaaucaacagacauauacaaaugaauuuuaaaauaaaa

SEQ ID NO: 13841 - RNA, 67 nt, Human
aguggccgugucucauugccucagacaugcagcagcaugaagugcgcgaugagcuggagggcccacu

SEQ ID NO: 13842 - RNA, 94 nt, Human
ccugcccuuggcuuccagaacagcugucagccugaguagagggugagggggccuccugcugcaggcagauuccuucugcagagcccuggccagg

SEQ ID NO: 13843 - RNA, 60 nt, Human
ugaugagaacaccguguacagcaucggcgaggacgggaagguaggcggcugcaggauuca

SEQ ID NO: 13844 - RNA, 71 nt, Human
cugguuugccaauuggucagguccccagcgugaacguuuccuagaggaccugguagcuaaggcagugccag

SEQ ID NO: 13845 - RNA, 64 nt, Human; identical to SEQ ID NO: 4220

SEQ ID NO: 13846 - RNA, 90 nt, Human
cagaagaaaacgcgucagacuguggaagcugagcagaggccaguucugugccuagugucagcucuuugaaucagacacgagacgcuucug

SEQ ID NO: 13847 - RNA, 103 nt, Human
uuuuuuuucuuuuuuuugaaacagggucuggcucuguugcccaggcuggagugcagugggcaacagaguaagaguccgucucaaaaaaaaacaacaaaaaaaa

SEQ ID NO: 13848 - RNA, 65 nt, Human
cuggcgguggagguucucccgaggccucagcgccucuguucucggaaggucucuuuacauguuag

SEQ ID NO: 13849 - RNA, 69 nt, Human
gaaugggcugcuugcuguggacucauggguccgugagucugcucaucuucuucaguuugcguuucauuu

SEQ ID NO: 13850 - RNA, 83 nt, Human
ggggguuugucaagauuuguaggcuuugucauuuuuaugcaauuuggaaauauucuagcuauucggucucuuccccugccucc

SEQ ID NO: 13851 - RNA, 61 nt, Human
cguggccggccaugggaagagccauguuuucaacguggagcuuggcagcgagcuggccaug

SEQ ID NO: 13852 - RNA, 70 nt, Human
guugcaagcaaacuuguaucugggucuucaagauuuugacuuugaggaccagaggcccuauugcuucagc

SEQ ID NO: 13853 - RNA, 69 nt, Human
acugcucuaugagaacauuucuaccucuggaaaaggaggcuggugaaugucccuaucucaaaggguugu

SEQ ID NO: 13854 - RNA, 64 nt, Human
aggacguguuagccacuuucuucuucuccccugacucuucucagucggugguuaucagugucuu

SEQ ID NO: 13855 - RNA, 74 nt, Human
gugugcggcaguagaaauagcacaggccuuggggacacgcagggcuggguguuaacccugauacugccucaugc

SEQ ID NO: 13856 - RNA, 118 nt, Human; identical to SEQ ID NO: 3011

SEQ ID NO: 13857 - RNA, 80 nt, Human; identical to SEQ ID NO: 3013

SEQ ID NO: 13858 - RNA, 70 nt, Human
gucauauuccuaaguggaagaagccagucuaaagcuauagcuacacacuguauugauccaaguauaugac

SEQ ID NO: 13859 - RNA, 76 nt, Human
guuuauagcagcuuuauucauaauugccaaaacuuggaagcaaccaagaugucccuuaauggaugaagaaauaaac

SEQ ID NO: 13860 - RNA, 94 nt, Human
gcaggcauguguuggcaaaggcuguuaauaguaguuaaguguuaagacugcuuuucuuuaacguuuucaugguaaugcauauuuagagcacugu

SEQ ID NO: 13861 - RNA, 85 nt, Human
ccccauauuauuacagguuccaaaucgaggccgagugcaccgcccaccaaugccacggccuuuaacaauauguauuagcaugggg

SEQ ID NO: 13862 - RNA, 72 nt, Human
guguacgggcaguucacgggccaggcccuccucucagggcgagagaugguggggcccacgcugcccggauac

SEQ ID NO: 13863 - RNA, 61 nt, Human
uugaugucaugugucaagugcuuacugauuugauugaugaagaaguaaaaaguggcaucaa

SEQ ID NO: 13864 - RNA, 64 nt, Human
guggcacaauuuaauuguuuuguaucagaaauacacugacccaccuuuuauugaguccugccac

SEQ ID NO: 13865 - RNA, 80 nt, Human
uuuuguuuacaagauugauuuaauaugagaggauacaaaaugucaucguuauccucucuuaugaacaacuguagucaaaa

SEQ ID NO: 13866 - RNA, 64 nt, Human; identical to SEQ ID NO: 9729

SEQ ID NO: 13867 - RNA, 73 nt, Human
uaguaucauggacuaaacuaggucagagugaaguauaugcaaaaugaccauuuuguuguuuuccauguuauua

SEQ ID NO: 13868 - RNA, 76 nt, Human
gugugaaaugggccagcugccugccugucugcuccucccuggcucggccgggcgcugccauggcuccagcucagau

SEQ ID NO: 13869 - RNA, 77 nt, Human
guguuuccagggacuuuaggaauucuuuuuuuuuuuuuuggaaagggauucucguuuugucgcccagguggaauugc

SEQ ID NO: 13870 - RNA, 61 nt, Human
auuugagaaggaggcugcugagaugggagagggcuccuucaaguaugccugggucuuggau

SEQ ID NO: 13871 - RNA, 61 nt, Human
gaauauauuguauuuaauauuggauucucuaugaauugaauuuuggugagcacaaauauuu

SEQ ID NO: 13872 - RNA, 71 nt, Human
cguaacauuuuccaaauguuccuuaucaguugguccacugagagccacugaucugauuggaaaacaagacg

SEQ ID NO: 13873 - RNA, 88 nt, Human
ggccuuccagaaaggcaguuggaguuggcagguuacucuugcuucauuuuuggugguguuuucucuuuuucucugucuacugugggcu

SEQ ID NO: 13874 - RNA, 88 nt, Human; identical to SEQ ID NO: 12250

SEQ ID NO: 13875 - RNA, 60 nt, Human; identical to SEQ ID NO: 12251

SEQ ID NO: 13876 - RNA, 71 nt, Human
ugccuucaugaagcuugugaccaaguggaggaaauagcuauuaaccacacaaucacauaaucaagaaggua

SEQ ID NO: 13877 - RNA, 60 nt, Human
uuucuuugguaccucugcuuacugccucuugugaugccacuagucagaaugccuuggaaa

SEQ ID NO: 13878 - RNA, 67 nt, Human
cauuguuuguuucuauucaaccaauuucagaacuucaugaaaaaguugaaugguagguugagugaug

SEQ ID NO: 13879 - RNA, 87 nt, Human
gguaacacaaugggagccuuuucugcaaggcuggcaugugaauaaaguaccacaguaugagcagaggcuccugcuucuugguuuauc

SEQ ID NO: 13880 - RNA, 66 nt, Human
ggugacuacuagggccaagucaagagggaagaguagaacucaucccccacggccucaguaaaagcc

SEQ ID NO: 13881 - RNA, 60 nt, Human
agggggccgguggaccugcuccagcagcuggugcugcaccagcaggagguccugcccccu

SEQ ID NO: 13882 - RNA, 64 nt, Human
ucuccgagcucgccugcaucuacucggcccucacugcacgacgaugaggugacagucacggagg

SEQ ID NO: 13883 - RNA, 91 nt, Human
ggacuccagcccgccccagaagccgagguuucuccugagcgaggugagcaccuguaccuggagguuggagacaggggcagggcuggcagcc

SEQ ID NO: 13884 - RNA, 61 nt, Human
ucuucccuuccuccuccauguucccugcacuccaguuccgaccccagagcaggagggaaga

SEQ ID NO: 13885 - RNA, 73 nt, Human
gggaacucuauuuguuugauguucuccgcgcagaucgaacuacugcugcccauggucuugaacugagaguccc

SEQ ID NO: 13886 - RNA, 72 nt, Human
gccuacugagcagagagugguccagguauugaauggacucaauauccuagaaggacucacauucuagcaggc

SEQ ID NO: 13887 - RNA, 107 nt, Human
guucuugccaccaaaaagaagcaaauaacaucuaguaccugugggcaguuggcuaagaggcugugguauuuuuuguguguauuugcuuucuaccuggggaucagagc

SEQ ID NO: 13888 - RNA, 67 nt, Human; identical to SEQ ID NO: 681

SEQ ID NO: 13889 - RNA, 78 nt, Human; identical to SEQ ID NO: 7298

SEQ ID NO: 13890 - RNA, 63 nt, Human
ugcuggggcuggugguccaggggucuuacuccuuggaggccaugugggccaugagguccagca

SEQ ID NO: 13891 - RNA, 84 nt, Human; identical to SEQ ID NO: 286

SEQ ID NO: 13892 - RNA, 77 nt, Human
gcacggcccggguucuccguucucuuccugcaggcuaugcuuggaugaucuacggaaucugaccuuggaggcggugc

SEQ ID NO: 13893 - RNA, 93 nt, Human
gccguggagugggagagcaaugggcagccggagaacaacuacaagaccacgccucccaugcuggacuccgacggcuccuucuuccucuacagc

SEQ ID NO: 13894 - RNA, 66 nt, Human
guagcagaauauguuacaacugcggcaaaggaaaugcuaaacugucacagcuguagaucaugcugc

SEQ ID NO: 13895 - RNA, 78 nt, Human
gggcccagacuuguuuggggaggccagggugugcucggagugugcgagccaauaccaucacuccuaugucaggggccc

SEQ ID NO: 13896 - RNA, 74 nt, Human
gggguucuggcccccagcacugugagaaccccccagguguccugggccagggucaggaaaggggcgggcucccu

SEQ ID NO: 13897 - RNA, 79 nt, Human
guguccccuugcacaagugggggguccagggucacagucuaugaguaggccucagccccccaugcggcaagcuggacac

SEQ ID NO: 13898 - RNA, 63 nt, Human
ggugugguggcucaugccuguaaucccaggacuuugggaggccaaggcgugagcaccugcgcc

SEQ ID NO: 13899 - RNA, 63 nt, Human
aggcaaguucuucauccacucaaggagaaacuuuaaaauccacuuaaaaugaagagcauuccu

SEQ ID NO: 13900 - RNA, 113 nt, Human
gcuaauuacaaaguauuuaugacucuugugaggaccacuugacaagguugcuauauauauguaaaaaaacccucugcacuuccucauuugacuuacuacugaguaaaauuagc

SEQ ID NO: 13901 - RNA, 72 nt, Human; identical to SEQ ID NO: 9067

SEQ ID NO: 13902 - RNA, 70 nt, Human
cagggauauuguuaauuuucauacuuaaaaaugauaccuuauuaucuuuuaaaaauugccaaacucucug

SEQ ID NO: 13903 - RNA, 60 nt, Human
gcacaugcugcuuuacagacgauacauauuuguaaacuuacucaugcaaaauuagugugc

SEQ ID NO: 13904 - RNA, 68 nt, Human
cugcaaccucagccuccuggauucaagcaauccucucacgucagccacccagguagcggggacuacag

SEQ ID NO: 13905 - RNA, 74 nt, Human
ugggcucaagcaguccucccacuuggccucccaaagugcugggauuacaagagugagccacugcacucagccca

SEQ ID NO: 13906 - RNA, 90 nt, Human
gucccucccuccccugcugugaccuuguggggguugagaaaccuaggcacucauggcccccuggaggggcagggcaggcagggcuggggc

SEQ ID NO: 13907 - RNA, 68 nt, Human
ccugucucaaacagcccagggccugaaauacccugauucaccuacaguguuccccugggcucagcagg

SEQ ID NO: 13908 - RNA, 92 nt, Human
uaagcaccagaucauaugggauguggauauacuggcuucaguguaagcuucacucuauuccaggguucacacucaacaauugaugguguuug

SEQ ID NO: 13909 - RNA, 86 nt, Human
gccucuguguuccugggacaccgcugacuggaggcugcuccucuucuaaggggguccggcacagagcgccacccaaagcacauggc

SEQ ID NO: 13910 - RNA, 72 nt, Human
ggaucuagaccaugcagcuuuucccuacugucaccagauugggagcagggauuggcugccauuguccucucc

SEQ ID NO: 13911 - RNA, 68 nt, Human
ggauuaguucuuuuuuccagucuuccuuuacuuuaucuggauaagauugggcagauugaauuugaucu

SEQ ID NO: 13912 - RNA, 62 nt, Human
uuugcggauguccacgucacacuucaugauggaguugaagguggucucguggaugccgcaag

SEQ ID NO: 13913 - RNA, 77 nt, Human
gauccugucacgaacacauuuagcacacauggaaccaccauaggcccugcugacauguuucuuuguuuuggacaauc

SEQ ID NO: 13914 - RNA, 60 nt, Human
gcuuucccaaccuucuugguauaaagguaaacaauucuauuaccagggguucgggacagc

SEQ ID NO: 13915 - RNA, 78 nt, Human
uuuuuuuauuuagguuucugacucugugcuugugccuucaacacuuucacaacgauuuucugcuccucgauaaggaaa

SEQ ID NO: 13916 - RNA, 76 nt, Human; identical to SEQ ID NO: 758

SEQ ID NO: 13917 - RNA, 63 nt, Human; identical to SEQ ID NO: 9379

SEQ ID NO: 13918 - RNA, 74 nt, Human; identical to SEQ ID NO: 493

SEQ ID NO: 13919 - RNA, 62 nt, Human
gggguugccauggacucucugucuccucccaucggagaagcagagagccagaccaaagcucc

SEQ ID NO: 13920 - RNA, 105 nt, Human
uuucuuauauuguuguuaaucaucaaggaaucucuucucgauuaaaauacacacaucuuaagaauaagguuucagagcauauuccuguuuaucaacaagaagaaa

SEQ ID NO: 13921 - RNA, 65 nt, Human
gaagcagaacagguaauauaaaaccgauacaauaaggccuccccucuauccuuaucugucugguc

SEQ ID NO: 13922 - RNA, 65 nt, Human
gaguugacaauuuuauuuucacauuugccaauacaaaggaaaacugcaucuuuuuugucccacuu

SEQ ID NO: 13923 - RNA, 60 nt, Human
cacccguggucaccccagaugaagaugccguuuucgaaaacgggugauugguugcgggug

SEQ ID NO: 13924 - RNA, 71 nt, Human
gacggcguguccaugggggggaucucucguagaauggagcugcaggggugcucagcuugggaguggucguc

SEQ ID NO: 13925 - RNA, 62 nt, Human
auuguuauuaauauccuuucagaaccaccaaaaaggaaaaaaagaaaagauauuaauacaau

SEQ ID NO: 13926 - RNA, 83 nt, Human
ggcaagggaugguauuuaugcucgcuugcugagacuuccagacuuucagaucucaagcgauguuugauauuguauuucagguc

SEQ ID NO: 13927 - RNA, 84 nt, Human
uggcacagauccucgaacaauucuuaaagauuuauugccggaaacaauaccuccaccugaguuggaugauaugacacuguggca

SEQ ID NO: 13928 - RNA, 77 nt, Human
aggucuagugcaucuuuuaaccagccgaauggaguccuuuacaaacugccgacuuggcucaacaaacugcauuaccu

SEQ ID NO: 13929 - RNA, 65 nt, Human
gagccucuccuggcucugucugcuggucuaggccagggguggggcugaucaagggcagagagcuc

SEQ ID NO: 13930 - RNA, 73 nt, Human; identical to SEQ ID NO: 163

SEQ ID NO: 13931 - RNA, 76 nt, Human
gagucggugcuugguaccuggucucuccagucucaacagacucaggucaggucucucaaccaggaagcaaccacuc

SEQ ID NO: 13932 - RNA, 60 nt, Human
caccagaguucugcucccucacuccucgccccgcccccugucccagaguccgaccuggug

SEQ ID NO: 13933 - RNA, 70 nt, Human
ccaguuucaaccagaguuccaaccaaugggcuccauccucuggauucuggccaaugaaauaucucccugg

SEQ ID NO: 13934 - RNA, 62 nt, Human
ggguccucuucuuuucccagagcuccaccccaaccaggagcucuagauaauggagagcuccc

SEQ ID NO: 13935 - RNA, 76 nt, Human
guggauccugcaugaagacaguggcugacggugccuggacguacaauaccacuuccgcugucacgguaaaguccgc

SEQ ID NO: 13936 - RNA, 66 nt, Human
cucccagaugcugggcccagagccaccccaacaauccagcacaggaccccgcucagcaccagggag

SEQ ID NO: 13937 - RNA, 80 nt, Human
gucuucccccaagcgcaugguugugggacuaagcaccucaaaggagggcacagaccccgccagccugcugggaaaaaggc

SEQ ID NO: 13938 - RNA, 63 nt, Human
gucgcccaggcuggagugcaguggcacgaucucugcucacuacaaccuccgccuccuggcgau

SEQ ID NO: 13939 - RNA, 65 nt, Human
gcuucuccagguuagggugagccgccgucuggauuagugguggcgggccacacaccaggaugagc

SEQ ID NO: 13940 - RNA, 86 nt, Human
ggcgugguuccgggaaacgcagcggcgccgacccugggucucgcacauucuucacguccguucgcagcgucacccggaucuucgcc

SEQ ID NO: 13941 - RNA, 66 nt, Human; identical to SEQ ID NO: 11638

SEQ ID NO: 13942 - RNA, 82 nt, Human
ugugguacuucaggaacucuuuuucaaacucacaucacaguacaucuggagauugucuaagaggcagccuccugacaccaca

SEQ ID NO: 13943 - RNA, 86 nt, Human; identical to SEQ ID NO: 12138

SEQ ID NO: 13944 - RNA, 79 nt, Human; identical to SEQ ID NO: 12139

SEQ ID NO: 13945 - RNA, 71 nt, Human
cugccggcacugggcagcugccccacacaaugggaagcagugguggggcugggccaguccaggagccgcag

SEQ ID NO: 13946 - RNA, 84 nt, Human
guuuauugaguggcaugugaguggcgagcuaaauugggcuguaacacuuuucuugguuggcucaccgagcugcaggcaagugac

SEQ ID NO: 13947 - RNA, 75 nt, Human; identical to SEQ ID NO: 12474

SEQ ID NO: 13948 - RNA, 63 nt, Human
cuauuuuugagaauaacuuuaaugagacauuuccucucauuaacauuguuauuaaugauguag

SEQ ID NO: 13949 - RNA, 64 nt, Human
ggaaugauuauguguggcauuguacucuuucaucaggagguauauaaugucuaguuuuuguucu

SEQ ID NO: 13950 - RNA, 76 nt, Human
uaggaaaggcaagagaaaugcuuguuucuuuuauauauccagcuuuuuaagaaauacguguuugccagucauccua

SEQ ID NO: 13951 - RNA, 78 nt, Human; identical to SEQ ID NO: 12410

SEQ ID NO: 13952 - RNA, 88 nt, Human
ggagaaccgcuugaacccaggagacagagguugcugugagccgaaauagugcuacugcagucgagcuugggcgacagagugagaaucc

SEQ ID NO: 13953 - RNA, 73 nt, Human
gugggggcgguugugaucaugaggucaggaguucaagagcagccuggccaaaauggagaaagccugucucuac

SEQ ID NO: 13954 - RNA, 65 nt, Human
agagcauccccugcaaagcccccaccccagagccugcugauggaagcggggcugcaggacgcucu

SEQ ID NO: 13955 - RNA, 85 nt, Human
cugcacaaagaccccuugcugccagggccaggcaccggccuagcuccuugccugccugccugaggcagccguggaaucagggcag

SEQ ID NO: 13956 - RNA, 60 nt, Human
gguggcacagguagaaaagacagauggaaacaaugcccaugaauauacccaaaguguccc

SEQ ID NO: 13957 - RNA, 60 nt, Human; identical to SEQ ID NO: 10992

SEQ ID NO: 13958 - RNA, 61 nt, Human; identical to SEQ ID NO: 13200

SEQ ID NO: 13959 - RNA, 84 nt, Human; identical to SEQ ID NO: 286

SEQ ID NO: 13960 - RNA, 110 nt, Human
gccuucuuguccacugcuuugaugacacccaccgcaacugucugucuuauaucacgaacagcaaagcgaccccaaaguggauagucugagaagcuccaacacacaugggc

SEQ ID NO: 13961 - RNA, 73 nt, Human
gacccuuucagugccacgcuugcagggugcaaguuuuaugcauaugguggccaccuucccugcuggaaggguc

SEQ ID NO: 13962 - RNA, 77 nt, Human
uaugggggucucucaacaacccaacccuuagggaguuuacacucuuggagggguggacaaucaucacgagccucaug

SEQ ID NO: 13963 - RNA, 96 nt, Human
gcccuuuuuuuuuuuuuuucuguagcaaugaaaauuuuuaauuugaauaaaaaucacguaagcaugagguuguuggggaacacggaaaggaagggc

SEQ ID NO: 13964 - RNA, 60 nt, Human
uuaggggguguagcacauuuaucaggagguaagaucuccauagucuccuaccccuccugg

SEQ ID NO: 13965 - RNA, 82 nt, Human
gagcuugccuaaguuuugggcagagaacuccuugauguucuggcagaaaguguuuaucuggccugaaaugagcagcaaguuc

SEQ ID NO: 13966 - RNA, 86 nt, Human
gcccuggugugacuucaagaguucauguuaacuacuuuucuggaaacuuacuuuucuuaguugaugaauucuugaagagccugggc

SEQ ID NO: 13967 - RNA, 68 nt, Human
gagaucaccgcgcuggcacccagcaugaugaagagcaagaucaucgcaccgccguagcgcacauacuc

SEQ ID NO: 13968 - RNA, 64 nt, Human
ucugccaacaacggcgugucguggggcaccacgauguacccugugaucgcugaccgcaugcaga

SEQ ID NO: 13969 - RNA, 77 nt, Human
cucaucgauuuucugguacagaaaaagaucaauccucaagugaugaaggcugggagacucugccaggaaaagaugag

SEQ ID NO: 13970 - RNA, 66 nt, Human
cugccccaucaggcccaucucaagauguuggauuacagugcaacaugagaugggguggggacacag

SEQ ID NO: 13971 - RNA, 64 nt, Human
uauauuguacaagagugguauauuuuacauucaaauguuggauaugccauuaauuguauuuaua

SEQ ID NO: 13972 - RNA, 78 nt, Human; identical to SEQ ID NO: 99

SEQ ID NO: 13973 - RNA, 65 nt, Human; identical to SEQ ID NO: 247

SEQ ID NO: 13974 - RNA, 80 nt, Human; identical to SEQ ID NO: 100

SEQ ID NO: 13975 - RNA, 77 nt, Human
aucccugagagacgugugcauggaaaacguuggagcuucuguugagauaaucuucauuagguauauaucuuagggau

SEQ ID NO: 13976 - RNA, 60 nt, Human
cagccuuuucuuuaucuuauagcaggaaaaaaaaaacuuuggagggaaauagaagggcug

SEQ ID NO: 13977 - RNA, 72 nt, Human
ggucggcugccagguacagguuuccuaaagacaaaaaaaaauggaggaaucuguaaaccaaaugcagccacu

SEQ ID NO: 13978 - RNA, 131 nt, Human
gagaaagcaugcacuuguuauuuggaaaacugggcuaaauauauaacaguauccaaaguuauaccauaauaauuuauuguaauuguguauuacauagcuuuguuuacccagauauaggugcguucuuuuuu

SEQ ID NO: 13979 - RNA, 64 nt, Human
guuagucaucugugacuuuuguucuggaauaccgguuuuuaauauaucuuacagucugacuaac

SEQ ID NO: 13980 - RNA, 66 nt, Human
gaaugcuuuuaagaaccaaggacaaauuuucaguauugaagaagacaacauacauaaaaagcacuc

SEQ ID NO: 13981 - RNA, 77 nt, Human; identical to SEQ ID NO: 8674

SEQ ID NO: 13982 - RNA, 61 nt, Human
cuauuggcaugucuggugauuaguucugugacuguguuuuaccugugccagcaugccaugg

SEQ ID NO: 13983 - RNA, 86 nt, Human
cugaacauuuuccgaaaaucauuuugagcaaaauaucuguuuaauaacaagauaaccacaucaagaugguuggaaagcugaagcag

SEQ ID NO: 13984 - RNA, 70 nt, Human
gcccugagguucagaacaugaacauuuuccagaagaaggauuuuccuuuuuggaaaggagaacuucuggc

SEQ ID NO: 13985 - RNA, 80 nt, Human
cuaccaucuuuauggcagccgcauggacaggcagacgaaacagcagcccagacagaauguggcuuacaacagagaggagg

SEQ ID NO: 13986 - RNA, 62 nt, Human
gagggaaaaggcacugcuuauuccagugcagccagucaugguaaugcagugcaccagcccuc

SEQ ID NO: 13987 - RNA, 76 nt, Human
caguagagcaguuauuaaaccuuaaaguuccaaaaugaucuccuucgacuuuaugucucacauucaugucaugcug

SEQ ID NO: 13988 - RNA, 70 nt, Human
gcuguugguggaucuaccauucugguguuuggaggacaguggcccucuucucacagaucuacuaggcagu

SEQ ID NO: 13989 - RNA, 75 nt, Human
acauugccagcaggugggggugucuccagccuugcgccucccgcugggucaggaugucugucaccgcugcgaugu

SEQ ID NO: 13990 - RNA, 61 nt, Human
gcacugcuuccauuggcucaugucaaagaaaagcugccacagagccuccauccagcucugc

SEQ ID NO: 13991 - RNA, 73 nt, Human
ucaugguacaaggaccccugcuuugccagugcuuggggugguuuccggggagcaggaguuucaauuuucauga

SEQ ID NO: 13992 - RNA, 83 nt, Human
cugucaagaaggaacaucaaagugaagacauuuucugucaggcaaauuuucaggaaagucuccuuugcacccuuacuugaggg

SEQ ID NO: 13993 - RNA, 79 nt, Human
ggccaauacaaucuacaucuagacacaauauuguaaaauuuuggaauauuaaggauagaaggaagauauuaaaguggcc

SEQ ID NO: 13994 - RNA, 72 nt, Human
gaggcacuuuagagcaaaucaugaaagaucgauggaugaaugugggucacgaagaugaugaacuaaagccuu

SEQ ID NO: 13995 - RNA, 79 nt, Human
uggagccacucccugacuacaaggacccccggcggacagagcugaugguguccauggguuauacacgggaggagaucca

SEQ ID NO: 13996 - RNA, 82 nt, Human
cugguuccgccggccguggucgccgagucggugucguccuugaccaucgccgacgcguucauugcagccggcgagagcucag

SEQ ID NO: 13997 - RNA, 65 nt, Human; identical to SEQ ID NO: 2198

SEQ ID NO: 13998 - RNA, 65 nt, Human
cuuucuauuaccagacagaaaguuuggaucuuuagugguuccaaucugacuucaguaauaggagg

SEQ ID NO: 13999 - RNA, 100 nt, Human; identical to SEQ ID NO: 2199

SEQ ID NO: 14000 - RNA, 100 nt, Human
cgccauuugcuccuguuuucggcaggcuuccagcuucucugggcucaggggccaaugcucccgucaagacgcuggggcagcagcagcagggggaggugug

SEQ ID NO: 14001 - RNA, 69 nt, Human
gggaugggggucaaggagucaccuguaaucaaggugagauucugcaggacgaucauggagccucgugcc

SEQ ID NO: 14002 - RNA, 64 nt, Human
ggaauggguauugugggaauugggagaauaugaugucaaguauccagccuugauacccauuacc

SEQ ID NO: 14003 - RNA, 65 nt, Human
gguuucucuguggcagugcuuguugcuugucaguuuaucaauugcauuuuacugcauagucuacc

SEQ ID NO: 14004 - RNA, 60 nt, Human
ggacaagagauacuggaugcuuugcaaaaagcagagccuagaacagaggaucucaagucu

SEQ ID NO: 14005 - RNA, 89 nt, Human
uucucaggccaaguggucaacuggagcagacccuggaacaguucagugcccuucugaaaaccugggcucagcaguuaacccuccuggaa

SEQ ID NO: 14006 - RNA, 88 nt, Human; identical to SEQ ID NO: 7351

SEQ ID NO: 14007 - RNA, 94 nt, Human
uuuuuuugucuuuauucauuuauuuauuuauucauucauuuugugcccuucugggaaugaaccaggacuauuugaauggaaagagaaaaaaaaa

SEQ ID NO: 14008 - RNA, 84 nt, Human
ucugcaggccuccuuuaugacuaaauccagccauuaagcuucaaaugaguuaccugcuggcauuguguaagggcagccagcaga

SEQ ID NO: 14009 - RNA, 65 nt, Human
ugauuuggacacaaagacuaaacagauucagcaguggauuaagaaaaaacaccuaguccagauua

SEQ ID NO: 14010 - RNA, 77 nt, Human
cccugccaagcugcacaacucccucauuggcaccaagggccgucugauccgcuccaucauggaggagugcggcgggg

SEQ ID NO: 14011 - RNA, 98 nt, Human
auuugugucuaucuaauggguuauugagaaaaucaaauaaaauaaugcaugcaaaguacuuuuagcacagguccaauauccaugguaagaauacaaau

SEQ ID NO: 14012 - RNA, 94 nt, Human
guaagccuaccaggaggaaccagaacagcugcauaacuuggcaucuaccuaugugcuccugucccuuccacuuccuccuucuguggguaauuac

SEQ ID NO: 14013 - RNA, 84 nt, Human
ccuaaacagaugaaaaaauaggaggugggcuggauguggcccauggcuacagguuuccuggccccucacucauuucacuggugg

SEQ ID NO: 14014 - RNA, 73 nt, Human
ucacagcacuacuucuucaauguaaauuuuuuguccauuuuacagaugaaaaaacugaggauuagagaaguga

SEQ ID NO: 14015 - RNA, 87 nt, Human
ggaaagauuuugauuauacaguuuguuuuuaaauugucuuuuauauguauuugguaagaaucgguuguuacacaagcuguucuuucc

SEQ ID NO: 14016 - RNA, 92 nt, Human
guuuagaaaacuuguuuagcuccauagaggaaagaauguuaaacuuuguauuuuaaaacaugauucucugagguuaaacaugguuuucaaau

SEQ ID NO: 14017 - RNA, 100 nt, Human; identical to SEQ ID NO: 3028

SEQ ID NO: 14018 - RNA, 64 nt, Human
aaaaaagggccuuaucuuuuuuauccagaguuauaauauaaaaaggauuuaaaggcuuuuuuuu

SEQ ID NO: 14019 - RNA, 80 nt, Human
uuuuuuuucagcuacauaaacauuuuucucauguuuuguuacuaaaacaacuuguuuaggguuuuaugguugggggaaaa

SEQ ID NO: 14020 - RNA, 62 nt, Human
gcaagcguaagggcguacgugggggggcgucuugcugggccgguugggguacuugcgcaugc

SEQ ID NO: 14021 - RNA, 130 nt, Human
gucugcaggcgaacgggcuuuucugccuguguuggugcggauguguggugguugagguggucgcuugcggcuugaaguugcgcaugcagaugcggcacuggaagggcuucuggccuguguggaugcggau

SEQ ID NO: 14022 - RNA, 66 nt, Human; identical to SEQ ID NO: 6268

SEQ ID NO: 14023 - RNA, 79 nt, Human; identical to SEQ ID NO: 6269

SEQ ID NO: 14024 - RNA, 65 nt, Human
cggcgaucgcgggagagggggccauaccggacccgcaagcaugcccaccacugccacaaacgccg

SEQ ID NO: 14025 - RNA, 93 nt, Human
gauuguggggaaccugggugaaggcaccuuuggcaaggugguggagugcuuggaccaugccagagggaagucucagguugcccugacacgauc

SEQ ID NO: 14026 - RNA, 67 nt, Human; identical to SEQ ID NO: 6270

SEQ ID NO: 14027 - RNA, 68 nt, Human
ucggcaguguuuuuaccccccccaacuuguguuuuuuggcgcgcgccuuggucuggggggucugcgga

SEQ ID NO: 14028 - RNA, 75 nt, Human; identical to SEQ ID NO: 10146

SEQ ID NO: 14029 - RNA, 85 nt, Human
ccacggcggggccaagcuggccugaaaggcaccugggaagacucacuggaaggaaaggcacgcgggccgguagggcugagccggg

SEQ ID NO: 14030 - RNA, 60 nt, Human
gcugugcaccucaacacgcugcugggagagcggccugugcagcaccgcgaggugcagggc

SEQ ID NO: 14031 - RNA, 62 nt, Human
ggcucuccauucccaggcucagugcaggauccaggccugcauguguggcggguggagaagcu

SEQ ID NO: 14032 - RNA, 85 nt, Human
gaucagguauugauaacagaacauggcgacuugggaaauggaaaguuuuuggauccaaagaacagaaucuguuuuaaauuugauc

SEQ ID NO: 14033 - RNA, 76 nt, Human
uguagcaugaaucaaauguauuuauuaauagcacuuaugacuauagaauauaauuuggcauaugauucauauuaca

SEQ ID NO: 14034 - RNA, 69 nt, Human
auuuuuauacaguagugagaagaauauguuccuaaguucuuagauaucuuuuuauugaugugcaaaaau

SEQ ID NO: 14035 - RNA, 60 nt, Human
ugguaaaauugcauggguuuguagguacuuuuggaaucuagaagaaaugaaauuuuacca

SEQ ID NO: 14036 - RNA, 121 nt, Human
aacagcuccaguuacaacagcuccaguauagcuguggacuuuuaauauauggacuuuauuguguugagguaaguuccaucuaugccuauuuugcugagcauuuuaauuaugagugaauguu

SEQ ID NO: 14037 - RNA, 77 nt, Human
auuuuguuauuguguuguaucacauugaugguucaguauacucaaacaaucaaugugauacaacacaauaacaaaau

SEQ ID NO: 14038 - RNA, 70 nt, Human
aagggaaguuaggauucacuuagaguagcauuaauagaguuauguguuaugaaaggucuuagugucuguu

SEQ ID NO: 14039 - RNA, 76 nt, Human
acaaauguagauacaauaaaauguaaacaauguagcuauuaaauaugauuacagaaaauguucuauuuauuuuugu

SEQ ID NO: 14040 - RNA, 67 nt, Human
acuagauguaugggauauuucuaauaucuaguauucuagauauuaauaucuaauacuaaucucuagu

SEQ ID NO: 14041 - RNA, 60 nt, Human
ggagcggugguggccagaccacgccugcuucaccaggucugcauaggccucuagcgcacc

SEQ ID NO: 14042 - RNA, 63 nt, Human; identical to SEQ ID NO: 11061

SEQ ID NO: 14043 - RNA, 63 nt, Human
gggcgucccaguucccuuucccauuccugagccugaugguuguaagaguggaauuaacugccc

SEQ ID NO: 14044 - RNA, 63 nt, Human
aggguuaaauucaguauuuggaccugacauuucagguuauaucuccaaacugagguuaauucu

SEQ ID NO: 14045 - RNA, 85 nt, Human
gcuauguuaacuuuuacagaaaaaauaucauugaguuaggacccuauggcacauaagaauauuuuuuacaacaguuaaacaaagc

SEQ ID NO: 14046 - RNA, 64 nt, Human
cggggugggcggggggagccgagcagucacguauggggcaucugcucuuuucucuguccuccug

SEQ ID NO: 14047 - RNA, 85 nt, Human
cuugaaagggcugcaaauuucccauguucuggcauuaaagggauuucaacccuuuggccaaauugggguaccaguaacccccgag

SEQ ID NO: 14048 - RNA, 81 nt, Human
uuuuuuuuuuuuuuuuuuuuuuuuuuuuuuuuucggguuuccucuuugaaaguuuauuguuuucuuuaaaaaaaaaaaaaa

SEQ ID NO: 14049 - RNA, 64 nt, Human
cuccauuuucauuaggcagguugacuaaaaaugauugcaguaacagguuuauauaaaauaggag

SEQ ID NO: 14050 - RNA, 75 nt, Human
accaugcacccuugaaaaaagcuuugccuccuucaucacgagcaaucuuccgccagcagucaagcgugccugugu

SEQ ID NO: 14051 - RNA, 61 nt, Human
ggaaauaacuuauguguacuucuugauuucaucauacaagacaagcacaaaagcaccaccc

SEQ ID NO: 14052 - RNA, 104 nt, Human
auugguuuuaaucucacguguaacauagguuggcugguuuuguuuuuguuuuagacaauuuaaggcagaauuaucucccugcaacacugcagauaaauccuagu

SEQ ID NO: 14053 - RNA, 81 nt, Human
uauaaguuucaagaguucagauauacagauaaagcaauuuaaaaaaagcuuuucuuauucuaaggcuuuugaugcauuaua

SEQ ID NO: 14054 - RNA, 64 nt, Human
aguugaggacuuugaaucugggacagaacugcaucaccucacucccagagaaaguuggucagcu

SEQ ID NO: 14055 - RNA, 73 nt, Human
ucccagcucacucagcuggagcugaaggggaacugcuuggaccgccugccagcccagcugggccagugucgga

SEQ ID NO: 14056 - RNA, 62 nt, Human
cuugguugugcaucuucccagucuauuucugcuucuagaaauacccuguguacaacagcaag

SEQ ID NO: 14057 - RNA, 65 nt, Human
gauagggcccuccaaucagucuucuggcucccuuucacucauaguaacugguugcucuuccuauu

SEQ ID NO: 14058 - RNA, 73 nt, Human
gauggaaaaaucagcucagaaaggccaauuacuucuuuaauagaucaguuuuuuugacauaauaacucacauc

SEQ ID NO: 14059 - RNA, 71 nt, Human
ucagaaucugagaauucuucaucacaagcuauccgcuugucugaugcucgaauagaauaucucucgucugg

SEQ ID NO: 14060 - RNA, 60 nt, Human
gagcugggcaggagaggugaccuccaacuguguuccuaaaguucaucuuucgcuuggcuc

SEQ ID NO: 14061 - RNA, 73 nt, Human
gggagggcaauuuuucaucuuccaauggcggccucaaccuugaggcgaauccacuggcgaaagaugccuuucu

SEQ ID NO: 14062 - RNA, 62 nt, Human
cauguaugacuuaagaucuuuucuuuuuuugugaagaaauuuaggucucaagaacuuuuaug

SEQ ID NO: 14063 - RNA, 71 nt, Human
ugugguacaggaggcugcuuagcaguuuugagauaguuuaaucuacuaaauguggccucagcugugucgca

SEQ ID NO: 14064 - RNA, 73 nt, Human
gcuugacuuuagacacagguuucaaaaguagaaaguuuuauucucuuauguuucuauggcuuugaaguuuugc

SEQ ID NO: 14065 - RNA, 69 nt, Human
agugaugggucuguuugcaguaaaguuuaugcagaaugacguuuugcagaaaauaacagaagcaucacu

SEQ ID NO: 14066 - RNA, 61 nt, Human
gguacuauuaaaagcuguauuuggaauauguguaccaauaucaguuuuccuuuguaguacu

SEQ ID NO: 14067 - RNA, 62 nt, Human
ugaaaaacuagauuuaaaauagugguuuuagaaaacaggauaucacaaguaacaguuuuuca

SEQ ID NO: 14068 - RNA, 65 nt, Human
cccugccgggggguuggccgaggcccugggaaagggguugccgggggugugggccccgggcaggg

SEQ ID NO: 14069 - RNA, 79 nt, Human
gccauccagugccauccucgucgcugcagcgacacacgcucucgccgccgccaugacugagcagaugacccuucguggc

SEQ ID NO: 14070 - RNA, 75 nt, Human
ugugguuaucuccucagauggccaguugcccucucaggcuccugggauggaacccugcgccucugggaucucaca

SEQ ID NO: 14071 - RNA, 67 nt, Human
gcugguccggccguagcaccuccgcgccgucgccaugucgcgguuuuucaccaccgguucggacagc

SEQ ID NO: 14072 - RNA, 62 nt, Human
gucugcggaugaagaugcugagaaaaaugaggaggauucagaaggcucuucagaaugaggau

SEQ ID NO: 14073 - RNA, 77 nt, Human
gaagacucaccaugacaacuggcaggaacauaaacagcaauucacugaugaccaacugcuuguucucaccgaucuuc

SEQ ID NO: 14074 - RNA, 69 nt, Human
ggugaccagcagucaugcaggaccccauucggauccugucagaacgcaaauugaccugcgagguucgcc

SEQ ID NO: 14075 - RNA, 68 nt, Human
ggaucuaggagauuacuuguagcuguccaugaguucaggggcauggccagauuguuuccuaguuggcc

SEQ ID NO: 14076 - RNA, 77 nt, Human
gccaaauugagacaauuucagcaaaucuguaagcaguuuguauguuuaguugggguaaugaaguauuucaguuuugu

SEQ ID NO: 14077 - RNA, 89 nt, Human
uuuccggguguuguagguuucucuuuuucaggcuuauacucaugaaucuugucugaagcuuuugagggcagacugccaaguccuggaga

SEQ ID NO: 14078 - RNA, 84 nt, Human
aggguccuauguggaaaugagugggacaaugauaaaaauaaacaaauaauuaaaauuccaaaucaaaacauaacuccuggcccu

SEQ ID NO: 14079 - RNA, 65 nt, Human
cuccccauugaaguucacaagacgggaggccauuucuccucauucuuggugcaucaaauccggag

SEQ ID NO: 14080 - RNA, 83 nt, Human
guuuuauuauauaauuaucuuccuuauauauauaauauauauauaauauauauauauuaugauguaaacauauauaauauaau

SEQ ID NO: 14081 - RNA, 63 nt, Human
ggcacugggucagauuuauugcacuugcaacagaguuuaaauaaguccugggugucuggugcc

SEQ ID NO: 14082 - RNA, 62 nt, Human
ccgauucucuggcuccagcucaggaaacacagcuuccuugaccaucacuggggcucaggcgg

SEQ ID NO: 14083 - RNA, 96 nt, Human
cucuuugcauagguucugugguuucuucugagcugacucaggacccugcugugucuguggccuugggacagacagucaggaucacaugccaaggag

SEQ ID NO: 14084 - RNA, 63 nt, Human
gcugguaccagcagaagccaggacaggccccuguacuugucaucuaugguaaaaacaaccggc

SEQ ID NO: 14085 - RNA, 74 nt, Human
guguaggugugggaagguggaaucuggauuucgguaucuuucggauaaaguauucgcugcuguuuacucugcau

SEQ ID NO: 14086 - RNA, 64 nt, Human
guugauauugcuaggguggcgcuccaauuaggugcaugaguagguggccugcaguaauguuagc

SEQ ID NO: 14087 - RNA, 70 nt, Human
uguguguguaugugugugagugagauggguagcgggggugcuaucaugucgcccacgcgggucacgaacg

SEQ ID NO: 14088 - RNA, 68 nt, Human
uccuuuuucaguuugguuuugucuuuucucaugauuuagauugagggaauacaaauuuuggaggagga

SEQ ID NO: 14089 - RNA, 67 nt, Human
gcugcucacucagguuggcucuauccagucgaacacccgcugguuacugcugcccuccuucagcagc

SEQ ID NO: 14090 - RNA, 61 nt, Human
ggaggggagugcccucuggccaggggcuuccgacuccucucccaggguauacuccaccuuc

SEQ ID NO: 14091 - RNA, 87 nt, Human
uuucuuaaaggcauuuugguuuuuuaaaaucuguacagcaagagcaacuuuuucugucaaauaaaaaugagaaaugcaaaaaagaaa

SEQ ID NO: 14092 - RNA, 68 nt, Human; identical to SEQ ID NO: 6548

SEQ ID NO: 14093 - RNA, 90 nt, Human
uaguuuauuguccaguuaacuuuagugaccuuuuaaaaguuggcauuguaaauaaaacaacuugcaaaaaaguuuucuggaauagaauua

SEQ ID NO: 14094 - RNA, 65 nt, Human
cuauggcccuccaggcccacagcgguauccaauuggcauccagggucggacucccggggccaugg

SEQ ID NO: 14095 - RNA, 64 nt, Human; identical to SEQ ID NO: 3889

SEQ ID NO: 14096 - RNA, 64 nt, Human; identical to SEQ ID NO: 3890

SEQ ID NO: 14097 - RNA, 69 nt, Human; identical to SEQ ID NO: 10228

SEQ ID NO: 14098 - RNA, 77 nt, Human
cugagggcccucaugccauauuccugugccuuugaagaauucaucaucagguaguaaagcaugaccaggaucuucag

SEQ ID NO: 14099 - RNA, 85 nt, Human
ugaugcagagcucaugggucacuaaguaaugggauggucuucaguugaaaugagacuuaauaacucuugaauggugcuuugcuca

SEQ ID NO: 14100 - RNA, 79 nt, Human
cccauuuuuuggcuuuugaggggguucaguuuggguugcuugucuguuuccggguuggggggaaaguugguuggguggg

SEQ ID NO: 14101 - RNA, 60 nt, Human
uugaaugcacuuuugguuuuuggucauguucgguuggucaaagauaaaaacuaaguuuga

SEQ ID NO: 14102 - RNA, 75 nt, Human
agugccacggagagugagguggcccggggcaaaaacauccucagaaaugcccugguaucucaucuagauggcacu

SEQ ID NO: 14103 - RNA, 99 nt, Human
ggacgcagccuccugaccuauggccgccgcaucccccuggcugaaugggaaagccggauugcggagguggaugccagugugguacgugagaucugcucc

SEQ ID NO: 14104 - RNA, 75 nt, Human
gggugcacacuuugucugugaccgaaugaaaaucgaugacaugauguucguccugcaagggcaguggaugcgccu

SEQ ID NO: 14105 - RNA, 63 nt, Human
cauuuguaggguuucucuccggaguggaugcgcuggugcuccuucaggcucccccuguaggug

SEQ ID NO: 14106 - RNA, 85 nt, Human
gaaaaauaucauucacuucuucuuggugcagaaggcauagaccggauuaugcaaucacugagaaguagcuucuggauguguuuuc

SEQ ID NO: 14107 - RNA, 79 nt, Human
ugggguggcagguauuagggauaauauucauauagccuucugagcuaucugggcagacuuggugaccugucgaacucca

SEQ ID NO: 14108 - RNA, 72 nt, Human
caguauguugcucugccucuuggacuuggauguauugggaaauccaucuugguuuaauuagagaauuugcug

SEQ ID NO: 14109 - RNA, 78 nt, Human
gguguagaagcauuucuuuacugaaccuuaccagggagccauccaggauccugaagaguuuguggaaggaauggcacu

SEQ ID NO: 14110 - RNA, 71 nt, Human
gcgucuauagagcaacucacagcauugaagcuagcuucauuaaacaagcuuucacugugaguuacugaugc

SEQ ID NO: 14111 - RNA, 65 nt, Human
gcuacaaucuucucgaguuucagcugggcaggauccgcuuccaggcucacucagugguuguuggc

SEQ ID NO: 14112 - RNA, 71 nt, Human
ccaggaaaggcuccagugguucuuacuugauccaaaaaaugucaagaauuaaucuaggaggccgggccugg

SEQ ID NO: 14113 - RNA, 68 nt, Human
gaggcggguggaucacucaaggucaggcauuugagaccagccuggccaacauugugaaaccccgucuc

SEQ ID NO: 14114 - RNA, 64 nt, Human; identical to SEQ ID NO: 7986

SEQ ID NO: 14115 - RNA, 104 nt, Human
guuucucaugaaauggaaagauucagaugaggcagacuuggugcuggcgaaagaggcaaauaugaaguguccucaaauuguaauugcuuuuuaugaagagagac

SEQ ID NO: 14116 - RNA, 68 nt, Human
ucucagaaagcuggcaaagaaaaagaugguacaaaaagaaaaucuuuaucugacagugaaucugauga

SEQ ID NO: 14117 - RNA, 71 nt, Human
ugcugcugacaaaccaagaggauuugccagaggucuugauccugaaagaauaauuggugccacagacagca

SEQ ID NO: 14118 - RNA, 80 nt, Human; identical to SEQ ID NO: 4773

SEQ ID NO: 14119 - RNA, 70 nt, Human
ggugacgcccagguccuugagcuccugcaugggggggcccacagggucgcuggagccgccaucugucacc

SEQ ID NO: 14120 - RNA, 75 nt, Human
ggguuugagcccacaggaccugcacacaaacuuccccaccucuuggacuuggggacaggaucugugccucaaccc

SEQ ID NO: 14121 - RNA, 77 nt, Human
cucuugacccuuaaugcucagguucuuguggggaguuaaucagccacaucccaauuuuaccuugagggggggaagag

SEQ ID NO: 14122 - RNA, 73 nt, Human
ggggagaaaaagcuguagaacaaauguuugggguuaccauugaaaaucuaaugucugcaauauuuuucuccuc

SEQ ID NO: 14123 - RNA, 69 nt, Human; identical to SEQ ID NO: 528

SEQ ID NO: 14124 - RNA, 90 nt, Human; identical to SEQ ID NO: 5735

SEQ ID NO: 14125 - RNA, 69 nt, Human
cagugcuggccuggaagccccucaagucggguaugaaggagcuggccguguuccgggagaaggucacug

SEQ ID NO: 14126 - RNA, 77 nt, Human
ccggcagaugggcaaggguggcaagcaucaccuuggccuggaggagcccaagaagcugcgaccaccccacugccagg

SEQ ID NO: 14127 - RNA, 60 nt, Human
gccucuaagaagucccgacuguccuccucuucuaucauugacagugggaauaauguuggc

SEQ ID NO: 14128 - RNA, 97 nt, Human
cgucagacuuggaagaaauauucuguucuaaaaucuucucacuuuuauaaaaaauaugcuuuucuuuuggauuuaggauguuaucuaauuucugaug

SEQ ID NO: 14129 - RNA, 97 nt, Human
gagaaaccacacuggaguaagguaagcuguccuggagagcuggaagcuuuacuugaaucgggugcuuuguuuuuggcagucuuuauuccuguggcuc

SEQ ID NO: 14130 - RNA, 76 nt, Human
gagaguccugauuuuucucacaaccagcaucuuuggcuucuguugaaaggcaugugggcugcucaucagaacuuuc

SEQ ID NO: 14131 - RNA, 69 nt, Human
cugggggaaggaggguugggaauguguauauugaacaaaauccucuaaaugauucugacuugccucugg

SEQ ID NO: 14132 - RNA, 72 nt, Human
ucagaaacuguguugcacauugguguacaucucuuuaaauagauuucaccuuggcauucacacuuugucugg

SEQ ID NO: 14133 - RNA, 76 nt, Human
guuccuacuugcaaaagaaaagugacguggaggaucacucggugcaccugcuuuuuuucugcaaaucgcugggaac

SEQ ID NO: 14134 - RNA, 74 nt, Human
gccaccgagaagcagaagaaggcccuggagaaguugcucccggacuccucuugagggcugccugagcugguggc

SEQ ID NO: 14135 - RNA, 71 nt, Human
ggcuaagugccagcuccucuuugcccucaaggugcucaagcaugaugcccgaggagaagcugguugaggcc

SEQ ID NO: 14136 - RNA, 67 nt, Human
gcugguggugaacuucgagagcgacaagcugaaggcugugaagggcuuccggaaugucaucauuggc

SEQ ID NO: 14137 - RNA, 63 nt, Human; identical to SEQ ID NO: 123

SEQ ID NO: 14138 - RNA, 65 nt, Human; identical to SEQ ID NO: 404

SEQ ID NO: 14139 - RNA, 91 nt, Human; identical to SEQ ID NO: 124

SEQ ID NO: 14140 - RNA, 91 nt, Human
ugccccuguuggaugcagugucucgggacuucgucaguguccugcacaggcgcaucaagaaggcggggcuccggaaauuacucgggggaca

SEQ ID NO: 14141 - RNA, 79 nt, Human
cagccugcgggccgggagcggccgggauguaaaagcucuuacccuccacuaugaccgcuauaccaccucccgcaggcug

SEQ ID NO: 14142 - RNA, 63 nt, Human
gccgccgccaggguagcgguguagcugcgcagcgucgcgcgcgcuaccgcacccagguucggc

SEQ ID NO: 14143 - RNA, 73 nt, Human
ucuuauaccccaaaagucauacagugucagaacaaaggcugggauggguaugauguacagugggaauguaaga

SEQ ID NO: 14144 - RNA, 85 nt, Human
gcccgccagcucuggcugggaggacuugcucuugggucugcagccugcaucaggagccuccacuuuccccagugcuggauuaugc

SEQ ID NO: 14145 - RNA, 77 nt, Human
guaugggggguguucugcuuggcaccaugucuggcuuuuuggccagaaguccuuugcagagcugaauauccccuugc

SEQ ID NO: 14146 - RNA, 103 nt, Human
uguggaagagaaauggaagucggcucccauugcggcagacaucauggcuuccaagcuucgcugcucuugggcuccgaaacaguauccauuggcuuuauccaca

SEQ ID NO: 14147 - RNA, 73 nt, Human
cuuuuuuacuaaaggaugccuaaagccacagguuuuauugccuaacuuaaggccaugacuuuuaggauaugag

SEQ ID NO: 14148 - RNA, 65 nt, Human; identical to SEQ ID NO: 1518

SEQ ID NO: 14149 - RNA, 75 nt, Human; identical to SEQ ID NO: 74

SEQ ID NO: 14150 - RNA, 89 nt, Human; identical to SEQ ID NO: 288

SEQ ID NO: 14151 - RNA, 61 nt, Human; identical to SEQ ID NO: 776

SEQ ID NO: 14152 - RNA, 82 nt, Human
agugguucuucuuaucuccauccccaucggcuuccucuuuaagaaagccgguccugggcugaagagauggggagcagccgcu

SEQ ID NO: 14153 - RNA, 89 nt, Human
cugaucaggggagguggggguacacaucaauuugaguuguucaggcuacugaaacauuaaaaugugaauucccaaacuuuucuuuuugg

SEQ ID NO: 14154 - RNA, 96 nt, Human
gaaaagaaggagacaggauuuuuuuaaagagcaagaaagucacaauauuacuucuuuccuuccuuuuuuccuucuuuccuuucuucuuucucuuuc

SEQ ID NO: 14155 - RNA, 76 nt, Human
gggggagcuugaaggaacuacuacuaagccccuggccccaaacccaagcuucagucccacuccaggcuucaccccc

SEQ ID NO: 14156 - RNA, 64 nt, Human
ccugccaaaagagcucauguugugccaccaccaagaggaaggggcaggggaggauuuggacagg

SEQ ID NO: 14157 - RNA, 103 nt, Human
ucaaguggaaaaucugaauacauugacguuauaaaggucucaugcuugugcuucccaaguuugagaccuuuauaacgucaaguggaaaaucugaauacauuga

SEQ ID NO: 14158 - RNA, 83 nt, Human
gcugggcugagcuucuaccuacgagugaaacucuguccucccgcgaggaccaggcaucgcugugugaggacggcacggccagc

SEQ ID NO: 14159 - RNA, 76 nt, Human
gggggugcagggcccugugguuggacuucaccucucagcacugaaaacccaaaacccagcuggccuuaacacuccu

SEQ ID NO: 14160 - RNA, 92 nt, Human
gaugguaauauucuauccuuaugacacuauugcaaccaaauuggcuuuaccaucuuggcuuuaguagguauagaagacaauggauuaccauc

SEQ ID NO: 14161 - RNA, 63 nt, Human
uuaaaacaucauauggagaaguuuacauggugauuguucaccugcaguacuguggaguuuuaa

SEQ ID NO: 14162 - RNA, 63 nt, Human
auggugacaacaugcuggagccaagugcuacauggcuugguucacaggauggcaaguccccgu

SEQ ID NO: 14163 - RNA, 79 nt, Human
gccaaaaugggaaaggaaaagacucauaucaacaugucgucauggacacguagauucgggcaaguccaccacuacuggc

SEQ ID NO: 14164 - RNA, 75 nt, Human
uauucugucauacgguagcaagaacuggccuauggcaucguauuccuggcauugagacuguauugacccugaaug

SEQ ID NO: 14165 - RNA, 64 nt, Human
aucuaaugcuaaugaacaaagguuauuuuuaaaaaaacgguuuuugugauauuaaccaugggau

SEQ ID NO: 14166 - RNA, 74 nt, Human
gauuugcuuuuaauuacaaauacugugcaugacgaugccuucuucugcaaaaccaauaaauacaagaacaaauu

SEQ ID NO: 14167 - RNA, 64 nt, Human
ugauuuguccaagauaucugaaaaaggaaacaaaagccugauuugcagguauuuauaaaaauca

SEQ ID NO: 14168 - RNA, 63 nt, Human
uucucuaaccuuucaaaggauuaaggcucaaagggugugacucaucugugggagggcagggaa

SEQ ID NO: 14169 - RNA, 63 nt, Human
auuuauuaauuccauuaagacacaacuacauauuuuauucuuauaauggccauguuaauaagu

SEQ ID NO: 14170 - RNA, 93 nt, Human
accuggagcugcacccccccaguuauccguggucucaccguggccuccucucuuccuuggaccacgaccagcuauccggagggguuuccaggu

SEQ ID NO: 14171 - RNA, 84 nt, Human
cagcgcugggcaugcuggcggcagggggugcggggcuggccguggcucugcauucggcugugagugccaguugaccuggagcug

SEQ ID NO: 14172 - RNA, 63 nt, Human
ccagcuauccggagggguuuccagguauauaagcauggugugcgccuuccugccacagcaugg

SEQ ID NO: 14173 - RNA, 74 nt, Human
cggggcgcggggcucccgggcgcgcgugcccggggucugcugugcagcgcgcggcccgggcagcucccgcuacg

SEQ ID NO: 14174 - RNA, 71 nt, Human
aucucuuuaucuauagggcaagcgugcaggccaucuagacuacuugcucuaaguccugagaugaacugggu

SEQ ID NO: 14175 - RNA, 73 nt, Human
ucuuacaugguaugcuaaggagucaguacuuuacucauaaggaggcaaaauuggcaaggcauacagaaaaaga

SEQ ID NO: 14176 - RNA, 90 nt, Human
gggguuuguggagcgcugugggagcguccagccugggugucguuacuugcggcuccguggugaagcuacucaauacgcgccacaacgucc

SEQ ID NO: 14177 - RNA, 121 nt, Human
ccccggaccugcagucuauggagcagauucggcggaucaugcggcccacagaugugccugaccagggccugcugugugaccugcuguggucugacccugacaaggacgugcagggcugggg

SEQ ID NO: 14178 - RNA, 121 nt, Human
gagaacgaccguggcgucucuuuuaccuuuggagccgaggugguggccaaguuccuccacaagcacgacuuggaccucaucugccgagcacaccaggugguagaagacgguacgaguucuu

SEQ ID NO: 14179 - RNA, 65 nt, Human
cgccuccugcaccaugcggcucgaucuccuccuugcucaggcggcccuugucguuggugauggug

SEQ ID NO: 14180 - RNA, 92 nt, Human
ggccaagguguaggcguccagccacgagaugaccucuugacacuuguccagaaccuucuucuuguccgacucgcugaucuugcccuugagcc

SEQ ID NO: 14181 - RNA, 75 nt, Human
gugccucuuguccguggccgugacguucaggaugccguuggcaucgauugucgaaggucacucgaucuggggcac

SEQ ID NO: 14182 - RNA, 94 nt, Human
uguccgacucgcugaucuugcccuugagccccucauccuccacggcgcucuucauguugaaggcguaggacuccagggcguucuuggcuugaca

SEQ ID NO: 14183 - RNA, 62 nt, Human; identical to SEQ ID NO: 5274

SEQ ID NO: 14184 - RNA, 77 nt, Human
gggugcggcuccaccccuuccacgucauccgcaucaacaagauguuguccugugcuggggcugacagauccacaucu

SEQ ID NO: 14185 - RNA, 63 nt, Human
cugccguagauuaaaagcaauuauaaaaucauaaaauugaauguuugcagaauccuggagcag

SEQ ID NO: 14186 - RNA, 73 nt, Human
ugguuucuuuucauuagaucugauuuacguuucccacuguagaucugauuuuguaguugaaaacauuucacca

SEQ ID NO: 14187 - RNA, 65 nt, Human
uuucugaauauugugccuuuuuauaccuagccuagauuaaaaccgaugccauacuuauucagaaa

SEQ ID NO: 14188 - RNA, 60 nt, Human
uuuugaugaauuucaccuauuccauucuucacguuucagaauuggucgacuuuguuagaa

SEQ ID NO: 14189 - RNA, 66 nt, Human
gccccaucccuuguccaguguccucucuaaggcagauuuaaaggacacaaaaggaagcuguguggc

SEQ ID NO: 14190 - RNA, 64 nt, Human
gugcccaccuauaccagugguggacacaguagaaccagauuguguaccuuguccacuguggcau

SEQ ID NO: 14191 - RNA, 73 nt, Human
uccaaauaucuuacaggcugcugagaaacuaggugaaccugagaaccuuaguauacugauugaagaaugugga

SEQ ID NO: 14192 - RNA, 88 nt, Human
gcucagcgucgccgcgaugguguuguuggagagcgagcaguuccugacggagcugaccagacuuuuccagaagugccggacgucgggc

SEQ ID NO: 14193 - RNA, 84 nt, Human
ucagcacuguggugagcuccaaggaagugaauaaguuucagauggcuuauucaaaccuccuuagagcuaacauggaugggcuga

SEQ ID NO: 14194 - RNA, 64 nt, Human; identical to SEQ ID NO: 8423

SEQ ID NO: 14195 - RNA, 64 nt, Human
auuugccaauuuuugaguguucuucauguuacugauuuguaggagcucuuuauauauugcagau

SEQ ID NO: 14196 - RNA, 87 nt, Human
cuccuggcccccaucccagacccuucaggggauccuggcgauucgaagcagcauagccugauaggccucuggugaggguguugggag

SEQ ID NO: 14197 - RNA, 77 nt, Human
guuuucuuggccgccuguuccaggaugcucaagaugaugcugugggccuccuggcauagcucagcacccaggaaagc

SEQ ID NO: 14198 - RNA, 70 nt, Human
gagacucuuccaggucaaagggcggcgugugguccgugccaccgagguaccuguguccugggagagcuuc

SEQ ID NO: 14199 - RNA, 89 nt, Human
gcggaguggccgggcccgagugcacgugucugaggagggcacugagcccgaggcgaugcuccaggugcugggccccaagccggcucugc

SEQ ID NO: 14200 - RNA, 65 nt, Human
cuuugcgagucagagcacucacgcccgucuacauggauagaggccucgaguaucugaccgucuag

SEQ ID NO: 14201 - RNA, 91 nt, Human
uccuggaucuggcugacaacgcggaucgugacaacaagaagacgcucauuauucaucgucaccuccagcuagucauccguaacgaccagga

SEQ ID NO: 14202 - RNA, 65 nt, Human
gaugggaaauaauucaguuugagagccaacuagaccuagauucagaccuagauuugaaucccauc

SEQ ID NO: 14203 - RNA, 70 nt, Human
agugaagcaaauauuuuauuuaaaucagucgucaaaucacaacuuauccaaaugaauguguugcaacauu

SEQ ID NO: 14204 - RNA, 72 nt, Human
auauggcacaaacacaauccaguaucuaucaaaauaccauuuguaaagaaccugacuuauuucaugccaugu

SEQ ID NO: 14205 - RNA, 90 nt, Human; identical to SEQ ID NO: 2702

SEQ ID NO: 14206 - RNA, 74 nt, Human
gggcccuggcguuacccaacuuaaucgccuuugagcacaucccccuuuugccaguuugcguaauaacggggccc

SEQ ID NO: 14207 - RNA, 82 nt, Human
ccaggcugcugggacugggcugguuuuguccuugaaguggucaggauacaggacaagggcagccccaccccauccagccugg

SEQ ID NO: 14208 - RNA, 79 nt, Human; identical to SEQ ID NO: 3096

SEQ ID NO: 14209 - RNA, 120 nt, Human
gggggcccggucugccaacucagcuccucugcugcaaaagcggggugcuuguuggggccaucuccuggcaauggcaagugagucuggagcagagaggggagaggggcugggugggucccc

SEQ ID NO: 14210 - RNA, 85 nt, Human
gaccggccggagagccgagaaggugcacgggcugcucaagacauucgugaggcagaacgcugccauccguggcauccggcacguc

SEQ ID NO: 14211 - RNA, 103 nt, Human
gcgaugacuucuguuucuuccagaugcucaugggugggggugugugucgcacagugacacucaacuucaacaugccaggcgccuuugugcaugaagucauggu

SEQ ID NO: 14212 - RNA, 102 nt, Human
ggugcaguggcacacaccuguaaucccagcuacuccgaaggcugaggcaggaggaucaccugagcccaggaaguugagacugcagugagcugagauugcacc

SEQ ID NO: 14213 - RNA, 72 nt, Human
gacggagaggaugagggugaagaguauuaaccugugugcuguacuuuuacacuccuuugucuuggaacuguc

SEQ ID NO: 14214 - RNA, 65 nt, Human
ggugugacccucgccaugguaaauacauggcuugcugccuguuauaccguggugacgugguuccc

SEQ ID NO: 14215 - RNA, 68 nt, Human
ugccaccaucaaaaccaagcguaccauccaguuuguggauuggugccccacuggcuucaagguuggca

SEQ ID NO: 14216 - RNA, 98 nt, Human
uguggugccuggcggagaccuggccaagguacagagagcugugugcaugcugagcaauaccacagcuguugccgaggccugggcucgccuggaccaca

SEQ ID NO: 14217 - RNA, 69 nt, Human; identical to SEQ ID NO: 6797

SEQ ID NO: 14218 - RNA, 63 nt, Human; identical to SEQ ID NO: 6798

SEQ ID NO: 14219 - RNA, 98 nt, Human
uuuuuaaaauuaugagauacuuuuuuaugugugcuucauuaacaauaaaaacauugcaaagggaaguaauacucaagagaauaucaucauuuuggaaa

SEQ ID NO: 14220 - RNA, 104 nt, Human
uucgcccacuuuuugaugggguuguauguuuuuuucuuguaaauuuguuugaguucauuguagauucuggauauuagcccuuugucagaugaguagguugcgaa

SEQ ID NO: 14221 - RNA, 98 nt, Human
uuuucucccauguuguagguugccuguucacucagaugguaguuucuuuugcguucucuuucccucucccaacauggcggccucagcaaaaaagaaga

SEQ ID NO: 14222 - RNA, 68 nt, Human; identical to SEQ ID NO: 12184

SEQ ID NO: 14223 - RNA, 82 nt, Human
gcaggccgccugcacauugagcagcagcagggugggcgagcacuugucagccaucuccuggaagauguaguaggcauccugc

SEQ ID NO: 14224 - RNA, 90 nt, Human
aucuaugaaggccaaguggaggugacuggugaugaauacaauguggaaagcauugauggucagccaggugccuucaccugcuauuuggau

SEQ ID NO: 14225 - RNA, 64 nt, Human
auaagaucuaagaguuaccuggcuacagaaagaagaugccagaugacacuuaagaccuacuugu

SEQ ID NO: 14226 - RNA, 61 nt, Human; identical to SEQ ID NO: 200

SEQ ID NO: 14227 - RNA, 62 nt, Human; identical to SEQ ID NO: 11985

SEQ ID NO: 14228 - RNA, 93 nt, Human
cgggggucggggcgcaauugccagggacaucuggagcccggccugcuucugucgggcuccaggguaccccuggauggcugcgcugugcccucg

SEQ ID NO: 14229 - RNA, 62 nt, Human
uagauauauaagaaccugaucuccaaguguugaagacugaaaaucagauaucuauaugucua

SEQ ID NO: 14230 - RNA, 76 nt, Human
gaggcuaagucugggcagugggcuggccccuggugugagcauuagaccagccacagugccugauugguauagccuu

SEQ ID NO: 14231 - RNA, 81 nt, Human
gccuuaagaaaauagcuuccugucucaggcuuucuaggaagucacaaacuaggugucugggaggcaguuuuagguaagugc

SEQ ID NO: 14232 - RNA, 95 nt, Human
cccucuucuaagcagcaggaacagaguugcuuuaggcugucauagucuucccuggaucuaacuaaagcaaauaugugaugagcuuuaggggaggg

SEQ ID NO: 14233 - RNA, 79 nt, Human
agauccuguuuugaaauuccauucacauuacauucgauuuacuagaaugccuuuuuuuuucuuuuuugagauggggucu

SEQ ID NO: 14234 - RNA, 64 nt, Human
auccucuugccucugcagccuaauaauuuuuuuuuaauuuuuauuuuuuuguagaguuggggau

SEQ ID NO: 14235 - RNA, 70 nt, Human
cucuguugcucagcaggaaugcagggguacaaucacgacucacuauacccuugaacuucugggcucaggg

SEQ ID NO: 14236 - RNA, 115 nt, Human
aaggcuuauuuuuccaggcaggaggagaggcugguggucuugagcuuuuggccuggaauuccagucugaauuuucaaauauucccugccuccaaccccuuugggauccuagucuu

SEQ ID NO: 14237 - RNA, 99 nt, Human
gauguuaagggugaacuugucacuugguauguagguccgacucccaucccagagguggcagugggccuuggcucaagaucaaguuugaacuaaaauauu

SEQ ID NO: 14238 - RNA, 61 nt, Human
cuuuuuucuuuucuuugauuucucuucaguagcacuuucggaaucagaggaaucagaagag

SEQ ID NO: 14239 - RNA, 95 nt, Human
gagcuaucugagucacuagaugaggaggaggaagaugaugaugauuuaugccuuuucuuuucuucuuucuuaacuuuagauuugggaaucagcuc

SEQ ID NO: 14240 - RNA, 75 nt, Human
gcaucuguuuucugguuuucaaucucucuuacaacuucuugaccagagauuacuuguccaaaaacaacaugaugc

SEQ ID NO: 14241 - RNA, 103 nt, Human
cacaggucgggggccuagagaccaccaaugcccuuggacacacagaauccccuugauuuccaggagguaguggguggcauucucugagccuuugcacauggug

SEQ ID NO: 14242 - RNA, 98 nt, Human
gccuuguauuucugcagguucucaaaguggcccaggcacuugcagugggagagcugugccccuggcguugcugugauagaacuuguggcagaugcggc

SEQ ID NO: 14243 - RNA, 68 nt, Human
ccuuaauuacuuccuuagcagccccagcuccacagugaagguuggggcuucaacaugggaauuuaggg

SEQ ID NO: 14244 - RNA, 66 nt, Human
ggugccagcaggguggggggggggguucauugugaggcuucuccucuuggcuuguagguggcugcc

SEQ ID NO: 14245 - RNA, 95 nt, Human
ugccaauuaccccuaucugauuacuauacauuauauguauugaaacauuauuauguaccccauaaauauguagagagcagucaagggagcuggcg

SEQ ID NO: 14246 - RNA, 63 nt, Human; identical to SEQ ID NO: 12577

SEQ ID NO: 14247 - RNA, 102 nt, Human; identical to SEQ ID NO: 2172

SEQ ID NO: 14248 - RNA, 77 nt, Human; identical to SEQ ID NO: 3082

SEQ ID NO: 14249 - RNA, 85 nt, Human; identical to SEQ ID NO: 6504

SEQ ID NO: 14250 - RNA, 62 nt, Human
ccccagucagucaccgccucugcgcuguuccucagguguaauauuguuaagaaagaaagggg

SEQ ID NO: 14251 - RNA, 67 nt, Human
gcccucauccaccgagaccucacgagagcgcaccaggucgcucuuguagcccacgaggaugaugggc

SEQ ID NO: 14252 - RNA, 68 nt, Human
gccuggacauuguggugcacugccgcugaugucucaaugaacuugcagucaaagaccaccgcgcaggc

SEQ ID NO: 14253 - RNA, 120 nt, Human
gcucaaauugcugcuaggaagauuuauaggcaaagaagugugggagugggaggccaagagcugccuucuucacaucaacagaaacuccagcuguucuuuccccuuagcaguucucugagc

SEQ ID NO: 14254 - RNA, 69 nt, Human
ggagggcggucaggggaacuucacagugcggggaggggugucuggaaaggaaacucugaagcgccgucu

SEQ ID NO: 14255 - RNA, 64 nt, Human; identical to SEQ ID NO: 6321

SEQ ID NO: 14256 - RNA, 65 nt, Human
aagucugccacaaugcugauaacccagcccauggaaucagggcugugcugcagcugggcaugcuu

SEQ ID NO: 14257 - RNA, 100 nt, Human
ugaucaucaucgugcagugcugccuguaugaggugagaccagcccuggcaggaccuaggucucagcuaucaaacagguagcuguacgguggcuuugauca

SEQ ID NO: 14258 - RNA, 105 nt, Human
agcuuugguuuugcuuacaaaguauauuuaaggauuauucugcugaagauucaguuuaagaguuuuccuugggagaacuaaguaagaaacacaaugccaacagcu

SEQ ID NO: 14259 - RNA, 76 nt, Human
auuggcaaauagcgugggauagauugguuucuuaaugggugugaccaauccuguuuuuccuaugcucugggugaau

SEQ ID NO: 14260 - RNA, 80 nt, Human
gccugaugguauacuacugcuuugcggaauugcauacaacugugcauuacaaaguuaauaugguaauuauggucuggggu

SEQ ID NO: 14261 - RNA, 75 nt, Human; identical to SEQ ID NO: 74

SEQ ID NO: 14262 - RNA, 87 nt, Human; identical to SEQ ID NO: 76

SEQ ID NO: 14263 - RNA, 71 nt, Human; identical to SEQ ID NO: 77

SEQ ID NO: 14264 - RNA, 66 nt, Human; identical to SEQ ID NO: 3167

SEQ ID NO: 14265 - RNA, 68 nt, Human
ggcccugaaaagacccgacgacacagcuuuccaaauaguggaacuucggauuuuuucuaacuggggcc

SEQ ID NO: 14266 - RNA, 64 nt, Human
ugaguauaccugucuguaucgguucagaguucauggcgaaccugucaagugaagacacuacuca

SEQ ID NO: 14267 - RNA, 84 nt, Human
gcauccuaggccuauuaauauuccggaguauacguagccggcuaacguuaacaaccgguaccucuagaacuauagcuagcaugc

SEQ ID NO: 14268 - RNA, 88 nt, Human
ggcgcacgugcacuagugcuuucgagcucuguacauguccgcggucgcgauguacgcguaucgauggcgccagcugcaggcggccgcc

SEQ ID NO: 14269 - RNA, 82 nt, Human
aauuuuuguucaggaaugacuugcucauucuguguuuuuaaaaauaggaaauaaggcauagugagucaucauuacaucaauu

SEQ ID NO: 14270 - RNA, 67 nt, Human
acuguguuauuugauuaguaauauguucccuuaaaauucauuuugagguguauguuauacacacagu

SEQ ID NO: 14271 - RNA, 84 nt, Human
cagaaggacuccccaaaauucccucuguguccacucacauaaaggugaaaagcgaagagaagaucaaagugguggagaagucug

SEQ ID NO: 14272 - RNA, 73 nt, Human
ggaagcauucagcagcuggacgcugagcugaggaacaccaagugggagauggccgcccagcugcgagaauacc

SEQ ID NO: 14273 - RNA, 62 nt, Human
gcaucuuuuauucuugguaguuuuugggauccccggaugcuuuuuccuugggugacugaugc

SEQ ID NO: 14274 - RNA, 65 nt, Human
ugauuguagugucuuacuguguguguucaaccuugugcuuagaguaucagaaauaucucucuuca

SEQ ID NO: 14275 - RNA, 61 nt, Human
gcugcugcagcccgcggggucccucggcuccuacagcuaccggaguccccacuggggcagc

SEQ ID NO: 14276 - RNA, 61 nt, Human
ugguggccccugccacggaugguggccucaaccugaccuccaccuuccucaggaaaaacca

SEQ ID NO: 14277 - RNA, 61 nt, Human
ggccccugggagaugacgagguuggugcaaaggcagcugguagguggucugcuggguggcu

SEQ ID NO: 14278 - RNA, 61 nt, Human; identical to SEQ ID NO: 12046

SEQ ID NO: 14279 - RNA, 64 nt, Human; identical to SEQ ID NO: 9729

SEQ ID NO: 14280 - RNA, 73 nt, Human; identical to SEQ ID NO: 12049

SEQ ID NO: 14281 - RNA, 84 nt, Human
cggacuuccauaaacucaaccuuccuuaaccccagaaaccacagacuuucaagagugaugacgaggggaagagaugagaagacg

SEQ ID NO: 14282 - RNA, 68 nt, Human
gugauuaacaaaacauuuugugcagaaggcugaagucuaaucuaagcaaauuugugucuggugauuau

SEQ ID NO: 14283 - RNA, 63 nt, Human
ugcucuagaucacgucuacaagucaacuuuccuucucugauuuuagaucuauucaagagagca

SEQ ID NO: 14284 - RNA, 63 nt, Human
ugggccacagaggcauaaggucuggguuaagaaauaucuaagacgugcucaaucuguguucca

SEQ ID NO: 14285 - RNA, 75 nt, Human; identical to SEQ ID NO: 74

SEQ ID NO: 14286 - RNA, 87 nt, Human; identical to SEQ ID NO: 76

SEQ ID NO: 14287 - RNA, 71 nt, Human; identical to SEQ ID NO: 77

SEQ ID NO: 14288 - RNA, 60 nt, Human
gugaaaugaggguagcaguagugacgcccaucuccacuggcagugcugauccucagaaac

SEQ ID NO: 14289 - RNA, 64 nt, Human
ugcgcugaaugaugucacggcagucguugaacacacggcggauguucucaguguccacagcgca

SEQ ID NO: 14290 - RNA, 60 nt, Human
gcucucgggggcaccuuccgggguuccuaagccgcggggccccucgcugccccucgaggc

SEQ ID NO: 14291 - RNA, 98 nt, Human
gcuuggagaggacaagugcagccugucaguuuuagaagcaaguaaaucauccucuuuucaagagcaguguccguggugugcaguuccucuccaauugc

SEQ ID NO: 14292 - RNA, 87 nt, Human; identical to SEQ ID NO: 4554

SEQ ID NO: 14293 - RNA, 81 nt, Human
ucaugcucugaaacuuugcaucaaggacugaccaacuggucagggucaucaugauguacaaagaagccaaacagaacauga

SEQ ID NO: 14294 - RNA, 70 nt, Human
aaaguuugauuauacuuuggaggaucacagauuguuccauaaccuuaagccuccaacuauuuccgacuuu

SEQ ID NO: 14295 - RNA, 65 nt, Human
cucucccuugcaguuguucgccccucugggccaaaccaaagggacgcugcucuguacagguagag

SEQ ID NO: 14296 - RNA, 102 nt, Human
uggaauucuucauugagucguugacuucucgacggaaugcugacagguucugggugaaccugucucuguuuuucguaagaagauuucgcucgaugccuucca

SEQ ID NO: 14297 - RNA, 74 nt, Human
ucucagaagcucuaucccauggagacugugauguucuuacaagaaccuuuguccgucggguauuguaggugaga

SEQ ID NO: 14298 - RNA, 72 nt, Human
uguauuuugacaucauuaugagauuuaaacaaauuccucagugaauguuugguugugauauguuaaccugca

SEQ ID NO: 14299 - RNA, 95 nt, Human
acguauucgacgcgccauuguucggcaucgccugggcaguacgcaggccgagagugguggugcuggcauggccgaacaggcgcgucggaauacgu

SEQ ID NO: 14300 - RNA, 82 nt, Human
aaaaguaaugugagucugucuaaccauauuuuccuaacucaacaguaggaucaugaugguaaggcaaauacaaguuauuuuu

SEQ ID NO: 14301 - RNA, 69 nt, Human
uccugaacgcagccugcugaggucgacuugagaaaguucagggccuggagagaaggcugugaggcagga

SEQ ID NO: 14302 - RNA, 71 nt, Human
ccuggcacggugacucacgccuguaaucccagcacuuugugaggcugaggcaggcagaucacaaggucagg

SEQ ID NO: 14303 - RNA, 69 nt, Human
gauuggaauuugaguuaaaauuuagcuuuguacauuacgugugagaguuacagacuagcaagucuaauu

SEQ ID NO: 14304 - RNA, 91 nt, Human; identical to SEQ ID NO: 8804

SEQ ID NO: 14305 - RNA, 71 nt, Human
acuuuuaaaacuuuaaacgacccacagcugaaauaguuguacuuagcuagguuaaaaacacauaauaaggu

SEQ ID NO: 14306 - RNA, 82 nt, Human
gcaauaauggaagaacagaguauuuuaauuuuuaucuucaaagaaaaucguacaaugacacugauuuuucuguuaaaacugc

SEQ ID NO: 14307 - RNA, 78 nt, Human
cgccgagcacagcuucuccuuaugucacgcacgauuucccgcucggccgugguggugaagcuguagccgcgcucggug

SEQ ID NO: 14308 - RNA, 61 nt, Human
cguagauuggcacagugugggugaccccgucaccggaguccaucacgaugccagugguacg

SEQ ID NO: 14309 - RNA, 107 nt, Human
cuggcucuagccugcuuuuguuuggauuuagaucuugguggagaggacugucccacuccucucuucuggcuagugagucuuccacaaaagccgcugccaggagccag

SEQ ID NO: 14310 - RNA, 97 nt, Human
uuuuuuuuuuuuauugaaaucaagacaugaauagcuaagguuuuauuuguuaucacuauuugcugggcuauuaucugauuuggaaaaaaaaaaaaaa

SEQ ID NO: 14311 - RNA, 64 nt, Human; identical to SEQ ID NO: 14289

SEQ ID NO: 14312 - RNA, 64 nt, Human
ccuuuugauuauuuaguccaauaacauugaguuuuuuucuucuuugggcuggaauucaugaagg

SEQ ID NO: 14313 - RNA, 61 nt, Human
uuugaaaucauaaugauaggaauaauagcuaacauugaauuacuccuuaauaugugccaaa

SEQ ID NO: 14314 - RNA, 74 nt, Human
guccugcaaggcuucuggcuacaucuucacaaguuaugauauagacugggugaggcagacgccugaacagggac

SEQ ID NO: 14315 - RNA, 61 nt, Human
guuccuuuucuaugcggcccgagccggccaugggccaggugaagcugcagcaguaaggaac

SEQ ID NO: 14316 - RNA, 64 nt, Human
aacugaaauacaguagaaauggaaaacuacagcaguuuugauguuuucucauaguaaugcaguu

SEQ ID NO: 14317 - RNA, 80 nt, Human; identical to SEQ ID NO: 9102

SEQ ID NO: 14318 - RNA, 130 nt, Human; identical to SEQ ID NO: 3361

SEQ ID NO: 14319 - RNA, 80 nt, Human; identical to SEQ ID NO: 7076

SEQ ID NO: 14320 - RNA, 69 nt, Human
cugucagggcugauggugaaggggucagcacgcggauguugaucuuuucuuucuucagcaguucggcag

SEQ ID NO: 14321 - RNA, 68 nt, Human
gauucaauaguaauaaaaacaacagaaacaagauucauauuuccacagcuguuuucuuauuuggaguc

SEQ ID NO: 14322 - RNA, 70 nt, Human
uagaagguggaguaaaauuccuggcauaagauaaucagauugcacaaggaaccucuaaaucuaacuucua

SEQ ID NO: 14323 - RNA, 60 nt, Human
ucucugggguuucaguuggcccuauuguuuggugagggaaaccauagugaaccucagaga

SEQ ID NO: 14324 - RNA, 77 nt, Human
caaggacaucggcuccaagucugacccacucugcauccuuuuacaggaugugggagggggcagcugggcugagcuug

SEQ ID NO: 14325 - RNA, 78 nt, Human; identical to SEQ ID NO: 5666

SEQ ID NO: 14326 - RNA, 90 nt, Human
gggcggaggcacucgcgcgggggguaauucggggucuggguucuggugccgcgcagcuuuccccgauggcccacugcgugaccuugguuc

SEQ ID NO: 14327 - RNA, 90 nt, Human
cacagagcaaauaacauuacugaaagaaccuggaggcuauuaaauacaaaauggcaguuuucuuucaaagugaaaauauuugcuucuuug

SEQ ID NO: 14328 - RNA, 71 nt, Human
gccaaauguggaacuaagguggguucaguggggaccagggaaggccucauggccccaguccacaauugugc

SEQ ID NO: 14329 - RNA, 67 nt, Human
uacuccucagugccuugcagucucccaaucacagaagaguagauaugggaagggccaaagaggagua

SEQ ID NO: 14330 - RNA, 60 nt, Human
ccucggaucuagccugcggagacagggcggccgggccaggucuggggagagaggccgagg

SEQ ID NO: 14331 - RNA, 75 nt, Human
ggcggcccggccuucggccgcccggggcgcgcggggcacgcccgcgagggggcgagcccgggggcuggagcugcc

SEQ ID NO: 14332 - RNA, 70 nt, Human
ggggcagggaggaaaaagcgaaaacacggaauuacagagaaagucgguuucuucuuaaucuccuuggccc

SEQ ID NO: 14333 - RNA, 77 nt, Human
gaagaucaaucugauggcuaaagaucaguaugacugcguaaggcaguuugacaucuacccaucccuaacagauuuuc

SEQ ID NO: 14334 - RNA, 80 nt, Human
uguggaacaaccaaggagaaggcauauuccucccuuuccaaaggugggcaaugugccucuuccuggaagguuauuuuaca

SEQ ID NO: 14335 - RNA, 130 nt, Human
ccacgucaccgacccuucggcuuuuggguucgggugaugaugguuccacgucagcggcccuccgccucuuggguuugcgugacgguuccacaucaccgacccuccgccucuuggguucgggugaugaugg

SEQ ID NO: 14336 - RNA, 96 nt, Human; identical to SEQ ID NO: 8065

SEQ ID NO: 14337 - RNA, 70 nt, Human
gagaaacauacaugacuuagagugaaaaauaauucuagaaaaguuucacuagguaaguaugcaaauucuu

SEQ ID NO: 14338 - RNA, 70 nt, Human
acaaaagguacuuuuggagaccucugucauggaagucaccuucaagacaguacuguaacaagccauuugu

SEQ ID NO: 14339 - RNA, 86 nt, Human
uuuuuuguagagacggggccuugccauguuacccaggcugguuuugaaccugggaaacauagggagacccugucucuauuguaaaa

SEQ ID NO: 14340 - RNA, 94 nt, Human
caaacacaaagcagguuugguugaggacagacacucagggaauuuuugaccaccaaaaaaguuuuggggguuuguuuuuccuguuuuuuguaug

SEQ ID NO: 14341 - RNA, 60 nt, Human
gaugucauaggcggccuucuucaguucguaaucucucugugccuuggccaucucgaucuc

SEQ ID NO: 14342 - RNA, 71 nt, Human
gccaccugcugggcccgcuccaccaccugcaccugcacccgcugcuccucaaucugcugcuuagucuuggc

SEQ ID NO: 14343 - RNA, 64 nt, Human
uugucccgcuccgcuuccgcuggcuuccgcacccgggccuccagcuccuucucccgccgggcga

SEQ ID NO: 14344 - RNA, 70 nt, Human
agguagagcucaaaaguuagcagcuauuauguauuuuuccaacauguuugauugcugcuucugcuccccu

SEQ ID NO: 14345 - RNA, 60 nt, Human
uuguuugguauacuucauuuccagugaugggcuggucacugaugcugaggagccaggcag

SEQ ID NO: 14346 - RNA, 64 nt, Human
acuuuuuuaaugggucucaaaauuuugugacaaauuuuuggucaaguuguuuccauuaaaaagu

SEQ ID NO: 14347 - RNA, 89 nt, Human; identical to SEQ ID NO: 288

SEQ ID NO: 14348 - RNA, 81 nt, Human
ugacuguuuagaauaugguuuucuuaauuagcagucauggggaaaacaugcauuuuuaauuuggaaaaaaccugacaguua

SEQ ID NO: 14349 - RNA, 61 nt, Human
ugguucuguuuaccuugauuagugaaguaauuugcugcaguguuacagaggagcagaauca

SEQ ID NO: 14350 - RNA, 68 nt, Human; identical to SEQ ID NO: 8944

SEQ ID NO: 14351 - RNA, 91 nt, Human
cauacuuucaugcauuucaucauuucucaaaagagcuuuauuuccuuuuaguaggaauagaucuagaaaucaagauuugggugcuaauaug

SEQ ID NO: 14352 - RNA, 61 nt, Human
gacgccaauucggccaaugggagcccuuucaagcaggcuucugugcccuuuaugauguguc

SEQ ID NO: 14353 - RNA, 131 nt, Human; identical to SEQ ID NO: 6294

SEQ ID NO: 14354 - RNA, 65 nt, Human
ccuuguguuggaggcugcugugaugucaggaacggggaucugucuagcuuuuggccacuuccugg

SEQ ID NO: 14355 - RNA, 88 nt, Human; identical to SEQ ID NO: 11656

SEQ ID NO: 14356 - RNA, 77 nt, Human
ggcuagaaaagccaaggccaaaggcuggaggggagaggacagucagcauguccagccuggggucuggguguaggguu

SEQ ID NO: 14357 - RNA, 78 nt, Human; identical to SEQ ID NO: 99

SEQ ID NO: 14358 - RNA, 65 nt, Human; identical to SEQ ID NO: 247

SEQ ID NO: 14359 - RNA, 80 nt, Human; identical to SEQ ID NO: 100

SEQ ID NO: 14360 - RNA, 77 nt, Human
cucaggauggcgcugggcuguccccucgccucuguccuugccagaagauggaggagaggcggcccaacucuucugag

SEQ ID NO: 14361 - RNA, 90 nt, Human
gggagggugggguggggggcagacuggggcucaacaaauggaaugugugccgggaagggccaccuggaagcccccacuccacccccaccc

SEQ ID NO: 14362 - RNA, 63 nt, Human
guuaccaggccggggccguguuggcaagacgccucauccgccucguguuccuguccuggucgc

SEQ ID NO: 14363 - RNA, 69 nt, Human
ucuccagcagugggcaccacugguccgcaucgcccguguuccggauggcaagucuccacugugggcaga

SEQ ID NO: 14364 - RNA, 61 nt, Human; identical to SEQ ID NO: 776

SEQ ID NO: 14365 - RNA, 84 nt, Human; identical to SEQ ID NO: 286

SEQ ID NO: 14366 - RNA, 69 nt, Human
aauggugacaacaugcugggagccaagugcuaacaugccuuggguucaaggcauggcaacgucaccguu

SEQ ID NO: 14367 - RNA, 64 nt, Human
cguacugacucgaacaagcguuuaaaagagcucaaccuguagagacgugcucgcgagucagccg

SEQ ID NO: 14368 - RNA, 78 nt, Human
aaggcuccacauacuucacaaacuuccauuuguuuuucuugugcagcaaagcuuucaauugucgacguuguggaccuu

SEQ ID NO: 14369 - RNA, 69 nt, Human
cagaagacugcugguuuugagauaaugccaaacgagcauggccucgucugauccuacguucuacuucug

SEQ ID NO: 14370 - RNA, 64 nt, Human
ggugaacaucaucucccagaauauucagcuuuuagcuuguuuuuucuuuuggaccaguucaacc

SEQ ID NO: 14371 - RNA, 61 nt, Human
aaggcaaucggaauuugaguacuaugguuaccuagaugaagaugauggugucacgugccuu

SEQ ID NO: 14372 - RNA, 64 nt, Human
gguccggauaaaaggagcugggagguccugauuauggaaaaaguuggcccuaaaaugcuggauc

SEQ ID NO: 14373 - RNA, 74 nt, Human
caggcagaagaagaugcccaugauggcgcccugcauggagcgcggggccucugaguaggcaaacuccaggccug

SEQ ID NO: 14374 - RNA, 77 nt, Human
gaugcuggcaaagaucucacugaucccaaugagcagguacugagggaucugcaccagauggacaguggugccgcguu

SEQ ID NO: 14375 - RNA, 68 nt, Human
ggauguauuguaagcgcuccaucuccaggacuccugccacaaugacggagguauaaccaaagacauuc

SEQ ID NO: 14376 - RNA, 94 nt, Human
ggcaauuguugauguucccaaaguccuuggggcagugcagccagcccccgggcaaggacagcauugccacuaggcuggagcccaacagugagcc

SEQ ID NO: 14377 - RNA, 80 nt, Human
ggggcgcaggugcgcgggugcguggugccacugggugaccgacuuagccuggccagacucucagcaccuggaagcgcccc

SEQ ID NO: 14378 - RNA, 82 nt, Human; identical to SEQ ID NO: 4821

SEQ ID NO: 14379 - RNA, 66 nt, Human; identical to SEQ ID NO: 4822

SEQ ID NO: 14380 - RNA, 66 nt, Human; identical to SEQ ID NO: 4823

SEQ ID NO: 14381 - RNA, 62 nt, Human
aaggucacguggcaauggucucgggacuuugggucccggaguggccgugaaacggugguauu

SEQ ID NO: 14382 - RNA, 74 nt, Human
gaaaugaggucggguuuauaugcacuuauugguauuggaauuucuggugcaacuuauagguuugauuuuaauuu

SEQ ID NO: 14383 - RNA, 83 nt, Human
ggaaacucaucuccuuccugaggagccggggaggcuggacccaguccccgucgugcagucaggugggcgggugugucuuuucc

SEQ ID NO: 14384 - RNA, 77 nt, Human
gucucgggcaaagcguuaugagaagcuggacuuccuuggggagggacaguuugccaccguuuacaaggccaugagau

SEQ ID NO: 14385 - RNA, 103 nt, Human
ugaugcuuuuggacauaaaucuaauauuagccuugucuuugauuuuauggaaacugaucuagagguuauaauaaaggauaauagucuugugcugacaccauca

SEQ ID NO: 14386 - RNA, 64 nt, Human; identical to SEQ ID NO: 7119

SEQ ID NO: 14387 - RNA, 77 nt, Human; identical to SEQ ID NO: 3323

SEQ ID NO: 14388 - RNA, 85 nt, Human
acagccagcgcucucagcucaugaugcgcacccggaucgccgcccaggguuucacggucgcagccaucuugcugggucuggcugu

SEQ ID NO: 14389 - RNA, 60 nt, Human
guguaacuguaaccgaaaguuuuuucaaaaauccuagaugcuguuguuugaauguuacau

SEQ ID NO: 14390 - RNA, 82 nt, Human
uaagcccagggucuggccuugaaagcuccgcagaaaugauuccaaaacccaggagcaaccacuggcccuaccgugggacuua

SEQ ID NO: 14391 - RNA, 73 nt, Human
cgggccacccgggucaagcgcgcuccgccgggaaacuucugcgggcgccgggcugaagcuccgggcagggcug

SEQ ID NO: 14392 - RNA, 76 nt, Human
accugccuaccagacacaagauucgagagcucaccucauccagaauugguuugcucacucgcaucagugggcaggu

SEQ ID NO: 14393 - RNA, 131 nt, Human
guucuauagaguuuacccuuaccugugucgggccuugaaaacauucgucaaagaccguaaagagaucccucuugccaaggauuuuuauguugcauuccaagaccugccuaccagacacaagauucgagagc

SEQ ID NO: 14394 - RNA, 70 nt, Human
guuucagagcagcgauggagaaauuaaauacuugcaauuagcagaggaacugauucguccugagagaaac

SEQ ID NO: 14395 - RNA, 60 nt, Human
gcucgcugggaaaguccuugcugugaaaucgaagauugaggacuacuuuccagaauuugc

SEQ ID NO: 14396 - RNA, 75 nt, Human
agacuaaggccaacacagcagaaagggcaaagggcuggaaagaagcuaaguccugauggaggcuuucugaagucu

SEQ ID NO: 14397 - RNA, 73 nt, Human
cuucagagaggugggauguggaggggagaggacaugaggauggagcugccaaagccauccugccacugugaag

SEQ ID NO: 14398 - RNA, 100 nt, Human
gucgggcuugugcguauggguggugugaugucuggggcugucccugcugcacagcccaggaggcgguggaagaagauauccccauagcgaaagaacggac

SEQ ID NO: 14399 - RNA, 64 nt, Human; identical to SEQ ID NO: 14289

SEQ ID NO: 14400 - RNA, 87 nt, Human
aggcgugaacaguuauccagaagaacagcacccuccaccacuggucugggcuugagguucaucaucaauaaucuguacaccucgccu

SEQ ID NO: 14401 - RNA, 71 nt, Human
cagugggaggagucaaugucauucuaccccucgcuaaacgaagauauuaacaucuauugcuuguuccgcug

SEQ ID NO: 14402 - RNA, 63 nt, Human
uggucgacaggcucucaaggcaacuccccauuuucaagaggcugcuccugccugcuucgauca

SEQ ID NO: 14403 - RNA, 73 nt, Human
aagauugaauuaggagguuaggcaggaguaggaucaaagacuuagaaaaugcuuguuuccuccuauuauucuu

SEQ ID NO: 14404 - RNA, 78 nt, Human
ggaagccgcggggacaguugacauuguggaauggagcgaaagagucgaccgggccgucgauggccaugggguguagcc

SEQ ID NO: 14405 - RNA, 69 nt, Human
ccuggaagacuuuuuuuucuuauuuuaguugagaaguuucauaaacugcucaaggauuaguuuuccagg

SEQ ID NO: 14406 - RNA, 79 nt, Human
uacaacaugacaccaacagaagggaucaaagugugucgugaaauugcgagucuucauuccuuuuucuugguucuuugua

SEQ ID NO: 14407 - RNA, 70 nt, Human
ucuuuuagucuagacuauuuaaccaaagguauguguuccuuuaauaauuuuucuuuaguuuauugaaaga

SEQ ID NO: 14408 - RNA, 70 nt, Human
ggacggugugggacacgggcuaccacuggguacacgucacggucuuacaccugugccccacgacgggucc

SEQ ID NO: 14409 - RNA, 69 nt, Human
caucuugugggccuugugguguucuggucacugcuacccucucaaugccacacaugagcccucagggug

SEQ ID NO: 14410 - RNA, 73 nt, Human
gaguuucauccuugugauaagaaauguguacuuggaacaagcuaaccugcuauuucccaccuuuaugaaacuc

SEQ ID NO: 14411 - RNA, 79 nt, Human
aggacuuuagcagcucguuguauuuccuggucaaccucucagcgaccuggagggauucgucgagcucccgccgcagcuu

SEQ ID NO: 14412 - RNA, 61 nt, Human; identical to SEQ ID NO: 10042

SEQ ID NO: 14413 - RNA, 85 nt, Human
ggcugggauuggaacuguguuugggagccucaucauugguuaugccaggaacccuucucugaagcaacagcucuucuccuacgcc

SEQ ID NO: 14414 - RNA, 130 nt, Human
ucucuagccgcagcuuccaaaccagcgccauuucaagggacaucgacacagcagccaaguucauuggagcuggggcugccacaguugggguggcugguucuggggcugggauuggaacuguguuugggag

SEQ ID NO: 14415 - RNA, 65 nt, Human
uggcgcugcacagguggcuggacugucccaccuucuguggacagagccacuuggugcugcgacca

SEQ ID NO: 14416 - RNA, 65 nt, Human
caugggcaaauagcgugggauagauuuguuucuuaaugggugugaccaauccuguuuuuccuaug

SEQ ID NO: 14417 - RNA, 77 nt, Human
ccugaugguauacuacugcuuugcggaauugcauacaacugugcauuacaaaguuaauaugguaauuauggucuggg

SEQ ID NO: 14418 - RNA, 73 nt, Human
cuuacaaaguauauuuaaggauuauucugcugaagauucaguuuaagaguuuuccuugggagaacuaaguaag

SEQ ID NO: 14419 - RNA, 82 nt, Human
cagauaagacagggaacacuugugagcacacagagcagcaucugaugcccugugguguuuggcaugugcccccugucuacug

SEQ ID NO: 14420 - RNA, 72 nt, Human
ccacagccuguaacucaguguuuuguacuucacugaauugugaugguuagaaacuucguggauaguuugugg

SEQ ID NO: 14421 - RNA, 79 nt, Human
aucucaggacucuggauaccuuuauuuuugcuucagguggcuuuuaaucagauucaaaagggaauuuaguuuucuagau

SEQ ID NO: 14422 - RNA, 66 nt, Human
guccgucugcccguagcuaauccacaggccugugagaacuggcuccggggaaagaauaggauggau

SEQ ID NO: 14423 - RNA, 88 nt, Human
gggagguacacauagucgguugcucccggcaccaaggccgcaggcggcggucggugcagggcgccccgcuggcguaguaguccauccc

SEQ ID NO: 14424 - RNA, 60 nt, Human; identical to SEQ ID NO: 5344

SEQ ID NO: 14425 - RNA, 69 nt, Human; identical to SEQ ID NO: 5346

SEQ ID NO: 14426 - RNA, 93 nt, Human
cggaauagagucugagaagcagaaggaggucugggagucaugcaggaaugaauacuucugguccuuugggauauagguuucuucaaacuccug

SEQ ID NO: 14427 - RNA, 60 nt, Human
aagugcgaaaaaagcagugugggccgggcgcgguggcucacgccuguaaucccagcacuu

SEQ ID NO: 14428 - RNA, 63 nt, Human
ucugcuuugaauacgggcaguuuauugcaugucaauuaaacccguauaaacuguuaagggaga

SEQ ID NO: 14429 - RNA, 69 nt, Human
aucggagagcagguaguacuggcaggacauggggaugcccuccuccgcgugaacagucugcuccacgau

SEQ ID NO: 14430 - RNA, 61 nt, Human
ggcaucuuggugaugaugcagcacccuggggagcccaccuguauucucuuggccaggugcc

SEQ ID NO: 14431 - RNA, 93 nt, Human; identical to SEQ ID NO: 2387

SEQ ID NO: 14432 - RNA, 64 nt, Human
gaugaacgcuaccgacauuuaggauucucuguugaugaccuuggaugcuguaaagugauucguc

SEQ ID NO: 14433 - RNA, 62 nt, Human; identical to SEQ ID NO: 2389

SEQ ID NO: 14434 - RNA, 83 nt, Human
uucauuauuggugugaacucaugaguucucauauuuuccauaguuuaucauucauuacuauucucacuguuuucauacuugaa

SEQ ID NO: 14435 - RNA, 67 nt, Human
cggucuguuaucuccuuuugcgcgacacggucucagcuguuccgccugaggcgagugacgcuggccg

SEQ ID NO: 14436 - RNA, 117 nt, Human
gacuuuauagagaaagaccaguuuuaccuagauacuaaaggaagaauuaaaccgcuguuaguuugaaaugcuuuuuuuuuuuuuuuuuuaaauggagauagggucuuaacucuuguc

SEQ ID NO: 14437 - RNA, 72 nt, Human
gccucccaaacuggugagauuacaggcaugagccaccacaacuggccugaaauucuuaaaggaugggagugu

SEQ ID NO: 14438 - RNA, 66 nt, Human
ggcuggaggagugcagucguacagucauggcucacugaagucuugaccccgcugccucagccuccc

SEQ ID NO: 14439 - RNA, 83 nt, Human
cuugcuuuucaguuccaaauuugcaagaaaaugaggaaucugagauuacacaugguuuucuuguuaauuuugaacguggcggg

SEQ ID NO: 14440 - RNA, 98 nt, Human
gggguugggagcgggaugcguggcagggccaugugguggugguaacaggggccauuuguuaaauugguuugaaaugcaaagucucugcuaaaaaccuc

SEQ ID NO: 14441 - RNA, 76 nt, Human; identical to SEQ ID NO: 758

SEQ ID NO: 14442 - RNA, 61 nt, Human
guuucucccagcaggacccucuuuuuguuuugaaagauggucggcugcuuuugggaggcac

SEQ ID NO: 14443 - RNA, 71 nt, Human; identical to SEQ ID NO: 1764

SEQ ID NO: 14444 - RNA, 75 nt, Human
gcuuucagugcaguuucaaacauuuucacaacaggcaauaguccaugagaauuuggaaugacaguauagaauggc

SEQ ID NO: 14445 - RNA, 60 nt, Human
ugcuucaguuuccuuuguguuucucuacccaaccccaagaugaaagaagggagaagagua

SEQ ID NO: 14446 - RNA, 61 nt, Human
gugaaugaguaacuuauuuuguaucaggaauguuuugguacuguguuuucacucaaaccac

SEQ ID NO: 14447 - RNA, 98 nt, Human
uguaucaggaauguuuugguacuguguuuucacucaaaccacugacuuaacagauacugcuguguauaacauguacuaaauauuacaguuauugugca

SEQ ID NO: 14448 - RNA, 73 nt, Human
uuuaguuguacauuuagccaguguuauuugaaguauguaacuuuuaaaauauuaagugucuuguaugauuaga

SEQ ID NO: 14449 - RNA, 70 nt, Human
aacuggugauugucggugauggagccuguggaaagacaugcuugcucauagucuucagcaaggaccaguu

SEQ ID NO: 14450 - RNA, 62 nt, Human
cgucuccgaguuugcgacucgcggaccggcgucccggcgcgaagaggcuggacucggauucg

SEQ ID NO: 14451 - RNA, 71 nt, Human
gacaugacauuaggaacuuagcauuuuagaucuguguucaaacaagucuuaaaauugucuagucucauguc

SEQ ID NO: 14452 - RNA, 65 nt, Human; identical to SEQ ID NO: 3707

SEQ ID NO: 14453 - RNA, 61 nt, Human
agaagagaaguugcuaggccugauugacguuuaagcccagaacuggcguagcuucacuucu

SEQ ID NO: 14454 - RNA, 70 nt, Human
cuucaaacugguuucuucacucugaagcagguuccccuuccccuucaggauaucuggaccaaguuugaag

SEQ ID NO: 14455 - RNA, 79 nt, Human
ucuucccauccuuaacuguucaaguaugucuguuguaaccaauaaguuuauugcugugaaauuacuucugaugguaaga

SEQ ID NO: 14456 - RNA, 63 nt, Human
gauauacguguguguguguguguguguguauauauauauauauauauaauguguguguauauc

SEQ ID NO: 14457 - RNA, 85 nt, Human
ggccacuuuuaugcuaaauaaagacacugagauaauaaauuuccuuguacaguuuauugucuaauacuagcaaaucaaauuggcc

SEQ ID NO: 14458 - RNA, 67 nt, Human
ggcuagaaagaugcuaaggggaugcuacagcuguuuguccccugacagagauuccaucuaucuaacc

SEQ ID NO: 14459 - RNA, 94 nt, Human
gggcgucugcuggagugugcccaaugcuauaugucaguugagguucuaagacuuggaagccacagaaaugcagaaugccacuccggaagggucc

SEQ ID NO: 14460 - RNA, 103 nt, Human
uccugccuggaaguuuaggucaaagaggcugcuuggagcaaaauacaguggugucucaucccaaauauucuccaggcguuucuuccauccuuccaggauuuga

SEQ ID NO: 14461 - RNA, 66 nt, Human
aaaauuggcaaaaguaacuuaaguaguuaacguucaauagauacuuucaaaauuucuguuaauuuu

SEQ ID NO: 14462 - RNA, 75 nt, Human
uguuucucugucauugcugucauguucucuagcgauauuuuccuuaagucggcaguaguagucuagaucaaaaca

SEQ ID NO: 14463 - RNA, 112 nt, Human; identical to SEQ ID NO: 2686

SEQ ID NO: 14464 - RNA, 77 nt, Human
cugggguguuuauggcaagucacuuugacagacauuauguggcaaauguugucugacuuacuguuucaacaaaccag

SEQ ID NO: 14465 - RNA, 90 nt, Human
gaggacuuuaaauaucucuuuaugaaguucccugccuaaccucuuucuauuuaaaggcaaacaaauuucgaagagguuuuguguucccuc

SEQ ID NO: 14466 - RNA, 84 nt, Human
ggagaugaaacggaagaugcgcgaggaugugaucucuuccauacggaacuuucucaucuacguggcccuccugcgagucacucc

SEQ ID NO: 14467 - RNA, 62 nt, Human; identical to SEQ ID NO: 5613

SEQ ID NO: 14468 - RNA, 105 nt, Human
ggaaggugcaacguaagagcagacacaaccugagaugcccuugagauuuaggagaacaggagggcgcccuuucuguugugaccugacucuuaaaagaaaucuucu

SEQ ID NO: 14469 - RNA, 94 nt, Human
acuccacggcgaugucgcugggauagaagccuuugaccaagcaugucaagugaccugguucuuggcuucuucucccgggauuggggccgggggu

SEQ ID NO: 14470 - RNA, 80 nt, Human
agcgcacugcuccacugcgccucucugcagcuggacucuugacguagagaaaccuggggaucugugagggagcuggugcu

SEQ ID NO: 14471 - RNA, 91 nt, Human
gcggccgcugcuaccgacuagcaccgcggccagucugcuccggaaaaaggcggacugcgcccggcgcuggcgacugaggcggcgagcgcgc

SEQ ID NO: 14472 - RNA, 67 nt, Human
gcccagaggacucccaacccuggcuuggugucaagaaacagccagcaagaguuaggggccuuagggc

SEQ ID NO: 14473 - RNA, 74 nt, Human
ggaggaaugcuggacuggaggccccuggagccagauggcaagagggugacagcuuccuuuccuguguguacucu

SEQ ID NO: 14474 - RNA, 61 nt, Human
ggcugugauugcagccugcucuagugggacagcccagagccuggcugcccaucauguggcc

SEQ ID NO: 14475 - RNA, 73 nt, Human
gcauuugucuuucugaccucaugcaauuccuaggaaacucuguguucugugauuuagucaggcaauaaaaugc

SEQ ID NO: 14476 - RNA, 97 nt, Human
gguuucuuaauuagauauagcugaaaagaacgcuagaccaaauagguucucugccuugccuuuucguuuguuuuguuuuagcuauuaucagggaacc

SEQ ID NO: 14477 - RNA, 79 nt, Human; identical to SEQ ID NO: 7764

SEQ ID NO: 14478 - RNA, 93 nt, Human
guggcuucaauucuaagaguggacagcggggaucuuccaagucuggaaaguugacaaggagaugaccuucaggccauucagaaaggagcugac

SEQ ID NO: 14479 - RNA, 77 nt, Human
ucuuuucgaaguauggcaaaauugugggcugcucuguucauaagggcuuugccuucguucaguauguuaaugagaga

SEQ ID NO: 14480 - RNA, 60 nt, Human
gauuucucucuacccccccucagcaucuucccgcugagagugugggggaagagccuuguc

SEQ ID NO: 14481 - RNA, 105 nt, Human
ccccaucgccuccaguugcuauggcaacaggccauucugggccagccacgucucugcauggcagugcccaaugguggaguugcuaggggcgacggagcuguuugg

SEQ ID NO: 14482 - RNA, 67 nt, Human
cucaccuggaacauugggaauuguuuauuuuuugaugaggucaucagaaauaaucucaccaggucag

SEQ ID NO: 14483 - RNA, 88 nt, Human
gacacuguuuuuauuuaguuugauauguuucuuuacagaaugcagaaaacacaucuuaaaaucauauagaaggaaauaaaaacacauc

SEQ ID NO: 14484 - RNA, 65 nt, Human
agcaagaguagggugcauggcuugaauaagaggaaacagccguucacccaacauuugcuuuugcu

SEQ ID NO: 14485 - RNA, 92 nt, Human
gcuguugcauuguaacuuguggugugcauuaagaugugcugaggauugcgaacuccugcagcauauuuauacugugggacggugcggacagc

SEQ ID NO: 14486 - RNA, 78 nt, Human
aagagaagugagacaaaccaucuaauaucuguaucaugcuauuaauaggcugugauguugaguuucucacuuacucuu

SEQ ID NO: 14487 - RNA, 78 nt, Human; identical to SEQ ID NO: 99

SEQ ID NO: 14488 - RNA, 90 nt, Human
cuuuaggaggcugaggugggaggacugcuuaaggcaaggagucugagaccagccugggcaauacagcaagaucccaucucuauuucaaag

SEQ ID NO: 14489 - RNA, 65 nt, Human
guuaagauaaacaugagaaacuugaucuaauauuuaauauauauucaguucuacacuuuauuaac

SEQ ID NO: 14490 - RNA, 76 nt, Human
guuucacuuugggaggccaaggcggguggaucacaaggucaggagaucgagaccauccuggccaacauaguaaaac

SEQ ID NO: 14491 - RNA, 82 nt, Human
agcaucuguguuuucauucguuuguaccuacugugggcuagccucuagaggauacaaugaaaggcuacacgucauucuugcu

SEQ ID NO: 14492 - RNA, 62 nt, Human
aggcguuucuacaaugacguguuacaaggagugguacuuugugagcuucgguguauuugccu

SEQ ID NO: 14493 - RNA, 78 nt, Human
guggguauuaacauuggcuggaguagcaaggaucuucaacacuagaagauauuugcugcagccuuuagguauacguac

SEQ ID NO: 14494 - RNA, 91 nt, Human
gaauucagaauauuguauugaugaugguuauucuuuuauauaauuacaauaauuauccaggaaaauagcaaacagaugcagugcugaauuc

SEQ ID NO: 14495 - RNA, 130 nt, Human
gcucccaccccuuucccccugccccacccccaggccuaacuucuuggcuuaagauacaaaagggcacucucuacuggcccuggugucaaacgucagcagccucaggccuggaugcauuuggauacaaagc

SEQ ID NO: 14496 - RNA, 68 nt, Human
ucacucauuaacucaugcauaccaaacauagcuaaaguaaaguauuaaugguaugaguuaauaaguga

SEQ ID NO: 14497 - RNA, 93 nt, Human
ccugcagccaguugcaugaagggcaucccaucuugcugcucuguccacuggcauggcggccccacugcccuuuuuugccacuggcuucugagg

SEQ ID NO: 14498 - RNA, 70 nt, Human
gugcuccuagugccaacaaugugcgacauuauucaaccacugugacgccaaugaugacugcuaggaggac

SEQ ID NO: 14499 - RNA, 78 nt, Human; identical to SEQ ID NO: 11810

SEQ ID NO: 14500 - RNA, 76 nt, Human; identical to SEQ ID NO: 11811

SEQ ID NO: 14501 - RNA, 84 nt, Human
uuuguuucacugcguucaauuuugaguuuccuaacauccauucuacaggucaaucaaaauacaaaggcgugcaaaugaaacaag

SEQ ID NO: 14502 - RNA, 71 nt, Human
caugguggugaguuuauuacauuagcaugagggcaggguguaagcaggcagaguggaugaacguuuacaug

SEQ ID NO: 14503 - RNA, 62 nt, Human
ugcgcgcaccaucccaacacagcagcaagaaaagggcaaugcaugaagggguuggugccgca

SEQ ID NO: 14504 - RNA, 85 nt, Human
acccuagaaaagaucaccaacagccguccucccugcgucauccugugacugcacaggacucuggguuccugcucuguucuggggu

SEQ ID NO: 14505 - RNA, 96 nt, Human
gcccccucccgaggaggucgagccgggcagugggguccgcaucgugguggaguacugugaacccugcggcuucgaggcgaccuaccuggagcuggc

SEQ ID NO: 14506 - RNA, 75 nt, Human
ucuccaagcuggagaaugggggcuucccuaugagaaagaucucauugaggccauccgaagagccaguaauggaga

SEQ ID NO: 14507 - RNA, 91 nt, Human; identical to SEQ ID NO: 5353

SEQ ID NO: 14508 - RNA, 67 nt, Human; identical to SEQ ID NO: 5354

SEQ ID NO: 14509 - RNA, 72 nt, Human
cucgggugguggcgcaugccuguaaucccagcuacucaggaggcugaggcaggagaaucgcuuaaacccggg

SEQ ID NO: 14510 - RNA, 94 nt, Human
ggcaggagaaucgcuuaaacccgggagguggagguuguggagcugagauugugccauugcacugcagccugggcaauaacagcaaaacuccguc

SEQ ID NO: 14511 - RNA, 62 nt, Human
aguagcccucuuucuccugggaucuugcugaaauuaguggguggggggguggggggacgacu

SEQ ID NO: 14512 - RNA, 72 nt, Human
gccuugagcuaagguauccgcuucaaggccuccuauccauggcccuuggaagcggauaccuuagcucaaggu

SEQ ID NO: 14513 - RNA, 102 nt, Human
guguguaguaguaucucauuuugguuuuaauuuauauauuucccugaugauuaaaaggggauguccuguaaauguuuucuuuugugaaauaccauagcacac

SEQ ID NO: 14514 - RNA, 78 nt, Human
uuauggcagauugauaccugccuggucgcaugaugcaaugaguauuuuuagacgagggaauuauuucaagggccauga

SEQ ID NO: 14515 - RNA, 69 nt, Human
acuggugacacaugcuggagccaagugcuaacauugccuugguuccacgggcaugugacagucacccgu

SEQ ID NO: 14516 - RNA, 62 nt, Human; identical to SEQ ID NO: 6733

SEQ ID NO: 14517 - RNA, 68 nt, Human
gagcaagcggggcccgcgcagcuucaggggccgcaagggccggggcgccaagggcaucggcuuuccuc

SEQ ID NO: 14518 - RNA, 67 nt, Human
uucggcuggcuagcaggacacugagacuccccucugcuuugggcaguguccgcugcagccagucgga

SEQ ID NO: 14519 - RNA, 67 nt, Human
accagccuggcuaacauggugaaaccccgguuucuacuaaaaauacaaaaaacuagccaggcguggu

SEQ ID NO: 14520 - RNA, 81 nt, Human
ccuguugacagauggagauugggcagcagggccuugcugcauuguuaucugcuguuccgacuugguuugucuuguccaagg

SEQ ID NO: 14521 - RNA, 77 nt, Human
ggcuagaaaagccaaggccaaaggcuggaggggggaggacagucagcauguccagccuggggucuggguguaggguu

SEQ ID NO: 14522 - RNA, 85 nt, Human
aaucuaaggcaaacagacuugaccaucuucagacccacugcauucucaagcugaaguggucugcucauaguuugugugccagguu

SEQ ID NO: 14523 - RNA, 117 nt, Human
gcucagucggugaugaugagcucguccaccccccagucuucauagcucccaucuggcagguaacggcgaaugaugauggggaucuuucgggccuugaguuccuucauggcaaugagc

SEQ ID NO: 14524 - RNA, 88 nt, Human
ggagcgcucgggugcccagcagcgggcucgcucguacuuggucauguaugguguggugauucgcuucugguuggccugcggucgcucc

SEQ ID NO: 14525 - RNA, 106 nt, Human
aguuugccauguuucuucugugccuaccauucucccuuggccucaacuucuguaagaugggggggggacaaaaagagaaguaaaguuaagaagaaaguggaaaauu

SEQ ID NO: 14526 - RNA, 71 nt, Human
gaugucaaaguuuuuacaugcauauauuucagcuuaugcugaagaccuaccuguauguugcacauugaauc

SEQ ID NO: 14527 - RNA, 82 nt, Human
uuuuuuuuuuuuuuaaacauagagcugcgagagaguagggcaucccuuguggugguaccucuauguuuaaagaaagaagaaa

SEQ ID NO: 14528 - RNA, 64 nt, Human
ggggguuuugugaagaccuuuccugucccacaugacuagacgaugaggcauucacauuauuucc

SEQ ID NO: 14529 - RNA, 74 nt, Human
gucaaagaaaauagggcuuuuggcauucucauuaguuagaaauauauuuaggaugucuucccuuuucuuuagac

SEQ ID NO: 14530 - RNA, 80 nt, Human
ggaaagaaggaaaaaaggaaggaaagaaguaauauugugacuuucuugcucuuuaaaaaaaucccugucuccuucuuuuc

SEQ ID NO: 14531 - RNA, 60 nt, Human
ugggaauucacauuuuaauguuucaguagccugaacaacucaaauugauguguaccccca

SEQ ID NO: 14532 - RNA, 64 nt, Human
cuuauucccuaauagaguuaagaagcuuauacagcauccuggccaaacaaguuaugggaguagg

SEQ ID NO: 14533 - RNA, 61 nt, Human
gccucuggguccugggcagauacagccuuugcugugggagggaugugggggaccuugaggc

SEQ ID NO: 14534 - RNA, 89 nt, Human
acucauuuuuaaggucgggaguuagauuuuaugauagaauuaugacuguuagcuuuucuccuuauagcaucuuagucuuagaaaucggu

SEQ ID NO: 14535 - RNA, 71 nt, Human
auugaugaauucuguaucuucucugguuuccuguaucuuuuuaaucaagucuagaaacuauguucaucagu

SEQ ID NO: 14536 - RNA, 99 nt, Human
uaauuauuuuaaauguguuaauacugugccuuugauaaguuagcuuuaaaguuaguuuaagacuuuuacacugccaguauuccacauuuggugaaauua

SEQ ID NO: 14537 - RNA, 67 nt, Human
ccuaagucugaagucucaucagacgaacgacauccaguucagccuggugacaagaaucggacugagg

SEQ ID NO: 14538 - RNA, 64 nt, Human
gggcaaagucucuggggagcgguuaggagguggaaagccagaagugcugacacagauggugucc

SEQ ID NO: 14539 - RNA, 74 nt, Human
gguuugcgcugcuaugagaaucuaaggcugccacugaucugacaggaggcagaacucagguggcaaugcuuacu

SEQ ID NO: 14540 - RNA, 73 nt, Human
uucuggagugaguuauuagcauggaagaaggaggaagaucuugggaucaaacgugggugaugguacuucagga

SEQ ID NO: 14541 - RNA, 82 nt, Human
guucaauccagcuuguugcuaauauuaguuacccuuguuuuaaugacagagaguggcuggaaucuguagcuaggggaggggc

SEQ ID NO: 14542 - RNA, 129 nt, Human
ggacaggcaauuuagucauuaugauaauaaggaaaacaguguuuuagaugagagaucauuaaugcauuuuucccucaucaagcauauaucugcuuuuuuuuauuuugcaauucucuguauucuaugucu

SEQ ID NO: 14543 - RNA, 61 nt, Human
agcugcccuccucuucuccccucacacuacagcccuggugggggagaagggggugggugcu

SEQ ID NO: 14544 - RNA, 62 nt, Human
ccuucgccugccugugucucuccccaaaccccuuuagauggggagggaagaggaggagaggg

SEQ ID NO: 14545 - RNA, 69 nt, Human
ggucugguccccguguugccuauuagcccuuuacccugagcaccaccccaacagacuuggggaccagcc

SEQ ID NO: 14546 - RNA, 70 nt, Human
uuuggcuuaacauucaagcaccuggaauaaagaucucccgggguuucguuguugcacaaaaucagccaaa

SEQ ID NO: 14547 - RNA, 80 nt, Human
gaaguugaucuacuuccagcugcaccgggcccucaagaugauuguggaucccguggagccacauggcgagaugaaauuuc

SEQ ID NO: 14548 - RNA, 80 nt, Human
cauagcacaggagauucagagggcugggaugacuucugagcugcucucuauacccaaggcccuuucaauuucuagcugug

SEQ ID NO: 14549 - RNA, 70 nt, Human
ggagguaauaaagucaaagaauccuucgguugaauuuuagguuuaauuuucuucggugcuccuucccucu

SEQ ID NO: 14550 - RNA, 66 nt, Human
uccagacuuaaggaaggaagucccaccaguguuuguugcauuugaauuuccuuuaaaaaugcuggg

SEQ ID NO: 14551 - RNA, 61 nt, Human
caugcucuugcgaagcuugauggggcgcgagcccacauacuucccauucaucucacgcaug

SEQ ID NO: 14552 - RNA, 64 nt, Human
cgcgcacguagucgcugggguccuugaagcugacgaagccguagcccuuggucuugccugugcg

SEQ ID NO: 14553 - RNA, 83 nt, Human
ugcucugcaaccuuagacaccucugccagaccuuugucuucgagaaagagacaugcuguacagguaagguccccaggagagca

SEQ ID NO: 14554 - RNA, 91 nt, Human
gcuuuugggaagugaugagucauuuugcaccagguaauaggggaaaauugugugaccuccagcaaacacaugaaugguuauuuccuggagc

SEQ ID NO: 14555 - RNA, 63 nt, Human
ggcaugugccaccacacccaauugacuuuaguauuuuuaguaaagacaggguuucaccaugcu

SEQ ID NO: 14556 - RNA, 82 nt, Human
ggugcaggccucacuugagccugggaggcggagguuggcuaacugcaaccucugccucccaggcucaagcgauucuugugcc

SEQ ID NO: 14557 - RNA, 71 nt, Human
ucgaacuccugaccucgugaucugcccgccuuggccucccaaagugcugggauuacaggcaugagccucgg

SEQ ID NO: 14558 - RNA, 106 nt, Human
uguauuuuuaguagagaugggguuucacuauguuggccaggcuggucaugaacuccugaccucaagugaucugccugccuuggccucccaaauugcuaggauuaca

SEQ ID NO: 14559 - RNA, 96 nt, Human
augugaguacucgaguugauaauucccucuaucuuuuuaaacccauaaacuacauuuuuaaaaaaaucaaugggaguuuuaaauuuugacucaugu

SEQ ID NO: 14560 - RNA, 79 nt, Human
caggaagucugauuuuuuuuuuuuggagucuuuguugcuauauuuuguggggcugggagagagagauuagauuauuuug

SEQ ID NO: 14561 - RNA, 109 nt, Human
agcgguugacccuccuggcuccccugaauucuguauucaaagauggaaccccuccaauugaugcccauacaaggaauuugcuucggaaccacauaauuaaagaccagcu

SEQ ID NO: 14562 - RNA, 68 nt, Human
uucagacaagccggccucggcaaucaucucucuggaagugagcgguugacccuccuggcuccccugaa

SEQ ID NO: 14563 - RNA, 85 nt, Human
ggcacagugagacagauguggaagagcagacccaggagcugaagaccaucacucagcuccagggugagccugcaccgccgugacc

SEQ ID NO: 14564 - RNA, 87 nt, Human
ucugaguggcggcucugagcaagcugagcccagggaggcuuugagguacacagggucccuuggggggccuaagagcagccaugagga

SEQ ID NO: 14565 - RNA, 84 nt, Human
cugaugaucauuuuagauagguaaggugaucuccauguaagggagggccaacaucuaccuuagaagcuaaaugugucacaucag

SEQ ID NO: 14566 - RNA, 77 nt, Human
uguugaauuuagggcaaaaugacauguuuauauuuuaaauaaaugaaaucuagucauuaaagagucuuaauaaagca

SEQ ID NO: 14567 - RNA, 65 nt, Human
auguaagucauugugucuaugaugccacuuuuaaaaggaaaaugcaauugcguaauggcuuauau

SEQ ID NO: 14568 - RNA, 61 nt, Human
auuguuugaauguuuuauucagcuuaaaacuuuacccaugaagucauaaacaguaaacaau

SEQ ID NO: 14569 - RNA, 78 nt, Human; identical to SEQ ID NO: 13039

SEQ ID NO: 14570 - RNA, 63 nt, Human; identical to SEQ ID NO: 13040

SEQ ID NO: 14571 - RNA, 74 nt, Human
ggaggcucagcccacccuccagcuuuuccucaggguguccugagguccaagauucuggagcaaucugacccuuc

SEQ ID NO: 14572 - RNA, 72 nt, Human
gaacugaagcuggggcugcagcuguggccuugguuugauccuuggccuuggcucuggccuuggcucuggcuc

SEQ ID NO: 14573 - RNA, 63 nt, Human; identical to SEQ ID NO: 11285

SEQ ID NO: 14574 - RNA, 65 nt, Human
cauugcacaauaucaugcuaccucuugaaucuuuaaaauauucaauuggcaaauguuuuucaaug

SEQ ID NO: 14575 - RNA, 61 nt, Human
cagcccucacuucuccauccuggaggucuuccagcaggaggucuuucacggggauuggcug

SEQ ID NO: 14576 - RNA, 91 nt, Human
gugggucugacuugggggccauuuuagaaacugacucugaagaaguuuuuaauucucucauuguugcugaaugccccucgcagggagccac

SEQ ID NO: 14577 - RNA, 130 nt, Human
uggacaggcagaggcugaggcugcugcuauccagggaagacacacccucacgcugcgugcccucuaggugcacucggcaagccaggguuccagcuucaccaggaccaggcucuucuccuugggccuccca

SEQ ID NO: 14578 - RNA, 75 nt, Human
cuggaggaggagaagaagcaucuggaguuuaugaaucagcugaaaaaauaugaugacgacauuuccccauccgag

SEQ ID NO: 14579 - RNA, 60 nt, Human
gccucuggaugaccuuuuuccccaaugaugaagacgacccagggcaaggaauccagcagc

SEQ ID NO: 14580 - RNA, 74 nt, Human
ucaguggcuacgggaugaacuggccaacacgcagcagaaacugcagaagagugagcagucuguggcucaacugg

SEQ ID NO: 14581 - RNA, 93 nt, Human
guacuggaaugcuaagauaaaagaacuguauaguuucuguuauguaauacgagaauagaaauguuauuaaaaucuuucuauaauuuccagugc

SEQ ID NO: 14582 - RNA, 70 nt, Human
uaguaugaaacuuaguguuuuaguagaucuugugauuucugaaaacgaauuucuucuaaacaucaagcua

SEQ ID NO: 14583 - RNA, 61 nt, Human
ggggaguuugugcugggccuggcgucccaggcuguggacuggaacuggacaugagaacccc

SEQ ID NO: 14584 - RNA, 73 nt, Human
ggugguggacugcacuccggggccauuuaaugucuuuaggccuugagucucggcuucggucccagucaacgcc

SEQ ID NO: 14585 - RNA, 67 nt, Human
uccccagacuuccaagcaaggugggcuggcuaacgucccuccuaccugucgcagguuaucuggguga

SEQ ID NO: 14586 - RNA, 72 nt, Human; identical to SEQ ID NO: 14437

SEQ ID NO: 14587 - RNA, 80 nt, Human
agaguucaauauaucgauguugcauguuauuuuuaucuuuagacauggcagcuacugcaucuucaugugucacaaacucu

SEQ ID NO: 14588 - RNA, 67 nt, Human
auuccaucucuuccguagccucccauuccagaaccucccaugccagagccgccuccaggaguagaau

SEQ ID NO: 14589 - RNA, 62 nt, Human
gguaaugucucuggccgccaccuccaggacccccugggccuccuccaggccgguacagcacc

SEQ ID NO: 14590 - RNA, 65 nt, Human
gcaguugcagaaaggaaugucagucagaaaugaauuguguuucagucacucugcaugguugcugc

SEQ ID NO: 14591 - RNA, 64 nt, Human
gggccacuaauagaugaauuucuugcacucccaagaacaagccucucucgucuuccaaaugcuu

SEQ ID NO: 14592 - RNA, 63 nt, Human; identical to SEQ ID NO: 7225

SEQ ID NO: 14593 - RNA, 93 nt, Human
gaugaagucuugcucugucgcccaggcuggagugcaauggcgcgaucucggcucacugcaagcuccggcuugguaacagagcgagacuccauc

SEQ ID NO: 14594 - RNA, 68 nt, Human
gcugggaaaacguaucugguuuggguccuaagagucccagugagaccagguugcuguaguucuccagc

SEQ ID NO: 14595 - RNA, 65 nt, Human
agugauggucaguauuucuuugaaauucuacaaggaacuucaggcacaugugcugaugaguuauu

SEQ ID NO: 14596 - RNA, 69 nt, Human
uguuuugccucugucuuugaaaaauacuuccaauuccaagaagagggcaaggaaggagagaacagagca

SEQ ID NO: 14597 - RNA, 74 nt, Human
acuuccgcugcaggcugacuuauucccaucagcaccaaagccgcuggagggggucauccacuagcaaaugaagu

SEQ ID NO: 14598 - RNA, 83 nt, Human
gcuuucuuuaggaucucucuugcacuguccaacucagagaauuucaaaucuugauggauuccaaugauggagcuaaaucaggc

SEQ ID NO: 14599 - RNA, 75 nt, Human
cugggguguuuauggcaagucacuugauacauuauuguggcaaauguugucugacuuacuguuucaacaaaccag

SEQ ID NO: 14600 - RNA, 65 nt, Human; identical to SEQ ID NO: 247

SEQ ID NO: 14601 - RNA, 80 nt, Human; identical to SEQ ID NO: 100

SEQ ID NO: 14602 - RNA, 79 nt, Human
auggaaaacuuuugaggaggggcuagcuaaauaagggguccagguaaugguggcccuugcaaccuuaagaccuagaaau

SEQ ID NO: 14603 - RNA, 64 nt, Human
gcagcgaggaaugucagguagugaucagccugugaaggcaaacagauguggcaccacuuggggu

SEQ ID NO: 14604 - RNA, 74 nt, Human
agggguguaggugugccuugugguaagaagugggcuagggcauuuuuaaucuuagagcgaaaccuauaaucacu

SEQ ID NO: 14605 - RNA, 71 nt, Human
gcccgcucauaaggggauggccauggcgagguuuauagauaguugggguggugaguguaaaugagugaggc

SEQ ID NO: 14606 - RNA, 77 nt, Human; identical to SEQ ID NO: 9246

SEQ ID NO: 14607 - RNA, 100 nt, Human
ggacuacacucccggaggacaagcggucucugcaaauuggcuguggcgcugccuucguuggcagugucuccgacagaugcuggcuuuggcuagugugucc

SEQ ID NO: 14608 - RNA, 89 nt, Human
guaucagaaagacuuguguuaaaucaguccgcccuuuaacuugcgcaaaggcauggcgcggggugacuuggccagucugaccugagugc

SEQ ID NO: 14609 - RNA, 63 nt, Human; identical to SEQ ID NO: 7379

SEQ ID NO: 14610 - RNA, 67 nt, Human; identical to SEQ ID NO: 7380

SEQ ID NO: 14611 - RNA, 73 nt, Human; identical to SEQ ID NO: 7381

SEQ ID NO: 14612 - RNA, 69 nt, Human
aacugggcuuucccaguauuucaaaaagagauaauauaucuguuaacguuauuggaaugcugcucaguu

SEQ ID NO: 14613 - RNA, 67 nt, Human
gaaauguuauuuuauuagaucuaacucuucauaguauguaaauguuagaacauuuuaauaauauuuu

SEQ ID NO: 14614 - RNA, 79 nt, Human
gugugaguugggauguauggauaugugauagucauauuuucaagguauggauguuuggugauaacgucucagagcaugc

SEQ ID NO: 14615 - RNA, 69 nt, Human
uucuucuuaccacagguccacucacaaaucgcagcugguauggacugguacugccccaaauaagaggaa

SEQ ID NO: 14616 - RNA, 80 nt, Human; identical to SEQ ID NO: 9351

SEQ ID NO: 14617 - RNA, 65 nt, Human
augagauuugggaggggccaggggcagaaugauaugguuugacuguguccucacccaaaucucau

SEQ ID NO: 14618 - RNA, 75 nt, Human
ucugaauuaauguugaaaugaguuaagacuuucggagacuguugggaaggcaugauugguuuugaaaugugagga

SEQ ID NO: 14619 - RNA, 86 nt, Human
uacguagugaggaucacaugcaugaagaauccauugcucgcugaaagaagaucuuggaaugagugcguggauccacaauucaugua

SEQ ID NO: 14620 - RNA, 99 nt, Human
ucucuuuucauauuauaagauuuuagcaauacuuccaauauugauuuccuuaccaaauggaaucuauaagcuaaauuuuuaaaaauuguuaaaggauga

SEQ ID NO: 14621 - RNA, 85 nt, Human
aagauuguuucagggugucucagggucccucuguaccaucugcuguggaaugcaggacccucugugacauucuuuaucccuucuu

SEQ ID NO: 14622 - RNA, 62 nt, Human
cagaggaugugagaggcagaggcaggcuccuggggcugagcuccuuccucugcaucauucug

SEQ ID NO: 14623 - RNA, 127 nt, Human
ucucagggucccucuguaccaucugcuguggaaugcaggacccucugugacauucuuuaucccuucuuccccggguuggugugcauggagggucuugucugcugugauucgacucuggaugcuguga

SEQ ID NO: 14624 - RNA, 61 nt, Human; identical to SEQ ID NO: 14051

SEQ ID NO: 14625 - RNA, 72 nt, Human
ugaugucaguuccuuugcgcccugacugcaucaucaugcggcggcgaacggugucaaauggauaggaaguca

SEQ ID NO: 14626 - RNA, 62 nt, Human
ugccucugagaacauuggaccaugcacccuugaaaaaagcuuugccuccuucaucacgagca

SEQ ID NO: 14627 - RNA, 75 nt, Human; identical to SEQ ID NO: 12674

SEQ ID NO: 14628 - RNA, 96 nt, Human
gcgagaccccaacggcugguggcgucgccugcgcgucucggcugagcuggccauggcgcagcugugcgggcugaggcggagccaggcguuucucgc

SEQ ID NO: 14629 - RNA, 68 nt, Human
ggccuccaugccuauguggugguacaaugucacugacggauccugccagcuguuuguguaugggggcu

SEQ ID NO: 14630 - RNA, 64 nt, Human
ccuuguuuuaguugaauaugaagaaagucaguaguccuacagauacguaguuagaaaaaggagg

SEQ ID NO: 14631 - RNA, 67 nt, Human
gcauaaauguuuuuuaugaagauaacuuuucuaaagcaaaaaugugagaagugccaucauuuuaugc

SEQ ID NO: 14632 - RNA, 62 nt, Human; identical to SEQ ID NO: 14622

SEQ ID NO: 14633 - RNA, 89 nt, Human
ggaagauuguuucagggugucucagggucccucuguaccaucugcuguggaaugcaggacccucugugacauucuuuaucccuucuucc

SEQ ID NO: 14634 - RNA, 70 nt, Human
cccaaguagcugggauuacaagcaugugccaucacaccuggcuaauuuuuguauuuuuaguagagauggg

SEQ ID NO: 14635 - RNA, 74 nt, Human
ccucgugaguagcugggauuacaggagcaugccaccaugacugucuaauuuuuguauuuuuaguugagacgggg

SEQ ID NO: 14636 - RNA, 67 nt, Human
cacuaguuucucgguacuaugcauaugauccaauaucaaaggaaaugauagcauugaaggacucgug

SEQ ID NO: 14637 - RNA, 61 nt, Human
ggacaucuaacagcauacugaucacuacuucgcacuaguucucgguacuagcauauggucc

SEQ ID NO: 14638 - RNA, 72 nt, Human; identical to SEQ ID NO: 9079

SEQ ID NO: 14639 - RNA, 127 nt, Human
ucggggauaucuaacagcaauaccugaucacuacuucgcacuaguuucucgguacuaugcauaugguccaauaucaaagggaaugauagcauugaaggacucggggauaucuaacagcaauaccuga

SEQ ID NO: 14640 - RNA, 88 nt, Human
acuuucaagcuccuggggaaauguugcugguugaccguuuuugggcaauccauuuucggccaaagauuucacccuugagguugcaggu

SEQ ID NO: 14641 - RNA, 80 nt, Human
gaguggccugguagaagguugagugcacgucuuuguccccucuggcagcagauucuaguagcugauuuuagcagguccuc

SEQ ID NO: 14642 - RNA, 64 nt, Human
gcguuguuaacagacuccugacgcccacacauucguuccuggccagaaguaaaagcacagcugc

SEQ ID NO: 14643 - RNA, 83 nt, Human
ggcucagucaaagcugcuccugcucagguccggcccccauccccgggaacauccgccugucagagggaagucaaaguggagcu

SEQ ID NO: 14644 - RNA, 66 nt, Human; identical to SEQ ID NO: 11638

SEQ ID NO: 14645 - RNA, 60 nt, Human; identical to SEQ ID NO: 11639

SEQ ID NO: 14646 - RNA, 62 nt, Human; identical to SEQ ID NO: 10420

SEQ ID NO: 14647 - RNA, 89 nt, Human
aggcacauuggguaucauucauuacauucuugaguuuuuaggguuuucucuuuucuucuggagacagucuugcuguauugcccaggccu

SEQ ID NO: 14648 - RNA, 61 nt, Human
gaugucagucccaaggaccaguagcugccaucaguuuggauucugaaaacuaacuggcauc

SEQ ID NO: 14649 - RNA, 74 nt, Human; identical to SEQ ID NO: 4266

SEQ ID NO: 14650 - RNA, 74 nt, Human
cuugcagucauacagaggagcuggccacgaaauacgagaggcaauccagcauccagcagaugagaaguugcaag

SEQ ID NO: 14651 - RNA, 62 nt, Human
guuguuccacuaguaggcaaauuaaagaaauuuuacgaauuuucucagagguuagaagcagc

SEQ ID NO: 14652 - RNA, 81 nt, Human; identical to SEQ ID NO: 13161

SEQ ID NO: 14653 - RNA, 92 nt, Human; identical to SEQ ID NO: 13162

SEQ ID NO: 14654 - RNA, 76 nt, Human
gacgcugccagcucgggacucuguuccaccgugguggucugccccuacagugcugcaggcugagcugacauuuguc

SEQ ID NO: 14655 - RNA, 93 nt, Human
ucaggagccaggguaccacagccucaagggcucucaggagguuguaacugaggguuguuuuuugggguccaucaucuuggggucuucuucuga

SEQ ID NO: 14656 - RNA, 102 nt, Human
ggaaacuucaguuuuuauaaucuuccuaaauugauccuuuauguugauaaacagugucgauauuaaggagcucauuaauuuuggaagauccauaucugaucc

SEQ ID NO: 14657 - RNA, 113 nt, Human
cuuuaauugauaaagccagaguggagacacagaaccacugguucaccuacaaugagacaaugacaguggagagugugacccaagcuguguccaaucuggcuuugcaguuggag

SEQ ID NO: 14658 - RNA, 70 nt, Human
auuuuauuuuccccacaacaaagaauuaucccacuucucuaguaauuuccaucgugcaagaauguagaau

SEQ ID NO: 14659 - RNA, 61 nt, Human
uaaagggucaugggagagaaaagguaucugugggaagagaauaaucucuuuugacuucgug

SEQ ID NO: 14660 - RNA, 75 nt, Human
ggggcuaggguuucgcuauguugcucaggcuaguuucaaacuccuggguucaagugauuuuucuaccucugccuc

SEQ ID NO: 14661 - RNA, 87 nt, Human
ugaccuggcggacaggugggagccacagcguacaccccaugauucccucugugcugugcguagugccuacugcuugcuuccagguua

SEQ ID NO: 14662 - RNA, 67 nt, Human; identical to SEQ ID NO: 1379

SEQ ID NO: 14663 - RNA, 63 nt, Human; identical to SEQ ID NO: 1366

SEQ ID NO: 14664 - RNA, 86 nt, Human; identical to SEQ ID NO: 1381

SEQ ID NO: 14665 - RNA, 91 nt, Human
aaggaaacauuuauaaauuauuauaccuaagaaaaggcacaaaaagccuuuuacuuauuuuuauugauuauugaugugauauauuuuccuu

SEQ ID NO: 14666 - RNA, 69 nt, Human
caaagacuuacugauuaagcaaaucccuacuugacaacaucuacguauuguuuguaacuucaauuuuug

SEQ ID NO: 14667 - RNA, 66 nt, Human
uaaauaaauauggcaguaauagucauuccuauuucauuagggauauaucuucuucauauuaauuua

SEQ ID NO: 14668 - RNA, 61 nt, Human
uaguuuauuucauaaaaauacaaaaauauaaauauacauuuauaaaaauaugaaugaauua

SEQ ID NO: 14669 - RNA, 89 nt, Human
aguagugggagcacuguguuuagaguuaagagugaacacuguuugauuuuacuuggaauuuccucuguuauauagcuuuucccaaugcu

SEQ ID NO: 14670 - RNA, 81 nt, Human
gaugauccccaagucuuagcuguugcugcucacgauguuggagaauaugugcggcauuauccacgaggcaaacgggucauc

SEQ ID NO: 14671 - RNA, 74 nt, Human
uagggaggcggaucauuugaggucaggcguuugauaacagccugggcaauauggaugaaaccccgucucuacug

SEQ ID NO: 14672 - RNA, 72 nt, Human
cuacugguagaaagccaaaucuuuucuugaugaaaaugcauuacaugaaauuuuaagucuuucugucuauag

SEQ ID NO: 14673 - RNA, 61 nt, Human
ugcguguccuaacugguuggaaaaacugugaucaccacuucaaguguagggacuccucgca

SEQ ID NO: 14674 - RNA, 71 nt, Human
ccaggcaugguggugcaugccuguagucccaguuacuuggaaggcugaggcugagaaucacuugaaccugg

SEQ ID NO: 14675 - RNA, 63 nt, Human
cgagacuacuuacuuucuccaguguaccuagggaacccucaggucucuagagugagggucuug

SEQ ID NO: 14676 - RNA, 66 nt, Human
agccccaucauuuaauuucuggggggggcgaaguuagaagguaaagcuggagaagaugaagggguu

SEQ ID NO: 14677 - RNA, 63 nt, Human
ucaacuuagagaauuggagauacaacagauuagaugaaauaugucagaguucgauagaaauga

SEQ ID NO: 14678 - RNA, 81 nt, Human
agccuuguggcugaggccugugacacuccggaacacugggaggcaguaccccagagccuagcaggccgacaagcaaggacu

SEQ ID NO: 14679 - RNA, 75 nt, Human
uccagugaccugggaagcgaagaagaggagguggaauuugggccaggacuuacuucuuugacauggggaucugga

SEQ ID NO: 14680 - RNA, 76 nt, Human
aaugaggcuuuugcuaaguggccagacuugggauuugaucuuccucacuuguuauuuauuaaguuuaagccuuauu

SEQ ID NO: 14681 - RNA, 72 nt, Human
uuauguuuggcuuucucugauuuguccaaagcuggaaguggggacaaaaauuagggaggcugucaguuauga

SEQ ID NO: 14682 - RNA, 87 nt, Human
gaacuccugggcucaagcaagccucaugccuuggcucccaaagugcugggauuacaggcgugagacaccgagcccagguuaaaguuu

SEQ ID NO: 14683 - RNA, 77 nt, Human
cugcccuagccaggggcacuggccagccugguuccaggcccacauggccuagucagugccucgaggagcugguucag

SEQ ID NO: 14684 - RNA, 70 nt, Human
aacuuaaauucuuuguaccaguuaaaaaaaauguauaaaauuuacaucugugcaguggaguuguuaaguu

SEQ ID NO: 14685 - RNA, 70 nt, Human
caugauaaucauauucggauuuauagaagcauuuuacaaguauugcaaucauugaguagagauaaucaug

SEQ ID NO: 14686 - RNA, 67 nt, Human
gguacuuuuugaaacgugacugcguugugugaacaaucugcaauuuuucaguccgugagauccugcc

SEQ ID NO: 14687 - RNA, 74 nt, Human
gcuuuucuugaucacuguggcuggggacccgcuagcgcguuaucauccugugucgcaguggcauuuagucuggc

SEQ ID NO: 14688 - RNA, 65 nt, Human
ucucuguccuucuacaggagguguuccgcuuugccuacuacaagcugcuucacgaaggcagauga

SEQ ID NO: 14689 - RNA, 62 nt, Human
cccaaaggauggcuggagggcucggcugcggcgcggguccccgaagacuuggccagguuggg

SEQ ID NO: 14690 - RNA, 86 nt, Human
gucccuucccuccccaggccucgcuuccccagccuucugaaagaaggagguccaaggggaucgagggcuggcggggagaagcagac

SEQ ID NO: 14691 - RNA, 74 nt, Human
aguugugacugaaaacacugaaaccuaccacguccagauucacuggauugggggauagaggaacggucacagcu

SEQ ID NO: 14692 - RNA, 84 nt, Human
aggcagaacggaggguggcgggggacaaacgcgcgggacaauuuucucuccagcugguuaauuuuucuccaauauuuguagccu

SEQ ID NO: 14693 - RNA, 62 nt, Human
aguuauuugcuucaucuugaccuguuuuuuuaaauguaaacuuuuaaggacuugagauaacu

SEQ ID NO: 14694 - RNA, 67 nt, Human
guugcccaggcuggagugcaguggcaugaucucgggucacugcaaccucugccucucggguucaaac

SEQ ID NO: 14695 - RNA, 60 nt, Human; identical to SEQ ID NO: 8964

SEQ ID NO: 14696 - RNA, 86 nt, Human; identical to SEQ ID NO: 8965

SEQ ID NO: 14697 - RNA, 64 nt, Human
auccucaggcuuuucccuaccaguuuggcgcaccuuugaaagcuggcggggccugcuggggggu

SEQ ID NO: 14698 - RNA, 61 nt, Human; identical to SEQ ID NO: 1283

SEQ ID NO: 14699 - RNA, 91 nt, Human; identical to SEQ ID NO: 1284

SEQ ID NO: 14700 - RNA, 74 nt, Human
acuuggaaauaaauaugaauugguagguuaccuauuaaacaaguguguuagaguagccuagcaguuuucaaagu

SEQ ID NO: 14701 - RNA, 72 nt, Human; identical to SEQ ID NO: 1989

SEQ ID NO: 14702 - RNA, 90 nt, Human; identical to SEQ ID NO: 14224

SEQ ID NO: 14703 - RNA, 65 nt, Human
uuaugcugcagcauauuguacuggccugcugcuggcccgcaggcuucucaauagguuuggcaugg

SEQ ID NO: 14704 - RNA, 81 nt, Human
acaaagcuccaucuauguauucuucuguauuugcaagcugcauguucauguagccaucuacagauaccagauagcccuugu

SEQ ID NO: 14705 - RNA, 76 nt, Human
aaggccauucaaguucaagcacagagauacaaaucuuucagagccccaucuaguuguguuugaaauaugugaccuu

SEQ ID NO: 14706 - RNA, 77 nt, Human; identical to SEQ ID NO: 283

SEQ ID NO: 14707 - RNA, 72 nt, Human; identical to SEQ ID NO: 284

SEQ ID NO: 14708 - RNA, 64 nt, Human
aagaucaaaugacagucgaacucagaaauugaccaaucuaggccucugagugucaguguuucuu

SEQ ID NO: 14709 - RNA, 107 nt, Human
ggcagcagcuucaaucuucaguuauuccacagcuaucuugaggcuaauugauacugucugccucuucagcuuaugguaucagugacaugagauuugaaaaugaugcu

SEQ ID NO: 14710 - RNA, 99 nt, Human
guuaagugguaaaaauuaugagagugauuuauagagcugugccuuaaauauuuuauuuauccauaucuucuaaauucauuuucauggcaaucaguuaau

SEQ ID NO: 14711 - RNA, 83 nt, Human
auuuuuuaacaccuacagaacuguuuauuuguuuggauacuggaugauucaagcucauuaaguccugggggaaaaugaaaaau

SEQ ID NO: 14712 - RNA, 74 nt, Human
ggagcgcuggaugaaagaagacugcacucacugcauuugugagguuugugcugcgaguuuuccaguccaacucc

SEQ ID NO: 14713 - RNA, 74 nt, Human
gccaauuagagguuaaauaaauugcuuaaaaguguucucaaaacuugcaguuucuucaaucuuaugaaauuggc

SEQ ID NO: 14714 - RNA, 68 nt, Human
gcuuagauaagucuggguucuacucccaaagccucuaggcuaggcauggagcagcccaauuaucuagc

SEQ ID NO: 14715 - RNA, 60 nt, Human
aagauucaucagugacacaaggauuuauuuauuaucauuuucuauaacacugauggucuu

SEQ ID NO: 14716 - RNA, 76 nt, Human
ggugcccauccuuauguacauaguguuuucaauguuuagcuccgacuaccaaacgagaucaugcagcuaggauacc

SEQ ID NO: 14717 - RNA, 61 nt, Human
ugccuuuuauacaaugcucaugaaucuuuuuuguuaagaccacaaaagcaauaaaaaugca

SEQ ID NO: 14718 - RNA, 91 nt, Human
cagaaacagauccaccuccagguacgugguggacgaaugggagcagcuggcugcuggccccacgcuuaccaaccuugaguccacauuuuug

SEQ ID NO: 14719 - RNA, 60 nt, Human
ggccguuggcuugaucacucacgacacuauuacugacguuaguuauuauacugccgugcc

SEQ ID NO: 14720 - RNA, 71 nt, Human; identical to SEQ ID NO: 8542

SEQ ID NO: 14721 - RNA, 67 nt, Human; identical to SEQ ID NO: 8543

SEQ ID NO: 14722 - RNA, 88 nt, Human; identical to SEQ ID NO: 8544

SEQ ID NO: 14723 - RNA, 61 nt, Human; identical to SEQ ID NO: 347

SEQ ID NO: 14724 - RNA, 74 nt, Human; identical to SEQ ID NO: 3804

SEQ ID NO: 14725 - RNA, 63 nt, Human; identical to SEQ ID NO: 7988

SEQ ID NO: 14726 - RNA, 75 nt, Human
ggggcuugcacugccuucucaggccagcuauacccuagcugagcaaagaacugaagaagcaaguguccacucccc

SEQ ID NO: 14727 - RNA, 78 nt, Human
cggagcaccaggugcaagguggacucuuucuggauguuguagucagacaggguacgaccaucuuccagcuguuuuccg

SEQ ID NO: 14728 - RNA, 85 nt, Human
ccagucagcucaggccucuauggagcaaagaaacugguguccuucuuggagcgcugccuucaucuccuugaacugagccaacugg

SEQ ID NO: 14729 - RNA, 76 nt, Human
cccccaagcugggcccgcgacucgaaggugacugggauggugaucucguuggacugcguggcuagcuugggcaugg

SEQ ID NO: 14730 - RNA, 69 nt, Human; identical to SEQ ID NO: 9003

SEQ ID NO: 14731 - RNA, 70 nt, Human
gccuggacuugcaacugguggggaugagggcagucuggggccagagcccucccacugugggaucugaggc

SEQ ID NO: 14732 - RNA, 88 nt, Human
ucugugagccgcuccagcaaauuaauugaaccaaaagaggggguugugguaacucccaacuugaaggcaguuagugagaaguuccaga

SEQ ID NO: 14733 - RNA, 68 nt, Human
gaagacucuguagcuccuccagauucucaaugcauuuaauuaaauuuuggcggaggcagagagucuuc

SEQ ID NO: 14734 - RNA, 72 nt, Human
ccuccgugacugucaccucaucgucgugcagaaugaaggccguguagaugcaggugagcucggugacagagg

SEQ ID NO: 14735 - RNA, 82 nt, Human
gagagguuuagucaagaauaccaaagcccaugucaucaucagacuccucggauucuucuuucuuugcuuccacuugcuucuc

SEQ ID NO: 14736 - RNA, 77 nt, Human
gaacauucgugcugagcccuuugaaagugauaugauuguauuauuuaaaugaguggggcuggggcaugguaguguuu

SEQ ID NO: 14737 - RNA, 71 nt, Human; identical to SEQ ID NO: 1050

SEQ ID NO: 14738 - RNA, 77 nt, Human
ugcgugaccuggcagcuguagcuucugugggacuuccacugcucaggcgucaggcucagauagcugcuggccgcgua

SEQ ID NO: 14739 - RNA, 81 nt, Human
guccaggggugggaauacagggggugggaggugugcauaagaggugauaggcacaggccagcccgguacagaccccuaggc

SEQ ID NO: 14740 - RNA, 62 nt, Human; identical to SEQ ID NO: 186

SEQ ID NO: 14741 - RNA, 62 nt, Human
gaaggugcugacuuccuugggagaugccauaaagcaccugggaugaucucaagggcaccuuu

SEQ ID NO: 14742 - RNA, 76 nt, Human
gcugcauguggauccugagaacuucaagcuccuggggaaaugugcuggugaccguuuugggcaauccauuuucggc

SEQ ID NO: 14743 - RNA, 66 nt, Human; identical to SEQ ID NO: 12

SEQ ID NO: 14744 - RNA, 90 nt, Human; identical to SEQ ID NO: 3033

SEQ ID NO: 14745 - RNA, 82 nt, Human; identical to SEQ ID NO: 3034

SEQ ID NO: 14746 - RNA, 103 nt, Human
uuggacaacugccccuuccaugaccagccacaucugaaaaggaaagcauucugcucuuuccagaucuacgcugugccuuggagggcacaaugaacuugucgaa

SEQ ID NO: 14747 - RNA, 85 nt, Human
caugauaauuugaugaguaaaucaaacuauauaauuuuaaaauuugcauauuuuaaaguuuuaucaguuacuuacagacuguuug

SEQ ID NO: 14748 - RNA, 70 nt, Human
guauauuuccguuuccccaagucuucaccuguccccaucuacccagaucauuugggaaauguaaaugugc

SEQ ID NO: 14749 - RNA, 70 nt, Human; identical to SEQ ID NO: 9761

SEQ ID NO: 14750 - RNA, 67 nt, Human; identical to SEQ ID NO: 1347

SEQ ID NO: 14751 - RNA, 66 nt, Human; identical to SEQ ID NO: 3934

SEQ ID NO: 14752 - RNA, 69 nt, Human; identical to SEQ ID NO: 1348

SEQ ID NO: 14753 - RNA, 60 nt, Human
gguaaaguggcaacggccaauuuggguaucuggucucccaaaaguacuugccgcucuacc

SEQ ID NO: 14754 - RNA, 68 nt, Human
aguugagggcgugccagcugcugcucccgaacucuuucgcacaguaguauacagccguguccucagcu

SEQ ID NO: 14755 - RNA, 71 nt, Human
cagauaaucuaaaacuacgaauacuaccugacuccacaaggguacgguguauucuccaguuuuagcaucug

SEQ ID NO: 14756 - RNA, 67 nt, Human; identical to SEQ ID NO: 3685

SEQ ID NO: 14757 - RNA, 64 nt, Human; identical to SEQ ID NO: 7119

SEQ ID NO: 14758 - RNA, 71 nt, Human; identical to SEQ ID NO: 3322

SEQ ID NO: 14759 - RNA, 77 nt, Human; identical to SEQ ID NO: 12696

SEQ ID NO: 14760 - RNA, 60 nt, Human
ccuuugaacaaccugucgguuuuuaucaccauuuuauagguaagaaaauugggucagagg

SEQ ID NO: 14761 - RNA, 93 nt, Human
gcugauagugugaacaccagcacuaagacuggacaacugugggcuguuaaugugaacaccaguacuaggacuggaugacugugggcuguuagc

SEQ ID NO: 14762 - RNA, 85 nt, Human
cacaccucagccuuccaaguaguugggacuacaggcauauaucaucaugccuggcuaaauuaacuauuuuauuuuaagagaugug

SEQ ID NO: 14763 - RNA, 91 nt, Human
uuuuugagucugggucucgcucugucacccaggcuggaguacaguggugagaucauagcuuacuguagccucgaccucccgggcucaaaga

SEQ ID NO: 14764 - RNA, 69 nt, Human
ggaugucaguacuggcaugugcuuaugacccucgugggcaugauaacuggguacguggaguucuguucc

SEQ ID NO: 14765 - RNA, 86 nt, Human
ggauuuccacaagacggcacccuaugucgucacuggcagcguagaucaaacaguaaaagugugggagugccguugauugugucucc

SEQ ID NO: 14766 - RNA, 81 nt, Human
gggcccaugcucuuaguggggaaaacucuuggagccguuuacuuugagcuuugaacacugaaaccauuguuggcaggguuc

SEQ ID NO: 14767 - RNA, 76 nt, Human
ggucuuuuauuggagaguauacaguacaagcagaucauucugccuuagaggugcuaauucccgaaauuagaagacc

SEQ ID NO: 14768 - RNA, 89 nt, Human
ggaggaugaggaggagggagguggagacguggacaucaccccaggacguuuuguccgcuaucaguucacaccggcauuucuccgccucc

SEQ ID NO: 14769 - RNA, 87 nt, Human
acgcagugcucacggggagcaagugggcaggggacgguccagaucgauggccacccacugagccgcugcuacguggcccccuggcgu

SEQ ID NO: 14770 - RNA, 84 nt, Human
uuucaguucuuuacguauugucacccagagaacaguguucacuaaaaacauuauucccacugccagauagaaaaggacaugaaa

SEQ ID NO: 14771 - RNA, 63 nt, Human
uaugccuggacauugaugcuaacaugaccaugcuuggggaugucucuagcuggucuggggaua

SEQ ID NO: 14772 - RNA, 77 nt, Human
ucagagaacagaagggguuccugagcagguagccuggggggacaccagagguggcucuggggcuccuccugcucuga

SEQ ID NO: 14773 - RNA, 65 nt, Human
uuauuaaauauauaagcagcuuccuaucuuuuaaauagauauuuaaaugacuuuauauaaaauaa

SEQ ID NO: 14774 - RNA, 69 nt, Human
ccuguucuucauuagacggaccucucucuuucgugcugcuucuucagcaggcuguguaggaagugcugg

SEQ ID NO: 14775 - RNA, 73 nt, Human
gaggaugccauaacaacuccaggggcaauagugcuagugggugcugugcgaaucugguauguuuguacgucuc

SEQ ID NO: 14776 - RNA, 64 nt, Human
gcugggcacuaagaucugcuguccaucaguggucugugcauacuguagaaugguaguacccggc

SEQ ID NO: 14777 - RNA, 66 nt, Human
gugauguccuaugccuuaugcaaagauucuagaggacaacucuauaccucaggucauagacaucau

SEQ ID NO: 14778 - RNA, 81 nt, Human
gugcaauaaagaaaacauuaaauauuuaguuuggacuugaauaucaagucguagaaauuuauuuggaauacuugcuggcac

SEQ ID NO: 14779 - RNA, 68 nt, Human
uguacugcaagaccugacuauucauaacggaaaacgauuucuaaagcaacagcagguauuuuuguaca

SEQ ID NO: 14780 - RNA, 101 nt, Human
cccuagagacuaugucuuuuaacgccguguacgacgucgccagcuagaugggccuuucucggugaggugaguugccugcggcagggugaaugacauuaggg

SEQ ID NO: 14781 - RNA, 64 nt, Human
ggaccucauuagucuuaggaguaauacgcguucgcuguucuucuacauucauuucacuaggucu

SEQ ID NO: 14782 - RNA, 75 nt, Human
ucccguucccccagucagccuggcccugcuggugccuccggcgcuacgggcugggcaagauggcggccuucggga

SEQ ID NO: 14783 - RNA, 83 nt, Human
uccugccaagaucaguuccaacuucagcagcauuauugcagagaaauuacguuguaauacccuuccugacacuggucgcagga

SEQ ID NO: 14784 - RNA, 121 nt, Human
cgggcaaguccaccacuacuggccaucugaucuauaaaugcgguggcaucgacaaaagaaccauugaaaaauuugagaaggaggcugcugagaugggaaagggcuccuucaaguaugccug

SEQ ID NO: 14785 - RNA, 60 nt, Human
ggugacaacaugcuggagccaagugcuaacaugccuugggucaagggauggcaagucacc

SEQ ID NO: 14786 - RNA, 78 nt, Human
uccacuugacaggccuugcgcugccucucaggaugucuacaaauugggggucacuggaugguccuguaggcgagugga

SEQ ID NO: 14787 - RNA, 77 nt, Human
accuucaccuuccucaccaaaagcacucacuuccugguuuccagaaagaggugaagugaaguggugacuauggaggu

SEQ ID NO: 14788 - RNA, 91 nt, Human
cacugcgcuuuaugacgaugccucccauggcucucccaguaguuguucugacuguggcugggccaugccaugcaccucuuuuugcccacug

SEQ ID NO: 14789 - RNA, 62 nt, Human
uucgagccagacaugucaugauuuggguuugcaguccuucucucuggugucuucaggcugag

SEQ ID NO: 14790 - RNA, 64 nt, Human; identical to SEQ ID NO: 7119

SEQ ID NO: 14791 - RNA, 79 nt, Human
gagcaaugguaccauccugggagcccaccuccuugaaagauuagacuccaauuuucaaaauccuaggguuaccuaguuc

SEQ ID NO: 14792 - RNA, 63 nt, Human
gaguaaucguuguguaaacaauagaauggaaugaaauuacauuaaauuguaugcaaauggcuc

SEQ ID NO: 14793 - RNA, 65 nt, Human; identical to SEQ ID NO: 1518

SEQ ID NO: 14794 - RNA, 75 nt, Human; identical to SEQ ID NO: 74

SEQ ID NO: 14795 - RNA, 87 nt, Human; identical to SEQ ID NO: 76

SEQ ID NO: 14796 - RNA, 71 nt, Human; identical to SEQ ID NO: 77

SEQ ID NO: 14797 - RNA, 82 nt, Human
ggcggcggcugaaccggggccugcggcggaagcagcacucccugcugaagcgccugcgcaaggccaagaaggaggcgccgcc

SEQ ID NO: 14798 - RNA, 61 nt, Human; identical to SEQ ID NO: 387

SEQ ID NO: 14799 - RNA, 78 nt, Human
gacucccagccaaauccauccugcucuuccauuucuuccacgauggugcaguguaacgaugcacuuuggaagggaguu

SEQ ID NO: 14800 - RNA, 65 nt, Human
gggacuaguuagcuuuaagcacccuagaggacuaggguaaucugacuucucacuuccuaaguucc

SEQ ID NO: 14801 - RNA, 64 nt, Human
uuugaagcagauguggugauacugagauugucuguucaguuuccccauuuguuugugcuucaaa

SEQ ID NO: 14802 - RNA, 61 nt, Human
gcagggugagaaagucccagccccaagaggcugggcugggaaggagcuggcugagucuugc

SEQ ID NO: 14803 - RNA, 84 nt, Human
gcauccagucgguuuuagcaguacccucagguagucuccgaagagagaugguuugauaaugggucuccuagauuuucuaauugc

SEQ ID NO: 14804 - RNA, 96 nt, Human
guaaucccagcacuuugggaggccaaggcggguggaucaggaggucaggaguucaagugauccucccuccuuggucuccaaaagugcuuugauuac

SEQ ID NO: 14805 - RNA, 83 nt, Human
uaacuggcgaaaagcuuucagaaacacuggagauaucguuagcuucccugauuucuuguguuuccgggaacguucuaagguua

SEQ ID NO: 14806 - RNA, 92 nt, Human
augcuuguauacagaguauuuauacaaauguuuuagcaucuucauaugcgguguuaaccccuaguucuguacagcauauucuguucaaguau

SEQ ID NO: 14807 - RNA, 89 nt, Human
ucugaugcacugcguguuuaaacacagaucaguccuuuuuucuggugcuacuguggaagaagauugucuuugggcaugcugacagcaga

SEQ ID NO: 14808 - RNA, 107 nt, Human
ugguccaugcuuuucugacguucucagaauaguggcuagcuucaaaccugacaagcgcugcuugaagcccgaacacuagagaauguugcugaaagcagaaacggcca

SEQ ID NO: 14809 - RNA, 79 nt, Human
gucaucuuuggcuugcaacauugcccuggaugcugucaagaugguacaguuugaggagaauggucggaaaagagauggc

SEQ ID NO: 14810 - RNA, 63 nt, Human
cuuugugcucauaaguucuuaucauuuagcucccacuuauacguaagaauaugcaguauuugg

SEQ ID NO: 14811 - RNA, 78 nt, Human
ggguuuuguuauacagauuauuuuaucacccagguauuaagcccaguacccaauagugaucucuucugcuccucuccc

SEQ ID NO: 14812 - RNA, 78 nt, Human
gucaauuucgguugauuccaucaauuccaucguuuacguuugcuauugugaagggugcuugguuuuuucaaaauuggc

SEQ ID NO: 14813 - RNA, 81 nt, Human
ugcuauugugaagggugcuugguuuuuucaaaauuggcuuccucagauauuugcaaaacuuuguucaccuguucauaagca

SEQ ID NO: 14814 - RNA, 99 nt, Human
aagaccugagagaauguaagaacauauagaacauccaaaauaagacauaucuuugguuguuuuaaaaccuuuuuguuugccucauuuucuucugugcuu

SEQ ID NO: 14815 - RNA, 65 nt, Human
cccagguauggguacauucuccucuuuuccgugaguuggagaaaccuagauuugucccucuuggg

SEQ ID NO: 14816 - RNA, 92 nt, Human
ugggccucaguguauuggucgggcuugaccguggucuccugguacaucuucccagaucgaggugaaucccuucaggugcucugagagcucca

SEQ ID NO: 14817 - RNA, 68 nt, Human
aaggggaucugaaaaccagagcguccccggcgcucccuucugugccgcccgcuuaggcagguucccuu

SEQ ID NO: 14818 - RNA, 67 nt, Human
acaaauggcauacuaccucucaacauugaguuauuuuuuaaaagucgacuagugugauauuguuugu

SEQ ID NO: 14819 - RNA, 88 nt, Human
gaacuugaguguauucgagagaucaaagagagaguaggcacgucaaaaguuuagguuuuacucagugguggaguagacucaacaguuu

SEQ ID NO: 14820 - RNA, 96 nt, Human
guguagacaaaguagcugauggauucaagguuguggcacguucuggaaacauaguagcaggcauagcaaaugaaucuaaaaaguuauauggagcac

SEQ ID NO: 14821 - RNA, 84 nt, Human
guuccacccugaaguuggccuuacagaaaauggaaaaguaauacugaagaauuuccuuuaugauauagcuggaugcaguggaac

SEQ ID NO: 14822 - RNA, 83 nt, Human
ggucucuucagagcugcuggugcccaguggugcuucaacgugguaucuaugaggcccuagagcuccgggacaaugauaagacu

SEQ ID NO: 14823 - RNA, 76 nt, Human
uugccgucugccacagcuggugccgucugagaagggggucccccuguagcagcacaucgcugacuuggcucggcaa

SEQ ID NO: 14824 - RNA, 74 nt, Human
gcaguggagggggcaggaccuccugcuggugcagcaccagcucgugugagcagguccaccggccccuacauugc

SEQ ID NO: 14825 - RNA, 69 nt, Human; identical to SEQ ID NO: 6356

SEQ ID NO: 14826 - RNA, 64 nt, Human; identical to SEQ ID NO: 3818

SEQ ID NO: 14827 - RNA, 65 nt, Human
ccugugguggucuuggacaguauguggaaacagaagcuccaugacgguagaagacuucucauugg

SEQ ID NO: 14828 - RNA, 66 nt, Human
uuccaucacuacaucuuuucuuccggaucuucaucauggaaguuucauuuguugcggaauauggaa

SEQ ID NO: 14829 - RNA, 80 nt, Human
ggucagacagggggacagggcagagcuagcauaacucaggcuuuuggggaugugcauggcagcuguuuuccuuuggggcc

SEQ ID NO: 14830 - RNA, 72 nt, Human
gucacagcugccugguaccuccauuuguuucucuguaauucaggaauaauugcaucuaggggcugcugugac

SEQ ID NO: 14831 - RNA, 82 nt, Human
uguugagaugaggguuucagggaagcagaaaaaccaagugcuggaucauuucuccuuugaggggccuuuguccaauucagca

SEQ ID NO: 14832 - RNA, 68 nt, Human
gaggcggguggaucacuugaggucaggaguuugagaccaaccuggccaacauggugaaaccuugucuc

SEQ ID NO: 14833 - RNA, 88 nt, Human
uguacuucugaggcaucaaacaugucuucuaaggccuucuccacacauuggagaaggcuuagaagacauguuugaugcuuagaaggca

SEQ ID NO: 14834 - RNA, 98 nt, Human; identical to SEQ ID NO: 651

SEQ ID NO: 14835 - RNA, 71 nt, Human
gcaaguggccuacguuaaaguugauaaacagcagauuaaugauacugcgcgacaacaauuaacgcacuugu

SEQ ID NO: 14836 - RNA, 94 nt, Human
guuuuaagccugccugaaaaucgacaaacagaugaauggacuucacagcuuuuaucuauucaugguauugaagaagucguggugaugccugaac

SEQ ID NO: 14837 - RNA, 64 nt, Human
uggguuggaguauucugacugcgguugcuauaauuuggcugcucaucaguuuuggucuggcuca

SEQ ID NO: 14838 - RNA, 86 nt, Human
ggaaaaucuaaagcuugucuuguagguucgaaccgggggaaauucccgggacccgguaaccgugcaaggcgguaccaagcuuuucc

SEQ ID NO: 14839 - RNA, 62 nt, Human
ggggaguccgguauuaagggcuuuugugcggaauuccauggugccaaaagacugguuucccc

SEQ ID NO: 14840 - RNA, 65 nt, Human
gguccaauucgauuucagguaauggggcaaagcgacucaugguuuuugaacguucgaacgcggcc

SEQ ID NO: 14841 - RNA, 130 nt, Human
uacaguaucuuaagugucgaccaguuauauaccuaaucugguuuuuuauaacuucuguuugauuaugcucuuacagaaguuauaaaaaaccagauuagguauauaacugguugacacuuaagauacugua

SEQ ID NO: 14842 - RNA, 73 nt, Human
agcuuagcagagaaaccagcgaaaccugugaggguaucugaagaugacuucacggaggcgguacagcugagcu

SEQ ID NO: 14843 - RNA, 60 nt, Human
ggugccagucaagggaugaguggggucuggaaucuagccucaagagggggaaguggcacc

SEQ ID NO: 14844 - RNA, 95 nt, Human
ugggcuaccagucuugagaaguaggugagggcaugcaaauguaaaaaaguaauguguguucugggaucuacuaguucuugagaagcacaaguuca

SEQ ID NO: 14845 - RNA, 63 nt, Human
cuguggaacuuugaacaugagagagauaaccugaaauuggaacacauguuuacgaagaagcag

SEQ ID NO: 14846 - RNA, 75 nt, Human
ucuugggaacuggaguaaaggucacucuugcuacgcuuuagcagagacugguggcauuuugccccugcccugaga

SEQ ID NO: 14847 - RNA, 72 nt, Human
ucuuuauagcaguaugagaaugaacuaacacaguaaauugguacugcggagaguagaguauugcuauaaaga

SEQ ID NO: 14848 - RNA, 77 nt, Human
gcagucuuuuuaaaugauacagaaauacguuuauagaugcagaaagacauuuaugauauaucguuaagcagaaaagc

SEQ ID NO: 14849 - RNA, 69 nt, Human
uaucugaauggcagaauuuauggauaauuuuuauuuuuuuacuuaucaguauuuucucaauuuuagaua

SEQ ID NO: 14850 - RNA, 62 nt, Human
uggaugguugcagugagcugagaccaggcugagagccugguugacacacugaggcccaucua

SEQ ID NO: 14851 - RNA, 60 nt, Human
gagccuucgugcccccccuucccccuuuuuugucccccaacuugagauguaugaaggcuu

SEQ ID NO: 14852 - RNA, 63 nt, Human
agucaggugccugggucugggucucauccagagacccacgggccuaggcagagcauccuggcu

SEQ ID NO: 14853 - RNA, 74 nt, Human
ggagaagaucaccucuucucacagcacacaaauuuuauguuugucucauugcaguguagaagguauucuguucc

SEQ ID NO: 14854 - RNA, 82 nt, Human
ggggcuucugagcugugggucaggaaacagcucuaacgaagauauuuauuggguguuuacucugccccauuccuuaagcucc

SEQ ID NO: 14855 - RNA, 75 nt, Human
uucaaguacagaaggcuuccucucaaauaagucuccugaggugacauaaagacugaaagaagccuaugacuugag

SEQ ID NO: 14856 - RNA, 65 nt, Human
cuuccucgaggaggacggggauggccucccuguuggggugguccuuguggccuuccuugaggagg

SEQ ID NO: 14857 - RNA, 78 nt, Human
gguauauugaaguuagagcaugaucacauuauguuucauaggcauuugaaacacugucaucuucuuauucacgugucc

SEQ ID NO: 14858 - RNA, 71 nt, Human
ggagauuuuauaggaugguuccugggcugauugauaaugccaaggcagcagggagcugaccugcauucuuc

SEQ ID NO: 14859 - RNA, 84 nt, Human
agucuccaugcaauuuucagaugaaaaacauucugugcauuuucaauuuguguguuuucauuuagaugguugaaaggguuugcu

SEQ ID NO: 14860 - RNA, 97 nt, Human
uugauagcuuguaauguccauuuaaauuuucaaguguaucuugccuucucuguagcaagagccagccugcggauauuggauauacaaccagcugcag

SEQ ID NO: 14861 - RNA, 71 nt, Human; identical to SEQ ID NO: 8959

SEQ ID NO: 14862 - RNA, 102 nt, Human; identical to SEQ ID NO: 3952

SEQ ID NO: 14863 - RNA, 77 nt, Human; identical to SEQ ID NO: 3082

SEQ ID NO: 14864 - RNA, 69 nt, Human
ggaauaggcuaaauuugcuagagaugugcuguggaauuaucuguauuucuagcuaugaucuuagcuucc

SEQ ID NO: 14865 - RNA, 65 nt, Human
gucacccaggcuggagugcagucgcacaauccuggcucacugcaaccuccgccucccggguugac

SEQ ID NO: 14866 - RNA, 84 nt, Human
guccauuucauugcaagaauaugaaaaauuaaauugagauccagguucuuuuuuuauuuuuuaauuuuuauuuuuugagauggc

SEQ ID NO: 14867 - RNA, 78 nt, Human
aucucucucuuuucaccuguauuguuuauugaaaauccaagacacuaugccaaugcaaccgugacuacuuugggagau

SEQ ID NO: 14868 - RNA, 74 nt, Human
guuacggaacucucacuucuguguuauggacauuuucaugacaugcacagaaguggagaggaugguucugugac

SEQ ID NO: 14869 - RNA, 103 nt, Human
uaagggauccuccugcucaggcucuggacuagcugggauuacaggugugugccaccacaccuugcuuucccacuaauucuguuccugcuaguuucuucccuua

SEQ ID NO: 14870 - RNA, 69 nt, Human
ucgauugucaagugcaacagagggagaagguugucaucaucuagcaauaccuugugugcugacuguuga

SEQ ID NO: 14871 - RNA, 72 nt, Human
uuugcagaaguucccuaagccuuuaccacaggaauaccaguacuuugaugaacucaguggaauaccugcaga

SEQ ID NO: 14872 - RNA, 63 nt, Human; identical to SEQ ID NO: 1060

SEQ ID NO: 14873 - RNA, 69 nt, Human
ucccgaaacaagcuuucaccgacguggccacuggcucccugggccagggccucggggccgcuuguggga

SEQ ID NO: 14874 - RNA, 68 nt, Human
ucguauuuuuagaagagacggggccccaccaugcugaccaggccggucccgaaccucugaccuuauga

SEQ ID NO: 14875 - RNA, 64 nt, Human
ugucaacacuggucugauuauuucuggaauuuuuuuuuuuuuuuuuuugaaacagugucuguca

SEQ ID NO: 14876 - RNA, 77 nt, Human
aucuugcugucacuuccaaguucaauauuccugacuuaaagguuggcacguuggaugucuugguuggcuugucagau

SEQ ID NO: 14877 - RNA, 78 nt, Human
ggccaaguuccagaggaucuguuugccaaaugaguugaccuugguaccuauauaacaaaggucccuuggacauugccc

SEQ ID NO: 14878 - RNA, 80 nt, Human
gugacgggagcuuaggucgggaagggauggaucgcugagccgauagcguccgcuaggcugucugccucgguaccuguuac

SEQ ID NO: 14879 - RNA, 63 nt, Human
uuuggagcgccgggagcgagagugugaacauggcuacgccucuucauucccguccaugccgag

SEQ ID NO: 14880 - RNA, 87 nt, Human
aaucuuuaaaauguguuguuuuucacaaguaauuuaaguauagcauuauuauuauuugguacuugagucaaagacgacauuuagauu

SEQ ID NO: 14881 - RNA, 65 nt, Human
ggaacaccauaggaguugccaucagggauaacacccauggacacaaacucucccucugggguucc

SEQ ID NO: 14882 - RNA, 74 nt, Human
cuagcggguggcccucucuggaacaggucgauucccggguagcacccucggaguugagcuggggcccccgaaag

SEQ ID NO: 14883 - RNA, 89 nt, Human; identical to SEQ ID NO: 2878

SEQ ID NO: 14884 - RNA, 81 nt, Human
uggggggggcggcgggaagcugggaaggcuagugcuuggagagcccuagggacaggccauuucagggcccugccuuuccca

SEQ ID NO: 14885 - RNA, 76 nt, Human
gccaucaaugucaaugacuccgucaccaagagcaaguuugacaaccucuauggcugcgggaguccucauagauggc

SEQ ID NO: 14886 - RNA, 63 nt, Human
gucauucaucaccgacauagacccaucaacgcacugcagcugccauggaggguaugaagugac

SEQ ID NO: 14887 - RNA, 81 nt, Human
cgcccuugcaaucucuaggucacuuucuccgcuuguagauuuugcgcgcaagccccagaaagacggcugggggcaggggug

SEQ ID NO: 14888 - RNA, 97 nt, Human
cucaugauuccguuucuagguccuaggcccgugccugauccaggauccaagcucccggaagcuggcacugggcccgcccuggguaggcagcagugag

SEQ ID NO: 14889 - RNA, 104 nt, Human
gcgcggggacacugggcagagggggcgugcggccucucuaggaagcuuucucggagccccagacacuggcgaggcgccgcgcccccucuucuggauuccggcgc

SEQ ID NO: 14890 - RNA, 67 nt, Human
cccaccuucuguugcuauuuugagagucauaguugcuuugaacugugcaaugaguaauaaacuuggg

SEQ ID NO: 14891 - RNA, 70 nt, Human; identical to SEQ ID NO: 3642

SEQ ID NO: 14892 - RNA, 60 nt, Human; identical to SEQ ID NO: 3643

SEQ ID NO: 14893 - RNA, 69 nt, Human
gaugugggccgcauguucaagcaauucaacaaguuaacugaggacaaggcagacgugcaguccaucauc

SEQ ID NO: 14894 - RNA, 104 nt, Human; identical to SEQ ID NO: 5474

SEQ ID NO: 14895 - RNA, 67 nt, Human
aguagauacacuuugaaaucuuggagcacuuaauagaggugacuuaauauuuuggaguugagaaacu

SEQ ID NO: 14896 - RNA, 68 nt, Human
ggagaguaaguaggcccucucaagggagcguaagugauguuccauauuaaccacagacuguccucucc

SEQ ID NO: 14897 - RNA, 63 nt, Human
ggaggcugcccgaauuugugccaauaaguacaugguaaaaaguugugggcaaagauggcuucc

SEQ ID NO: 14898 - RNA, 86 nt, Human
ccuuuaaagaaaccuuuagaaggacuuagaccucacauauuaauguugagaaguucugcuuaauuuuaaaaugguuucuauaaagg

SEQ ID NO: 14899 - RNA, 63 nt, Human
gucagaauuaucuuaauguagauuauaauuuggucuuuuaggaaaaaaaaacaaaaaucugau

SEQ ID NO: 14900 - RNA, 69 nt, Human
ugacguauuuugcuucuaguaugugccuacugugauuuuuuucaugugggaaaaugccaaaauuuguua

SEQ ID NO: 14901 - RNA, 117 nt, Human
uggaauuuguagaaaauuauggacauuuuuggugagaaagaacaauagucaaaacucacauggauagaguguguuuguuuuuugccaaaaaugccccagacuuuuucccaaaccuca

SEQ ID NO: 14902 - RNA, 72 nt, Human
uuuuaauucaauuuuuauggugaugggcaaaucauucuugguaaauguaaaucaaacaugauugauuuaaaa

SEQ ID NO: 14903 - RNA, 70 nt, Human; identical to SEQ ID NO: 1335

SEQ ID NO: 14904 - RNA, 76 nt, Human; identical to SEQ ID NO: 3277

SEQ ID NO: 14905 - RNA, 67 nt, Human
agaauuuuuacagacauacgcaguaggucuaugccaguccuuuugugaacuuuuaaaggaaauuacu

SEQ ID NO: 14906 - RNA, 64 nt, Human
gaauuaugguuaguaacuuuggaaaacaguccauguauuacaccagaguugcuucguauauuuc

SEQ ID NO: 14907 - RNA, 88 nt, Human
ggguuggggggacuucagaucauacagucugccauggagaaaagaacuugcuggcagacagccugaugguucagaggcuccagugccc

SEQ ID NO: 14908 - RNA, 114 nt, Human
uuuuagauuuaaaugauguauuuguucagcucacugauagggggcaaauacuacauuaauauauuuucuuccugucaagaguuauuuacauauguacaguauuucaguuaaaaa

SEQ ID NO: 14909 - RNA, 74 nt, Human; identical to SEQ ID NO: 365

SEQ ID NO: 14910 - RNA, 102 nt, Human; identical to SEQ ID NO: 2172

SEQ ID NO: 14911 - RNA, 77 nt, Human; identical to SEQ ID NO: 3082

SEQ ID NO: 14912 - RNA, 70 nt, Human
gagaagggcugguagguuaaauuauccuauuuuuuauucugaaaaugauauuaauagaaagucccguuuc

SEQ ID NO: 14913 - RNA, 68 nt, Human
agauacacccuuuccguuuggauggugaguuccuaaguuuauccagagguaaagcccauugugugucu

SEQ ID NO: 14914 - RNA, 63 nt, Human
gcagaccccagcgugggcucccuuccaagcuuccucuagcuuugggccuaugcuguccccugc

SEQ ID NO: 14915 - RNA, 100 nt, Human; identical to SEQ ID NO: 192

SEQ ID NO: 14916 - RNA, 88 nt, Human; identical to SEQ ID NO: 1500

SEQ ID NO: 14917 - RNA, 84 nt, Human; identical to SEQ ID NO: 286

SEQ ID NO: 14918 - RNA, 71 nt, Human
gcccuacccuuguuaguuauuuuaggagacagucucaagcacuaaaaaguggcuaauucaauuuauggggu

SEQ ID NO: 14919 - RNA, 76 nt, Human
cucuaacuucaucuaccuguuuauagcggccggacagacuucaggaaagaaacuggcgccagggauggagggggag

SEQ ID NO: 14920 - RNA, 130 nt, Human
gcagacaaaaccugauugcaugucauguuaaaaugcucuaaggggaaauuuaagugcuuucuuuucauuuaccuaauuucaucaauuggcaauuaagaugugacgucuagguaauccaggcaguguccgu

SEQ ID NO: 14921 - RNA, 91 nt, Human
gagagagaagaaagagaagugaaacgacaguugguggcuuggugggauaggaagcugaaaccaaugguuaagucaaaguuuuguuuuccuu

SEQ ID NO: 14922 - RNA, 104 nt, Human; identical to SEQ ID NO: 10248

SEQ ID NO: 14923 - RNA, 78 nt, Human; identical to SEQ ID NO: 99

SEQ ID NO: 14924 - RNA, 65 nt, Human; identical to SEQ ID NO: 247

SEQ ID NO: 14925 - RNA, 83 nt, Human
accucacuccuguuuggcugauuggguugaauuucucuuaauaccauacugaauguaacuugacgaguuaguagggaacuggu

SEQ ID NO: 14926 - RNA, 73 nt, Human
ugagguggggccuacucggagguguuugggucauggagacgaaucccucaugagugaccuuggugccaucuca

SEQ ID NO: 14927 - RNA, 92 nt, Human
gguguccagcauccacaucaucggcggagucauugcugugggaguuuuccuucuccuuauugcaguggcuggacuggugggugcugucaacc

SEQ ID NO: 14928 - RNA, 61 nt, Human
gccuggcuaauuuuuguauuuguuguagagauggugucucgcuuugucauguuggccaggu

SEQ ID NO: 14929 - RNA, 81 nt, Human
gggugucauaaacaccauuggcuugggagcugagugcaccuggauguccucugggcccugccgcugacuggcugugcgccc

SEQ ID NO: 14930 - RNA, 81 nt, Human
aggguuccaucuuugcuaucuguugaucagccuuagaaaaucuaaguaugaucaauaaauuuuaaugguugauggcauccu

SEQ ID NO: 14931 - RNA, 60 nt, Human
cacggcucaagcagcggcgccgcacacucaaaaaccguggcuacgccgccagcugccgcg

SEQ ID NO: 14932 - RNA, 100 nt, Human
gcuggcgcgcgagaacgccgccaugcgccuggagcucgacgcgcugcgcggcaagugcgaggcgcugcagggcuucgcgcgcuccguggccgccgcccgc

SEQ ID NO: 14933 - RNA, 61 nt, Human; identical to SEQ ID NO: 12046

SEQ ID NO: 14934 - RNA, 62 nt, Human
cagccaggucugggaagucuuucacuucuccuacuucgcugaaaggcuguccaccuugguug

SEQ ID NO: 14935 - RNA, 74 nt, Human
uuuuugacgucaggauaggacucuuggcacuccgcacugaaacaccgugauuaguccugacuagacagcaaaag

SEQ ID NO: 14936 - RNA, 98 nt, Human; identical to SEQ ID NO: 5891

SEQ ID NO: 14937 - RNA, 123 nt, Human
cguuggaaccagcuggaccgcuccgacguggcggugccgcucacucugcacggcuacucggaccucgacagcgaggagccgggcacgggcggcgccgccucgcgcaggggccagccucccgcg

SEQ ID NO: 14938 - RNA, 72 nt, Human
cuuguggaccacgcccgccgggcccaaggauccgccgccggggcgcggaccgggggcugggcuggccgcagg

SEQ ID NO: 14939 - RNA, 84 nt, Human
gcccggcugcccgcggggucuacgugcugcccaucggcgacgcggacgcggcugcagcagugaccacgucguacagguaugggc

SEQ ID NO: 14940 - RNA, 73 nt, Human; identical to SEQ ID NO: 12049

SEQ ID NO: 14941 - RNA, 102 nt, Human
cccugucuccacuggaagugaguggugcagcaucucuuuggcagguggggggcaucaguaccuggccagagggguccucgucgcugagcuccuggaucaggg

SEQ ID NO: 14942 - RNA, 62 nt, Human
gggagacauuuaugauuaaaccauuuaugcuacauauaacuggggaaaacuaugaugcuuuc

SEQ ID NO: 14943 - RNA, 65 nt, Human
gggaggugaggacuucaucucaacaucggcuggugguugguaggggagcuuuuucuuuucuuucc

SEQ ID NO: 14944 - RNA, 74 nt, Human
gccaccgagaagcagaagaaggcccuggagaaguugcucccggccuccucuugagggcugccugagcugguggc

SEQ ID NO: 14945 - RNA, 78 nt, Human
cugggcuuugggccuggugguugggagucaccuacugacaucgggacugacauuccugaaccccugguaugaggccag

SEQ ID NO: 14946 - RNA, 61 nt, Human
guccuuucuuucgccaggcuggggacccgcuucgcguuaucauccuggucgcagggaaggc

SEQ ID NO: 14947 - RNA, 65 nt, Human
ucugacagcagccauuauccugcuccauaccuuuuggggaguuguguucuuugaugccugugaga

SEQ ID NO: 14948 - RNA, 72 nt, Human
cgccgccgccgccgccaucaugaguggaaaucgugcacuugcaggccgggcagugcggcaaccaaaucggcg

SEQ ID NO: 14949 - RNA, 91 nt, Human
gugcgcucggggcccuucgggcagaucuuccggccggacaacuucguuuucggucagaguggugcugggaacaacugggccaagggugcac

SEQ ID NO: 14950 - RNA, 71 nt, Human
ccccuccgcccccucuggaggcugaagagggauuccagccccugccacccacagacacgggcugacugggg

SEQ ID NO: 14951 - RNA, 72 nt, Human
ggaggagcagcugacucagggguggaggagccuaggaaugccucucuccaggcccaagucgugcucuccuuc

SEQ ID NO: 14952 - RNA, 78 nt, Human
guccuuucucuggagaggcuuguggggccucaggacgcuacccacugcucuccgggccucuccugccgccucugggac

SEQ ID NO: 14953 - RNA, 67 nt, Human
ccucuggacuugcauucugauaggugcuuuaauuuaaaugugcccaaagggagugacugucuucagg

SEQ ID NO: 14954 - RNA, 60 nt, Human
ugcagcuaugcucugaaugauuucauuccugagagugauagcauucugguccuggcugca

SEQ ID NO: 14955 - RNA, 92 nt, Human
auuuucuccuuauaguaguuggaccgauuauggacacggaauaauuuuauacuguggcuaugagagcauuuaagagauuauuaggagaaagu

SEQ ID NO: 14956 - RNA, 104 nt, Human
ccacgggcaccuaccacggggacagcgaccugcagcuggaacgcaucaacguguacuacaaugaggccaccggcggcaguacgugccccgcgccgugcucgugg

SEQ ID NO: 14957 - RNA, 98 nt, Human
cgugacccugccccagccuaggccugucugcuggccuucagugccaucccaccccugggcaaggcaggcuuagcagcuaagggaggcugggggucacg

SEQ ID NO: 14958 - RNA, 73 nt, Human
uuccaaaagcauuuaauugaauuucucaauguuuuucaaaaacaaaaagauccaaauuagagguaaaaaggaa

SEQ ID NO: 14959 - RNA, 64 nt, Human
gugacauugacaucgugguaggcuucaagcaagccucagugcccagaaggucauguucuguuac

SEQ ID NO: 14960 - RNA, 61 nt, Human
ucugcccccggaagugggcagccagugcagcagcagccccacagccuggcuguuggguagg

SEQ ID NO: 14961 - RNA, 61 nt, Human
ugagagccacagggcacgggugaggcacaagcgccuucgugccgaauuucuuuggccuucg

SEQ ID NO: 14962 - RNA, 85 nt, Human
uacaaccuacuucacucauuuauauuauuugccaggccccugaaggcgucugguuugugacuucugugauuuaauacugguugua

SEQ ID NO: 14963 - RNA, 69 nt, Human
uugcugagcaugguuaucaauauaacauuuaagaucuuggaucaaauguuguccccgagucuucugcaa

SEQ ID NO: 14964 - RNA, 68 nt, Human
aguugggcugggucuugguacacgugguuccgcccaucuccacguccaagaacuaguucaccccagcu

SEQ ID NO: 14965 - RNA, 69 nt, Human
gcgcggcuguggcacaugucgucucuugcuuuguuguacucgccgacggcuaaguccauugcacgccgc

SEQ ID NO: 14966 - RNA, 94 nt, Human
ggucauugugcccugccaaggcacagcguagaucuggaaagagcagaaugcuuuccuuuucauauguggcuggucauggaaggggcaguugucc

SEQ ID NO: 14967 - RNA, 79 nt, Human
ggggaguucucgggcgcgcacaggcagcucgguuugcccugcgauugagcugcgggucgcggccggcgccggccucucc

SEQ ID NO: 14968 - RNA, 69 nt, Human
guagacagcacccccuugaguccaauuccuccccuuucggaggaagccgguuucuccuuucuaugcuac

SEQ ID NO: 14969 - RNA, 87 nt, Human
gugaguucucugcccgcucuuugcccacccgcgucaggccggucccccuccggccucuucuguggcgcgagggacagcggaaaccac

SEQ ID NO: 14970 - RNA, 64 nt, Human
cccccggaguccuuuuuuauuuuuuuucccuuugggccaaaaagaaaaaaaaggggacuggggg

SEQ ID NO: 14971 - RNA, 67 nt, Human
auucauuuuuguucuaaauuuuuaaaccuucuaucaugaaaaacuucaaauauacacaaaagagaau

SEQ ID NO: 14972 - RNA, 90 nt, Human
ccuaccaagaauucccugccuuaaacuccaggaugauauggacauuuuuccccauugucacuuaaaguucauuuagaaacaucugguagg

SEQ ID NO: 14973 - RNA, 60 nt, Human; identical to SEQ ID NO: 8964

SEQ ID NO: 14974 - RNA, 86 nt, Human
uggcaucccagauguugcaguugaagucgucguagccagcgagcagcagccguucgcugcgcgagaaggcaacagaggugaugcca

SEQ ID NO: 14975 - RNA, 63 nt, Human
agacacgccugccccaugacaagaccaagugcuucaaguucaucuaggggcagcgcacggucu

SEQ ID NO: 14976 - RNA, 61 nt, Human
gaagguguacggcuacaugccccuccuguacacgcaguucaggguggauucugugcucuuc

SEQ ID NO: 14977 - RNA, 69 nt, Human
gugaggacauugccaugaacuuccuugucucccacaucacucggaagccccccaucaaggugaccucac

SEQ ID NO: 14978 - RNA, 61 nt, Human; identical to SEQ ID NO: 9223

SEQ ID NO: 14979 - RNA, 103 nt, Human
uuuucuaauuuacaaccaguuaagaauuacaauauccaaagaaaguauuuuaaaauauauaugcucacugguaagugauuuucuacucaaauaaauaggaaaa

SEQ ID NO: 14980 - RNA, 73 nt, Human
agauguuauuuaugguguggaggaagcaugauauuuuacaaaugcgauugccgccagcuccuuacagaacucu

SEQ ID NO: 14981 - RNA, 86 nt, Human
auaucaucaaagucaugacauuggaaauauugcagcuuuucacagucauuagaaaugcuuauuuccugaaguuccuuugauuguau

SEQ ID NO: 14982 - RNA, 72 nt, Human
ucuuguggcuggguggaacugagucuuuuuuggugaaauguacacaguaguucuguucccccaguuacauga

SEQ ID NO: 14983 - RNA, 64 nt, Human; identical to SEQ ID NO: 7119

SEQ ID NO: 14984 - RNA, 77 nt, Human; identical to SEQ ID NO: 3323

SEQ ID NO: 14985 - RNA, 88 nt, Human
ggccaggcuggucucgaacuccuugugauccacccaccuuggccucccaaaauucuaggauuacaggcaugagccacugagccuggcc

SEQ ID NO: 14986 - RNA, 67 nt, Human
ggacaucuaucauuauaugucgagguugaguccauguaacguuggcagucucuagugacugguguuc

SEQ ID NO: 14987 - RNA, 78 nt, Human
guacugcucccuugagcggucguauucuucgcuguuuccagaacucgugauuguaguaccaucguccagggguugugc

SEQ ID NO: 14988 - RNA, 75 nt, Human
ucucgugugccuuucccauaguaucguaaggacguuucgaguaauuuacaacaacuaagggaguguauaucggga

SEQ ID NO: 14989 - RNA, 93 nt, Human
ccuuuacuaauucaaaguugcauguucuaugacaucugugacuugcguugcagaguguacaugaaacuguauaauugagucauucaguaaagg

SEQ ID NO: 14990 - RNA, 89 nt, Human
uaucuugguuaauugcuacugaaagguugagaaaggaaugguuugauauuuaccacagcgcugugccuuucuacaguagaacuggggua

SEQ ID NO: 14991 - RNA, 102 nt, Human
agggaggggguagggcuggguuauuaagauacaggcugcuguauuuuacauugguugugggggaaggggagccugagaaaacaaagucacuauucccuuuuu

SEQ ID NO: 14992 - RNA, 66 nt, Human
uuuaguggacuucugugagauuguaguuguacuuuguaucucuaaaucuaaagauaguuuuuuaaa

SEQ ID NO: 14993 - RNA, 101 nt, Human
aaucgagaauuucucacaaugggugguauacaagacuggaugggaaacaaaguuuauuaaccccaggugagccacuccauaacuuugaugggauuucgauu

SEQ ID NO: 14994 - RNA, 66 nt, Human
uccaggucuuuuuaaagaaucaacauguauucacaguacuugggaugcuaagcaaaggaccuguga

SEQ ID NO: 14995 - RNA, 67 nt, Human
uggggcggguuuuauuucaaaugcagccacagaggcgguuuuugcacagguacgugauccgacucca

SEQ ID NO: 14996 - RNA, 60 nt, Human
gucccacuuaguuuuuguuuuuucuuuaaaaaaaaaacaaaagcucacaaacaauaggac

SEQ ID NO: 14997 - RNA, 77 nt, Human
ucagcaggaaagaguuuaaaagacuugaauggaaaucagaaauuuagggauuugagaaaauaacuuuuugguacuga

SEQ ID NO: 14998 - RNA, 70 nt, Human
gauugcagccaacccuuaaggcccuaccuugugaaggugcuugugggccacaccaagguggguugugguu

SEQ ID NO: 14999 - RNA, 65 nt, Human
gggagggcauguugcugcagucuggggcaugugagcuuggccuccagagaugagcucauccuccc

SEQ ID NO: 15000 - RNA, 74 nt, Human
gcuugucugcaacagccccaaacuggaaacaacccauauccaucaaguuuauccagcaggguggacaaauaagc

SEQ ID NO: 15001 - RNA, 62 nt, Human
guagaagcauuuugagaacagguuggcaucaucacauaagcccuuauauucaagaacucugc

SEQ ID NO: 15002 - RNA, 73 nt, Human
ucaggauaaacccaauuaaguuuuuuauauacugcugauucaguuuguuaauuauuaugaugggauuuuuuga

SEQ ID NO: 15003 - RNA, 111 nt, Human
ugaggaaguucuuucuguggauagucugcugugaguuuuuauugggaaucaauguuaaauccaguuaaauguuuuuuuucuccaguauauuaaucauauggcuuuucuuua

SEQ ID NO: 15004 - RNA, 130 nt, Human
ggcccgcggucuuggcuccccuuucuuccuucuggcuggccggccgcaggguaggggguccguggaccucccggccuguagggggcgucgggcgcagcggaagggccugcuccggagccuggccagggcu

SEQ ID NO: 15005 - RNA, 99 nt, Human
ucaccgagaccgcggcggagccuacggucccugcagugccugcugcugaggaggccaccgaagcucggggacgcgaggagccggcguggcccuggguga

SEQ ID NO: 15006 - RNA, 79 nt, Human
augaaccuucagugaaaguaggcugcacagcuaaauggccuucuauuuugaggcaguucuuuauauucugaaauagcgu

SEQ ID NO: 15007 - RNA, 63 nt, Human
ccaacgugggcaaguugcucaaggguaucgacagguacaauccugagaaccuggccacccugg

SEQ ID NO: 15008 - RNA, 74 nt, Human; identical to SEQ ID NO: 365

SEQ ID NO: 15009 - RNA, 102 nt, Human; identical to SEQ ID NO: 2172

SEQ ID NO: 15010 - RNA, 77 nt, Human; identical to SEQ ID NO: 3082

SEQ ID NO: 15011 - RNA, 131 nt, Human
ucccgaaaaaggaaugccaggucagacagguggaggagggaaauggggcacaggucaagguaugaugaaucucuuaaaaagaaauccggccaggcacaguggcucacgccuguaaucccagcacuuuggga

SEQ ID NO: 15012 - RNA, 83 nt, Human
ggaggcuaagccuuggcuugccaucugcuggagaaguccuacucaucuuuuucauacugacaggcacacaggguuuagucucu

SEQ ID NO: 15013 - RNA, 67 nt, Human
guauggcuuccauuugcuucaaauuugccagcuucuccuuugagauaugagguaauggaaucucuac

SEQ ID NO: 15014 - RNA, 68 nt, Human
gcaggguagucugagagugaagggccugaauaauaaauacaauuccuaaacucucaaauuccccucgu

SEQ ID NO: 15015 - RNA, 80 nt, Human
aaauauaagguuggguuagcaauauuuauagggcuuuauuuuuuaaguucaaugugucugugguccagaagaaauuauuu

SEQ ID NO: 15016 - RNA, 90 nt, Human
caaaaaggugcuacgguagugaugaaauuauaaguagauuuguaguugucccauuuauuauuuuaauauuuauguuuaagugcuugguug

SEQ ID NO: 15017 - RNA, 60 nt, Human
ggcuuaggacuucaaaaggugauuaaauauuuaaugaugugucauaugaguccucaagcu

SEQ ID NO: 15018 - RNA, 61 nt, Human
ccagcugaauugaauuuuuguaggcaaauaagcguuuuaaguaugagaaugauuuaguagg

SEQ ID NO: 15019 - RNA, 65 nt, Human
gagcuuuugucuucaguguuuauuucuuuaacauaaaggauuugaacuggaagacuucuaaguuc

SEQ ID NO: 15020 - RNA, 63 nt, Human
cagugaagcaggauguauguggccuugaggauaaccugcacuggucuaccuucugcuucccug

SEQ ID NO: 15021 - RNA, 96 nt, Human
ucacuuuuuacgugagcguauaaucccaagaucaguguuauauuuuacuggagaagcuauugaagaugaugaugaugauuaugaugaagaagguga

SEQ ID NO: 15022 - RNA, 78 nt, Human
ggcccugguaggcccacaacuucccuaagccaagcuccccaggcccagcucaggccucgcgguggccucuccaggguc

SEQ ID NO: 15023 - RNA, 71 nt, Human
guuguccugaagucgggcucucccggcugcaucuccaggccggacucuggccgacuccaggucccaacaac

SEQ ID NO: 15024 - RNA, 72 nt, Human; identical to SEQ ID NO: 9079

SEQ ID NO: 15025 - RNA, 72 nt, Human; identical to SEQ ID NO: 9079

SEQ ID NO: 15026 - RNA, 70 nt, Human
agaguauguauuggcucauuuauuugcaaaguuagaggauugcaaaaugcuaugugcccaaugcagaccu

SEQ ID NO: 15027 - RNA, 64 nt, Human
cccaccagaucucaugucaacuuguaguuuguagucaccacuguuggagguggggccuggcggg

SEQ ID NO: 15028 - RNA, 60 nt, Human
cuucuccccaccugggccuuggguucuucagcuauaaaauggccagagguuggggggcgg

SEQ ID NO: 15029 - RNA, 73 nt, Human
cuucaucuccacucugcacggcggcugagggcccuuacucugggccugggcacccuuagaggggagaacgaag

SEQ ID NO: 15030 - RNA, 60 nt, Human; identical to SEQ ID NO: 1720

SEQ ID NO: 15031 - RNA, 63 nt, Human
ucugcaagggcgacacuggaccacccgcugccccuacaaggcauacgcuggggcccaugcaga

SEQ ID NO: 15032 - RNA, 62 nt, Human
caaagagaacugccagugccaggaaagcccaggggaagccguggcugccaggaagcucuuug

SEQ ID NO: 15033 - RNA, 85 nt, Human; identical to SEQ ID NO: 10310

SEQ ID NO: 15034 - RNA, 81 nt, Human; identical to SEQ ID NO: 4229

SEQ ID NO: 15035 - RNA, 68 nt, Human
uuuuuuuuuuuuuuuucacggagcuuuauacuuacuuuuaauuucugcacugaaaaagaaaaggaagg

SEQ ID NO: 15036 - RNA, 73 nt, Human
cugggcaugaugguuggcgccuauagucccagcuacuugggaggcugaggcaggagacuggcaugaaccccgg

SEQ ID NO: 15037 - RNA, 66 nt, Human
gaggcgggcagaucacgagggcaggagauccagaccauccuggcuaacuuggugaaaccccggcuc

SEQ ID NO: 15038 - RNA, 63 nt, Human
ggcauggcacugagcagcuucuuuuaagaacauaauuuguagccaggcgcaguggcuuaugcc

SEQ ID NO: 15039 - RNA, 81 nt, Human
aaugaggaccuucaaauaggagugauugaaauaaauaacuacuugcauguuaugcuuucauucuggguggaauacuucauu

SEQ ID NO: 15040 - RNA, 95 nt, Human
cacuggugagguggauugaugaugaaucuucugacacaccuggagcaacuccagaacacagucacgaggauaaugggaauuuaccgaaacccgug

SEQ ID NO: 15041 - RNA, 69 nt, Human
gaagcugaccggcgcccucuaaaccuuugcccuaucuguuugcacaaguugcagugugcuguuggcuuc

SEQ ID NO: 15042 - RNA, 61 nt, Human
gcagaugucccuaagguagagguguuggaacgggagcuggccuggcugaaggagcaucugu

SEQ ID NO: 15043 - RNA, 81 nt, Human
cuggcugcugacugggcagggaccuggacccccuuuauuugcaccgucaggggaaacggguucccccuuuguauguaccag

SEQ ID NO: 15044 - RNA, 63 nt, Human
cuggugacggggcccugggcuggggcugucccacacuggacccagcucucccccugcagccag

SEQ ID NO: 15045 - RNA, 69 nt, Human
gguuugauuucacuggagccugcugggaacgugaccucugaccccugaugcuuucgugaucacgugacc

SEQ ID NO: 15046 - RNA, 75 nt, Human
uugaguagggccuagcccccuccaccccuuuucuuccauuugagaggagagugcuuggggcuugaaaccccuuaa

SEQ ID NO: 15047 - RNA, 61 nt, Human
gcucuccgccgcagcuucagcaccucggcccagaacaaugcuaaaguagcgugcuaggggc

SEQ ID NO: 15048 - RNA, 73 nt, Human
ucuggaggcaucgggcagccacuuucacuucuccugaagaacagccccuggugagccgccugacccucuauga

SEQ ID NO: 15049 - RNA, 86 nt, Human
gcccaguucacuucuuugcagagccuuuuaccccugcacaguuuagaacagagggaccaaaugcuucuaggagucaacuggcuggc

SEQ ID NO: 15050 - RNA, 61 nt, Human
ggggucggcuaagugggacauuaguaacugcacacuauuucccgucuacugaguaaacccu

SEQ ID NO: 15051 - RNA, 92 nt, Human
ucuggcauggcucccuuuguccuuccugugcccugcaaauauuagcaaagaagcuucaugccagguuaggaaggcagcauuccaugaccaga

SEQ ID NO: 15052 - RNA, 73 nt, Human
cccuggaguuuacuuccugccaggugaccuccugggggagggagccuucaagcgagccuggccagaagcgggg

SEQ ID NO: 15053 - RNA, 64 nt, Human
ggucgguaccuacucucggggccguuaguucuaagguccugauccugaggaagucacugggacc

SEQ ID NO: 15054 - RNA, 108 nt, Human
ugagagccugagaugggugaccucugaaggaggggagcuggucuggccgccccucuaggccucaguuuccccaucugugcagugggcagccugcaguucacacuuuca

SEQ ID NO: 15055 - RNA, 131 nt, Human
uuuccuuucuuucuguuuugagucggagucuugcucugucgcccaggcuggagugcaguggcgugaucuuggcucacugcaaacuccgccugggcaacagagugagaccccgucucggggggaaaaaaaaa

SEQ ID NO: 15056 - RNA, 84 nt, Human
ugcugaaaccuuucagaaauagccauaauuuuguauuacauacaaguaagccauuuuaaggaguuucaugaaagacguuuggca

SEQ ID NO: 15057 - RNA, 83 nt, Human
uggaacugaaauacuaccuaguuacuucuuuuaguagaauacuucugaggcaagaaacuaaaaucuaguugucauauuuucca

SEQ ID NO: 15058 - RNA, 61 nt, Human
agcaaguaguacaguauguuagggaucaucucaaaaguuccaagcuacuucuuucuuugcu

SEQ ID NO: 15059 - RNA, 83 nt, Human
ccuaauccucuccuuacucccagacuuuggccuaaucaccaggagacaaaaggaaaauaaggggggugggggugggggugggg

SEQ ID NO: 15060 - RNA, 64 nt, Human
gccaccagagucaaaauguaaguuuuuuauuuuuggcgaccacuuacuugaacacuugaguggc

SEQ ID NO: 15061 - RNA, 74 nt, Human
auacccccuuguagggauggaccacguuuaguuuaugcacacaugagcuugaguggcugcucuuuaaaggguau

SEQ ID NO: 15062 - RNA, 76 nt, Human
ccacuaaucugcuuucuguuucuauggauuugccuauucuggacauuucauauaaauggaaucauccaauaugugg

SEQ ID NO: 15063 - RNA, 69 nt, Human
uuagcaucauauuuuugaggaucauccgugcuauaucauggauggguaccauguuccuuugauggcuga

SEQ ID NO: 15064 - RNA, 61 nt, Human; identical to SEQ ID NO: 347

SEQ ID NO: 15065 - RNA, 74 nt, Human; identical to SEQ ID NO: 3804

SEQ ID NO: 15066 - RNA, 61 nt, Human; identical to SEQ ID NO: 347

SEQ ID NO: 15067 - RNA, 61 nt, Human; identical to SEQ ID NO: 9580

SEQ ID NO: 15068 - RNA, 84 nt, Human; identical to SEQ ID NO: 384

SEQ ID NO: 15069 - RNA, 89 nt, Human; identical to SEQ ID NO: 385

SEQ ID NO: 15070 - RNA, 67 nt, Human; identical to SEQ ID NO: 3685

SEQ ID NO: 15071 - RNA, 73 nt, Human; identical to SEQ ID NO: 2833

SEQ ID NO: 15072 - RNA, 104 nt, Human
cauaaaguaguauugcauagugacuaccauuucagggucuggauuuagacuuggcuuugaguccuaucucugcagcuuuuaguaacugugugacauugucauug

SEQ ID NO: 15073 - RNA, 70 nt, Human
gcuucaguuuccucaucuauaaagugaagauaauauuccuuaauggucaggguuauagugaggacuaagu

SEQ ID NO: 15074 - RNA, 88 nt, Human
guggcuggguuuagaaugauuccuugggaaaagggguagcaaaguaacuuuguccugaagaagccccaaguauccugagcccagcagc

SEQ ID NO: 15075 - RNA, 100 nt, Human
aggcucggcacagagaaggaggucgaggugauugggggagcagacaaguaccacuccgugugucggcucugcuacuucaagaaggccucaggcccagccu

SEQ ID NO: 15076 - RNA, 63 nt, Human; identical to SEQ ID NO: 12838

SEQ ID NO: 15077 - RNA, 85 nt, Human; identical to SEQ ID NO: 10310

SEQ ID NO: 15078 - RNA, 99 nt, Human
uuagauuggggcagguuaaggcaggcggccgaauuuggggcuaauugggccaauuggccuuauggggggccgaauaacauuuaauggcccgcgguuuaa

SEQ ID NO: 15079 - RNA, 62 nt, Human
uguuugagucuagaacucaguuccaguacuguaacuggagaccugacaaccugagccagaca

SEQ ID NO: 15080 - RNA, 69 nt, Human
uugggaauauauauguagccaugauaaagaaaaaacgaagauccuaggagacaaaaauguugaucccaa

SEQ ID NO: 15081 - RNA, 78 nt, Human
cuaauaaacucugcaaugaaaucauguugacugcaucagucuguaccaugaccugaccucauuagcaaguuuauucag

SEQ ID NO: 15082 - RNA, 68 nt, Human
aggcgggguggaucacuuaggggucaggaguucaagaccagccuggccaacauggugaaacccugucu

SEQ ID NO: 15083 - RNA, 75 nt, Human
ccccuguaaucucagcuacucaggagguugaggcaggagaaucucuugaaucugggaggcggagguugcaguggg

SEQ ID NO: 15084 - RNA, 78 nt, Human
uggaguuuuuaaaaacuuuuggacguggccgggcacggugacucaugcccgguaauccccagcacuuuugggaggcca

SEQ ID NO: 15085 - RNA, 65 nt, Human
ccuuguguuggaggcugcugugaugucaggaacggggaucugucuagcuuuuggccacuaccugg

SEQ ID NO: 15086 - RNA, 88 nt, Human
cgccccuguugacagauggagauugggcagcagggccuugcugcauuguuaucugcuguuccgacuugguuugucuuguucaagggug

SEQ ID NO: 15087 - RNA, 63 nt, Human
ggcugagccgauggaacucggggucggcagaaaggauuauggguggaaaacauuggcucuucc

SEQ ID NO: 15088 - RNA, 62 nt, Human
auauuauggcuugcaaccuggagaccucugguagauuucuuuagugcaucccagccaagugu

SEQ ID NO: 15089 - RNA, 61 nt, Human
gcuaucucaggguccauaauuuguguagaaauccugugcauuacaugaacuuugaaauagc

SEQ ID NO: 15090 - RNA, 64 nt, Human
ugugaucccaaaguuaaccuuggcuaucuauaauuugugauggcagcuauucuuuggguaaaca

SEQ ID NO: 15091 - RNA, 75 nt, Human
uguuguugccaggcucucuucauugcccucaaagagcucuacguaagcagugguuauaaagagcuuugcaugaua

SEQ ID NO: 15092 - RNA, 66 nt, Human
gaaaagaaugcagcagccuaacuuaguguuaccauauguuacugaauuugaaacugaccuuuuuuc

SEQ ID NO: 15093 - RNA, 79 nt, Human
ggcauggcuucuguuuccuuggggccucaguucugguguaacccgggaauacgggguuuggaggaagcgcggaggggcc

SEQ ID NO: 15094 - RNA, 104 nt, Human
uugaagccagagcaaguauguccuucaucagguaaucaggaacucuucaguugaagcugaggaacuaacugauuaguuguugaucauaauauaauugguuacaa

SEQ ID NO: 15095 - RNA, 68 nt, Human
agccuguccccagcccuucggaagccccggcgccagcccgggcccucggcagggaggaugacggagcu

SEQ ID NO: 15096 - RNA, 71 nt, Human
ccaguggacggcuuuucugcagguuuaauagaugacaaugaucucuaccgaugggaaguccuuauuauugg

SEQ ID NO: 15097 - RNA, 65 nt, Human
gcucuucugugaucuuggccucccggagcaguuccuccuggguuaguggccgcucacaguggggc

SEQ ID NO: 15098 - RNA, 86 nt, Human; identical to SEQ ID NO: 7015

SEQ ID NO: 15099 - RNA, 84 nt, Human
guuuuacuacugugugauuuuuguuuggacaucugaaguagagcuuguuuuguuuuuaaauaagaauauucacaaauuaaaaac

SEQ ID NO: 15100 - RNA, 90 nt, Human; identical to SEQ ID NO: 2449

SEQ ID NO: 15101 - RNA, 83 nt, Human
acagcacaucuccauuagcacuagccacaauucaggagcucaguagacacgaacuaguggcuugcauauuggagagugcaugu

SEQ ID NO: 15102 - RNA, 96 nt, Human
agauaaacuaugccauauucauaaauuuaaaauuucuaguagacucauuaaaaagguaaaaacaggagaaaugaauuuuaaugcuauauuuuauuu

SEQ ID NO: 15103 - RNA, 76 nt, Human
gaguguccaauucuaggguauuucuccuugauaaaugauuuauuauugucacaaaagauaccaaauuuugauacuc

SEQ ID NO: 15104 - RNA, 70 nt, Human
ccuguuggcacugaugaagaacccuuacaguucaggguccuggaacuucuaccagugccacucugacagg

SEQ ID NO: 15105 - RNA, 75 nt, Human; identical to SEQ ID NO: 12474

SEQ ID NO: 15106 - RNA, 68 nt, Human; identical to SEQ ID NO: 3588

SEQ ID NO: 15107 - RNA, 76 nt, Human
ggggccagagagcaagggagcuugagaaucagaucuguaacugcccagcaccguuucucugcucuuguuucacucc

SEQ ID NO: 15108 - RNA, 78 nt, Human
cugagcuagcaugcccagcccacagagagccuccacuagagugaugcuaaguggaaaugugaggugcagcugccacag

SEQ ID NO: 15109 - RNA, 92 nt, Human
ccgggcgccacagagcagggggcaaaguucuccccagcagccucaggaggccccgcugcuaauccacugucuucuguucugucugugccugg

SEQ ID NO: 15110 - RNA, 90 nt, Human
aacaaggcaaaauaucugccuuauacaugucacaaguuauaaagauugagagcuguauuuagguaaaugcguuguauguuuugucauguu

SEQ ID NO: 15111 - RNA, 90 nt, Human
aggagucuugcccuguugcccaggcuggagugcaguggggcgaucuuggcucacugcaaccucugccucccggguucaagcaauucuccu

SEQ ID NO: 15112 - RNA, 63 nt, Human
cccccuucaguaaauuguccugacauccucccccacuuggagagccagucuacuagaaggggg

SEQ ID NO: 15113 - RNA, 62 nt, Human
gaagcaaaugaauauuuaccuugugcuuucaugcaaauuuagggaccaaacucaaagguuuc

SEQ ID NO: 15114 - RNA, 89 nt, Human
gcuggacaccagaucuaagaauugugacaggaucuucucauauuucauuuuagaacacuugauacuagucugaugauacucauguuagc

SEQ ID NO: 15115 - RNA, 61 nt, Human
uccaaguuccuuuuuauucaaaugaaucagaacugcaaucauaaacauaaaaagaccuggg

SEQ ID NO: 15116 - RNA, 65 nt, Human
aucuguaacuuaaauugggccaaucagaaugguuaucuuuguucaggucacaugaguugcaagau

SEQ ID NO: 15117 - RNA, 69 nt, Human
gcagcgauucagccagcugagaauucgucccgcuccgaggcuugagcaggaccggggcugaguaaaugc

SEQ ID NO: 15118 - RNA, 61 nt, Human
cggcaccaucacgugcuuggggacggguucucucccggggcgucuucgugcaguggugccg

SEQ ID NO: 15119 - RNA, 67 nt, Human
cccuggaggagaucuaucucuucucccugcccauuaaggaaucagagaucauugauuucuuccuggg

SEQ ID NO: 15120 - RNA, 69 nt, Human
gguguuaagugcuccaaggagguggccaccgccauccguggggccaucauccuggccaagcucuccauc

SEQ ID NO: 15121 - RNA, 75 nt, Human
guuucccgguguggggcuggaccaggcggcgggcagcggguuuuccuccugguccuccaaaaugcgcuucagaac

SEQ ID NO: 15122 - RNA, 85 nt, Human
gcuucccacuggcacccugaaaccugcccaggcugggcgccagcgucguccacaggccuuggccagcgggggcccucagggaagc

SEQ ID NO: 15123 - RNA, 71 nt, Human; identical to SEQ ID NO: 9014

SEQ ID NO: 15124 - RNA, 72 nt, Human
aaugcacauacaaugccagaacuccuuaaaagcaacuaauaucauauuuguguuuugcauaaaacaugcauu

SEQ ID NO: 15125 - RNA, 81 nt, Human
augugaaagaaggaauaguaccuuucauaaaacaagcccuucagcgcugaguuaacugaucgguacuauugugcugcacgu

SEQ ID NO: 15126 - RNA, 91 nt, Human
cggcuccgacacaucucacugugcugcgugguggugugguucggagugaacuucuccuauuaacggccugagucuggaugugucggggcug

SEQ ID NO: 15127 - RNA, 70 nt, Human
ggugggugccugagucugcacgcuggcuucugacccaaggccaugugaaagaggcccacagguacuugcu

SEQ ID NO: 15128 - RNA, 61 nt, Human
gccuagaauucagaauguacccgauguccacuaacaguagacuggauacaugaacuguggc

SEQ ID NO: 15129 - RNA, 92 nt, Human
ggaggaucgcuugagcccaggaggcggagguugcagugagcugagauggcaccacuuauugcacuccagcccgggcgacagagcgagacucc

SEQ ID NO: 15130 - RNA, 80 nt, Human
ggccuggugaaaggagccugccagaagacacucagcgaccugaagcuggacuaccuggaccucuaccuuauucacuggcc

SEQ ID NO: 15131 - RNA, 90 nt, Human
ccuaucagagacaucuauuuuucugggcuccaacccaacaugccaccauguugacauaaguuccuaccugacuaugcuuucucuccuagg

SEQ ID NO: 15132 - RNA, 63 nt, Human
gccggguugggaccgcugcgggcccgccugccuuuggcgucgccggccguucccguucccggc

SEQ ID NO: 15133 - RNA, 66 nt, Human
uuccccuuuucccaguauuacugaauagucccagcuggagaguccaggcccugggaaugggaggaa

SEQ ID NO: 15134 - RNA, 61 nt, Human
ccguguacaccaaccuuauggugugaguggccaggcccacacuaaaccugggacuacacgg

SEQ ID NO: 15135 - RNA, 65 nt, Human
uguggcuugggacaagcuggucagguauggaaccuggcuaacugcaagcugaaagaccaaccaca

SEQ ID NO: 15136 - RNA, 65 nt, Human; identical to SEQ ID NO: 247

SEQ ID NO: 15137 - RNA, 80 nt, Human; identical to SEQ ID NO: 100

SEQ ID NO: 15138 - RNA, 64 nt, Human; identical to SEQ ID NO: 10357

SEQ ID NO: 15139 - RNA, 63 nt, Human
ccuacccuccuuuuuuucccuaucacugaagcuuuuuagugcauuaguggggaggaggguggg

SEQ ID NO: 15140 - RNA, 71 nt, Human
gucggauuacaaauaaggccucucauuugcaguagacagccagggaagggucuuagaauugugaaaucggc

SEQ ID NO: 15141 - RNA, 60 nt, Human
uuuuugaguuuaaaugcauuuuauuuuuagacaaccuacaugacauguuuuucuuaaaaa

SEQ ID NO: 15142 - RNA, 65 nt, Human; identical to SEQ ID NO: 11397

SEQ ID NO: 15143 - RNA, 63 nt, Human
ugugguggcuggagguuggccgaauugacaaacccaucuugaaggcuggccgggcguaccaca

SEQ ID NO: 15144 - RNA, 60 nt, Human
cuauuauuccagugcuuugagaagccgacguggaggaucgcuugaggcaaggaguucgag

SEQ ID NO: 15145 - RNA, 61 nt, Human
cuguucuccagcagaaccaaaugucagucacauauaccacauuuaaaauugcuuagaauag

SEQ ID NO: 15146 - RNA, 122 nt, Human
gaucucuugagcccaggaguuugaggcugcagucucccaaguagcugggcauuguuguguguaccugcagucccagcuacuugggaggcugaagugugagaauugccugagcccaggaguuc

SEQ ID NO: 15147 - RNA, 62 nt, Human
guacggccgcccggaaaacugaaguuggccugaaaagcuaaaaugacugggugaagccgaac

SEQ ID NO: 15148 - RNA, 71 nt, Human
ucccacguugagggucucgaggacgccuagaucucuuucccagggccauggcgaacccgaagcugcuggga

SEQ ID NO: 15149 - RNA, 73 nt, Human
gaucgguugcacgcagcugagcaggagagccucaagcgcuccaagguagcucaaccuggugcuggacgagauc

SEQ ID NO: 15150 - RNA, 75 nt, Human
agcugcgcuccccugcuagaaccuccaaacaagcucucaagguccauuuguaggagaacguaggguagucaagcu

SEQ ID NO: 15151 - RNA, 64 nt, Human
gacaucugucaccccauugaucgccaggguugauucggcugaucuggcuggcuaggcggguguc

SEQ ID NO: 15152 - RNA, 64 nt, Human; identical to SEQ ID NO: 10357

SEQ ID NO: 15153 - RNA, 64 nt, Human
uuuuuuuuuuuuuuuuuauuuugcauacuuuaauuucagaacaaaaugaagaaaauaaaauaaa

SEQ ID NO: 15154 - RNA, 71 nt, Human
cauugacaagacaggguucccacugacaagaccacaauuuaccagguugcugcucaaacgaacccccaaug

SEQ ID NO: 15155 - RNA, 60 nt, Human
ggggccggagaagugcgccugggugcgcacccaggcgcacuucugcauugaccagguccc

SEQ ID NO: 15156 - RNA, 82 nt, Human
gucgccgccacggggggcgugcgaucggcccgagguuaucuagagucaccaaagccgccggcgcccgccccccggccggggc

SEQ ID NO: 15157 - RNA, 74 nt, Human
cccagggccuggcaccucccacaucauccauugucuugcuggccagugcgauaacggguggauugccaccuggg

SEQ ID NO: 15158 - RNA, 63 nt, Human
cugcgagccauucacccagcuggucccuccaagacagagccggggccagcggcagacucccag

SEQ ID NO: 15159 - RNA, 60 nt, Human
auggugacacaugcuggagccagugcuaacaugccugguucacggauggcaagucaccgu

SEQ ID NO: 15160 - RNA, 79 nt, Human; identical to SEQ ID NO: 1810

SEQ ID NO: 15161 - RNA, 79 nt, Human
gccugagcgagcagaaggcccgcgagacgcucaagaacucggcucugagcgcgcagcugcgcgaggccgcuacucaggc

SEQ ID NO: 15162 - RNA, 75 nt, Human
ggccaugggcgccaaccaugcuggagaccagagcaacacaugccuggacacggcgacggaacgcaccacgaggcc

SEQ ID NO: 15163 - RNA, 64 nt, Human
caacaggccuauuagaagaaugaacuaacgugucuacgcaugauuauuuuucuuaagcugguug

SEQ ID NO: 15164 - RNA, 70 nt, Human
cuuugaagcagguaucuugcauggcccaccggggucgaagucccugccaugcuaccucugaaagucaaag

SEQ ID NO: 15165 - RNA, 80 nt, Human
gagggcacuggaaaggucgguacuuagaugcccagugaaaaccccucaccccaaucucugcccugccugcaggagcccuc

SEQ ID NO: 15166 - RNA, 69 nt, Human
guggugcuucgagcuggagggcagcaggugacccucaccacucaugcccccuuuggcuugggggcccau

SEQ ID NO: 15167 - RNA, 72 nt, Human
acaaggccugucugccugaugccaagacccaacgccuguuuuuuaaguggcagcaggacauacggcaauugu

SEQ ID NO: 15168 - RNA, 85 nt, Human
ccaaccaaauggcuuugccuccaccaaaagacauagagauucuuaccucuaugcuaaguuuguguuuggguacccucuagguugg

SEQ ID NO: 15169 - RNA, 73 nt, Human
uuucagcguauucucagcuaugacacaguggugcaaacaacuggagacucguggcacauaccauaugaugaag

SEQ ID NO: 15170 - RNA, 69 nt, Human
gagaaauggauaaacgaaaaaaagaaaaagaaaaccaaucacagcuuccuaauccuuaucucauuuuuc

SEQ ID NO: 15171 - RNA, 78 nt, Human; identical to SEQ ID NO: 99

SEQ ID NO: 15172 - RNA, 65 nt, Human; identical to SEQ ID NO: 247

SEQ ID NO: 15173 - RNA, 80 nt, Human; identical to SEQ ID NO: 100

SEQ ID NO: 15174 - RNA, 60 nt, Human
agcaccuuuuagaauaucccauguucuggcaauacaaacacguucuucugaaagguagcu

SEQ ID NO: 15175 - RNA, 70 nt, Human
gaaguguaacaauacauuccaggccuuuuauuucaauaguaaaauaauacaugucuuguucuaacacuuu

SEQ ID NO: 15176 - RNA, 81 nt, Human
acuguuagauacauuaccauucguuaugaaauaaccuuguuaugcuucaauaucauauuggugaaaugucuucauugcagu

SEQ ID NO: 15177 - RNA, 63 nt, Human
guaaggcugucauugugucagggcacagcacugcgccccaucaagucacacugucaaauuugc

SEQ ID NO: 15178 - RNA, 66 nt, Human
ucccuuuaucgugaacagaaggcgccugguaauuaaaacgggaauccucugcuuucacugcuggga

SEQ ID NO: 15179 - RNA, 69 nt, Human
agccugcuuugcaaggagcagcgccucugcugcugcugugcacagccgcgcgcuucaauaaaaguagcu

SEQ ID NO: 15180 - RNA, 62 nt, Human
uggagaaagcagcccaggacacuguugaauaaaacacacaauagucucuguggucuucucca

SEQ ID NO: 15181 - RNA, 102 nt, Human
acacuugaggugugugaccacuuuacagagaagaggcuaugaaagauaaaucuucaucuauuuaaaaguacuucuccauaaagaaagaacagacuuccuugu

SEQ ID NO: 15182 - RNA, 87 nt, Human
accugcuaugaauauuacugcacaaaucuggaaggacaaaugcuuuuguuuuucuuagguagauggcagugaaugaaauuguugggu

SEQ ID NO: 15183 - RNA, 63 nt, Human
aaccucuaucagacuaaguaauuucccuuuaauuccuaguuuuuuuuauugugaauggauguu

SEQ ID NO: 15184 - RNA, 127 nt, Human
uauaauuguuuuaaugugcuguucaggacaccauuauaauguuuacuguaacauaauguuuccuuucugugggaaaacuuucaguauuucauaguuaaguaucauguuugcuguuaagauuuuuaua

SEQ ID NO: 15185 - RNA, 69 nt, Human
cggacgagacgggcccuuguggaguucgagucgaacccagaagaaacgagggagcccgggucuccuccg

SEQ ID NO: 15186 - RNA, 72 nt, Human
gugugcagcgggcuggccuggggucccccgaaaggccgccgaagacaagcccaggaucaccccgucugcagc

SEQ ID NO: 15187 - RNA, 70 nt, Human
acaguuuuuauuuccaucaguaaauguauaaaaacacuuuucccuuaauacucauggcaauaacuauugu

SEQ ID NO: 15188 - RNA, 71 nt, Human
aggcugaaaugaaagugucuuccaggguggguacucaacuaaagcucugaggaggaauucgcuuccagccu

SEQ ID NO: 15189 - RNA, 68 nt, Human
auuaaaaaauacauagaaaaaagaaaaaaauccugguggauguagugauuuuucaguguuauuuuaau

SEQ ID NO: 15190 - RNA, 68 nt, Human
cugucgcccaggcuggagugcagugucaugaucucagcucacugcaagcuccaccucccggguucaag

SEQ ID NO: 15191 - RNA, 76 nt, Human
cuucuaguaaguaauuauuuucacuugguugauuuauaucuuuuucaucuaucuggggcaacauacugcuuggagg

SEQ ID NO: 15192 - RNA, 88 nt, Human
ggcuggucuugaacuccuuacgucgugauccaccugcuucggccucccaaagugcugggauuacaggcgugagccacugugcccagcu

SEQ ID NO: 15193 - RNA, 131 nt, Human
caaacucugucugggccacgcggagcuccugcucagaagccuguggacaggcccguguccuugaugagggagaggaggggcaggggcuuucccaggcuggggacagagccgugcuccuggcaguuguuggg

SEQ ID NO: 15194 - RNA, 61 nt, Human
guccacacugaaggccccaccgccaauaugauuauugguuuucagaagggagccuguugac

SEQ ID NO: 15195 - RNA, 94 nt, Human
ucauguguuuugcacugacuaguacugaauaauacaaccacucuuauuuaauguuaguauuauuuauuugacaacucagugucuaacagcuuga

SEQ ID NO: 15196 - RNA, 68 nt, Human
agccccacugauggucuguccugacugccaggcaccugcuugguuuagaggcagacaacagcaggguu

SEQ ID NO: 15197 - RNA, 67 nt, Human
gaagagguggugcuucaccagcaugucccggacgcccuccuucaggggcugcugcgccucucucuuc

SEQ ID NO: 15198 - RNA, 72 nt, Human
gcaagcggcgccgcaaccuucugcguaacccguguggggaagaggacuuggaaggcuggugugacguggagc

SEQ ID NO: 15199 - RNA, 75 nt, Human
ugaguggugucacaaagcacaggucauagacccugaggguugaggcuacugugaggaacugcuugacacgacuca

SEQ ID NO: 15200 - RNA, 121 nt, Human
ggggcauggaacacuuggguucugaguucaagauuuggcaaugucuugaccuggguuggaagguagggugggucuggaaaagcuuugguccaggguucaagauuugagagugccuugcucc

SEQ ID NO: 15201 - RNA, 65 nt, Human; identical to SEQ ID NO: 10292

SEQ ID NO: 15202 - RNA, 62 nt, Human
cccagccccuagccccacagccaagacaguuugacauaacaggccccggggcccugguuggg

SEQ ID NO: 15203 - RNA, 101 nt, Human
uguggccguggcguggccuggugaucuuggccacuguggucuuagggggugcccuccccgaggccuggcuuauggugguggccagggccucgucacccucg

SEQ ID NO: 15204 - RNA, 61 nt, Human
auuuaugauuuaauuaaaacuauuuaugcuucaauguaaaucucuuuaaugauuauuaaau

SEQ ID NO: 15205 - RNA, 79 nt, Human
agcugccggguguuggggaaagagucgccugccuccggaccggagugcagaccucugacccuggagucgcucggccgcu

SEQ ID NO: 15206 - RNA, 94 nt, Human
ccccuugggucgucgccugggccgcccgucguuccccggccccgagggguccggcuggccgcgguguggguagaggucagcaugagccaagggg

SEQ ID NO: 15207 - RNA, 65 nt, Human
cuuucugggcagaagauggccacuguucaauaaaacgacugucauguggagcccuguccagagag

SEQ ID NO: 15208 - RNA, 65 nt, Human; identical to SEQ ID NO: 11397

SEQ ID NO: 15209 - RNA, 130 nt, Human
cucucucucuuuuugagauggagucuugccuuguugccuaggcuggagugcaguggcaugaucuuggcucauuguaaccuccaccucuuggguucaagugauucuccugucucagccucccgaauagaug

SEQ ID NO: 15210 - RNA, 63 nt, Human
gccuggccaauuuuuuuuuuuuguauuuuuaguagagaugggguuucaucauauuggucaggc

SEQ ID NO: 15211 - RNA, 66 nt, Human
ggugaugaaaauguucuaaaaccagcuguggugauaaucacacuauuugugaacacauuaaaaacc

SEQ ID NO: 15212 - RNA, 79 nt, Human; identical to SEQ ID NO: 5860

SEQ ID NO: 15213 - RNA, 72 nt, Human; identical to SEQ ID NO: 5861

SEQ ID NO: 15214 - RNA, 60 nt, Human; identical to SEQ ID NO: 1720

SEQ ID NO: 15215 - RNA, 64 nt, Human
acuuuuuuaaugggucucaaaauucugggacaaauuuuuggucaaguuguuuccauuaaaaagu

SEQ ID NO: 15216 - RNA, 89 nt, Human; identical to SEQ ID NO: 288

SEQ ID NO: 15217 - RNA, 63 nt, Human
ccuucacgaugcuuugugugucauccggaaccucauccggauaaucguguggaguauggaagg

SEQ ID NO: 15218 - RNA, 60 nt, Human
ggggcugcugagauauccugugcccugggcaguuuagcccaagaagcggauuagugcccc

SEQ ID NO: 15219 - RNA, 74 nt, Human; identical to SEQ ID NO: 8144

SEQ ID NO: 15220 - RNA, 89 nt, Human
gucggaccccagcccuccggggccucgagggccugcagcagccgcugcagccucuugauggagauguccuggaaagccacaaagucgau

SEQ ID NO: 15221 - RNA, 61 nt, Human
gacacuuuuggauuuucccgucuuuuccaacaccaaggaugagauuaucaaaagauguguc

SEQ ID NO: 15222 - RNA, 69 nt, Human
gccuuggcgcugccggucccaacuugauccaaggagccuugagaaggagaugagauucaguaccagggc

SEQ ID NO: 15223 - RNA, 78 nt, Human
ggccguggcucccauccuccggaaucugcaaaauggcuacuucuucagacauaauggggagagggauggcaagaggcc

SEQ ID NO: 15224 - RNA, 62 nt, Human
ggagguuuggggacuuccuucagacccccaguaaacuuguuuguggaggccuucagaccccc

SEQ ID NO: 15225 - RNA, 87 nt, Human
aauggaaaccccuccaccucccacuucucaaaagcacccaacaacgggcccugggcacugagggugggagguggagggguuaccauu

SEQ ID NO: 15226 - RNA, 108 nt, Human
gacucccaggagaccuggccagcugcagcggcccccguggaccagcagagggacaagagaggagcugacguggaggagccgaggcccacugggggcuccuggagaguc

SEQ ID NO: 15227 - RNA, 67 nt, Human
gguguggagcggaggccgcggaggcuccucgguccuucagcaccccucggcccgacgcacccacgcc

SEQ ID NO: 15228 - RNA, 65 nt, Human
guagcuuccuuagaggacuccaaaacaaaacggggcucaccggcuuugggaaucucgucagcugc

SEQ ID NO: 15229 - RNA, 89 nt, Human; identical to SEQ ID NO: 15114

SEQ ID NO: 15230 - RNA, 60 nt, Human
gcaagugaggaaggaauucccuaucaauaaauggugcugggauaacuggcuaucacaugc

SEQ ID NO: 15231 - RNA, 80 nt, Human
uucuacggguccucaggguaucauaucagugggagggcuccuaagaaugugggaagauuagcgggggaccccucauagag

SEQ ID NO: 15232 - RNA, 102 nt, Human
aggggagguucuugcagauucccaaggaaaugucagaaaggcaaaauggccagcauuauccauuugcuuuuuuggguuuacugggugaauagcacuuuccuu

SEQ ID NO: 15233 - RNA, 84 nt, Human
gcuagcuuguuuguauagguagaaugauucaucucuccauuuuagauggcuagauguuuuguggaagaucuuagaauugccugc

SEQ ID NO: 15234 - RNA, 77 nt, Human; identical to SEQ ID NO: 796

SEQ ID NO: 15235 - RNA, 60 nt, Human; identical to SEQ ID NO: 11384

SEQ ID NO: 15236 - RNA, 64 nt, Human; identical to SEQ ID NO: 11385

SEQ ID NO: 15237 - RNA, 96 nt, Human
ucuguuauaacaucucaacuuaccuguugccacuuggaauauauaucgauacauuauggugccgagugguaacaugggaguguuugauccaacaga

SEQ ID NO: 15238 - RNA, 83 nt, Human; identical to SEQ ID NO: 12564

SEQ ID NO: 15239 - RNA, 73 nt, Human
cccagacgccaugaaagcugccauggccuggagaaaaagcugaaccaggccuuuggaaucuuaaugcccuggg

SEQ ID NO: 15240 - RNA, 68 nt, Human
cccaucucugugacuuccuggagacucacuuccuagaugaggacgugaaggcuaucacagaagauggg

SEQ ID NO: 15241 - RNA, 60 nt, Human
cuuugagcaaggauaugagggcccugcaaggaaggggucugcgaaacucacacagcaaag

SEQ ID NO: 15242 - RNA, 77 nt, Human
auuuguuuuuauugguguagucgcugcaguuuuaccugccaugguggugcucagguauaacauagauggaaacaagu

SEQ ID NO: 15243 - RNA, 63 nt, Human
ucauuuuguuuucuuucucuuaauucuguuaauuuauuuaaucucaugggagagaaaacauga

SEQ ID NO: 15244 - RNA, 70 nt, Human
acaggaacuuuggagauaaacagggcucucgacauuggcaaguugcaccaucccugguuucuccaucugu

SEQ ID NO: 15245 - RNA, 62 nt, Human
gaccauaugcauaguaccgagaaacuagugcgaaguagugaucagguaugcuguuagauauc

SEQ ID NO: 15246 - RNA, 63 nt, Human
cuucuucugggguucucuaauggggauaacauuaaucaucuccuaagaugacuauaguagagg

SEQ ID NO: 15247 - RNA, 61 nt, Human
gacauggcuguugugaggaucaaauggaaggauccaugagugcuuagaacaguccuggguc

SEQ ID NO: 15248 - RNA, 77 nt, Human
ucacagccuuucuauccugaacguuuuguuccuuagaugccagagaaauguuuagcauuggaauucugaaggcuuga

SEQ ID NO: 15249 - RNA, 98 nt, Human
ugaugguucucugcuuuauaucuccaacuggaauaaugcuguuggugagagaaagaaaacagcacuuagucagguuugagaaagcuuuucaugccaca

SEQ ID NO: 15250 - RNA, 67 nt, Human
caggguaccugauacaugagcauuuaacauauaugcugauauaugcugauaugcuguuagguuccug

SEQ ID NO: 15251 - RNA, 63 nt, Human
guacagauuuuuauaaaaucaucuauacagaugaaguacaaauuuuuauaaaauaaucuauac

SEQ ID NO: 15252 - RNA, 73 nt, Human
aaguauuauaaauuaucuaauugccaaauacagagaauacuucugagaauggaagaaauggauuuaugugcuu

SEQ ID NO: 15253 - RNA, 65 nt, Human
cuuaacuaaacuucguuucgaugagacauuguuucacaaucaaaguuaguccuugaaguuuuaag

SEQ ID NO: 15254 - RNA, 74 nt, Human
uaggaccugugcaucuauucaguauaaauauuuuaaaaguuuaaauaccuuaugggaaccuugcauggguccug

SEQ ID NO: 15255 - RNA, 67 nt, Human
ggagggaaugugauggucaaggucacucuaccaaugaguuccucccagaccgacgcuuuguuccccc

SEQ ID NO: 15256 - RNA, 103 nt, Human
ucugguauaaugaucuaugaugccaacauuacucaaagcagguaccacuguuuacuuugguguagucaauggcagaccuuauaaaucaaauacaacaaccagg

SEQ ID NO: 15257 - RNA, 89 nt, Human
uuggaaugaguuacagagauaucgauaugaguacaaugagagagaagguacuuuagucauauguugauaaaaacuuguacaucacccaa

SEQ ID NO: 15258 - RNA, 66 nt, Human
aggcagauuuuccaggacaagaaccuguguuccaucauuuuuuuuuuuuuuuuggagacuccgucu

SEQ ID NO: 15259 - RNA, 101 nt, Human
gggaugcgcgugagccgcagggugugggggcccguacacggcaggcacucagcaggcugccagggaccacaggcacccucgcgucugaacccagccauccc

SEQ ID NO: 15260 - RNA, 84 nt, Human
ugaugcgucgcaguauggucugcaggucggguagccgguggcggugcugcagguaggguguggugcggacuauagcaugcauca

SEQ ID NO: 15261 - RNA, 112 nt, Human
cauaacuauuaguggcagguuaguuguguguagggcucaugguagggguaaaaggagggcaauugcuagaucaaauaauaagaagguaauagcuacuaagaagaauuuuaug

SEQ ID NO: 15262 - RNA, 67 nt, Human
ccugcccucugaucucugccuguuccucugucccacagggggcaaaggcuacgggucagagagcggg

SEQ ID NO: 15263 - RNA, 63 nt, Human
guccgcucugacucggcuggcgucuuucgcucgcguuggaggccgccuuuucagaagcggugc

SEQ ID NO: 15264 - RNA, 120 nt, Human
uugauguacaguuucuccuaagaagaagcgaggugguugaauuuuggaagcacuucuugaaucggauuaacccaugcucuuauugaauuuuuucaucugcucuguuuaguuugauauuaa

SEQ ID NO: 15265 - RNA, 60 nt, Human
gguagcaggccccaaguuauuauuccccgcccugaauauucaucuuguagcagcucugcc

SEQ ID NO: 15266 - RNA, 72 nt, Human
ugacauugugcucaggucgcaggcccaggcucccacccaggacaaggggcagacgagagcugugagcaguca

SEQ ID NO: 15267 - RNA, 75 nt, Human
gagagacuacuugauauaauuuugauuuucuuaaauuuauuaagaguuguuuuguguccuaucauauggucuauc

SEQ ID NO: 15268 - RNA, 71 nt, Human
gaucacucaggagcauguuauucaauuuucauguauuuacauuguuuugaagguuccuuuuggaguugauu

SEQ ID NO: 15269 - RNA, 89 nt, Human
gcucuuucagauuuuuugauguaggcauuuaaggcuauguacuuuccacuuagcuucaccuuugccauaucccagauguuuugauaggu

SEQ ID NO: 15270 - RNA, 81 nt, Human
ugauagguugugucacuauuauuguucaguucaaauaauuuuuaaauuuccaucuugauuuuauuguugacccaaugauca

SEQ ID NO: 15271 - RNA, 60 nt, Human
cagugccgggagaucuugucuguggacuguuccaccaacaaccccucccaggcuaagcug

SEQ ID NO: 15272 - RNA, 61 nt, Human
gcccagccgcgagccccccaagaugaacccagugguggagccacuguccuggaugcugggc

SEQ ID NO: 15273 - RNA, 71 nt, Human
uacagaauagaauacauugauacaaaguacagaaaaauacuuugauuuuuauccauuucuuuuacucugug

SEQ ID NO: 15274 - RNA, 65 nt, Human
gaggucauugugugggaauucgcaguguuuaaaaaauaauaccacugggccuggcgcagugacuc

SEQ ID NO: 15275 - RNA, 64 nt, Human; identical to SEQ ID NO: 1375

SEQ ID NO: 15276 - RNA, 61 nt, Human; identical to SEQ ID NO: 2204

SEQ ID NO: 15277 - RNA, 70 nt, Human
gucucuuuuuaccuaguaagaguagacuucuuuaagucaaggaauaugcuuuauucaggugcucggcggc

SEQ ID NO: 15278 - RNA, 80 nt, Human
gaagggcugcagugaccccuccuggccagcagagguauuggcccagccaggcugggggagggcugaaacugcuucccuuc

SEQ ID NO: 15279 - RNA, 91 nt, Human
ggcauauaaaccuuggcuuuucauaagcucuaccugccuauccccaggaguuagggaggaucuauuugugauggccuaggguuuaagagcu

SEQ ID NO: 15280 - RNA, 62 nt, Human
gugggaggauuuugagauacuuauucuuuauuugagccagucuugcaagguuaacuucucac

SEQ ID NO: 15281 - RNA, 64 nt, Human
uuuguuacuuuuuucggaguuagggagggauugaagacugaaccucccuuggaagaauaccaga

SEQ ID NO: 15282 - RNA, 69 nt, Human
acuuacaccacuuucaggcacauccaaagaguuccuagauacuuggaaaaugucugaaaauuuuuaagu

SEQ ID NO: 15283 - RNA, 62 nt, Human
gccuugagaacaaauagauuguuacagccuugggcugcugcguaaucacgguuccucgaggc

SEQ ID NO: 15284 - RNA, 98 nt, Human
uuccaauuucauuguuaugccuauugaaguauuaauugccagguuugauuuuuagugaagcuuggaguccauacuuugagcagaccaagugaagggaa

SEQ ID NO: 15285 - RNA, 78 nt, Human
agaagcgcgucgaccugcgccaucugccguucgucaccaucgacggcgaagaugcccgcgacuucgacgaugcggucu

SEQ ID NO: 15286 - RNA, 67 nt, Human
ccuacgacauuccccacgucuggccgagcgugcucaaggaagcggcgacucaagccggaagucgagg

SEQ ID NO: 15287 - RNA, 75 nt, Human
gauccagcaggaagugcuggugaccccgggccgcaacgccgacgcccgugucgucaguucgucaaggugaagauc

SEQ ID NO: 15288 - RNA, 72 nt, Human
gcccagggcgaugugaucgaaguggugggcaacuacauggcgcccggcauggagaucgaugucgcgcugcgc

SEQ ID NO: 15289 - RNA, 81 nt, Human
aaugugauguuugcuuaaauaugugauagaguguaucuuuuuaaaacauguucuuaaaauauauuagcaggucauuauauu

SEQ ID NO: 15290 - RNA, 75 nt, Human
cccucaaguuuacugaguugguggaaaugugggcguucuagagaacugcccuaauauagacuacagcuaagaggg

SEQ ID NO: 15291 - RNA, 62 nt, Human
guuuguuacugcaacagacuggaguuuguuacugcaacagacuggaguuuguuacugcaaac

SEQ ID NO: 15292 - RNA, 61 nt, Human
ggcggcugaggcggcauggaucucagcgagcuggagagagacaauacaggccgcugucgcc

SEQ ID NO: 15293 - RNA, 68 nt, Human; identical to SEQ ID NO: 863

SEQ ID NO: 15294 - RNA, 62 nt, Human; identical to SEQ ID NO: 864

SEQ ID NO: 15295 - RNA, 84 nt, Human
cucagccagggcugcuugcggaaaagauugauuugaaagucucuuggcggcggaacuuugcuacaaggggcccuuuugccggag

SEQ ID NO: 15296 - RNA, 86 nt, Human; identical to SEQ ID NO: 343

SEQ ID NO: 15297 - RNA, 70 nt, Human
uggaggggcggcagauucuggcagggcagcagagggcucaguggccauggcuagagggguaaaaaauuca

SEQ ID NO: 15298 - RNA, 97 nt, Human
uuuuuuuuguggaaaccauugauuuuuauuaauuucauaacugggaaauuccaugugaaagugaaacaagcaugagucaagucaaccagggaaggaa

SEQ ID NO: 15299 - RNA, 85 nt, Human
ggauguggaguaccguccccugaccuugacugcacuaugggcuguggggccuggggcaggagaggcccagggcgugcccguaccc

SEQ ID NO: 15300 - RNA, 69 nt, Human
guuagucagaucuagaggaucccacuugcauguaccggcuugcaugggaagcuugaguauugcacugac

SEQ ID NO: 15301 - RNA, 87 nt, Human
uguccaucugucuguauaccuucgugagggacuccguaggggagccucuguacaugcucuuucgagggauuaagcaccaaguggaua

SEQ ID NO: 15302 - RNA, 74 nt, Human
acgaacgguuaagcuggcuguccugaacacuauuauaacgguggacugagaauggcaaaauuagucgccuucgu

SEQ ID NO: 15303 - RNA, 82 nt, Human
ucuugugucgagacuucgugguggugcuaagcaaacaggaagaagaagucuuacaccacucccaagaagaauaagcacaaga

SEQ ID NO: 15304 - RNA, 80 nt, Human; identical to SEQ ID NO: 7779

SEQ ID NO: 15305 - RNA, 83 nt, Human
gcugaacuguguuuacuggaaaaauucagaggccuaaaguuuaaaauaaaauuuacuucugauguuuuaauuaaaauguuugc

SEQ ID NO: 15306 - RNA, 62 nt, Human; identical to SEQ ID NO: 7780

SEQ ID NO: 15307 - RNA, 81 nt, Human
uuugugcuauuuuaucacaggcuuacacuacaauuguuaauaaauacuucauuuggagauguaugguguaaaacacacaaa

SEQ ID NO: 15308 - RNA, 100 nt, Human
aucccaauacugggaggccgaggcaggcagaucacaaggucaggaguucgagaccagccucaagugauucccccgccugggccuccuaaaguggcgggau

SEQ ID NO: 15309 - RNA, 130 nt, Human
cacagcucugggaaaacaagaggagcagacaggguucccugggcccagucucagcccagccacugaugcuggaugaccuuggccugacccuggucuggucucagaaaucacuuuucccaucuguaaauug

SEQ ID NO: 15310 - RNA, 61 nt, Human
uuuucaggugaagagugagguugucauggccucagcuaugcuuccuggcucucccucaaga

SEQ ID NO: 15311 - RNA, 75 nt, Human
cagcauuuuuauuuuaaguauucagcauuuuccaggaaauuaccauauuucuugcugacuuauaaagguuugcug

SEQ ID NO: 15312 - RNA, 60 nt, Human
cuauaugagcaguggaagaauuucgaugagagaaaagagauggcaaccauucuuaguaag

SEQ ID NO: 15313 - RNA, 86 nt, Human
guuaaagucuggguuauugggccauauucgaauggcgguuauugugggcgccaaguuuuucgauuauagcuauacccagaagcaac

SEQ ID NO: 15314 - RNA, 61 nt, Human; identical to SEQ ID NO: 6766

SEQ ID NO: 15315 - RNA, 69 nt, Human; identical to SEQ ID NO: 9578

SEQ ID NO: 15316 - RNA, 60 nt, Human
cccggacccugcucucaccccuggcacccgugccuacggguggcucccagaacauccugg

SEQ ID NO: 15317 - RNA, 85 nt, Human
agguuuugcucuguuacccaggauggaaugcaguggcgugaucauagcucacuguaaccuugaacuccugggcucaagcaauccu

SEQ ID NO: 15318 - RNA, 61 nt, Human
acugugggcucccuggccggccagccgcuacaggagcggacccaggccuggggcgagcggu

SEQ ID NO: 15319 - RNA, 100 nt, Human
ggcaguguaccaggcccuggcccgcgagggcgccgagcgcggucuaagcgccauccgugagcgccuggggccccugguggaacagggccgugugcgggcc

SEQ ID NO: 15320 - RNA, 103 nt, Human
ugcgcaucaagcuggaggagcaggcccagcagauacgccugcaggccgaggccuuucaggcccgucucaagagcugguucgagccccugguggaagacaugca

SEQ ID NO: 15321 - RNA, 79 nt, Human
aggcuggaaugcagugauacuaacauggcucgcagcagccuugaccuccugggcucaagcgacccuccugcuucagccu

SEQ ID NO: 15322 - RNA, 68 nt, Human
guagaaacagggucucgguauguuacccaggcuggucuugacauccugggcucaaccuauccuccuac

SEQ ID NO: 15323 - RNA, 63 nt, Human
cgcuuuucuaagucaguuguuucucgggcuacccuuuaagagacacugcugaauggccuggug

SEQ ID NO: 15324 - RNA, 80 nt, Human
uacagaaacagauggguacaagaacuaagaaaacggcuaagaaaguguuuugguccugacuacuaccauuucgcucugug

SEQ ID NO: 15325 - RNA, 83 nt, Human
ugcccuuucuucuuugucaaaagacaaaaucacaacaaauuuaguucaaagauuuuuuuuuucuuaagagacggacucuggca

SEQ ID NO: 15326 - RNA, 72 nt, Human; identical to SEQ ID NO: 7743

SEQ ID NO: 15327 - RNA, 66 nt, Human; identical to SEQ ID NO: 8995

SEQ ID NO: 15328 - RNA, 64 nt, Human
ugggaaccacgucaccacgguacaacaggcagcaagccauguauuuaccauggcgagggucaca

SEQ ID NO: 15329 - RNA, 70 nt, Human; identical to SEQ ID NO: 6934

SEQ ID NO: 15330 - RNA, 77 nt, Human; identical to SEQ ID NO: 9246

SEQ ID NO: 15331 - RNA, 61 nt, Human
guagagguugucuuuuucgauggcaaaucggacccuugcaggcugagggagagaaagcuac

SEQ ID NO: 15332 - RNA, 72 nt, Human
cuauggcauuugcagauguucagccccauguagcugacgucauggacagggcuggauguugagugacuguag

SEQ ID NO: 15333 - RNA, 73 nt, Human
ggcuauuugcacugggcuucuuuucaugccgcuacucuaagccucccugaauuuucccccgggacaaucagcc

SEQ ID NO: 15334 - RNA, 69 nt, Human
cgcgaagaugccaguggcggugauggcggaaagcgccgucuaguuucaaaaaguugcuggaucagugcg

SEQ ID NO: 15335 - RNA, 60 nt, Human
gaacuugggggaauuuggucaguaggacaaagaaucuggcagagagauuucccugggauc

SEQ ID NO: 15336 - RNA, 71 nt, Human
ggagcucgaggccccuggaggaauugcuacacccccaguguauggucagcuucuagcuuuauauuugcucc

SEQ ID NO: 15337 - RNA, 86 nt, Human
agagauauuguugauuaaagaaaaucuagaacugaagugaaagaagagaguuccaguucuaauagucuuuugauuaacaauucuuu

SEQ ID NO: 15338 - RNA, 61 nt, Human
guugaaggcacaacaguuaauggcuguauuguugcuauuccguugcugacauguuuuuaau

SEQ ID NO: 15339 - RNA, 74 nt, Human
gcucagcuacacagggcgugaugaccggcacuuuguacccaugggccucuacaucgucaggcagugauaugagc

SEQ ID NO: 15340 - RNA, 81 nt, Human
ggagguguacagacuggaagagauggagaagauuuuugucagguuggagaugaagaucaucaagggcuccaguggcacccc

SEQ ID NO: 15341 - RNA, 70 nt, Human
acagaaaaggcuaaugauaccuaaaaagcuuucacccuguuacguaggucaacucaguuaccuuggcugu

SEQ ID NO: 15342 - RNA, 71 nt, Human
ccaaagaagcguaguauacuaggaccuauauaugucugagggaucuaaggcaccacuauguucugacuugg

SEQ ID NO: 15343 - RNA, 70 nt, Human
acagaaaaggauaaugauaccuaaaaagcuuucacccuguuacguaggucaacucaguuaccuuggcugu

SEQ ID NO: 15344 - RNA, 65 nt, Human
auuacggaggaaaaggggggcauaggguguuguucaacucuaugagggguguugucgucgguggu

SEQ ID NO: 15345 - RNA, 67 nt, Human
ccugggagaagugggugucccguaaauugagcgagaguugggguaggggagaauauauugagugggg

SEQ ID NO: 15346 - RNA, 70 nt, Human
gugugugaagcccguguacucuagugagcaguaguuuuuggucaagggaaaacggggguaucauaagcac

SEQ ID NO: 15347 - RNA, 61 nt, Human
ggagccaccacggggcugcuggcucaguuugccucuucccucccccagcaguccaagcucu

SEQ ID NO: 15348 - RNA, 64 nt, Human
gucccucaaauaaaagucacuuucacgagguggucaaggaaggccagugugcuuuuguagggac

SEQ ID NO: 15349 - RNA, 104 nt, Human
gucguggcucuaagauaauaaaucaaauguuguguuaucuuugguugaaagauacacagaucaaaauauuuguuggaauauauuuuaaaaauugagaaaacgac

SEQ ID NO: 15350 - RNA, 73 nt, Human
ugggaauguguggggggcuuccaugggcacaugauccucaagggcauucuagcccauuaggcucccaguccca

SEQ ID NO: 15351 - RNA, 120 nt, Human
ccauuuuuaaucuauggguucaacuguuugugagacugaauccuugcaaugcauuaagauauuaaagcaaauuaugauucacucauuucuugcgggucguaucccugauuucagaagagg

SEQ ID NO: 15352 - RNA, 60 nt, Human; identical to SEQ ID NO: 8964

SEQ ID NO: 15353 - RNA, 85 nt, Human
uggcaucccagauguugcaguugaagucgucguagccagcgagcagcagccguccgcugcgcgagaaggcaacagagggaugcca

SEQ ID NO: 15354 - RNA, 64 nt, Human; identical to SEQ ID NO: 287

SEQ ID NO: 15355 - RNA, 103 nt, Human; identical to SEQ ID NO: 294

SEQ ID NO: 15356 - RNA, 82 nt, Human; identical to SEQ ID NO: 8105

SEQ ID NO: 15357 - RNA, 84 nt, Human; identical to SEQ ID NO: 286

SEQ ID NO: 15358 - RNA, 66 nt, Human
cagcaggacaauggcauggacuggcuuaacgacacgcucugggucuaccaucccuauauccugcug

SEQ ID NO: 15359 - RNA, 83 nt, Human
cuucaagugucuugaugguagacaaggugaacguuuccuccuucucaaauucauccccuaccucaucccaggcugcuucgaag

SEQ ID NO: 15360 - RNA, 63 nt, Human
ggaugucaugaccaccccggaacacaccagccaggaacaaccgggugguuguccuuguuaucc

SEQ ID NO: 15361 - RNA, 60 nt, Human
gguaguguuggggaaggguaugagguccuaugcaggcuggccucuuaucccacagaugcc

SEQ ID NO: 15362 - RNA, 61 nt, Human
ggguucuccggggaacuccuccagcuuggucagcaaguucucgggguucuccggggaaucc

SEQ ID NO: 15363 - RNA, 71 nt, Human
ucuuaauacagucgugugucauaaccugaccuggaaaagaucagucgaugaucuaguaggcgguguugagg

SEQ ID NO: 15364 - RNA, 74 nt, Human
gaagguuccuguccuucccuagcuaacaaagguuaauccagcagcaguguuguggggcuggggagcagaucuuc

SEQ ID NO: 15365 - RNA, 75 nt, Human
gugaugcgguugugaggaccauggagagugaccugcgagggagcuuagggaucaccucagccaacucugcauuac

SEQ ID NO: 15366 - RNA, 79 nt, Human; identical to SEQ ID NO: 2688

SEQ ID NO: 15367 - RNA, 70 nt, Human
cauuugaaaauggccuugugauacuguggaacuguaaauuauuuauuuuuuacauaaggucacuuaaaug

SEQ ID NO: 15368 - RNA, 97 nt, Human
ucuacuuuauaaucagauauuacggggguuagaugcucucggguaaaucuuacugagagagggcuaguaacugaaauuucuuguacuuaaggauggg

SEQ ID NO: 15369 - RNA, 82 nt, Human
gguggccacagcucaucaggaacagcuucuucuaagggauccacuggaccuaggaaaaccgagguguugagagcaggccacc

SEQ ID NO: 15370 - RNA, 88 nt, Human
uggaagugaugacucuaaacagugcaaugaacaauuuauuuauguacuauuaaaagaacuguaaaugcaauguaaagacacacagcca

SEQ ID NO: 15371 - RNA, 71 nt, Human
gggguuauaaugagaagaaaauaacagacaauauucagugugagauuuuucaaguucuuuaugaagaagcc

SEQ ID NO: 15372 - RNA, 62 nt, Human
guuucauauaguuuuugugcugagaacagauaccaauguauguguacgaaagacugugaaac

SEQ ID NO: 15373 - RNA, 105 nt, Human
uagacaauggggugggggugggcucaaggugagaugauuuuuuggguccaagucuacucaagacaggcaucccagucuucggucuccaaauccaccuccugucug

SEQ ID NO: 15374 - RNA, 86 nt, Human
cgacuggguggacaggccguuuguugugaaucguacaggcuuccaggagcgggugccgaucaauagcgaggugccgaugaauagcg

SEQ ID NO: 15375 - RNA, 67 nt, Human
cugagcauguuguccuagaccugggcaaaggacaauucagagcucgggggaauaggggugugcucag

SEQ ID NO: 15376 - RNA, 65 nt, Human
ugcuccuuguaggcagaugccacaccccaauuucauggagugauuugcgucugcagcaggcagca

SEQ ID NO: 15377 - RNA, 61 nt, Human
ggguaguggcuaacgggugggacggcacagaucuggguguucucauuuguucuccacgccc

SEQ ID NO: 15378 - RNA, 78 nt, Human; identical to SEQ ID NO: 5302

SEQ ID NO: 15379 - RNA, 62 nt, Human; identical to SEQ ID NO: 484

SEQ ID NO: 15380 - RNA, 86 nt, Human
gaagaaaagaaaugggaauaaauaauaguacucaccccaucgaaugaucaugaguaucaaauuaaauguaaaacuuuguuuuuuuc

SEQ ID NO: 15381 - RNA, 84 nt, Human
ucaagagacaacuuuaaaaacuccauugugguccauuuucuaaaacagacacacacggaggguggaguaaaguaaugucuagga

SEQ ID NO: 15382 - RNA, 111 nt, Human
ggagcauucuugucccucuauccucacagagaagcagaggcuucucuccccaagaucuuggggugaggcugggccaugugcugggguugugaggaugagucaaggaggccc

SEQ ID NO: 15383 - RNA, 71 nt, Human
uccucgcuguuuugugcccaggcuaccuugugaugcuuuuugcugaagccugggcuuugaaaggugggugg

SEQ ID NO: 15384 - RNA, 88 nt, Human
ggccagcgcgagggcaucguggcgaccgaugcaggagaaggugucccccuucuuccaguccucggcugccacgcgcaguaugcugguc

SEQ ID NO: 15385 - RNA, 95 nt, Human
gggcccacccggugggacccccguggggcagggagcugggcccgacauggcuccggccucugccuuugcaccacgggacaucacagggugggccu

SEQ ID NO: 15386 - RNA, 65 nt, Human
aggucaccagugacagggaaaaaguccugaaauccaggaaaaucacuuagucccugcgggugccu

SEQ ID NO: 15387 - RNA, 88 nt, Human
ggagacggcccagcaggucugggaaauggugcaucaggugcuugcaggugguguugaggaacuccccgaagugcagggcucggccucc

SEQ ID NO: 15388 - RNA, 80 nt, Human
gggcggcguggggguggggcaggggguggugcuuaccggugaacaggggugcagcagcucggacguucucccagcugcuc

SEQ ID NO: 15389 - RNA, 63 nt, Human
ggaguugggugcuccaugaagagauggggcaggugcccccacuugacucucgccccagacucc

SEQ ID NO: 15390 - RNA, 74 nt, Human
gauaggccacguagucaacucucaagccguguucucccugaaaagagcaguguaagugacuacgacggguuguu

SEQ ID NO: 15391 - RNA, 66 nt, Human
gugcuggaauccacaguuucuccggagggcuaugcaaggcgcuuuggaaaggcgaagccugggcgc

SEQ ID NO: 15392 - RNA, 62 nt, Human
cccgcuucaccggcagccgcagaggcaccccaggguguccucggcugccccggugggcaggg

SEQ ID NO: 15393 - RNA, 63 nt, Human
cuccaucgaccaccuggaaccggcgagcacgagagccaggacccagaggacacaugcagggag

SEQ ID NO: 15394 - RNA, 60 nt, Human
ggugacaacaugcuggagccaagugcuaacaugccuugguccaagggauggaaagucacc

SEQ ID NO: 15395 - RNA, 72 nt, Human
ggaacaagguguuaacaggccugggaaucuagaaaaucccaucagcuucaccauuuuguuuucauuuugucu

SEQ ID NO: 15396 - RNA, 67 nt, Human
guacuccgucaugaucaacaaggccacgcccuacaacuacccagugcccguccgugaugaugggaac

SEQ ID NO: 15397 - RNA, 70 nt, Human
ugugucgcgcgggucaaccuggccacgugcucccuagguccaugcgcgguugggugcgccugccggccca

SEQ ID NO: 15398 - RNA, 64 nt, Human
cccgggccugaagcuccaccccggccaggguccagacuucugcuuguggggaagcaggcccggg

SEQ ID NO: 15399 - RNA, 69 nt, Human
ccuuauaugauuuuaauaauucucacuuaacuaauuuuguaagccugagaucaauaagaaauguucagg

SEQ ID NO: 15400 - RNA, 80 nt, Human
ucuggguuccuuacauuaaaguuccucuuuccaguccugucuggaagugcuucacgaggaaugccugagggauucuuaga

SEQ ID NO: 15401 - RNA, 67 nt, Human
ucuguggguuacgccaucuuuaagguucuaaaugagaagaaacuucaagagguugauaguuuaugga

SEQ ID NO: 15402 - RNA, 60 nt, Human
uuugaaacuccagagaaagcaaacaaaauaguaaagcuaaaacauuugagaaauuucagg

SEQ ID NO: 15403 - RNA, 88 nt, Human
auuugagaauggaaaggacaaucuuugggaugacauagcuuaggacacuugcucauuuauuugaaagaguccgauacacagugcagau

SEQ ID NO: 15404 - RNA, 63 nt, Human
gugcuggguagcugugagagguuacucacuggaguagguagccuaguaauuagugguaagcac

SEQ ID NO: 15405 - RNA, 89 nt, Human
guaggagggcgacccuccggaggucgagagggggcguucucccgaauggggggggggccggucuuggaaucaccgggucguccucucuc

SEQ ID NO: 15406 - RNA, 81 nt, Human
ucgagauggcauccuccuugccacaggucuucacgugcaccgcaacucagcccauucagcaggaguaggagccaucuuuga

SEQ ID NO: 15407 - RNA, 66 nt, Human
ggcggaacacuggccaauuacagcgggcggggccccuuuuuuuauccgcuuagcauggcccccgcc

SEQ ID NO: 15408 - RNA, 65 nt, Human
ugucaggucuuucccuucccacgaggccauauuucagacuaucacauggggagaaaccuuggaca

SEQ ID NO: 15409 - RNA, 69 nt, Human
gccugaagagccgagagagaacuacuacagagagaagagcugugcuaacuuuaauugauuccuacaggc

SEQ ID NO: 15410 - RNA, 64 nt, Human
uuguaaggccaugaggguaaaacgggaaccgaggaagacgguuuagaccuucugugccccacaa

SEQ ID NO: 15411 - RNA, 80 nt, Human
gccacguguugcucagacagggugugcugggcaucaaggugaagaucaugcugcccugggacccaacugguaagauuggc

SEQ ID NO: 15412 - RNA, 71 nt, Human; identical to SEQ ID NO: 1145

SEQ ID NO: 15413 - RNA, 83 nt, Human
uuugucgcugacuggcauuuucacucggcuggaagugcaaaugauguauuccuuucuccgaggaugcucgugucguugacaga

SEQ ID NO: 15414 - RNA, 121 nt, Human
aucgucaaugaaagcccugggcugcucuccaggaugucaccauuggggguucggcucguccgguggccggggcggguuuccaccgguguggcgccuggccgcguccggggcuucgggcgau

SEQ ID NO: 15415 - RNA, 75 nt, Human; identical to SEQ ID NO: 74

SEQ ID NO: 15416 - RNA, 67 nt, Human; identical to SEQ ID NO: 836

SEQ ID NO: 15417 - RNA, 67 nt, Human
ggugaacggauuaugguggccgcaacacugggaaaacucauugguggugggaccauaaucauuaacc

SEQ ID NO: 15418 - RNA, 87 nt, Human; identical to SEQ ID NO: 76

SEQ ID NO: 15419 - RNA, 62 nt, Human
guuggucugaaagcccccgguaucauuccucgaauuucagugcgggaaccaugcagacuggc

SEQ ID NO: 15420 - RNA, 62 nt, Human
gauccccagccuucuaggacacuuaacugcagggcacucccugccuguaaggcuuugggguc

SEQ ID NO: 15421 - RNA, 73 nt, Human
ggcuccucuguuccgaccuuucccgugcccugcagauuucuagggcgcacugaggcucgaccacggaagggcc

SEQ ID NO: 15422 - RNA, 77 nt, Human
acucucaugucagaugugggccaaacuaggcugaucuccaccaacagcccagucaagcucaccucugacaugagagu

SEQ ID NO: 15423 - RNA, 109 nt, Human
uacuuuggacaagcuuccuggucucuuagccaaauuuucuccccucacccagcuguccccagcucugcuuacgagaagaacacaugguacuccagguccugacgaggug

SEQ ID NO: 15424 - RNA, 73 nt, Human
uguauaugcauuuguuauuuauauugaaaacauuccauuguuccuugcaguauagaaggcaaaugcaauuaua

SEQ ID NO: 15425 - RNA, 62 nt, Human
gggugcgcuugagccggucgaagacaaaccagcgcuucuuccaugauuuaaucuugccgccc

SEQ ID NO: 15426 - RNA, 67 nt, Human
aguugaucagauuucaaggucuggggaguauauccacuguguacugggucuugagcucuagagagcu

SEQ ID NO: 15427 - RNA, 79 nt, Human
ccaccccaugauuuuagcauucauugaugauucuugugugaacguuuaauacauuugugauuauggaauuuuaacgugg

SEQ ID NO: 15428 - RNA, 64 nt, Human
cugaggcugcuuucuugaagaaaacuugacuuuauuucauuuagugggaagagcagcagcccag

SEQ ID NO: 15429 - RNA, 89 nt, Human
ggcugugaaguguucguggcaguagacucugaagcuaaggagcugagggcuuaacaaguuucuagaagcugccaucaacaugccaaguc

SEQ ID NO: 15430 - RNA, 68 nt, Human
caagcgguccacagcuugacgcaauccagauuccacauguaggccugccagucgugccucaucgcuug

SEQ ID NO: 15431 - RNA, 81 nt, Human
cucaguaugcaugguuggcaauguagagugacugugcugcugcuccaccaucuucuacacugccuucauacuugcccugag

SEQ ID NO: 15432 - RNA, 63 nt, Human
cugggccugggcuuuugaaagcugagggaggaggaccauuugagcccaggagccugaaaccag

SEQ ID NO: 15433 - RNA, 80 nt, Human
uuuuuuuuuuuuuuuuuuuuuuggacaccaaaaaccaucuuuuauuggaaaauuaguuaagggaaacgggaaaaaaaaaa

SEQ ID NO: 15434 - RNA, 73 nt, Human
cuaguagugucuacuuccuagggcuguuagggguuacaugggauaaugccuguaaggguuaacacauugcugg

SEQ ID NO: 15435 - RNA, 74 nt, Human
gauuccucuauugccacugauuggagcugaaaauaaaacugaaauucagcuagaaaaaaaggagcauaugaguc

SEQ ID NO: 15436 - RNA, 80 nt, Human; identical to SEQ ID NO: 788

SEQ ID NO: 15437 - RNA, 70 nt, Human; identical to SEQ ID NO: 5658

SEQ ID NO: 15438 - RNA, 79 nt, Human; identical to SEQ ID NO: 3903

SEQ ID NO: 15439 - RNA, 70 nt, Human
ggcacgaggcgacucuuagcuugucggggacgguaaccgggacccggugucugcuccugucgccuucgcc

SEQ ID NO: 15440 - RNA, 124 nt, Human
gguucuggguucaccucccugcucauggaacgucucucaguugauuauggcaagaaguccaagcuggaguucuccauuuacccagcaccccagguuuccacagcuguaguugagcccuacaacu

SEQ ID NO: 15441 - RNA, 70 nt, Human
cugguuguuuauauuucuugguggugaaaugacaagcaaggucauuuugcugagagugugggugggccag

SEQ ID NO: 15442 - RNA, 67 nt, Human
gaaggaaggcagucauauaggcacagaugcugguaguuggguauauguggcugacuuguaguucuuu

SEQ ID NO: 15443 - RNA, 90 nt, Human
cgggggggccugggucccagcgggugggggggcugguucgcggugccguugcucaccgccgugcgccgcauuuggggccuggcgcccccg

SEQ ID NO: 15444 - RNA, 74 nt, Human
cucugaucgagauacuauuucagauguuccugcaguauacuuugugaugccaacugaagaaaauauugacagag

SEQ ID NO: 15445 - RNA, 68 nt, Human
gcgugugguccguauggaaagccugguagcccugcgaguuaaguacugcuuccauucauuguuuacgc

SEQ ID NO: 15446 - RNA, 65 nt, Human
guuucuguauacagcugugugcuuugauguuguguuacuguacacagaagugugugcacugaggc

SEQ ID NO: 15447 - RNA, 66 nt, Human
uaaguacugcuuccauucauuguuuacgcuggaauuuuucuccccauggaauguaaguaaaacuua

SEQ ID NO: 15448 - RNA, 90 nt, Human
agguacgaguagagguuuaaagaaaaaucaguuuuuguucuuaaaaaugcauuuaaguuguaaacgucuuuuuaagccuuugaagugccu

SEQ ID NO: 15449 - RNA, 98 nt, Human; identical to SEQ ID NO: 10030

SEQ ID NO: 15450 - RNA, 101 nt, Human
agaggugcacaggaugcugcagcuggccaucagcgaggguugcgagggcuuuggcaugcucugaccacucuccugucauccaguuggcucccaugcucucu

SEQ ID NO: 15451 - RNA, 109 nt, Human
uuuuugaugagaaugagcuugagcugcugaugugugggacuggagacaucagugugucugacuucaaagcccaugcaguaguuguugguggcucauggcauuucagaga

SEQ ID NO: 15452 - RNA, 67 nt, Human
ggacgccuuuacagucuagcacauguaucaagacaucagucaggaucaugugaagaaaacaguguuc

SEQ ID NO: 15453 - RNA, 100 nt, Human
ucacccucaucugccaccaccucccauguguucaguucacccaugcaggcaagcugaggugaugaagaaaaucauugagacuguugcagaaggaggggga

SEQ ID NO: 15454 - RNA, 69 nt, Human
ggcgggucauacuccuuaagagcaguucagaugaugaucaagccuauugacugaagagagacacucgcc

SEQ ID NO: 15455 - RNA, 84 nt, Human
guaacuauaaaagggaaccuauaaauguaguuucaucugucgucaauuacugcagaaaauuauguguauccacaaccuaguuau

SEQ ID NO: 15456 - RNA, 63 nt, Human
guaugguacggaggaggccauuacagaagcaagcaccaagauggaauuuucugggccgaauac

SEQ ID NO: 15457 - RNA, 83 nt, Human
caucuguggauugugaaguuuaucuaguuguuuauaacuuuuuuuuagcuaaauagaauagaaaacaucaaagugcauacgug

SEQ ID NO: 15458 - RNA, 63 nt, Human; identical to SEQ ID NO: 981

SEQ ID NO: 15459 - RNA, 72 nt, Human
ucaggugucacauuccaagcagauuggcccucaucccucagaauguggaucugccgaauugaagaggccuga

SEQ ID NO: 15460 - RNA, 65 nt, Human; identical to SEQ ID NO: 1253

SEQ ID NO: 15461 - RNA, 74 nt, Human
aaauuuaguuaggacauagaaagaauaauguugagauaaauuccuugaagccuuuugcaacuguccuuaaguuu

SEQ ID NO: 15462 - RNA, 77 nt, Human
caugugcaguguacaacauacuauauacauauggggcuucccuauguacauauacauaugcauacacuaucuauaug

SEQ ID NO: 15463 - RNA, 69 nt, Human
uuguuuguauucaucuucauguagcagaauagaccacuguucaagaaguagaugaaaaauucauaacag

SEQ ID NO: 15464 - RNA, 84 nt, Human
accaacacaggagauauuuuuauagaaagcaaugaauuuuuucuuuaaagaacuuaauuuuaaaaugucuaccccauguuuggu

SEQ ID NO: 15465 - RNA, 88 nt, Human
agcccucgaugagaacaaggucacggucagcugauuuacuugagcguucggcuuacucugaccugacacacuccacagagcacuggcu

SEQ ID NO: 15466 - RNA, 103 nt, Human
ccaaauuugucagguggggauuucaccccagccuuaugacucaguuuuagauuuaacuugauucauuuaagguuggaguuuauuucuggcuggcaaaauaugg

SEQ ID NO: 15467 - RNA, 95 nt, Human
ugucuaccccauguuuggucuuucaagagugcauugcguguggcaugagauguacauagcuucauguuuguuucuaaugaagguggggauggaua

SEQ ID NO: 15468 - RNA, 87 nt, Human
cagaaacgucccacaugcccaccaggagcaagcuucaaaauguucagcuugcuuacauuaagcagaguaauuccagggauguuucug

SEQ ID NO: 15469 - RNA, 63 nt, Human
ucaagauucugcuaagaucuguauuaaucaucuugugcaugggaagauuguaguuacucuuga

SEQ ID NO: 15470 - RNA, 67 nt, Human
uucaguggguucuucuuuaggacucugcgauggaucuucuugcguggugcccgaagggcucuuugga

SEQ ID NO: 15471 - RNA, 69 nt, Human
gcacugagcuuggaggagguacagguggaccagaugacggcucugccugugaaauccaaauuccagugu

SEQ ID NO: 15472 - RNA, 67 nt, Human
ggaacaugacagcaggcacacucauggaauacaauggguuuuccaugcacccugucauccucagucc

SEQ ID NO: 15473 - RNA, 61 nt, Human
ugcugggaauaccauagccaccuuuuagggaaacuuaaauuauguuuuuggauacccugua

SEQ ID NO: 15474 - RNA, 64 nt, Human
uucucacuaguugucaaaaagaacagccuugcuaucuggucaggugaaugacaaccaaguggaa

SEQ ID NO: 15475 - RNA, 85 nt, Human
guuguuuuuuucuaacaguagauauguauauauuuuucccucucuaggugaaucaauucagauauuugcugagauugagaacugc

SEQ ID NO: 15476 - RNA, 85 nt, Human
gacuugagaauuuuuuaacguaacuuccuaaguguaagaugacaaaauuugacuuacgggauauacuggcguuaauuuucccguc

SEQ ID NO: 15477 - RNA, 79 nt, Human; identical to SEQ ID NO: 10269

SEQ ID NO: 15478 - RNA, 80 nt, Human
gggcuagaagguaucuacaacuucacacauaaccaaaaacagagaaguggugaaguggugaaaggaguuucucaaagccu

SEQ ID NO: 15479 - RNA, 61 nt, Human
ucuucagucaagugauuucauuggcagcaaugggccaguaugagaacuugaaagcugcaga

SEQ ID NO: 15480 - RNA, 84 nt, Human
gcuccugggcugaagcgaucuuccugucuugaccuccuaaaguucugagauuacaggcaugagccacugcacccagcccacugc

SEQ ID NO: 15481 - RNA, 93 nt, Human
uuggcccugugaauaaugcugaaaugaacaugagauugcacaucucgcuuugagguucugauuucacuucaacuuaaggcauuuuuuauccaa

SEQ ID NO: 15482 - RNA, 78 nt, Human; identical to SEQ ID NO: 5302

SEQ ID NO: 15483 - RNA, 101 nt, Human
acaccacaugcagauuuuggugcuuucccaaccuucuugguauaaagguaaacaauucuauuaccagggguucgggacagccuaguuuuguuagaggcugu

SEQ ID NO: 15484 - RNA, 96 nt, Human
acuagccuugagcaauaugcagagugaucucuauagaguugcugucauuuuuguucuauagucauaucaucaugucauaggagaaucaucaauagu

SEQ ID NO: 15485 - RNA, 66 nt, Human
gauguguaaaugccacauuucguaacaagaaagcucuuggagaaaagaaguuguauuuguuucauc

SEQ ID NO: 15486 - RNA, 61 nt, Human
ggugagucuagugguauguaguuuguuuacugugacaacaaacaugucaccccuuuucacu

SEQ ID NO: 15487 - RNA, 80 nt, Human; identical to SEQ ID NO: 15478

SEQ ID NO: 15488 - RNA, 61 nt, Human; identical to SEQ ID NO: 15479

SEQ ID NO: 15489 - RNA, 92 nt, Human
gcccuucugugcuuguuaguugcucaugacauggcucugagucugcauuugugugugccucggagaugucacugcguguugcgcaggagggu

SEQ ID NO: 15490 - RNA, 87 nt, Human
uaagggcaaagcgggcauacucccauggcaucgaacuuuugucuuaaaguaaaucaaggccguugaguugagaaugcuuugcuuuug

SEQ ID NO: 15491 - RNA, 92 nt, Human
agagcucagaucugggaucgccugugaauugggauggguguguaggcgccaagcacauccuuaccguuagcacuugaccaggaggagacuuu

SEQ ID NO: 15492 - RNA, 66 nt, Human
gggcgcugcgaggcaggaagggggccacaggcaggccgcagugggccccuagagagagcauugccc

SEQ ID NO: 15493 - RNA, 82 nt, Human
accugagccagcucgggugucagguugacaguuauguuuuuauacaaggcgucguaugugauguuugcaaaguaguucaggu

SEQ ID NO: 15494 - RNA, 70 nt, Human
gcuguguagacccuccccccuccaaaaaaaaaucucaucggacugcuuucuugguggcgguggguaaagc

SEQ ID NO: 15495 - RNA, 62 nt, Human
aagagagaccagucaguccuaaugugaguaaaugaaauuuacagguaacuuacuuacuccuu

SEQ ID NO: 15496 - RNA, 72 nt, Human
auuggaguauuugaaaaugaccaauauauagcugccagucaugguccagucuguuuucuguuaaacuccaau

SEQ ID NO: 15497 - RNA, 99 nt, Human
gcuaggauuacagguaugagccaccacacccagcuaguuguuuucuuucguuguuguuaauucuuaaaguuggggggggucucaauuuguuauccuggc

SEQ ID NO: 15498 - RNA, 61 nt, Human
ggguuggccaggcguggucucgaacuccugaccucaggcaauccacccgccuuggccuccc

SEQ ID NO: 15499 - RNA, 94 nt, Human
ugggcauauacucaggaguggaaugcuggauccuaucguaauucuguuuacuuuuuugaggaaccaccaugcuguugccgcaguauaugcacca

SEQ ID NO: 15500 - RNA, 68 nt, Human
ggagagaaaauuguaccucuucuacugcaauacuguuaugauuccagugagauaaggaauuucuaucc

SEQ ID NO: 15501 - RNA, 98 nt, Human
ucucuucugaacaagccccaucauuuggugaaccuccacccuaacaaaguagcgaugggguugggggcuaaauuaauuggaguggggcgaggacgaga

SEQ ID NO: 15502 - RNA, 65 nt, Human
agauagaucuuaaagggcaaagcaguauauugguaguugucaauauagcagugcuagcucugucu

SEQ ID NO: 15503 - RNA, 75 nt, Human
agggcugacauggugugagugugugggugugugauaagcuucucaucccugcauagaugcaguauucuuagccuu

SEQ ID NO: 15504 - RNA, 71 nt, Human; identical to SEQ ID NO: 11073

SEQ ID NO: 15505 - RNA, 85 nt, Human; identical to SEQ ID NO: 10310

SEQ ID NO: 15506 - RNA, 64 nt, Human
gcuugaugcuuggcugucagaagacaugaauuacgcacgguucaucacggcagcgagcgcacgc

SEQ ID NO: 15507 - RNA, 69 nt, Human
aauugaguagugaaaggaaggaggaggaaaggaaauuaaauguccuucuaguauucucuggacucaagu

SEQ ID NO: 15508 - RNA, 127 nt, Human
cacauucccauucacuuugauuuucuacauguaauuaccuucuuuuguuuaucauuagauuugauggggccaaaguugagauagaauagagggugaugacgguaagagcaagugucccaugaaugug

SEQ ID NO: 15509 - RNA, 93 nt, Human
gacauaugaagaauuggaucagagauuucuaugacagugcgggaaagcagcacugagaaacuuuugauuguuuucaauuucuucuuuuauguu

SEQ ID NO: 15510 - RNA, 81 nt, Human
accuuuccccuggguuuccauuaggguaguucuugaaaugaauuucauuuuucacugagugccuaccuucccagggcaggu

SEQ ID NO: 15511 - RNA, 83 nt, Human
gugacccucaacuaccucagguuugaaggcccuaaaugaaacugauuaccacucauagggacaaaccgaggggguucgguuac

SEQ ID NO: 15512 - RNA, 115 nt, Human; identical to SEQ ID NO: 14236

SEQ ID NO: 15513 - RNA, 98 nt, Human; identical to SEQ ID NO: 6908

SEQ ID NO: 15514 - RNA, 61 nt, Human
cggcuuuguggacuuuuguccuucuaggucugugcuuuuaauaggacugucuccaaaguug

SEQ ID NO: 15515 - RNA, 75 nt, Human
ugcccagucccugaaagagauggucuccaagcugaagaagccccggcggaucauccuccuggugaaggcugggca

SEQ ID NO: 15516 - RNA, 75 nt, Human
acagucuuuuuacaguuguuguuuucagugggguccgaauaugguucaccauuugcauuuauuugauaagucugu

SEQ ID NO: 15517 - RNA, 77 nt, Human
cauucuggauuuggucgauugcuucuuuuuaguaucuuuaacuuauuagaucucaaacucagcugcacaucagaaug

SEQ ID NO: 15518 - RNA, 65 nt, Human
cagaaaacaagaagucauaccuuuuucuuaaaaaaaaaaaaaaaguuuuugcuucaaguguuuug

SEQ ID NO: 15519 - RNA, 70 nt, Human
ggugaugcaggcuguggcgcgacugggagcugagcccuucccuuugcgccugccucagaggauuguugcc

SEQ ID NO: 15520 - RNA, 84 nt, Human
ccagauagccaugauguuugacuucugaggggcauugagcagaggaacaugaaaggaaggggucagaguacauaauggugcugg

SEQ ID NO: 15521 - RNA, 73 nt, Human
cuucaggcccugucgauuggggagcagcucacugaacuccuuguaguucucuccaccagcacgggguacaaag

SEQ ID NO: 15522 - RNA, 77 nt, Human; identical to SEQ ID NO: 1066

SEQ ID NO: 15523 - RNA, 76 nt, Human
ggcuggucacuugcuguaggucuuaaagccugguuccuggaggcuuaggagaucuucuuuuagcccagauccagcc

SEQ ID NO: 15524 - RNA, 66 nt, Human
gccuccaaggccucacuccacuccggaaccugggcccccacugggcuggacugggcugggcuaggc

SEQ ID NO: 15525 - RNA, 72 nt, Human
ggcggccucugggaggacccuuccuuaguccccucucccaccacucaggcuccugcuucccagagaguggcc

SEQ ID NO: 15526 - RNA, 66 nt, Human
ggcuguggggggaugagcucacucuggccccacagaccuguggcuccaaggaaucuucccacggcc

SEQ ID NO: 15527 - RNA, 61 nt, Human
gggggaucuggcugguggggaaccggguggaccuuggcccccauccucagcaccugccccc

SEQ ID NO: 15528 - RNA, 62 nt, Human; identical to SEQ ID NO: 7958

SEQ ID NO: 15529 - RNA, 70 nt, Human
cauuagugauuuuuuuuuucguaggucgucaaugucuugucauuguucauucuauaauaaaucauuucug

SEQ ID NO: 15530 - RNA, 72 nt, Human
cccccuucacccuucucuguuaaccuugugccugucuccuguaugaucacaucaccaaaaagggggaggggg

SEQ ID NO: 15531 - RNA, 69 nt, Human
ugauucacuuugccauguuuccuucacauccagaucccugucgguguuaguuccacucuuggucuuuca

SEQ ID NO: 15532 - RNA, 67 nt, Human
ggaaaaauggacaguuuauuacucacagggaacacagcagccaaaacaguaucuuuagucacuuucc

SEQ ID NO: 15533 - RNA, 84 nt, Human
gccacacaacaacacaccuccccuccuugagccuggcacacagcaccgggcucucugaauuuggaaaguguuucauuuuguggc

SEQ ID NO: 15534 - RNA, 110 nt, Human
gcccaggccacccgugcaccuguccugcuuccugcaguccccacucccugccuccuuugagggacugggggacuugggguagggggacagacgggaaagggucugaaugc

SEQ ID NO: 15535 - RNA, 71 nt, Human
guugaaggaagugagcacauuauuuguacugugaauauaaauuuuuggccuuuuauuuaucuuccuuugac

SEQ ID NO: 15536 - RNA, 63 nt, Human
cucaugcagacgcuccgauuucuuggacucuacagagaugagcaucaggauuuuauggaugag

SEQ ID NO: 15537 - RNA, 67 nt, Human
gacuuucuuccucaguggcggagagaagaaagugcauuuauugucuuuccacauauggaggaauguc

SEQ ID NO: 15538 - RNA, 63 nt, Human
uuggaggaacacagucaucuccuggugaaaucuaauccgguuacauguggcugguuucuugaa

SEQ ID NO: 15539 - RNA, 69 nt, Human
cuuucgaaucauguuaauuaaauggugguccuuuaaccaguagcaguuugauuaccaauuacucggagg

SEQ ID NO: 15540 - RNA, 91 nt, Human; identical to SEQ ID NO: 10489

SEQ ID NO: 15541 - RNA, 61 nt, Human; identical to SEQ ID NO: 544

SEQ ID NO: 15542 - RNA, 92 nt, Human; identical to SEQ ID NO: 9620

SEQ ID NO: 15543 - RNA, 76 nt, Human
gagcuaacaaacugcuacaaacugaaggaccuuuucaaaaaagcaaacugaaggaccuuuucaaaaaagcaagcuc

SEQ ID NO: 15544 - RNA, 90 nt, Human
ugcacauaaauguaaaccaaaacauguauuucaucaaaguaacuaacaugaugaugagaaacaggauauuuugaaacauauuuauaagca

SEQ ID NO: 15545 - RNA, 85 nt, Human; identical to SEQ ID NO: 11187

SEQ ID NO: 15546 - RNA, 91 nt, Human
ggaaaguuagaucuguauguuuuuaauuuuaaagaaauuacauauuuuuuaauuuaauuuuuauuuuuuuaaacugcacauuuaccuuuuc

SEQ ID NO: 15547 - RNA, 89 nt, Human
ucuuaguaaccuaauguaguuacuuacuucuuuuauccuacuacauauauaauagaaccaaaauaguaacgucaaugugguuauuaaga

SEQ ID NO: 15548 - RNA, 72 nt, Human; identical to SEQ ID NO: 14420

SEQ ID NO: 15549 - RNA, 76 nt, Human
caaaaaaaauuaaaauaagaaaaccaaagcacacaaugauaaaccacuuuucucuucuugcuguaauuuuucuuug

SEQ ID NO: 15550 - RNA, 87 nt, Human
uuuuuuugagacagagucuugcucugucgccuuggcucacugcaagcuccggccuaggcgacagagcgagacuccaucucaaaaaaa

SEQ ID NO: 15551 - RNA, 66 nt, Human
aggccagaggaucacuugagcccaggaguuugagaccagccugggcaacauagugagacucugucu

SEQ ID NO: 15552 - RNA, 78 nt, Human; identical to SEQ ID NO: 99

SEQ ID NO: 15553 - RNA, 80 nt, Human; identical to SEQ ID NO: 100

SEQ ID NO: 15554 - RNA, 68 nt, Human; identical to SEQ ID NO: 863

SEQ ID NO: 15555 - RNA, 71 nt, Human
guauuaguucuugcagcuggugguggcggcugaggcggcauggaucucagcgagcuggagagagacaauac

SEQ ID NO: 15556 - RNA, 64 nt, Human
uggaggcugcccgaauuugugccaauaaguacaugguaaaaaguuguggcaaagauggcuucca

SEQ ID NO: 15557 - RNA, 105 nt, Human
cacugauacuauaagcauuauuuuaaaugacgcugaucuuaagucugaaauaaauggaaaguagaaaaggugagccaguugauuugaaugcauuggauauuagug

SEQ ID NO: 15558 - RNA, 76 nt, Human
caugaacuguuaaauuucuuaaguuacauaguuacuacaccacauuuauguguauguuauguuuuaauagucaaug

SEQ ID NO: 15559 - RNA, 75 nt, Human
guauguacaauugauaauauaaaggggcucauugaaacuugagagccuguugaguuuugguuacuuguacauugc

SEQ ID NO: 15560 - RNA, 63 nt, Human
gguggaggaucacuuuugcccaggaguugaagaccagccugagcaacacagugagacuccauc

SEQ ID NO: 15561 - RNA, 90 nt, Human
gguguggucaugcauaccugcagucccagcuacuuagaugagaggaaggaucaccugagccugggagaucaagugagucaugaucacacc

SEQ ID NO: 15562 - RNA, 96 nt, Human; identical to SEQ ID NO: 2935

SEQ ID NO: 15563 - RNA, 76 nt, Human; identical to SEQ ID NO: 2936

SEQ ID NO: 15564 - RNA, 71 nt, Human; identical to SEQ ID NO: 2937

SEQ ID NO: 15565 - RNA, 65 nt, Human
gacaaagaaagaagaaaauaaaaacccuagagaguggcuuugggguuauuuuacgguacaaaguc

SEQ ID NO: 15566 - RNA, 67 nt, Human; identical to SEQ ID NO: 11915

SEQ ID NO: 15567 - RNA, 61 nt, Human
acgacggugaagcagacggcuguggugaugcccacggccaugaugacugccucgguguugu

SEQ ID NO: 15568 - RNA, 104 nt, Human
augcgguuccggaugaagaugcagagaauggcgaagaugaagagcaccaccaugcucaccaggagcacgcccaugcaugaggugaagucguagcgggucugcau

SEQ ID NO: 15569 - RNA, 100 nt, Human
caacaggaugccucuuaaagacaucuggugauuagaaacccagagacuauuuuauauucuguacuugccugagauauaccaccaacuaagcagucuguug

SEQ ID NO: 15570 - RNA, 100 nt, Human
caggacuggauaugggagauggggagucaacauugguuaaaugacuuguuccaugccaggcauaaucaacauuccucauuacuucuucaacauccucuug

SEQ ID NO: 15571 - RNA, 100 nt, Human
gaaacccagagacuauuuuauauucuguacuugccugagauauaccaccaacuaagcagucuguugaggauacaggacuggauaugggagauggggaguc

SEQ ID NO: 15572 - RNA, 72 nt, Human
guggcacagaguggaaggcuaccugaauucaaagucauguuuucacuaugccaugaagcucauuaaagccau

SEQ ID NO: 15573 - RNA, 131 nt, Human
ugccaggcauaaucaacauuccucauuacuucuucaacauccucuugaaagcugugcucauuuuacaaaugagaaaacagauuuagagaaauauaaugacuuguaugaggucacauagcuuaugaguggca

SEQ ID NO: 15574 - RNA, 93 nt, Human
cuccugcuuuauauaacuucuugaauccagcuaagagauuuauaaacuaauggcauaaaugucuggagccaaccuuggcaguuauagcaggag

SEQ ID NO: 15575 - RNA, 64 nt, Human
ggugaaggaggccgcgaugucggugagcacguagggcagugcgcuggcacggcucuccucugcc

SEQ ID NO: 15576 - RNA, 83 nt, Human
uuggacuucugugcaucuugagucccggaccgguuugaacccgccaugauaccggucacggaggggaaguagaugccaaccag

SEQ ID NO: 15577 - RNA, 81 nt, Human
aauagggaucaaguuuuaaauccuccuccuucccuuuuuucuggagucuugagggccagaguuuuuguuuuuguuuuuguu

SEQ ID NO: 15578 - RNA, 80 nt, Human
ggucacaaucugaugcugucaguuugaccgagcugguuuugcuuauggucaugcugcaauuuguuagaauaauagggauc

SEQ ID NO: 15579 - RNA, 88 nt, Human
guuuuuguuuuuguuuuuguuuuuuuuuuccugcuugcuacuguuuugugguguugaaaagugguuuaaaccugagacuaacuuaaac

SEQ ID NO: 15580 - RNA, 67 nt, Human
guuuccuuucuuagcugaugucuuuggccagaacaccgugggcuguuacuugcuuugaguuggaagc

SEQ ID NO: 15581 - RNA, 73 nt, Human
uggucacuucguggcucagguaagaacgugcuuguggaagacaagucuguggcuuggugagucuguguggcca

SEQ ID NO: 15582 - RNA, 62 nt, Human
caaaagccuuagaauaagaaaagcuuuuuuuaaauugcuuuaucuguauaucugaacucuug

SEQ ID NO: 15583 - RNA, 70 nt, Human
cugccuguagaggaugccgcacagagauugacuugauucauagagacaauucacuccaucccuauggcag

SEQ ID NO: 15584 - RNA, 111 nt, Human
guagaaugucauuguuuuuaaaacuguuuuauaucuuaagagugccuuauuaaaguauagauguaugucuuaaaaugugggugauaggaauuuuaaagauuuauauaaugc

SEQ ID NO: 15585 - RNA, 73 nt, Human
aaggcugucuggggauaaaagugguacccucuuggaauaugggcaggaaggcaucccuagugaccauagccuu

SEQ ID NO: 15586 - RNA, 68 nt, Human
ucuugggcacuggaguaggacucuugcugcagaugguauaguucugguucucgagaaggaauccaaga

SEQ ID NO: 15587 - RNA, 62 nt, Human
ugacauuagcagcauuaggucuauagguggcugcuuaacuaauuaugaacucagcugcuuca

SEQ ID NO: 15588 - RNA, 62 nt, Human
cagguaacauauuucuaacucuauacaccgcugcuauaaauguugguuuaacacuacgccug

SEQ ID NO: 15589 - RNA, 78 nt, Human
gucgugacuugguuacucgcuagcuuagggaucccggaggacccuucacuucugcuggugugacuauuggaucauagc

SEQ ID NO: 15590 - RNA, 81 nt, Human
uucuauuuuuuuauuauugugauagcagaugugcguauuuaguuuauugcaccuauguauacaggagccuaaacaauagaa

SEQ ID NO: 15591 - RNA, 64 nt, Human
uuugagagagaagaaaaacuguguuggaaccacaccaaugauauuuuucuuuguaauacuugaa

SEQ ID NO: 15592 - RNA, 80 nt, Human
acguggucaggcugcggcccugugagaagaagcggcuggacauccgguggcagacuuuaccuggccccccgucaccacgu

SEQ ID NO: 15593 - RNA, 66 nt, Human
cagguccccgcagguccgggcacuagcaccccucccagcagccccgugcggaccugcgggccccug

SEQ ID NO: 15594 - RNA, 61 nt, Human
cggacggaucgugcaaggcgcuuucggggcggauugugacuuguggagagauggccgucug

SEQ ID NO: 15595 - RNA, 64 nt, Human
gccaggagccccacacccgcugccgcuguccccgagggcacggcagccgagggcgcucccaggc

SEQ ID NO: 15596 - RNA, 62 nt, Human
augacaauguagaggaugacuucucuaaucaguuacgagcugaacuagagaaacaugguuau

SEQ ID NO: 15597 - RNA, 89 nt, Human
ggcgcacgacucgaccaaccacacuccugccgagagacacucuaagucacucgcgcgcauacccaaggagaccaagaaacagagacgcc

SEQ ID NO: 15598 - RNA, 71 nt, Human
gggagaaaggcuuaaguccuuggggugggaggagaaaccccuccccggggauccugcagcucuagucuccc

SEQ ID NO: 15599 - RNA, 62 nt, Human
guuuggagcuucguuuugagcgucccgugaacaccacgcccgccuuaauggggcauuuaaac

SEQ ID NO: 15600 - RNA, 79 nt, Human
cgugggaccacgcugcuugagggucugggccugggucuuacacaaaucguccacugucaagccuugggcgcgucccacg

SEQ ID NO: 15601 - RNA, 79 nt, Human; identical to SEQ ID NO: 1810

SEQ ID NO: 15602 - RNA, 65 nt, Human
gugcuguggcucuagacgacuaaaggaccugagauccgaacugggcucaucaagggcagcggcac

SEQ ID NO: 15603 - RNA, 73 nt, Human
uguggcucgucugaacuucucucaauggaacucagugaguaccagugcggagaccaucaagaaugugcgcaca

SEQ ID NO: 15604 - RNA, 60 nt, Human
ugucuucaccuuuguucucagcuccacagucuggauugcugacaguagguguauaugaca

SEQ ID NO: 15605 - RNA, 77 nt, Human
agcagucaauagcauccuucucuacaacaggaggucaugaguagcuuucugccagagggaggguguuacgagcugcu

SEQ ID NO: 15606 - RNA, 69 nt, Human
ggcaggcauucacccucagaagcuuguaccaaugagaugguaacauucuugcagggcgagcugccuguc

SEQ ID NO: 15607 - RNA, 60 nt, Human; identical to SEQ ID NO: 15604

SEQ ID NO: 15608 - RNA, 60 nt, Human; identical to SEQ ID NO: 15604

SEQ ID NO: 15609 - RNA, 62 nt, Human
uuucaggcauuuuuauuuuuccuggcuaaacguuggugaaaguuauaaccuccugccuggga

SEQ ID NO: 15610 - RNA, 65 nt, Human
aggaaaugcaaaggaucauucagcacuguagcaauuacaguacacaggaaugguuacgauuuccu

SEQ ID NO: 15611 - RNA, 68 nt, Human
cuagccagagaauuaccuucagcguguagucacgagaucaagguggcaucuggagguggugggguugg

SEQ ID NO: 15612 - RNA, 60 nt, Human; identical to SEQ ID NO: 15604

SEQ ID NO: 15613 - RNA, 74 nt, Human
uucagacccucgaggauucggucauaugggaauugcuguuccugauguauacagugcuuguaaaacgguuugaa

SEQ ID NO: 15614 - RNA, 65 nt, Human
ggggguugaacaccagaaggucucuuauuucuggaaauggguccguaccuucugauucagguucc

SEQ ID NO: 15615 - RNA, 70 nt, Human
cccauugcgggccugggcuagggggaccaggcacucaccgccuccucccugguacacaggcuucuguggg

SEQ ID NO: 15616 - RNA, 70 nt, Human; identical to SEQ ID NO: 7835

SEQ ID NO: 15617 - RNA, 86 nt, Human
ucaauggaagcgguacuuucuggcuggcuugagguugauguauguggccuucaucuccucggccucaggguuccgcacaucuuuga

SEQ ID NO: 15618 - RNA, 60 nt, Human
uuuacuuugcccauugauguuuuccgauaguagguuaauauuuuggagcuaaggaguaga

SEQ ID NO: 15619 - RNA, 84 nt, Human; identical to SEQ ID NO: 384

SEQ ID NO: 15620 - RNA, 89 nt, Human; identical to SEQ ID NO: 385

SEQ ID NO: 15621 - RNA, 73 nt, Human
gcagaucagccauggccucgucgaaaguggucuuggccagagagauggccuccucggggcuguuggcgaucuc

SEQ ID NO: 15622 - RNA, 101 nt, Human
gguagaagacccggcucucggcguccccggccuccuugaugagguggcuguccagcaggcccagcaaggugucgcacacgcccuggagcucagucuccacc

SEQ ID NO: 15623 - RNA, 129 nt, Human
uggggggcggcaucuccuucuagcugauguccauggccucaugguaggcugaccgggcugagucaaugaugcgcuucuugucgucaccgguggccaccucggccagguagcgguaguagucacccuuca

SEQ ID NO: 15624 - RNA, 72 nt, Human
auuugccaaguauguaucugauccacacaaauccuuagaaagguuuucuguguagucuucauuaacgcaaau

SEQ ID NO: 15625 - RNA, 65 nt, Human
uauaucuuauuugcuuuguagucugcugucauuccuuucaaagagcacacagcacaugaggcaua

SEQ ID NO: 15626 - RNA, 63 nt, Human
uuugugaauguuucacucuuacuguaggaucuugaauauguuuuacaauaaugaagcuacaaa

SEQ ID NO: 15627 - RNA, 64 nt, Human; identical to SEQ ID NO: 3890

SEQ ID NO: 15628 - RNA, 84 nt, Human
ggcugggcaguguggaggucguuggagucacuuccgcgucaccagcuccugugccugccagucggugccccucccgcuccagcc

SEQ ID NO: 15629 - RNA, 83 nt, Human
gcugggccuguuggucaggcauggaggagcuguguggucacuggccacuggcucucuucugcaccaccgccggcucugacagu

SEQ ID NO: 15630 - RNA, 74 nt, Human; identical to SEQ ID NO: 365

SEQ ID NO: 15631 - RNA, 77 nt, Human; identical to SEQ ID NO: 3082

SEQ ID NO: 15632 - RNA, 75 nt, Human
gaaggagguuuuuucacauuugguucacaacuaggcaguaugugugcaagugacagcugaaagcaaaccuguuuc

SEQ ID NO: 15633 - RNA, 80 nt, Human
gccucccaaagcaccauuaaucuuuucaagcagggccucaaggaguaaggacaaagcuaauggguuaauggguggggggc

SEQ ID NO: 15634 - RNA, 76 nt, Human
gcugaguguaugauggcaugacuauagcucacuguaaccuugaacuccugggcucaagcaauccuccuaccucagc

SEQ ID NO: 15635 - RNA, 69 nt, Human
cgcugguucagcgcgggcucgcuuccaacucgagcuggcucgggagaagcaggcggcguuguccaugug

SEQ ID NO: 15636 - RNA, 61 nt, Human; identical to SEQ ID NO: 14276

SEQ ID NO: 15637 - RNA, 72 nt, Human
gggucucuuuucggcgcucuagaggcagagggaggggaucccugucgugacaagagcgccugucugcgaccc

SEQ ID NO: 15638 - RNA, 75 nt, Human
gugucugcuugugugcuggcguuucuuggagagauacgguggcugucacccucuucuccaggcacacacagacac

SEQ ID NO: 15639 - RNA, 83 nt, Human
cggccugcuucuccaccagcaccgccaucugcaagaagagcucguguacgucgcggaugcggcucuccaggcgcagcaguucg

SEQ ID NO: 15640 - RNA, 105 nt, Human
ucccugcagggcagagcucccggcuuuggugcguccuucccagcgcgcuccauggucugggaugggcgguggcggcccgggccggccugcuacuugaggcaggga

SEQ ID NO: 15641 - RNA, 70 nt, Human
ggcuugaggcaggagucugacggcagcagcucccgagagcccuugccgaugccuggcuccauccagagcc

SEQ ID NO: 15642 - RNA, 77 nt, Human
gaagucggucguguccggcgugaugggcuugcuguccuccuggucagagcccaucccuguccggggacugccgcuuu

SEQ ID NO: 15643 - RNA, 104 nt, Human
gcuugcuccacuggaggaggugcugggcagcguucuucugaggccagugcuggcuggguucaggucguaugccaggugccccugcagcucccccagggagaagu

SEQ ID NO: 15644 - RNA, 82 nt, Human
cugggucaaccgaaacagagcucacuccagagauccgcacagcccaaaucucagaggcagcucaagcugggaccuggcccag

SEQ ID NO: 15645 - RNA, 80 nt, Human
aaaggggagacuuaaaauuugcuccaaugucaguucucuacagaugagaaccaauacuacagcaaguaagucuugccuuu

SEQ ID NO: 15646 - RNA, 60 nt, Human
ugcuaguuucuuuuucggggggacagaggacuaucuaaucucccucuucaaucacaagca

SEQ ID NO: 15647 - RNA, 126 nt, Human
auugcaaauaaguucccaauuuuagucuagguuagaucacucugguuaaucauagggccaugaugcccucagaacucaagcaggagcugcugcuacuugggcuuaaagcugaggcacgaacgcaau

SEQ ID NO: 15648 - RNA, 66 nt, Human
uuaauaaauacuuuauacacugaguguagaaaaacuugugcauauucuauaaagauaauuuauuaa

SEQ ID NO: 15649 - RNA, 74 nt, Human
uugagggagggcaagagaggauuugauaaaaugaggaaaaauguucuacucuccuuucuuuccuggagccuuaa

SEQ ID NO: 15650 - RNA, 117 nt, Human
gccaguacagaaguuuuuaaaccaaacugaggcauaaagcagaaagagcaaagacacaugaauacccuucuuaacaaucucuucuacuuaugccuucaccguaaccuuuguacuugu

SEQ ID NO: 15651 - RNA, 72 nt, Human
uguuuagcauuauuuaauagccugaaaguggaaaacaauccaaauauccaucaacuagugaaugguuaaaua

SEQ ID NO: 15652 - RNA, 65 nt, Human; identical to SEQ ID NO: 1727

SEQ ID NO: 15653 - RNA, 102 nt, Human; identical to SEQ ID NO: 2172

SEQ ID NO: 15654 - RNA, 80 nt, Human; identical to SEQ ID NO: 367

SEQ ID NO: 15655 - RNA, 65 nt, Human; identical to SEQ ID NO: 247

SEQ ID NO: 15656 - RNA, 71 nt, Human
cuagaaucucguguguuaguuuuaacuguuuugaaaauaauaaguaacauuaacacaauguugauauuugg

SEQ ID NO: 15657 - RNA, 73 nt, Human
guagcuaacauuagaucuagcuuauuauuucagaaauuaauuuaggaaauaauuauuaaaacauguuggcuac

SEQ ID NO: 15658 - RNA, 65 nt, Human
ccaaggaaccaagggacgcuuggcauaaucagguaaacuuguggucaggcgagcccaagccuugg

SEQ ID NO: 15659 - RNA, 76 nt, Human
gauagucuaauauuuacaaucauuucuuguuuuaguguuccacauguagcuucuagaacagaacugaugauuacuc

SEQ ID NO: 15660 - RNA, 87 nt, Human
ucaguccaguggcagacgugugacucacaacuuuguaccuuaguuugggaggccaaguugugauuugcacaccugccacuggccuga

SEQ ID NO: 15661 - RNA, 63 nt, Human
ucuuugaaguguuuuucuuagagucuggcacaugcuaggcauuggagaaauuaagaacgagga

SEQ ID NO: 15662 - RNA, 84 nt, Human; identical to SEQ ID NO: 286

SEQ ID NO: 15663 - RNA, 64 nt, Human; identical to SEQ ID NO: 287

SEQ ID NO: 15664 - RNA, 89 nt, Human; identical to SEQ ID NO: 288

SEQ ID NO: 15665 - RNA, 61 nt, Human; identical to SEQ ID NO: 544

SEQ ID NO: 15666 - RNA, 86 nt, Human
gggcccccaagcuggggcccgcgacucgaaggggacugggauggggaucucguuggacugcguggcuagcuugggcaugggggccu

SEQ ID NO: 15667 - RNA, 88 nt, Human
uuuuuuuuuuuuuuuuuuuuuuuuuuuuuuuuaggggggggcuuugaacuuuauuugaaaaaaacagaaaauaaauggaucaaaagaa

SEQ ID NO: 15668 - RNA, 113 nt, Human
ccucccagcccugggcgcacagcauggaagaggagcucgggaggacaggguuggggccuccagggucugacaccaccccacuccucuuccuagcaccaugggguagggacagg

SEQ ID NO: 15669 - RNA, 68 nt, Human
ggguucugauuuggucauuaccacauccagucacuguggugagcgagaaugaccugagucaaaugccu

SEQ ID NO: 15670 - RNA, 84 nt, Human
ucacuaaguucaucuguggggcuggaaggggaggguuggcagaaagucagccccacccaguccacgugguugcuauacauggga

SEQ ID NO: 15671 - RNA, 69 nt, Human
agaugccuuuucccuguuugguucauuguauuguauuagguuaagcucuacuaggguaaugaaggcucu

SEQ ID NO: 15672 - RNA, 62 nt, Human; identical to SEQ ID NO: 14062

SEQ ID NO: 15673 - RNA, 83 nt, Human
agguguggguggggcccguggcucugagcgccugucugcccguccacagggcccugaugagcuguggagccuuccccuccccu

SEQ ID NO: 15674 - RNA, 72 nt, Human
guuaguuaacgcuguucacguagcucuuuucugccuuuucacuuagagcuguguguguaccaguuuccugac

SEQ ID NO: 15675 - RNA, 74 nt, Human
ggcucaaugaaaugaaagugaaaagaaccugacuuuacuucaucuuucuuuugauuaacuugugaucuugagcc

SEQ ID NO: 15676 - RNA, 67 nt, Human
gcugaucuucaccaaaacaucuucuguggcucuuuucuucccacagucauaggcagugacggucagc

SEQ ID NO: 15677 - RNA, 90 nt, Human
guugcuuuaugagacuuuuucacguuggugccaucaggucccuucccacaaucauaggccuggauggugaaugaauagucuuucugcagc

SEQ ID NO: 15678 - RNA, 63 nt, Human
ugaggggagcagucggcauccacggccuccacccucaaaaugcugucguacugcuuccccucg

SEQ ID NO: 15679 - RNA, 75 nt, Human
uuaguuugaagguugcuuuuuuuuuuucuugcuuguaaaguggaacaaaucuugaaucuccaaucugaaaacuga

SEQ ID NO: 15680 - RNA, 66 nt, Human
uuuuuuuuuuuuuuuugcacacaaugcaguuuaauaaaugcaauagaggcagaggcugagaagaaa

SEQ ID NO: 15681 - RNA, 64 nt, Human
cuacccucaccccaucacagcacccugagaaucacggguccaacugugugggagggggcugugg

SEQ ID NO: 15682 - RNA, 95 nt, Human
gugacucugguccaucacacuuagguccucuggccugccucugccacauccagcugcuaggggcuggccucagcccugugaggggccgcaggcac

SEQ ID NO: 15683 - RNA, 74 nt, Human
cuggaugugcugcagaugcaucccaauaaucaggguggccucaaaacccugucuguccucuguagcacuuuuag

SEQ ID NO: 15684 - RNA, 85 nt, Human
uucuaaaauuaugaagaucaauuuauauguaaaucuuacgcauuaagaacaugcuuauugauaaaucuaaaucucuauuuuagag

SEQ ID NO: 15685 - RNA, 63 nt, Human
caugacaacagacacauugacauggguggguuuaccgccaagcggucgauggucuucugugug

SEQ ID NO: 15686 - RNA, 98 nt, Human
ccuguauuucuccaucuccaggucuggacagugcaaguugccaagaaaaaggaccuaguguagccauugcacugcagaugaaauaauggaggcucagg

SEQ ID NO: 15687 - RNA, 66 nt, Human
ugcccaagacucaccucccuuccccucugcaggccgacggcaugaagacagucgggugauggugua

SEQ ID NO: 15688 - RNA, 74 nt, Human; identical to SEQ ID NO: 493

SEQ ID NO: 15689 - RNA, 61 nt, Human
agguuucagagcauauuccuguuuaucaacaagaagaaaaccaaacagaugucuggacucu

SEQ ID NO: 15690 - RNA, 63 nt, Human; identical to SEQ ID NO: 11804

SEQ ID NO: 15691 - RNA, 103 nt, Human
ggaagggauguuacgguacaaacguauauuuauguguguguguguguaugugugugcgcgcgcgcgugugcauuuauuugugaugucugugacccuccucucc

SEQ ID NO: 15692 - RNA, 91 nt, Human; identical to SEQ ID NO: 5353

SEQ ID NO: 15693 - RNA, 66 nt, Human
uuucucagauugcugauuuguuuccacaugucucuuaugguauaguucuugagcaauuuccugaaa

SEQ ID NO: 15694 - RNA, 67 nt, Human; identical to SEQ ID NO: 3685

SEQ ID NO: 15695 - RNA, 73 nt, Human; identical to SEQ ID NO: 2833

SEQ ID NO: 15696 - RNA, 66 nt, Human
cauacgugagcugacugcccgagcaguggaagucccacagaagcuacagcugccaggucacgcaug

SEQ ID NO: 15697 - RNA, 88 nt, Human
ggagaauugcuugacccgggaggcggagguugcagugagccaagauugcgccauugcacuccacccugggcaacaacagcgaaacucc

SEQ ID NO: 15698 - RNA, 87 nt, Human
gccugggcugcccccacuucucccauaauucccugcccuagagcagcaccuccagagcuaggagaaggagagggggccacccaaggc

SEQ ID NO: 15699 - RNA, 75 nt, Human
uuucuuuauuggcacuaguauaaaacagagcagaucaacuggccucucggucuguacaaaguguggggcgugaaa

SEQ ID NO: 15700 - RNA, 80 nt, Human
uguggcuuaaaugauuuuuucuaacuaauaaaguggaauauauauuucaaaaaacagaagaaaaaaacagagaaaacaca

SEQ ID NO: 15701 - RNA, 94 nt, Human
ggcaauuguugauguucccaaaguccuuggggcaaugcagccagcccccgggcaaggacagcaaugccacuaggcuggagcccaacagugagcc

SEQ ID NO: 15702 - RNA, 84 nt, Human; identical to SEQ ID NO: 286

SEQ ID NO: 15703 - RNA, 64 nt, Human; identical to SEQ ID NO: 287

SEQ ID NO: 15704 - RNA, 89 nt, Human; identical to SEQ ID NO: 288

SEQ ID NO: 15705 - RNA, 61 nt, Human; identical to SEQ ID NO: 776

SEQ ID NO: 15706 - RNA, 92 nt, Human
gcucgcgcugcuucucccgcuucuucaucaggugcauggcgcgggcggccucgcucgcggcgcccuuguauugagccauggcagcggcgugc

SEQ ID NO: 15707 - RNA, 66 nt, Human
gguggcuacuaguccacgguuggcuacuaguccacgguuggcgggacuugagcucuggcugccacc

SEQ ID NO: 15708 - RNA, 64 nt, Human
guagugcgcagagaacugcuugucaaugucggauuucaugaugugcuccuccgcgaugcgcugc

SEQ ID NO: 15709 - RNA, 131 nt, Human
uacuaguccacgguuggcuacuaguccacgguuggcuacuaguccacgguuggcuacuaguccacgguuggcuacuaguccacgguuggcuacuaguccacgguuggcuacuaguccacgguuggcuacua

SEQ ID NO: 15710 - RNA, 89 nt, Human; identical to SEQ ID NO: 385

SEQ ID NO: 15711 - RNA, 80 nt, Human
cuucacgcuggggcuagcaggacuucucggcgagggaguuuuuaacuuugugagaacuccucaugcacccugugcuggag

SEQ ID NO: 15712 - RNA, 69 nt, Human
gauuuagcagcuaaugaagcccagcuucugaggaaaauucaguuguugugccucauggagaugacuuuc

SEQ ID NO: 15713 - RNA, 74 nt, Human
ggcaguggcugauugacacccucuaugccuucaacaguggcaacguagagcgguuccagacucugaagacugcc

SEQ ID NO: 15714 - RNA, 81 nt, Human
ggucaggaguucaucuugauuuuuacauuugaaaauaaugaaauaaauuuacaaaauaaaaggaaaagugaauaucuuucc

SEQ ID NO: 15715 - RNA, 72 nt, Human; identical to SEQ ID NO: 3662

SEQ ID NO: 15716 - RNA, 74 nt, Human; identical to SEQ ID NO: 365

SEQ ID NO: 15717 - RNA, 102 nt, Human; identical to SEQ ID NO: 2172

SEQ ID NO: 15718 - RNA, 77 nt, Human; identical to SEQ ID NO: 3082

SEQ ID NO: 15719 - RNA, 84 nt, Human; identical to SEQ ID NO: 286

SEQ ID NO: 15720 - RNA, 64 nt, Human; identical to SEQ ID NO: 287

SEQ ID NO: 15721 - RNA, 89 nt, Human; identical to SEQ ID NO: 288

SEQ ID NO: 15722 - RNA, 83 nt, Human
ggauaccuuaggaagcaguacaaaucuucauaaucacucugagggagaguauauuccaggagcuuguagugcuucaagugucc

SEQ ID NO: 15723 - RNA, 61 nt, Human
uaaugaccaucuucaacuuucugcagaagucguggaagguaguagauaccaggaaucauua

SEQ ID NO: 15724 - RNA, 88 nt, Human
aggugaagagggaccguauucuggggcuuaguguggguggggcauauccuccccaaacuuguucuggugggcgauguucuucacaucu

SEQ ID NO: 15725 - RNA, 82 nt, Human
ggagagccuggugguggacauaggccugacaguaguaacaccaggcugacaggucgauguagcugaggaccaacgggugucc

SEQ ID NO: 15726 - RNA, 72 nt, Human
ggguaauuaacuuaaucuccagccccucuccccuccgugaagguuaagggguggggcugaaaguuccaaccc

SEQ ID NO: 15727 - RNA, 60 nt, Human
gugauagaggcuuguuuguuagucagguugguuuuuuugaggcagucuuaacucugucac

SEQ ID NO: 15728 - RNA, 61 nt, Human
ucaggaacugggaugaugagcaaauauauguauuucuuauuauaucacaaucaguguuuga

SEQ ID NO: 15729 - RNA, 92 nt, Human
guuccauuuuaaguuagaaaaauguaucugugugggaguaaaaagauuuccuuuuuaaaaucauuucagauaucaccauacuugaugggaac

SEQ ID NO: 15730 - RNA, 62 nt, Human
cgagugacuagcaaggaaagcagggcucaccaagagauccuugacacuuguuaaggcauuug

SEQ ID NO: 15731 - RNA, 65 nt, Human
cuuccaguuugcaaaagaucuucugugaccaugagugagcccguagaagugaaccaggcugggag

SEQ ID NO: 15732 - RNA, 62 nt, Human
acagauuauuuagugacccagguacuaagccuaguacccaauaguuacuuuucugguccugu

SEQ ID NO: 15733 - RNA, 81 nt, Human
accuguucaucccuuucuucccuaauccccuggcaaccacuuuaaaaaaaaaaauuagguucaggggguacaugugcaggu

SEQ ID NO: 15734 - RNA, 64 nt, Human
gggcuuagacaaauguaugaugauaucuacaauuauagaaucauacagaauaguuucacugccc

SEQ ID NO: 15735 - RNA, 73 nt, Human
caguggaauuuaguagugggcgccuguauaccaacuuuagugacuauaaaccaaaaauaaaauucuaagccug

SEQ ID NO: 15736 - RNA, 124 nt, Human
cucuuuaaaucugauaagaaacauuuacaggccugguggcucaugccuguaauuucagcaccuuggauuacaggcgugacgacugcaccagcccaucuuuuuuuuuuuuuuucuucagacagag

SEQ ID NO: 15737 - RNA, 64 nt, Human
ccaguuguagagcggcguccuuguucaagcaccggauaaugaugccccugauuuugcauucugg

SEQ ID NO: 15738 - RNA, 81 nt, Human
aauaguauuuauuuaauaaaacauauauuauauugaacuauguguuaauucauuuguaucuuuuaaaaaauuaucacuguu

SEQ ID NO: 15739 - RNA, 74 nt, Human
aggauggaacaggaagguauguccugucaguaucuuaacccuuucaacaagacauuuaccuauuugucuuuccu

SEQ ID NO: 15740 - RNA, 86 nt, Human
aacauggauuuuaacguugcaggauuguaaauucauaagauaguuauuaccuuucuuugaaauuguguaauguuuauauucuuguu

SEQ ID NO: 15741 - RNA, 66 nt, Human
auggguguuacuucuuugauaguucuuacuaccuugugggggaacuaccaaaggaaguugucucgu

SEQ ID NO: 15742 - RNA, 81 nt, Human
ccaaauugcaaaguggauauuauauuggcgaccuucacaggggggguccgguguggugggaaccaaacaggcacaauuagg

SEQ ID NO: 15743 - RNA, 64 nt, Human
uacaaaaaagauucaguuagaaucuguaaacuaaaccaguuuauuuuuaugggaucuucaugua

SEQ ID NO: 15744 - RNA, 68 nt, Human
caugaggaaggacaaagauaaacagguuucuaaaacaugacggagguuugagaugaagcuucuucaug

SEQ ID NO: 15745 - RNA, 84 nt, Human
gcuuuuagauucacacaugaacggugacuuaaacagcuuaaaguuuaguuuacaaguuguaggugauuaaaauaauuugaaggc

SEQ ID NO: 15746 - RNA, 77 nt, Human
ugcuuagcguuaaguuuuuaacguaauuuuaauagcuuaagauuuuaagcagaaaacuaugaagacuuagaagagua

SEQ ID NO: 15747 - RNA, 79 nt, Human; identical to SEQ ID NO: 728

SEQ ID NO: 15748 - RNA, 73 nt, Human; identical to SEQ ID NO: 729

SEQ ID NO: 15749 - RNA, 102 nt, Human; identical to SEQ ID NO: 2701

SEQ ID NO: 15750 - RNA, 87 nt, Human; identical to SEQ ID NO: 4680

SEQ ID NO: 15751 - RNA, 64 nt, Human; identical to SEQ ID NO: 11768

SEQ ID NO: 15752 - RNA, 60 nt, Human
uaguuguaauuugauagcaucuggucagugguuaucacugacuaucuucaauaacaauua

SEQ ID NO: 15753 - RNA, 100 nt, Human
cgggccuucgggagcugggaagagcacccugcugaagaggcugcuccaggagcacagcggcaucuuuggcuucagcgugucccauaccacgaggaacccg

SEQ ID NO: 15754 - RNA, 74 nt, Human
ggggcggagaugugcccuguggguuggaccuccugggugaccccguaccagcuccgugggguggucccuguccc

SEQ ID NO: 15755 - RNA, 62 nt, Human
gccucuucagaaugcugcuuuccuagagcaaccauugagcagucauuaucuguugucuuggc

SEQ ID NO: 15756 - RNA, 70 nt, Human
agggaggagcuggaagcagccguggcaucucuugcucgaaguccagggcgacguagcacagcuucuccuu

SEQ ID NO: 15757 - RNA, 76 nt, Human
ggaagagugccucagggcagcggaaccggcucauugcaauggugauggacuggccgucagagcucguaacucuucu

SEQ ID NO: 15758 - RNA, 69 nt, Human; identical to SEQ ID NO: 8816

SEQ ID NO: 15759 - RNA, 88 nt, Human
uggaggggccggacucgucauacuccugcuugcugauccacaucugcuggaagguggacagcgaggccaggauggagccgccgaucca

SEQ ID NO: 15760 - RNA, 61 nt, Human
uucuguggagagaggucuaauauaauauguaguauuuuauguaaggcacuguuauacagaa

SEQ ID NO: 15761 - RNA, 61 nt, Human
cccaggugcaccucauaaaaagguguauuacaccugauaguugugaguaguccaaccuggg

SEQ ID NO: 15762 - RNA, 66 nt, Human; identical to SEQ ID NO: 7949

SEQ ID NO: 15763 - RNA, 72 nt, Human; identical to SEQ ID NO: 1696

SEQ ID NO: 15764 - RNA, 62 nt, Human
gaggguguacgcucacugauuuucagcacacagcgccacuuggcaaagucagcaccauccuu

SEQ ID NO: 15765 - RNA, 83 nt, Human
gauggucacucagggccuuguacacagcagccaaguaccuucucuguaacauacugacaacguuugaggucgugaucuccauc

SEQ ID NO: 15766 - RNA, 71 nt, Human
guauacuugaugggacaggcauugcccggugucaccauguugggcuugagcaggguccccuccagguauac

SEQ ID NO: 15767 - RNA, 78 nt, Human; identical to SEQ ID NO: 99

SEQ ID NO: 15768 - RNA, 80 nt, Human; identical to SEQ ID NO: 100

SEQ ID NO: 15769 - RNA, 72 nt, Human
cccuccagagagaaaggaggccgcucccaaguccguccuugccccguggccuuccuguuccuuugacgaggg

SEQ ID NO: 15770 - RNA, 76 nt, Human
ggcccaccuucuagucguuuccuggugaauggcucugcugaagauggccggaaagcagauuaaugaaggugcugcc

SEQ ID NO: 15771 - RNA, 61 nt, Human
gggggcccuggccucauacccaccuggauugucuuccuccaagugagagaccacagcuucc

SEQ ID NO: 15772 - RNA, 67 nt, Human
acuauugagaccgcaacugcuugcacugaucauuuugguucgugagcaguuggugaguuuagauggu

SEQ ID NO: 15773 - RNA, 63 nt, Human
gagcagagagggagccguucaugucagagacucacugccagaaaagccuuacccauuuugguu

SEQ ID NO: 15774 - RNA, 62 nt, Human
ugagaauguuccccccauuggaaacugacgcuuggcuccuuucuuguggauggauuuucuca

SEQ ID NO: 15775 - RNA, 76 nt, Human
ugugcugcugggaaggaucuuuggccuaggggaugacuuaguuuauucaaagcuuuucuuaagcccuuucaguaca

SEQ ID NO: 15776 - RNA, 71 nt, Human
ccgcaugccaucccaagauuauguccucacuuauaacuaugagggaagaagaucuccagcugguucugugg

SEQ ID NO: 15777 - RNA, 65 nt, Human; identical to SEQ ID NO: 1253

SEQ ID NO: 15778 - RNA, 90 nt, Human
ccccgcagaccccgcagaccccauggacccaggugcagaggcccgacggcaaaaagcacaggguaggugggugugggggcaccagcaggg

SEQ ID NO: 15779 - RNA, 65 nt, Human
cuguggggacaggaugucuggguccccaggcuuugacuguggggacaggugucugggucccccag

SEQ ID NO: 15780 - RNA, 61 nt, Human
auguggaagaggagcagcccgaggaguuuuuuauccccuaugucuggucucuugucuacau

SEQ ID NO: 15781 - RNA, 64 nt, Human
gccaagcagcccuucaaguucuuuuauuucuggguaacagaaguagacagacaggcuacuuggu

SEQ ID NO: 15782 - RNA, 63 nt, Human
aucucuguggagagaucgcucgauuuucgcaucguggagaugaagacuucuuguagcagaggu

SEQ ID NO: 15783 - RNA, 69 nt, Human
uacucuggguguguacauucucacgaccggccugaucccugugcuggagaaagaacacgaccccgagug

SEQ ID NO: 15784 - RNA, 79 nt, Human
gaucauuguccccucaaugagcgagguucgaugaagcaugauucuauugcuggaguugccugcgcuuaaggacgugauc

SEQ ID NO: 15785 - RNA, 63 nt, Human
uggccauuuguaucacucauucugccuacaaaacaaagaaugcacuguggaauuugagggcca

SEQ ID NO: 15786 - RNA, 85 nt, Human
guauguuagacugggauugucuucaucaucaucuuuauccagucauacagcaggggugacagaaaaacauucucaggacucauac

SEQ ID NO: 15787 - RNA, 70 nt, Human
uacaacagagaugaaguucagcugccccggggaccuagugccacaccaguagauuguucacucuguggua

SEQ ID NO: 15788 - RNA, 74 nt, Human
uugaaaacuauugcccauaagccucaggauuuuaagagccuggauauuuuuuuggaaaugguuauuuuauucaa

SEQ ID NO: 15789 - RNA, 71 nt, Human
ucuugcccccaaggaccagcgcuguggcugacacauacgaacguggcccacauaggucucugggcgugaga

SEQ ID NO: 15790 - RNA, 131 nt, Human
auuucagcugauuggacuacaaauucacaagggaaaaaagucaagggcauuugguauuuggagacaggaaaacucaaggaaccaaaaguacugguacuuuaagucucaaaaaaggguuucagucaggaaau

SEQ ID NO: 15791 - RNA, 66 nt, Human
uuuuuuuagggaaagggcaaacccuuuauuauguacauugggggaaagggaggccaccuggaaaaa

SEQ ID NO: 15792 - RNA, 61 nt, Human
ucugagcagcagcugacaaaguuugcagagaaauuccaggaggugaaagaagcugccaaga

SEQ ID NO: 15793 - RNA, 89 nt, Human
cgggcggugcgacagcagcuggagggcagaggaggcggcgcgggguguccuguccucgccaugaggccgcuaguaggcgccgguguccg

SEQ ID NO: 15794 - RNA, 85 nt, Human
cugugauccuuuugauuacguuucugagaaaacaccaaugaagcacuucacuuuguuuauucaaagccauuuaauaaaaccacag

SEQ ID NO: 15795 - RNA, 69 nt, Human
uaugcagaagcgagagaagcucggcggccagucauaucucgaagguuguuuggcuuguuuaacagcaua

SEQ ID NO: 15796 - RNA, 69 nt, Human; identical to SEQ ID NO: 4109

SEQ ID NO: 15797 - RNA, 74 nt, Human; identical to SEQ ID NO: 4110

SEQ ID NO: 15798 - RNA, 62 nt, Human
uccaaguaccacgggguauccuaauagcuuuuuaauuagaugaaagcccagugggaauugga

SEQ ID NO: 15799 - RNA, 88 nt, Human
gagcuggcagguuggaugacacacugggaagcguauggggaaaacucugaacaauuccaaaaugcuucuaagaaccuguuugaagcuc

SEQ ID NO: 15800 - RNA, 63 nt, Human
gaaggaggagaccaaggaggaugcugaggagaagcaauaaaucgucuuauuuaauuuucuuuc

SEQ ID NO: 15801 - RNA, 79 nt, Human
gucagauggagacugagaaagcaagauguuggcuaccagaaauggaguuucaaaaauuuucuuaaaagcucuauuggac

SEQ ID NO: 15802 - RNA, 79 nt, Human
cauguggcuugcucaguguuuaauugcaaguuuucaaucuuggacuuugaaaacaggauuaaacguuaguacucgugug

SEQ ID NO: 15803 - RNA, 107 nt, Human
ugaagaucgacauuuaaaaaaugagggugaagaaaagcuauaguggcauagaaaaguauaaagcucaguuaguuuuuuuauuauuauuauuauuaaaaguuaauuca

SEQ ID NO: 15804 - RNA, 94 nt, Human
gauguguggccacccugaccgcuggcaugugcccagcgacguggccggaagccaugaucugcgucgauugccaauccgguuaauuccacgcauc

SEQ ID NO: 15805 - RNA, 72 nt, Human
gugcccaggaugauauuuuuacacaagcuguaaauauggcaggauugccagcagugaguaucccuguugcac

SEQ ID NO: 15806 - RNA, 86 nt, Human
ucaaaccaaggguugccaauaggacugcaguuuauuggacgugcguuuugugaccagcagcuucuuacaguagccaaaugguuuga

SEQ ID NO: 15807 - RNA, 62 nt, Human
uugaaccuggagguggaguugaaaaacccaaacaugccaugcuugauuccacccgggugaaa

SEQ ID NO: 15808 - RNA, 78 nt, Human; identical to SEQ ID NO: 5302

SEQ ID NO: 15809 - RNA, 62 nt, Human; identical to SEQ ID NO: 484

SEQ ID NO: 15810 - RNA, 68 nt, Human; identical to SEQ ID NO: 485

SEQ ID NO: 15811 - RNA, 69 nt, Human
gauaaucaacacguagcaugcagaaucauuauuuuaaaaggacuaagacaguuguguggugugauuguu

SEQ ID NO: 15812 - RNA, 75 nt, Human
gguuguggggguacagcguagaugccaguguggagacaggaaggaugauaacguguggucccacuaagagcagcc

SEQ ID NO: 15813 - RNA, 60 nt, Human
uuagaaagaacugaguagcguuacacaugaaaaugugaaaucugauuuucuuauuucuaa

SEQ ID NO: 15814 - RNA, 60 nt, Human
acacugagggagcugaggagccggggccgcgcacgcuccuggaugcucagcggaucgugu

SEQ ID NO: 15815 - RNA, 61 nt, Human
caucgucaugaacaucaaaguugaagagugguccaucuucccccgugccuuggugacgaug

SEQ ID NO: 15816 - RNA, 76 nt, Human
guucugggucccauggccagugaauaccccugguccggagaaggaaaaccaucauugcaucauggggcagccaggc

SEQ ID NO: 15817 - RNA, 83 nt, Human
uuuuuuuuuuuuuuuuuuuuuuuuuuuauuuaccacaacaacuuuauuagguagauacuauaugauuuuauggaagaagaaag

SEQ ID NO: 15818 - RNA, 67 nt, Human
guugauauuugaacuacgagagaaggacauuaauagaaauucucagugacugaguaguaaguucaac

SEQ ID NO: 15819 - RNA, 86 nt, Human
gggaagucuggacauuuuaacaauauugauucucccaauccaugaacauggaauaucuuuccauuuuguuguauuuucaguuucuu

SEQ ID NO: 15820 - RNA, 81 nt, Human
ccccccuugaguaucaggccauuaggacccgaggagggacaguauagccuugaguaucaggccauuagaacccgagggggg

SEQ ID NO: 15821 - RNA, 60 nt, Human
acugcgagcauggccgacucggacagacuacgauaacacugaagucauggcaugcccagu

SEQ ID NO: 15822 - RNA, 71 nt, Human
cgggcuguucgccugcgucgcuccgggagcugccgacggacggagcgcccccggcgaagagcgggcgcccg

SEQ ID NO: 15823 - RNA, 77 nt, Human
gaggcggagcacgcacgcagcucaucgacgaccacauuccucuucgacaaagcccguguaccccugcugcuggccuc

SEQ ID NO: 15824 - RNA, 67 nt, Human
cagacccuuccaaguaaguccaacgaaagccaugaccacauggaugauauggaugaugaagaugaug

SEQ ID NO: 15825 - RNA, 97 nt, Human
gaggugauagugugguuuauggacugaggucaaaaucuaagaaguuucgcagaccugacauccaguacccugaugcuacagacgaggacaucaccuc

SEQ ID NO: 15826 - RNA, 68 nt, Human
gcaggaggaggcagagcacagcaucgucgggaccagacucgucucaggccaguugcagccuucucagc

SEQ ID NO: 15827 - RNA, 61 nt, Human
ggaaaggccaugaugagagcaaugagcauuccgaaugugauugauagucagggaccuuccc

SEQ ID NO: 15828 - RNA, 76 nt, Human
uugcuuuugccuccuaggcaucaccugugccauaccaguuaaacaggcugauucuggaaguucugaggaaaagcag

SEQ ID NO: 15829 - RNA, 70 nt, Human; identical to SEQ ID NO: 14198

SEQ ID NO: 15830 - RNA, 80 nt, Human
cuccuuggcagccgggagaggagcaagcgcacgccacugcccgugacccaggcguccggcugcuguccccugccggggag

SEQ ID NO: 15831 - RNA, 60 nt, Human
ugcgggaaccaugcugcaagccuuuaccugaaggacacagcgcagccacaggguucccca

SEQ ID NO: 15832 - RNA, 68 nt, Human; identical to SEQ ID NO: 10509

SEQ ID NO: 15833 - RNA, 65 nt, Human
ggguaauauugucaugcucuuaguucaucuucacaacaaaacuaugaguaagcgguauuaggcuc

SEQ ID NO: 15834 - RNA, 73 nt, Human
gcugggccggucgagcugugcggugcccuccgggacgcagggggcgcugcagccacgcugggucaggcuccgc

SEQ ID NO: 15835 - RNA, 76 nt, Human
aaaggcagauuuaugauuaugggauagacaguagcuugcucucucuauuuuauuuuuuaaaaacuguucuuccuuu

SEQ ID NO: 15836 - RNA, 84 nt, Human
gauugcuggaugugugugugugugugcaugcaugcgugugugugugugugugugugugugugcacgcgugcugucucugugguc

SEQ ID NO: 15837 - RNA, 62 nt, Human
acaguagguacucgcgucuaucuucuuuuacucaccaaguuuuugacacuaauccauguugu

SEQ ID NO: 15838 - RNA, 97 nt, Human
accgccccugccgcuggcugcagauggcugaccugcgggcggagacaccggacaugcuggccgacggcacccggcugcagcuggcaggggucccggu

SEQ ID NO: 15839 - RNA, 70 nt, Human
gcaucgcaguaagccuggcaggccuguaacugugaccaguaccuaaaggucuccagggacaugaugaagc

SEQ ID NO: 15840 - RNA, 64 nt, Human
gcucauguggcucagcagucaccaggaggggcccaggagcucaggugacgaggccacccagagc

SEQ ID NO: 15841 - RNA, 74 nt, Human
caggguugcugggucagacugugcaagaccccccuuggccacuuguaaaguucggaucucaguuccagccacug

SEQ ID NO: 15842 - RNA, 82 nt, Human
uuagaggaucccugggaggcaggacacuggaggaugacaaagagucuuagggaaaaugcacugaguuugagggauaaacuag

SEQ ID NO: 15843 - RNA, 73 nt, Human
cuggggcgggggcggagagaggccagcaugggaccuucacuuggcaagccuccacucucugcccagcacccag

SEQ ID NO: 15844 - RNA, 81 nt, Human
gcgcucagccaggcacuggcagaugccgcccgccaccagagguaccacgcggcacaccugggccacugccacagcuagcgc

SEQ ID NO: 15845 - RNA, 76 nt, Human
cagcuuuuauugaaaauaguuacugcagccaacguuggaaaaguuuacugcagcuuuugacuucuucaaagagcug

SEQ ID NO: 15846 - RNA, 110 nt, Human
uucaaaauguucacuuuuaacacaaagucuucccauaaaaaauguggcuacauuuuccccccaaugacuacauacauagauggguagcagcaagaaaagaugaaaaugaa

SEQ ID NO: 15847 - RNA, 103 nt, Human
caaaagguauugaaauuuaaaaaguuacaguuuuauauguuuaaaaaagccucuuaauucauauaguuauuguaagcagagaaauuuucauuuuuacuuuuug

SEQ ID NO: 15848 - RNA, 62 nt, Human
uuuuauucauuguuucagcuggccaaaaaaaaugagguaugaugaaauuauaauuaauaaaa

SEQ ID NO: 15849 - RNA, 60 nt, Human
aagaaaaggaaaucugguucacagcaucugaauuacuucuggacucucuuucugguucuu

SEQ ID NO: 15850 - RNA, 86 nt, Human; identical to SEQ ID NO: 8822

SEQ ID NO: 15851 - RNA, 76 nt, Human; identical to SEQ ID NO: 8823

SEQ ID NO: 15852 - RNA, 60 nt, Human
uuuuuuuuuuuuuugcugggugguaacucuuuauuucauuguccggaagaaagaugggag

SEQ ID NO: 15853 - RNA, 69 nt, Human
acaugugcauuggugauuuugaucauucauucuuaauauuugauuucugugucaccuacugucauuugu

SEQ ID NO: 15854 - RNA, 93 nt, Human
gccuaaauacauuuuugcuuacuagcuauuuaaaauaaauucuuaaucagaggaggccuuuggguuuuauuggucaaaucuuuguaagcuggc

SEQ ID NO: 15855 - RNA, 74 nt, Human; identical to SEQ ID NO: 365

SEQ ID NO: 15856 - RNA, 81 nt, Human
ccagugccaggcagaggugggaugcaggggguuccugaaagggggugccugggaggcuugcccaugggaugcuuggacugg

SEQ ID NO: 15857 - RNA, 95 nt, Human
cuguccggacccucgucuugcuccccagaacuugcugcagugacagguacaggaagaagauggggcagggcuggaguuugagggaccaagggcag

SEQ ID NO: 15858 - RNA, 63 nt, Human
cugaguuuagaaaauccauauaauguuuaguaaaacuaguauuucauaaaugcugaaugacag

SEQ ID NO: 15859 - RNA, 62 nt, Human
uacagcugauagccuguuuuuguaaauaaaguuuuacuggauggcagaguugaauaguugua

SEQ ID NO: 15860 - RNA, 79 nt, Human
agccuuccauuggaagaaggugccgucuaggacuuucauaacuagagagaagacaacaucugcuuugaaaggacaugcu

SEQ ID NO: 15861 - RNA, 62 nt, Human
gaugugcccuggccugugaauuucaacucuccuugacuuaaguucucuugaagggcaacauu

SEQ ID NO: 15862 - RNA, 70 nt, Human
guguugaucgaccacgcggaugaauuuucugcaaauuauggguccgaaagucaccgugggacgggaacac

SEQ ID NO: 15863 - RNA, 61 nt, Human
uagcauugggugccaauuucgugguguggaauggugacaacaugcguggagccaagugcua

SEQ ID NO: 15864 - RNA, 66 nt, Human
aguguuguuuuuuauuuucuuucuugggccagcugcagcuuccaaccaagaaaaccucaaagcauu

SEQ ID NO: 15865 - RNA, 73 nt, Human
caggaagacgggcacuggggggcuggguggggcuuagcgcagguccuccucaucgcccuggauggucuucuug

SEQ ID NO: 15866 - RNA, 72 nt, Human
gucuuuggcgcuguacuugaggagggggcuguccauggcauugguccccaccuguucguagaugucaauggc

SEQ ID NO: 15867 - RNA, 85 nt, Human
gaagcaagauuuacuagggacaucuggauagcccaggacaaugacuucugggaacaggaagcucccuagggccagaucgugcugc

SEQ ID NO: 15868 - RNA, 76 nt, Human
gggagaugacauuaucgugcugggaugguggguaacuccuucaaaccaauccaugucacagaacacugucuauucc

SEQ ID NO: 15869 - RNA, 65 nt, Human
ugacuguacaaaccaguuuuauuagggaacugccccaggugcaccucugguucaugcucuuguca

SEQ ID NO: 15870 - RNA, 61 nt, Human
aaaaaguauucuagcacaagauuuuucuguaaaccuagaauuauguuugcuaaaccuuuuu

SEQ ID NO: 15871 - RNA, 62 nt, Human
uaggagugucgguuguuaagaacuagagcuuauuccuauuccaaaucuaucuugcgcuccug

SEQ ID NO: 15872 - RNA, 67 nt, Human
ucauugguuccuuuaagggcauccauuucacaggugagggacugcaccugucuccgguacucagugg

SEQ ID NO: 15873 - RNA, 65 nt, Human
uugcagugagggcacuaguuagaaugcguacgagaacacuuauccuuucugucucuacgcugcaa

SEQ ID NO: 15874 - RNA, 68 nt, Human
caggaccugguugcuacugguucggcaacugcagaaaauguccucccuuguggcuuccucagcuccug

SEQ ID NO: 15875 - RNA, 74 nt, Human
ggagagcacggucugaaucugcacagagcaagaugcugaguggagucgggggcuuugugcugggccugcucuuc

SEQ ID NO: 15876 - RNA, 88 nt, Human; identical to SEQ ID NO: 4936

SEQ ID NO: 15877 - RNA, 87 nt, Human
ggaauugaaaaguaaaaacaaagugugcauuuuccuuacuacguuuagucaggaauaugcggucauuuuauugguuacuggguuucc

SEQ ID NO: 15878 - RNA, 89 nt, Human
uccccuuucugccaacccaaaggauccaaauuaaaguaguccgagaaaagacacagcauuuggucugacuugugccuaggaaaggagga

SEQ ID NO: 15879 - RNA, 72 nt, Human
ugguuacuggguuuccucauacaaacagauauaauaucacuuuuaagagaaauguacacaaggaaguaacca

SEQ ID NO: 15880 - RNA, 62 nt, Human
acucaauuauagugucauguauccucucaaccguauugugauuaugacgcuuuacuguuagu

SEQ ID NO: 15881 - RNA, 69 nt, Human
cccggggaaauaaggcccucgaaugcaaggggaauggaaagaucccauaggacgggcccacacugcggg

SEQ ID NO: 15882 - RNA, 71 nt, Human
gcggagcaauugcuagaccgaggcauucacccaaucagaauagccgauggcuaugagcaggcugcucgcgu

(The sequence listing continues in the following parts.)

What is claimed is:

1. An isolated nucleic acid wherein the sequence of the nucleic acid consists of the sequence of SEQ ID NO: 12003.

2. A vector comprising, a human insert wherein an insert consists of the nucleic acid of claim 1.

3. An isolated first nucleic acid that is the complement of the nucleic acid according to claim 1.

4. A vector comprising an insert, wherein an insert is the nucleic acid of claim 3.

* * * * *